United States Patent 9,328,346 (POLYCOMB-ASSOCIATED NON-CODING RNAS) - sequence listing, part 15

SEQ ID NO: 2352 - RNA, 123464 nt, Mus musculus
ggcgucccgggaggcggagcgcggugcgggcggcgcgagcggcgcgaggguggaggcagcgcgccgccggcggcggggcuguagcucuuugggcuccagcggcggcacuagccuucgcgacucugcgcgucuccuagccgcuucccagcggcgcggcgccggcggcuacgguaggcgccacagcuccaugcucggcgggccauguggaggucgccgcacucugacaggaucccagggcugugcggaccgggcggcggagcggcgggcgggaugggggcgcgggcuucguggucgccguggcgcccccugccacgggcaccugcgggccccgcucggccgcggcccccucccuucgccggggcgcggcggcugcgggccggagcucggcgcggugugggcgcgcgcgccccugcgcuccucuggcuuggggucgcgcgguccccagagggcgugugggggcggcggguggccgggccggggcccacgcgagguccucuagcggcccgaggcgcgcgcgggcucgcggagcggucgcccugcgugcaggcacugcccgcgcggaagggcagcugcugcucccgcagcuccggcgcacgggaguugcggcuccuacagcgaccgcggaggggcggcuacccgagucucgcgcgugggccuuggcagggcauuucaggucugcaaacaaugcagugguccauaggcaugcuucaccuuguuuccgccucguguugacagccagcguucuaguauuguucugguauugugcuuucuaacucaucacugccuuguuaaacuucaggaaucauuuuguuaaccauuuuauuuuuguccggagaacaccuggggacuguauuaacaugugcuacugggaaaguacaauguggagcaauuaaucuuccuuguggguuuuacauacuuggguguauguaaauuagguaugcaauuuacaauuguuuugucagugguagacguugcuuacuuugauguuacuuuacguguaauacuuuaguaauuuuuuauugcuuucaucaaacauuuuuaagcguuucuugccuuuuuucuuuuuccgagucuuugauuuuaagugauuaugaauuugcuagguacuuuuguaaaucguuuuuccuaacacuggacuuccacgugcacuuuagcucaaguccuaacuuagguuugguguacaggcuauagauuaaaagggaaagaaacggguguuucugugaguuuuaugauucagacucuagaccccagaggaaagaaaucaggagguccggguagacugagccaugucuggaaccagaaaacaaggugguuccaggaaauuucuuaaguuuuucccucuuuggaaguagucugccuccugcacagggaagcaguugaaugcauuagauaguaucagaacuaucuaauguuggguggcgaggauucugaguuuuaguauauuguaguagaucauaaaaauguauuuauuucaagugcaucuaacugugugggcagucuugcauagccaagcuugcaagaguuaaauauuuuaaaggucaaauuggcacuggagaguugaugcuaaaaauaaagaugaccugaacaguuuuuaaguggaaaccuuuuuggcuuguucaguuuauguauaauuguagggaauauguaaugcauauaucgucacuaagagaauuuauguuaguauguugaaaaaaaugaagaucauaaauuaguuggauuauuuauauauuauauuaugucacauaauccaaugaguaauuacuauucucuauuauuacaacuaagauuuaguuaacuaaugguucgagauuuuaaugguaauaaguugauagauucacuuguaaccaauuuaauuacaaggacuacauuucaaguaugcuuuuggacuacaguuaaaugggaguagacuugguagaaagagacuaauagacaacaguguugcggggugauaagcugaguccaagcucuuucucuugaaacacuuucagaucacuguguaaacgcaauuuugaguguuguuaaagauguagggacgaagucaaucacugucacucuucuuaggagucagcggguuuguuuuuuuuuuuuuuuuuuuuuuuuuugguuuucgagacaggguuucucuguguagcccugguuguccuggcacucacuuuguagaccuggcuggccucgaacucagaaauaugucugccucugccucccaagugcugggauuaagggcaugcgccaccaccgcccaggacugccaggcaggagucagcgguuuaagaggagcgauacuuaaacaaaggauagcaccuuacuguguugugacuguguggaaucuggcugacuuuauggagaguuuaaaggauagguacuugggucacgugugguagcaugugccuuuaauucuaucuagguuuugagagccagagacagggagaugucuggauucuaggacagccaaguguacauaaugagaccuguuuuaaagcaauaacgacaaaaaccaaaccaaagggguuggggagauggcucauugguuaagagcacuggcugcucuuccaaaggaccaagguucaaauacacaugcgggcaaaacaucagugcgcauaaaaguaacacuggcugcucuuccagaagaccuggguucaguucccagcacucacauggcugcucauaacuguaacuccaguuccaggagauccaacauccuccucacccagacauacaugcaggcaaaccaucaauguaaacuuaaaacagaaagaaagagagagagagagaaagaaagagagagaaagaaagagagagagagagagagagaaagaaagaaaaccaaaccaaaacaagauagucacuagaguuugaauaccuguugaucuuuuuuacugugagcaugauaccacaucaguuuccuuauuuguugaacagagaggauaguacuuguaagugaauauuaaguacuaaauaaaaugauaagcacugaacaaagaaggaagaacauguaucuuuuauuuuuuaagagaaugguugggagguccagggaggagguuucuuuuuuuuauuauuauuagauauuuucuuuauuuacauuucaaauguuaccccuuuccugguuuccccucugaaaauacccuccuccuacccccuucacuuccccccgcucaccaacccacccacucuggcuuccuggcccuggcauuccccuccacuggggcauagagccuucacaggaccaggggccucugggaggagcuuucuugagcauuggagacuuaaguaguuuccauaaauagagaaggaaggaagauacuccauacaggagaagacagucucacaccaugagucuagcuugagagaaugggaauuguagcauuauauauaaguccuuguauaucaacaauaaaugcugauuugcauagauugugucucggcagagugaguauauccgauuuugaaaaucagaaauugccaaauaaucauuuuaguuauuuuuuuuuuuuuuuuguuacugugacaaaacaccacgaccaaaagcaacuuauaaaacguauuuaauuuggggcuuaugguucuauaggugaagagucugugaccaucauggucuggggaggcuggcaucaggcagcuggaggguccugaaauaguagcugagaacuuacaaguugauccacgagcauuaaagcagaaagaaagagaaaaacuggaaauaaaugggcuuuuacccccaagugacguaacuccuacaacaaggccaucucuccuaacucuuucuucucuaacaguugcuaacuggagggccuaaaauaagugagcccgugggggccguucucacuuaaacuaugacauacacuuagagaagcagucugucuguuauauuuuuaccuaauaguuacccuucacuuauuuuccaagugccuauucaguacauuuuuaaacaugucugauuagucaccauuucauugagcuuuuucuuucuaagcuguauaugaagacaacaaaacacuggcagaagccuuugcacucuauuuugccuccuuuauauaggaaucuuuuuuguuuguuuguuuuuuguuuuuguuuuuuguuuuuuuucgagacagggucucucuguauagcccuggcuguccuagaacucacuuuguagaccaggcuggccuggaacucagaaauccgccugccucugccucccgagugcugggauuauaaaggccugcgccaccacgcccggcuauauaggaaucuuaaaguggcuuuuguuguuccuaaucucugccuagucuagaaacuccuauaucagccgauuuccucccucccucccucccuucuuucuuucuguuccuuuuugagacagggucucauuauguagcguuagauggccuggaacuccauauagaccagauuggccuugagcucagauucuacuuacucugucugggacuaaagggaugugccaugugccagcacagccgcuuacuaucuuaaaaccagcgugggauagguugguggggcagaauguuuucaauugggacugcacuugaaacugagagaaaggguccauguuuauauuuaucuuguuagcauggaacucuacagacacuggguauauaaaacugaaccauccucacuugaucaccagaaauaucugaguaagaugcacauacaggugacauuuaggacagccguauuuucaguucagguuguuaguguuaugcaaguagcuggaaaaaaaauccauagguuugcaaagaaaaugcugacugcuuccuaaagcagguauuuucuuccucggcaagaaagaaaauaugcuggauuuaauucugaauagugaacuugaacuggggcaggaaauggcuguggcugaagaacucccugauaauaaucauagcuagauuaaauuugacauuuagugagaggaaguaaagaaaagaaugcaguuuucuggauguagaagcaguagaagaacuauugggaguuuaucugcagaaauuuugaagacuaauaguaggcacugauaacauuuaauaaaaaaccucaaaugagcugauaauaaaacaauaaaagauagcaaaacuguaugaaagauauuugaaaguuaugugcacaaguuacagucuuccacagauugaggauuaggucugaauucugucauugaccaauucagcaacucuggguucauuuaguaacuuuuuuugaaguuugguuuuauucuugaaaugcagaugucuaucuuguugcacuuugauguuaaaauacuuaagugagcucuuagacaccuugacauaguauuugacucauuagacuuucucaaaagcugacuguugugauucuuugucugcauugaacuuuagaaagcagucugguggcaguggcacacuccuucaaucccaguacuugggaggcagaggcuggcauauauuucugaguuuggggucagccugguuuauguagugaguucuaggacagccagggcuacgucaugaggugacccugacucaaaacaaaucaaaacaaaaauaaucaacagaccuaauagaaaacuccagaacaagguaacagaacuagaaaauagcaaaaauaacucaggaagaagcaauacucugcuagucauuuauaggcaguguuuaguaaaaaauuacuagaaccacauauauauguaaugaguuuaauauucuuaaugucaagaacauaaacuuaaugaaacugggucucagcgaugugauuaaagcauauagauaaaggaacuuauuuuuccuuaagucuucaucuuauuucugaaauauuuuuccauauacaugcauuugugugugugugugggggugugcacaggaacauguuuguguauaaaccuaggacagaaguuagcauugaguaucuuccucaguuaagcccuauccucacuggacucggagcucacugauggggcuagccugcuggccagcaagcccaggauucuccugucuaccacccaggugaugugcagggauuacauguggaccgacgaccaccuggcuuaauuggguuuggguaacaggucugagaaucucaugcuugcagggaagcugggaauugagccaucuccuagacuuuuauuucuaaaaucuuuaaugagauuaauuacuuaauuuucaaaaugcuuuuuaacuucauuauuauaucugcauaugaugcaugagcgugaguguguaugcaggucagagggcaguugguucucuucuacuuuuccauggguuucagggcucagucuaagaaagucaggccuguguggcaagugcuuaacccacugaguuaucaucuacuggguccuugucuuaguuacuguucugcugugacaaaggaccaugaccaaggcaacuuagggaagaguguuuugggggcuuacaauuucagagagcuaguacaugaugucugucauggcagggaacaaggguggcaggcacgcguggcacuggagcaguagcugagagcuuaugucucaucuacacgcucgaggcaacgggaggaggggaaagcuaccugggaguggugugagccuuugaaaccuccgacuggaggaccaagcauuuuaauguaugagccuaugggaggcauucucaggcaaaccaccacauucuacucccuggcuucuauauacuuguagccgcaucguaaugcaaaaugcauuuaguccaucuucagaaguccccauagucaaggcaacuuuuagaagaguguacuggggccuucaguuucaagaguuagguuaguucaugauugucguggugggaagcaugguagccggcgggaauggugcuaacgcugggccugagcacuuauaucucauccucaaauacaaggcagagagaguuaacuaggaauggcauggacuuuugaaagcucaaaaaaccauucccagugacaucucuggcaagguucuuguacugguugguucugugugucaacuugacacaagcuggaguugugucauagagaaaggagcuucaguugaggaaaugccuccacgagauccagcuguaaggcauuuucucaauuagugaccaagggugggagggccccuugugggugggaccaucucugggcugcuaguccuggguucuauaagagagcaggcugagcaaggcaggggaagcaagccaguaagggacaucccuccauggcuucuacaucagcuccugcuuccugaccugcuugaguuccaguccugguuuccuuucaugaugaauagcaauguggaaguguaagccgaauaaacccuuuccuccccaacuugcuucuuuuuuuuuuuaauuugauauuuucuuuauauacauuucaaaugcuaucccaaaaguucccuguacccuccccccgcccuccuccccuccccacccacuuccacuucuuggcccugguauuccccuguacugaggcauauaaaguuugcaagaccaaggggccucucuucccagugauggcuaauuaggccaucuucugcuacauaugcagcuagagacacgagcucuggggguacugguuaguucauauuguuguuccaccuauauguucagcuccuugggugcuuucgcuagcuccuccauuggaggccuguguuccauccaguagaugacugugagcauccacaucuguauuugccaggcacuggcauagccucacgugagucagcuauaucaggguccuuucagcaaaaucuugcuggcauauguaauagugucuggguuugguggcugauuaugggauggaucccugggugggguaguuucuggaugguccauccuuucaucuuagcuccaaaccuugucucuguaacuccuuccauagguauuuuguucccuauucuaaggaggaaugaaguauccacacguugaucuuccuucuucuugauuuucuuguguuuugcuaauuguaucuuggguauucuaaguuucugggcuaauacccacuuaucagugagugcauaucauauguguucuuuugugauuggguuaucucacucaggauuauauccucuagauccauccauuugccuaagaauuucauaaauucauuguuuuuaauaauugaguaguacuccauuguguaccacauuuucuguauccauuccucuguugaggggcaucuggguucuuuccagcuucuggcuauuauaaauaaggcugcuaugacuugcuucuugguccugauguuugucaggaauagaaacccugacugaaacauggugcuuuaaaauguuacuuuuagucggguguggugguguacuucuguaaucacagcacuggggaggcagaggcagcugaaucucugaguuccaggccagccaggccagccagggcuacauagagaaacaagauuacuuuuaaaacauuuguauguguauaucuuguauagagagcauauuuucacuccuuuucuugucucugcccucccuucuccugcuagugcccuuugacucccuaggcauuucuguuuuuuaugguguguguguaugaaaucuagaacucagaaauaagagaaaacauauuuguuugucugagauuggcuuaauucauuagcgugauuauguccaguugcauccugcaaaggacagaacuuuguuauggcugaaaaaagguccauggugugcaugugucauguuuuccuaucuauccuguuggacacccagauggucccauacuuuagcuauugggaguaguacuacaguaaacaccgaugugcaaggaucugugugauuuauuggcuuggaguccuauggguauauauauacccaggagucauagagcugacucauagaagaucugcugcuguguuuuuaugaaaccucuccacagaccuccacaguggcugugugccagcuuacaugcccacugucauucaagguucccauuugucugcagccuuaccugcaguuguuacuugucuucuuaacugaggugaugacuggaacaagggagacucucacugugguuuuacuuugcauuugcaauuuugauuugauggcuagugaaaugagagauuuuuucauacauuuauuggccauuuacuuuuuuaugaacugcucauuucauuagcuccucuaaauacuacuuugauuauuucacuuuuugauuauacagaucuugguauaucuuuuuuuauugaaaaaguuaauauucauuuaucuuuguguauauuugugcuugcauguguauguaugugugcugcccucaaggacacaugggcacuguguacgugcuguggcuuauguguggaugucagaggacagcuuggaggguuuuguuuuucccuuucccugaguuccggggauuaaaugcaggcugucagguuuguuggaaagcacuuucaccuggugaguuaucuugcuggucccauuuuaaacuuaagaagacuuauuuuauuaacccuugauauggucuguccaucugucugcuuauuauggguuaauuuuguuuuugagauggucugauuuuguagcucuguccacacugaaacuugugguaacccuucugacugucaucccaagggccaaaaguaccuaugugugccaccacacugugugccaccacacuggcagagcucugucuuaaaugauucacgugcucuugaaaagaaucccgggaauucuaaugaaguuaaauugauugauagcauuaacucuuuaauauucuuugauuuuuuuuuccccucucucuacuuguuuucuuuaucuguggacugauugauuuccuagcacuucuuucaguuuuuccuaaauacauuuugaaauucuuguacugcauguauucauacuuuggaucguaugaucucucagugaauuagaguccuuuacucuauauuauauaauugcaccucuuauuucuggugauauacuuuggacugaaaccuacuuuacauggccuuugagcuucuuuugauuacuguuagcauaguauauuguuuuaauuuuuaugauuuacuuauuaauuugugcauauauguauagauagauguauguguuguguguaugcuuacgugcauguggaugccagaggucauugucagcuguuuuucucaauaacuuuuucacccuguucuuugaggcagugucucuuuugagcccaccaguugguuaaauuggcuggccagcacacaccaggcccagagacuuaaaugucuaaaugagcuccaggugauaacauuuaacuuuggcuugcauuucagaauccacuuuaucauuucuccuaauuaauuuguuccauuuacauuuaaugugauaguuuaagucuaccaacuuguuuauugagacagggucucacuguguaguacugccugaccuggaacucacagaggucacucugccuuugcuucuuaaacucugcuacuaagucugacaucuugcuguuuguuuuauuuguucuuuuuugccuuguagaucagcuauugucauugucauuguuuguuuguauuggauaguguguaacuuauguuuaaguaaacaauguuuuauauugagaaauaccacauucugguucucuuuuaaacuugguaugcucacugggcuguggugucacaccccuaccuuugaucccagcacucgaggcagagagaacuccuaugaguucaaggccagcacggucuacagacugggcuccaugacagccagggcuacaaagagaaacuuucuugaaaaacaaaacaaaguauuuuuguagcuuuuuuuuuuuucuuucaauuuuguuaaauauauagaacauuuagggggaaaggguucuuaaauuuauucacuauuuucagagcucuuacguuuuuuucaguagucauaguuuuguauuugaugucauuuucauuuugcuugaaggccuuacagucauaguugccauagugccaaguuucugcugcugaauucuguuagcuucuuaugucugacaaccuuuugguuuggauggagggagugaagcuuuggcuuuugaccaugccacaagugcuguuacugauggggagccacuccuauugaacugcacccuuccccagugccgggaaguacuacuucugugcuuuuuccuacauaguuuauaaucuaaggaccugcguuuaacucuucaauuaauuuugaaguaauuuuaguauauaauguaaaacaaugguauacagaucccuauauuucagacuaguaugugugauggaagaguuuguccuucugccauugagugaucuuacuuucuuuguuaaagauuauuagaccaugcucuugaagucuuaauucuguuucauuugucguuuuaccuuuuugucaguaccaaacuguuuucauuauagcuuugcaauuuauuuuauaaucaggaaguuugaaucuuacagaucaaacuguuuuuuucaggcccuguaaaauucaauauaaauuuuacuguaaaaauuucuguaucugcaaaacaugccauuggaauuuuaauagguguuacauuguaucuguagauuauuuuggauauuguguacauaauggcaucaagucuuucaaucaaggaacauaaaauguuuuuuuuuuuuuucaaauuucugauuucuuccagcaauguuuuguauagcuauuuuguacuaaauuaauuuguaucaaaacuauacauuuugugguacacaccuuuaaucccagcacucaggaggcagaggcaggcggauuucugaguucgaggccagccuggucuacaaagugaguuuuugaaacccugucuggaaaaacaaaacaaaacaaaacaagaaccccaaaccaaaccaaaaaacuauacauuuuaauaaucuuguuuacaaaucuugucaucuuccuuacuuuuguuuuuuuuuuuccucauugcuacagcuuguaaauuuugucugaaugcuagacaguugaguacuuuauguuguuuccaucuguauuuucuuuguaucauuuuaaauauuauuaagcauucuuuucucuucuuuucuuuucuuuucuuuucuuuucguucguucguucguucguuuugauuuugugagacaggguugcucuguguagugaauuccugacuguacauaugggaauaguaguugcagaaccuugaagauguuggcuccccuaggacaggauuuaaagauaguuuuaaguugcuaugaaugcugcuccucuagaagagccuccaguucucuuaacugcugauucauggcuucagccccauagcauguaauuuauguauagaguuuugaaguaagaaguuacauggaaaaaaccaaagugucauuauuaguguuguuauaauaaaucucagaggacauuagccagaguauagcagauaccaggcugacugagugugguacuguucaucuccaccaguuaauucucucugccucccucucuuuuucccucccuuucuuucucccuccuuuccucccuuccuuucucccucccuccuucccucccuuccucucucccuccuuacuuuccucucucccacccuccccccucuccucuucuuccuccucuucuuccaagauuuauuuacuuuuauuuuauguauaugaguguuuugcuuacguguauguguguggaccacaucugugccuggugcucuugguuacuagaugagugucagaucucccugggaguggaguuacacaugguugugagcugccauuugggugcugagaauugaacccagguccucugcaagaacagccaaugcuuucaauugcugagucauuucuccagcccuguaaaaggaguaguuuaaaaguauauuacagcuuacuaguguuguuuguuuguuuuugagacuaaauuauucaaauuauacccagauuaaucaaauauauuacuucuacauuuuuaggauuauuuauuuauuuauuuauuuauuuuuauuuuuuauuuuuuacaggguuucuuguguagcccuggcuguccugaaacucacucugcagaccaggguggccucgaacucagaaauccgccugccucuuuagaauucuauuggcauggaauccuccccuuuagucucugucccuugagguuaagugagguccuugaagcagcagacaguuacucuauguauauaugcauggagaauuuaauccauuuuccaacagauaguuaaauagguaaggccuucccuguugcuuagagaccacaccaguaaccuuugcuaguuuuguuguaucaccuucuuugcuuuucuugcuguuuuccuuuaugguuauaggauuuagucugcucuagauugcuugcuuauuuguuuuguuuuuacacuguagauuuuucuuuugugguagcugaggcuaauagaaacaauauuugauuguaaccagcuauuuugaaaugauagcacuuuuaguauggucauaaauaauagaagaaauugauugaagaaggagaaaaauacuaauaugaaaaccauuuuuauuucuuuuuauuuuacaguuuuugauauccuguuuuugcaucuuucuauauuucuuaacuuuagcauguuagugcaguuguggucuugauucuuguacugugcaguuugucuugcuuguaagucuuacauccaagaucuuaccagacaugauauguauaagaugaucaaagucuguaaacuaacauuuuaaauauuuuuuuaauguacaaauguucauauuucacuaguuaccauaguguguguuuuagagcaaaagaaggaucaggaucacguuguauuuaauugucaugucucugcuuucccuuaaacaacaggauguuccugagccuauauuuguauuucaugauugacauuuuuaaagcauugaggccaguuauuuuguagaauauuuuucuacauuaguuugucccuccuagcuucccacccuuuccuuccacuccuagucuucacaacuacuaaguaucuuuuuuuagaauuguuuugagauuguaucauuauuuuauuacucuugaacauacuuauuuguuuuaauagugguuauucuuuacuauuuuaaaauaguugacaaaugguauuuuuuccaguucucugacuuauguuuaucaaaguuuaguaguggcuuuaguuuuaaauuacauucacucauauaucucauaugcuaggagugguguacauguggcggucaggacagcccaugagcguggauccuuuccuuuacuaaagucugugucccaggggucagccugcaguucucaggcuugguggcaagcaucuuuuaaccacggaucuaacuugccuggaucuaauuucucguaauaaaguaaaauuucucuuugauacucaaucauucauucauucaguauuaguauagacucauugguggcuaauuuaccaauguucuugugagucuuugagcauuuucuuauuuucugagucagcaagauaguuuaggaucauuuaaaacugacuguccuguugggaucaaguauuucucuaaggaaugugaaauggauuuagacauuuucauguuagacaucuuauugcuacuaaggaauuaauugcuucuaggugcacacaguggacauagucaaacguauauguagagggguauguauaguguacauuuacuuuucagaaagggauauugaguugacuggugucauggcuauuaaaaauaaagacagggcagaggugcacacacccagaggcaggaagauucugaguucaagaccagccuggacuauagaaugaguuccaggacagccagggcuacacagagaaacauugucucaaaaaacaaacagaaaacaaagagaggagaaggcggggcauauagucuuggcuacauagccucaucauuguucuuaaaagaaacuguaaagcugagugugguuauuuacaauaccagcuauuugggagaccugcuauggugcauuucagguuugagguuuaugggauccuguuacaggaaaaugaggaggggagcuggaguucaguucacugagcccugggcucauuuaucaguucugaaaagaaagaacuaacuccacuguuccugagaugaguagacauucuuuauuuuucuuuuuuuuuuuccucucacucugccccauucgcuccaacccaaagauuuauuuauuauauguaaguacacuguggcugucaucagacacaccagaacagggcaucagaucucauuauggaugguggugagccaccaugugguugcugggguuugaacucaggaccuccggaagagcagucagugcucuuaaccacugagccaucccuccagccccuaguagacauucuugacacaaaaagauuguuuuauugguuaacucaauucuaggaaagagauuuuauuuguagaggaagggaaccugaaugggaaagacuugggcugucaacacacucgagagauagauacauucugacuuugaguugucuguagagucagagagauacucauuaacauugaauuggaaaguaaacaacuuaacaauuuucaccuagucuucuuaaagauggcacucaccacuugacugugcauccuagugggaucauccagucagcugaccuguuuuauugauaugggauacauugggccagcacuuuccuuucugcuugugaugcucugcuguccucagaucucuguauucagucacuagucaugcaucuuucacaguucauuuuggugaucuucucugccuuguauguuuaugauuuugcuuugauuuuagcuacguuuuuuaagggaguaaagccagaugcucauguuuaguuggcauuuuuuuccuccugaaaguuugaaauauuuaaucuuauaaauaauuuuauuuauaguggcuggugagauggcucaguggguaagaguguuugcuguguaggaacaagcaccugaguccagaugccaguagcuacauuucaaaagcagguugugucugcugugcucuagccuacccagcgugugcggagacuugcaggaggaucuuugggguuuacugucuucuccuuagcuccagguucagugagaggacacccuuucuccaggaauaacauucucaggcggagaaugacagcaggaggacagccugugcucucuggccucuucaugcacaggcaugcacacccacauacaugugcucacacacaacguacaaauaccaugccaacacauacacacaaauuacucuuguaguaauacaauuauuggaacauuauugaucauauuuucagagguuaaugaaugaucugggccaagaugaaucugaaaggaaugugucaaauagaugaggaggaaaaagcuguuagguagaugaacuauuaggguuagaaggcaagcaugguaguguauguuauauguguguagaauaugcaugugaguuggcagaugaggagguaggugguugugcugaguuuacaauagaucuaugggcaguuuguagaagaaagaccuuauguuucuagcggaggaaacuuuucuucuucuuucaggcacucagaaucccuagagguuuuaaagugaugaagucaggauuuuuguuuuggguuuuuuuguuuuguuuuguuuuguuuuuuaauacugaaaaggaagaaauaagaaauuaaucugaguaguccuggaauuagagaaugugggcaugugccaggaggacaugugguagcuggauguguggugaguugguaguguacuguaugcuuucauauuugcugacugguuccuaugugucacacagaacuggcagaagcagcaagaauaaacaguaaugaggaggguuuugaaguguuauacaauauuuuuacacaagcgcuuaauguacagcccuguaguugcuguuuagugucuugaauuuauagcaagaauggaaacccugugucuuuuacuuacuuccuucugguagaaacagcggaagucaaagcacagcugcugcuaauuuauaauucugucuuagaauguuuauacugucuuuaguugugccaguagcauaaaauauuuauugaaaaaaaaaagaugucaagaaguaaauacagauggguugaagagguaccacuuagcccuaggaagagcuguagccucauacaaacugggugugguggugcaucuccuuaaugccagcaucggaggaggccaaucagaaguucaaggucaucgucaucuucauaguaaacugagaacagccuguaaccugaacuguuucaaaaauaaaggugaaaaaccuuaacaauaaaaugaagggauuucuaaauaaaugcuaaagaagaucacagaauuuucuuaccguaaaaccaaagggggaaaugcauguuggaagauggugagggguugagaaagacuagggcuggauggagagagacagugaucuacagugaugcuaaacacuucaaaaguaaugagcaagaaaagugagccauguggauaggcuccaguuaguucuagucccaugacacuaaggaaauguaaaucaaaaagaaacuguaaguauucucagaggaagcaggcagcagaacagucaagggaaguuccuguguugcuccugcauagaaaaacuguaccucagugggcucgagccacagaaucuuagaaccucaccuuuuacuucagcacaguugggcaagcaauucacucccuaaguacuucccuuccuuccuguuaauuuugacuaucucuggaacacagcuucuuugugcucucagaaaauacuucccagaagauuucaccucaguguugccggucucuucuuaauaacugcuaauuucuuagcuccagcuaaccagcaucgauugucccaguagucuccuucucuugacuaauauuuagccagagacaaauggccaaagcugccaaaguucugcugcuugcuagggcugaaacauggcucaaaucacucacagcaacagucuuccauuaagcucauuaagcucauuaagcgccacuuaaaacauuucauggcuuuccaauuccaaaguccccaaauucuuccaaacaaaaacauggugagguuuaucacagcaauaccccaaucccugguacuucucucuuaagguuuuacugccgugaacagacaccaugcaugaccaaggcaacucuuguaaggacaacauuuaauuggggcuggcuuacagguucagagguucaguccauuaucaccaaggugggagcauccaggcagacaugguacaggaggaacugagaguucuacaucuucaucuguaggcugcuagcagaauacuggcuuccauguagcuaggaugagagucuuaaagcccacacucaaaaugacacaccuacuccaacaaggcuacacuuccuaauagagcaacucccugggccaagcguauacaaaccaucacacuuuccuagcuacuguacccaccuuucaucccucccauuuuuaaucuuauuaacuaaaaccugaguauacuauguacuacucuuguuuauccaagcauuuugaucauaauguguggucaguaauuuuugaucucuaaaugcaaccaaauuuaaauaaaauguugaaguucuguugacaguauggaaaaaucacauggaaugcuuauuugguuaaugcuuuuguugguagcaguaagaucauguguagauuuggaucaagcuugcuugguugaugauagaacuuuuuuguggguaaauaagguaguuaaaccauuuaaaguggaucacaucucauaauugaguuuuccaugaaucacaucaaucaaaacacaaaaugcuuaaucauauacacuguaauuggguauuuaauggauauuuuaggccuuuaaaacaaaaugcaucaaagaacaguaagaauuguaggggauuuuugagaacaugcugaaauuaagaaacccucaaauauaaaaaguuacuuugaagagcaugcauagugguuuauugugcucauauggaaguccuacauaguaauaauaagauccaaacucuugggcucaauaauuaagagcaguucccagugcuacacgguggcccccagcugacuguaacucuaguuccagggguuccacgcccuuuucugguacugcaugcacaugguucgcauguagacaaaauauucauauacauuuaauaaauauaauuucuaaaagcuuacaacuuuuaaaugcuagauuucuuuuuuagaaaauaaauauuauagaauagaguuuauucugggcauggggaggggauuugagaggguaguagcaacagcagaggaguagaggcuggccaugagggugucagaccucauuacagaugguugugagcuaccaugugguugcugggauuuaaacucagggccuuccaaagagcagucaguguuccuaaaccucugagccaucucuccagcccgaauacuagauuuuuuuucuuuguuuuguuuauuuuuuguuuuguuuguuuguuuuuggguuugcuuguuuuuguuuuuugagacaggguuucuguuguccucuaacuugcuuuuuguagaccaggcuggccuggaacuuacagagauccaccugccucugcuugugcugggauuaaaggugugagucacauuucuuaauagcacagaguuuuuguuaaugcaagcucagacuugcuugugauucucucuucuuagaguaaaaucacccuccacgcugaagugcacugauugugcauugguucuguucaugaaauuaaaaauuaaacauuccuuuuaugaauuguuaaaagaaagaauggauagcuguuuuuuagaucacuuuuucaaauuccauuuucuauucuaaaauugaaguaaguuuuuuaaagcauauaauuuagcauuuaauuucuuuauuccagaugaaaccauaaaaacuuagaugaaacagucacaacuuacagaccacgcugcuggauuucacucuguccacaccguacgccuucgucaguagaugucagucauuuuccccuggccucaguaucaaugugaagaaauuuauuugacucuuagcauuucuuaccaucuuaagaagaggaaacuguuaaacuuagcauuuaugaguagaauuagucuaggcuucagagguuuuagugauuuuuuaaaaaaauuuauuuauuuuuauucauaugaguacacuguaguuaucuucagacagaccagaggagggcaucccauuacagaugguugugagccuccaugugacugcugggaauugagcccaggaacucuggaagaguagucagugcucuuaacugcgagccaucucuucagucuggguuuuaguaauuuuucauuggaccuuuuaggcuccagauuauucuguauuggaugauugaaugauacgucagcaaaucagccauauuuauuauauuuaaaaaauuuuuaauauuaagaaaaggugugccuauguguuucugugcacugugggagguuuaugaguuauuuuuuauucuugcccuuaaauucauuuuugauggugcuuuguuguuaacuucaaaauuucuuuaaaccuuaguguuuaauauagucaaaaaguaacagcugugguucucaaccugugggucgugacaccuauggagguuaaacaacucuugcacaggacagaugucagauauucugcauaucagauauuuauauuauaauucauagcaguagaaaaauuuaguuaugaaguagcaaugaaauacuuuuaugguugggauaaccacaacaugaggaacuguauucaagggucgcagcaucaggaagguugaguccacuagguuauaggaugguuacuuaaaggcauuggacuuuucuuaacauuuagaacuggggguggggagcauauguagcuaaguacagcagaguacaugcaggacaguauagauguaauugaaacacagaacaaagacaguuucaaaguauugaguggaaggaugaggggaaaugcauaggaggccccuuuguaaagaggaaauaggauuuuggcagagguagaaaagugugguaugguugaaacaagagaagaugagaggacugaacagcaguguugguuaauagguuagagcagggcaauagagguuggaauauaguucuaagguaguuaguuacgaguuuuauucuaugaccagacaggggugauaaaagguuauuaggaaagguaguaauagugaggccauagggccugaggagaaacuuucuuuaaaacacauucaucuaguaguuuguacccuguuaaauuccauauguaaaauagauucagcuaauauuuuuagauauguuaguaaaauaauuuagaggaacucguacauaacugaagcugcugucuuuuagucuuuuguuauguggaaccuaggguuagagcuggugaaaagcguaggugcagagaacucaguaacugaacaguacccgggccuuccugaaguuugaacuacaauucuccuggugcuuguucuucugcuccauguccucugcugcagagacauaguaggugcccagugagaugcaaaggaagaacauggccucucuuccccaaguggccuguacggccuugcugucugcaaguuauaugucauacuuccucauuaauguggacaaagagacaguaagcacauguuccuuaggaagccuuuguuuuggaguuaagauggaggauggagagaagcacuaagcuuccucuguguguguauguggggcgggggguggagugggagaggggaguguacugagacccugugucaaacaaauaagaaaauaacacacacacacacacacaaagacauuuuuguaagucuugaaucugggguaacuccucuccuccaucuuuccugcucucucucucucuguuuucuugagagggucuuguuauguagccaggauagccucagaaucacuaaguaucccagcuggccucacacucaguuucuacuuucuuaagcuuuccaauugcuugaguuauagacagccauguacaagcuuggcuugaaguuuuuguuuuuguuuuuaaauuccaaaugguagaauuaaacacaugccacucaggauuuugaagauuucuuguguauaauaaaacauagacuauaagcaaacaaacaaacaaacaaagaauaaaaggaauaaaaggcagaagccgagugucaggugagaugguguguuuucugagcauaaugaggggcauguuggacugugaauugguucaagaauaauaagagaaaugcacgguaauauaugaccauucauagaguaauucaaaguaguuaaaaaucgcuuuuuaaaacauguagaucuguacaaagaaucuuccuccuggucauuauuacagugagagcacccugcacccaccaugacuucuguagucaccaucucauuguaggcuaaccuuuggcaucauaaaugugaaaauguaauaaagaaaaauucagauauuuugauagaaacagugauuaauccuauguaacaaagagaauuaacugauacuaucuauagcaaaguuaaaaugucaugccuacaguuaacacuauaguuuuaaaaucuuuuuuuuuuccauuuuuuauuagguauuuagcucauuuacauuuccaaugcuauaccaaaagucccccauacccacccaccccuaguuuuaaaaucuuauucuuacuguaauacccauccuuguaguugauugauccaaaaaagauuuagugggcuagagaauggcuuagguggugaugucuugccacauaauuaugaggugcugagaacagauucccaacacccauguucaugcugggugugggggagcauuccugacacuucagugcuuuggggagcagagacaggaggauuccuagagcugguuagccagucagccuugcugaacuggugaguuccugguucagugagaggcacugucuuaaaaauaaaguggugauacagaaaaugugguacauuuacacaauggaguacuacucagcuaugaaaaacaaugacuucaugaaaucugcagacaaauggauggaacuugaaaauaucauccugagugagguaacucagucacgaaagaacacacaugguauggacucauugaucgguggauguuagcccaaagguuuggaauacccaagauucaauucacaaaccauaugaagcccaagaagaaggaagaccaaaguguggaugcuucagugcuucuuagaagggugaacaaaauacucacaggaggaaauacagagacagaguguggagcagagacugaaggaaaggccauccagagacugcccaaccuggggauccaucccaauacagucaccaaaccaggacgcuauuguggaugcgagagaguugaccucuggcaugcacauaaacacacauggaugcagacaucuacacugaggucuucuacacacaaaagguucagauuguuuauucaggguaccuaguaagucuuuuagcgcucccuguucaucucccucuaccuccauguacaguaaccugaauauaguugauuauuaacaagguuauuuaacacaaacaauuacacuagagaugauaagcauuuaagcuuggacuuguuauaggauaaaagucaaaaggcuuuaguuauccacagcaccauucguuguauauuaauuacuuuuguuuacugguuugaaauuuguagucuuuuugcuuuugcuaaguuuuacuugucugaaauucacuuacugugagcgugcuuugucagguguuugguucagaacucugccccagcauguuguauaaccuguuuaaaaauaggacugaaccucacaguguucagaaagguuguugauacuagaaaaacuauuaaaugaauuuguagagcucauaccuuacaaaaggggauuuucuuuaaaacagaaaauuaagguuucaauucuguagaucuauauaacuaaaauguagagaauauuuauguagcuaauaguuguuggauaguugacauuuauuguaaguguuguucacuaagucaguuugauguuguggcugcugggauggggaagcaggucaaggcacugccauacaagucugacuaccugaguuccguuccacgccccaugaaaagguugaggcuugcucuacacacauuguggccuguguguacauacaagaagaagaaaacacauuguggccuguguguacauacaagaagaagaaaacacauuguggccuguguguacauacaagaagaagaaaacacauuguggccuguguguacauacaagaagaagaaaacacauuguggccuguguguacauacaagaagaagaaaacacauuguggucuguguguacauacaagaagaaaacaaucggaaagcuucuguuuagguucuuuuauuuugaggcagauguuauccuuaucuuuauugaggauuuucccuuuguuuuguuuaacugcuauuguuuguuuguuuauugugucugugcauauguguggacauauaugugccauggugcacauaugcaaaugucaaaggacaacuugcuuagacuccauccucucuuuuaucacgugaauccuaggauucggacugagguugucaugcucuugcugacccucgguacuauuauuuauaugucugucugucugucugucucucucucugucucuguauacacacacacacacacacacacacacacacacacacacacacauauauauauauccuccaaguguauuagauacaacauaaauaaguaguuuuggucaccaaaaccuguucauguucuuauauguagaaaaugggaugcuuauuucgacagauaaucuggaauuuuucccacaagguuuggguaggaugaaaaggguagagugagaauuugcugucuaacuuuuguaccauuuauucauuuauuaucacuugcaugaugggagauuaugguucacuugcaaaguguauacaguugucuugacagaacagacaguuuagggguguaauguuguaaauacaccuuuaguagaaucauacucuugaguaaaaguacucuugaaaugaauuucaccccagaggcgucuuaagacuaaaaccuaaacaggggauuuuaagucaauaaggcaacucuucuguaaaaacaaaacacaaacaaaaaccagugguaagagaucugaagguaaucauuaccugacuucagaggaggacagugucagcaucucuaaaugaaauguauguaguugagacugacauugucaucuuaggauagccagguagcuacucuuauuuuuguugucaacaaaaccuaacuauuacagcauucaguuguuuuccacauuaaaggaaacuauaacuauuuucuucuuacugaacugaagaacuuuuuaaaaagugaauuauaauugagcuguacuaucuguuguguucuuuuguaaguaucucaugcauuuguuggucacaacaacucuaguggcuaaguaggcaccagcauuccucccaauguauuuuuuuaaagcccauuuauuuauuaauauuuaugcauaccuauggugguugguuccuccccuccccucccuuccccaccccuccccuccaaaacaggguuucucuguguagcccuggcuuuccuggaacucauucuguagaccaggcuggccucgaacucagaaauccaccugccucugccucucaaguccuaggauuaaaggcgugcgccaccacugcugggcccucccacuguuauaagugaaggcaaccaaaguuggaggagcuuaaguggcuucuccaguauuaaauaggagauauuagagccaauauuuaaauucagaucucuuguuuugguaaaauuuggggaaauuuucuugauuggauaauucaaaaugggaaguuucacuauaaccauauguauggugauuugacagugauuucaaaauguacuuugucuggauuugaccaguaaaagugcagucauugauauauuaggaaagguaauaaaauaauuuugucugcagcuaucaagaguacaagcauuaaguaaauucugcuuuaagcuuuagagguuauacuucacauuugaacuugauaauaauuuuauaguauuugaauccuagcauguucaaggagccuucacgcucccaagaauagcauguaacauuggugauguuuaguuuaccuugacaaacuagcuuuucuuuucuuuucuuuucuuuuuuuuauuagauacuuucuuuauauacauuucaaaugcuauccugaaaguuccccauacccucccuccgcucugcuccccuacccacccacucccgcuucuuggcccuggcauuccccuguauuggggcauauaaaggcaaacuagcauuucuacagcugcagaucugcauguggugggauggacuauguaaagugcuuuucucccuugauuucccugaggugggcuuugaggaugcugauuuguaaugaccguucugcccagaauccggcagagguuagaggugcuaucuauagcauggcuguuuuaugaccaggaaagcauccugcuuuuagcugcugucagugugaagucuuuggagggcaguggacugucuguuuuacaugaauauaagaaagauguagauuucucauuacccacaacugugauaucugacauguucuuaauagguauuauuucuguguaauuaacccugauacuggcuuaauguuuaagaagcuugucuugauguuaguuugauucuauuauaaaaauacaagacuuaaaauucagucauuucuuuccagacaucuguuagcaauaguaauugacgcuuguucuuugauagaaaguagagaaaaauuaaccuguuacucugugaguuaguuccuauuacauauuaguuauaaggauaaaauugccuguauagccuggaauauucugaaacuuaucuaaaagauuuauuuuucuuagauaauaguucauuuucuaggaacauuuuauuacuauagccaccuaaaaacaacuuuauuaugacaacugauuuuuguuuacuuaagagaaccugcugcuaaaauuggaaugaggaaggguguaaucuaaguauaggcauacaccgcuuacuuugcaaauaaccagaguguaugugugcauguuguuaggcuccuucugaaugguagaaauaaaguuauuugcauguuuuucucuuuguacagcuuaaaaugacgaaugugugaucucaauggaauaaauggcguccagagucacagaugcuauagucugguaucagaagaaggugaguugauagucaaagcuuuucuuuuuucuuuuuaagaguuugaauaucacgaauuaauguguauuuuuugcuaucuguuuaaaccagguauuaccaaaaguaaagacuaaauagguuuuuggggcagaagauuauauuauugugauuuucuuuuucccuauguuaucuuuaaauaaauuggaaaaacaguaccuaaaacacugucuucuaguuuucacccuaagaucucaaaguagguagacuacuagauuaaucacugccauguagagucuauggcaagucucagggugauuuauauaaguagaaauauacaaaaguaguccaaguuuuauugcuuucuuuucucuuuuuguuuuaacugaaagaaugcuagauugucagaauuuagcuuauguaaaaagucuaauaaccuuaguuuuaaauuuuuuguuuuuaguguuuguggugaauuauauuuauuguuauauauuaaagcauuucuuuuuauucuugggaauacccauuauugaacccaucguuuuguacuuacaaggcagauauucagccauugauuuacauuuuuaacccuuggaacccugauggugcuuuggcccuaaggguuuuauucaaauguaacuguguauuuaagcuucugcuguuggaagcaaaccaggcaagcuuuaaacuuucggaacuggugcugugauaauuaaaucccguagaagugugacaaggcugagaacugagucucuuuagaauauguuauuuaauucuugguaaaauacaccacagguguacagauaauauaauaucaugguuucuauaugaaguucuucauuggaaguauugauacuggaaugucgugacaugaucuguaguagugccaccuuuaaaguucuaaugagcuuaaacaaaaaauucccaaagaaaguagaaauaaagaauuagauaaauccguguauauacacacacacacacacacaaaacaagguacuuugagguguaucgauuaaacuugucuucuaaaaauuauuuucaguuaggcaugguggccccugccuuugaucccugcauuugggaggcagagggaggaagaucucugagugcucuaccagccuggucuacauagcaaguuucagguuugccauggcugcacaaugagacccagucucagcaaacaaauacauacacacacacacacacacacacacacacacacacacacacauauacacacuuguugauauuuauauauacaaguguguguguauauguagcuauauauacauuuucccacaguuuucuaauuucuauuuaucagaguaauguuuccaaacauuuucuuuagcuuuuaguguaggccauuuagaauuucacugaagauuauagaacauacuuggcuaaaugaacuuuguuugggauccucccauauauuuagcugaaugacacuucucuugucugagguaauuuauuuagaugucuuggacgugugcaacuuaaaaauucuauagaacacuuguaaaaaugugucccaaaauuauuccaacagauuuaaccacauauuuucuaugagggaguugaccuuuaaauuguuucuuuaaagaaaaccauaugaaucauucagaaauuguugcuuauuauuaaacuuauuauuaaaaauaaauaaacaagaagccccaguaauguaguaccuuuugcucccccuauuuauuuauuuauuuauuuauuuauuuauuugguuuuuuugagacaaaguuucucugcguagcucuggcuguccuggaacucacucuguagaccaggcuggucucgaacucagaaaucugccugccucugccucccaagugcugggauuaaaggcgugcgccaccacgccaggcuacugcuuucuugaccuagucccucaguucuguuccucagaggcagccauguuuagucaucacucacugacucucaacgucuuuccuuccuuucuucaucuucauagggguuucggagagggauugcaaauuccagguaugggauuuuaguuuuguaauuacuucugggggaucuugcccuugguggauaagaaguagauaagcaaggucauauaguguuuauagugcuaaguuuaagauugguaggccuuuucuacagagggcuagagaacauagaucuuaguguuuuaaguuuauaaaguuguugcuacaguuacucagcucugccaguguuguauaaaaauagccgcagaucauauccuggguuggugacugugcuugccuucucauagacuuaacuuggaaaaacaacuagagcugaccuguaacaccuuagugcugauaguacgugaagacagucucgugucacacagugcaaugaugcccuuaagucacacugucuacucauccucucuuccucauuuuauuguugauuuaugacuguaugauaaauuguuguuuuuaauaagcuaucucuaaauguucuacuauugagcaaugacuaaaagcccuaauuaaugucuuuauaugacuguguguguguguguaugauuuacagcaguguccuauaauaauacuauaaugauauuuuccaguguauaugacuuauuuuuugacuugguuuuucaaauucuuuucugaagcuucugaugaaaccguaacauuuauuuuuguugcagucauucauguguacgcuuuauuuugcuuccuagggaaugauuuuccuagaauugugugugcgccugcaggaugcuuuccaauguuggguguauugaaauaugccuugagaguuccccuuacaggucuuuguucagacaaguuuguuuuaaaacaagagccuuuuaaaagugcuugcagugcuucggaaaccuuaagaacuugaugcuugcugaucauuugagcacagacaauucuuucuuugagcuccaauugccacuuuuuuaagauugcccagauaaugguucucagcacauuuucaaucaugacucccucugaaguagugauggcagcuaaggauguaauuuuuggaaaauauauauaauguuuacacauaugaaaugucacauugguuugaaugcuggcuaauauguccuagauuauauaacuuaaaacuuuuaauauauaauaguuuguuuuucugacuaucauuaauaguauucaacuuagauugguauuacuacuccagauaaaauucagagugugucuaccucauuuguugguuguuccacgcaccuuagagucacucuucccucauggaaaauggucccauuuucguguuuuuguuuuaguacuaaagguuaauuagcuccaaaggcauuacuuagcuuaugagugguuuugaacuugaacucuaauaucagaugugaaauuuccagaaggaugugaaacaaaacauuuuaaacuauaaucaguguuuccaggaaaaaaauuacaugugagggaccuuuaugcauuguuuacuuugguauuuuuaaagcuccuuacaaucauuucuuaaccuuuauucaaugcuauauaguaauaaucaugaacuacuugcaaguuccuauugcuaaaaaaaaaaaauaguuuuucaguuaccuuguagguacagcuuaugcaacacaaaagaccacaggagagaacccagacaguuucagguuaauaaugggcaguugaauguucuuuauaacagaacuauucuuuuauguuuguauuucuuauuucugaaguuagagacuuacuuaucauugggagugaauccuaaauaucaauccacagguaauucauugacacacuaaggauuacuuuuuaaaaaauccagugauaauaaaguuuuaugaauauacauguuaaaauagagaaaaugagguugauuuuagaagacaaauguauaaaagaaggcugauguacaaauaaccccuaaacaaauaacaaagagaagcacuacuaauauaugguaauuaaaacuuugaggaaguacaguggcaguaaaacacguuugaauuuuugugguuguuuuaaugauuuauuuuuauguguguguaugugucucucuauaugugcauguucuugucuguauauguaucucaugcgugguacccaugaaggccugaagaggucauuguaucucccuguaagugguuuugaguugauugauguaugugcuaggaacucagcucgagucuucuacaagcucaguguacacauuuaacuacuaagccaucucucaagucccccagaugaaugaaugcuuuguggccaauguuggcuaauguuagcaaagugugggauucauuuauuaacuuaaacaaacugucccgaguaacaugaacaucauuuguaacugguguuaauuauaaauauuugggaacuuuagauccucuacuuucuuaguuaagucgugauguguacauaugugccacauauguacauaggcaucugugaauguuuucauguguguauauaaguacaaguauaggcauuuccgaguuagcuguaguugcuuuuuaaucgcccagcagucacuaccuaccccaaucuuguagcucucggaugaaagacacacacagccuuauauuuaauaugccuuaauuagcucaauggcugggccgauuccaaacuuccauauuccuaacgccugcccuccaacacuccugaguuauuacuuacugaaaccuguauuccaucuuugcugcccuagacccaauuggggagggaggacuaagcugcucuuccuuggcacuuacauguguuggcugacucuucauccugugcuuuccccagcauggcaguucugguccccuugccugccaaucugacaguucugucucugugucccuggccagccauuggcuguaggcaacuuuauuuacaaaucagaaccagcucgggccagggacccucagcaucuuacauguggauucccugcagucuugggaacccaguuaacauaacacaagcauaagaccaaauccacaacagguuaacuugcacagcaucauacagaugauuaagaaguagugagugucuggugucaguuuccaaaacuacugcuauuauuuauuuuuuuaacgucuuucuugugucaggauuuucuuguaagaugaguccaacacaaacuaagagagggaaauguauuggcuuaaaugcuaaaccaugcaaaauggugagguuuaccucagaacugacugaauccuaacgccagaguaccaccagaaauaugugccugcuucauuuuccuucucugcuucucuagaguuaacacuucuuuuuaccacauaggcuguuauauguguuaugggaaccaaccugaggcaccucuggacucuuguuuuccuuugagaagaaaggaucuauggaggacuggaauauuuuggguuuuccauucaagacuuucccccugcuguaagagcuucaguuugccuagaaguuuucacugaccauaaucccuagacuaagaggcugacuaucuaaaaucucagggcagggaaaccucaauuucuuuaaacugaugauggcauucuguuucccugccagcgucugguuuagaucagcacaugugccccaauuuugccuaaaugaaacaugaaggaagucuucuaagaaaaggcuuccauuucuuaaaaagaaaaccagcagcaguaauaauagagaaaacgaaaggaaggaaggaaggaaggagggagggaggaagaagaaggaaggaaggaaggaagggggaaggaaggaagaaagggaggaagaagggaggaagggagggaggguaccaagcacuucaaagugagcugagugagugacauggaggaugguccugucuuuggacuucuguuggauaaaauucugcugucacagcuuuguauggugaccuuguuccuauaggaauuugugaacaaguuaauaauagcugauuucaaugaugaacaaauuuuuuuuccugaacuuuuuauuuaaacuacaggauuaccacugaaaguguacuacuuuugaucuuugugcaagauaauguuacacuuguauuuuauguuguuacuguuaguuacugagauaccuucuuacucugcaacccugaccggccuagaacuugcuauguacagcaggcugacuaacagaucugcuugccucugccucccaagggcugccauuaaaggcaggagucaccacuucuggcuaccauauuaauauucuugaaaaauuauucauucauacuauuggagauuuuaguuccuugaagcugaaagugcuauucagacauucacucaaacuggcuuucugaacaagacauacuaagccacagaaaaguggucucucuuuuucuuuccuuacgccauauucuuaauauacaucaauuuuuuuuuaauguaacuagggggcuagagagauggccuaguggcuaagagcgcuuucugcuuuugcagaggaccuguuugauucccagcucccacauggcagcucacaccuagguaacuccagcuccagggcauacucucuccuggcaucaguggguacuccacuugcauguaguauaugcacacaugcaggcagacacucaguaccuaaaauaaaaaaaaaaucuuaaaaauguaauguaaaacaaauagguuuauaguaugauuaaauauauauguuauauacacacauacauauaauagagaaaagacaguguaauugaguauguguguggguaugugugugcauguggagcucagaggacaaucugugggagucaguucuuuccauuaugguguagcucccagggauugaacucugguugccauguuugggcagcaacugucuuuccccuccgggcuaucuuuguggccuccaacacuguuguuaagagucgggaucuggggcuggcacgauggcucagugguuaagagcgccgacagcucuuccgaagguccagaguucaaaucucaguaaccacaugguggcucacaaccaucgguaaugagaucugaugcccucuucuggagugucugaagacagcuacaguguacuuagauauaauaaauaaauaaauaaauaaaucuaucuuaaaaaaaaaaaaagagucaggaucuguguuugcauugugcauucuggagugucugaagacagcuacaguguacuuagauauaauaaauaaauaaauaaauaaauaaauaaauaaauaaaucuaucuuuaaaaaaaaaagagucaggaucuguguuugcauugugagauuuccuagcuugugauacugaagauguuuagucuuggagcuuugguccuccuuuuguauguggcagcuacuaacacuggacaggucuuuuaaaguugugaggguauaaguuuauuaugaauuuuaagaggguuugaaguauuguaugaauugcuuaaucaauaugagcaagcagucuuuuuuuuuuuuuuuuuuuuuuaaagauuuauuuauugauuauauguaaguacacuguagcugucuucagacacucuagaagagggagucagaucuuguuggggaugguugugagccaccaugugguugcugggauuugaacucuggaccuucggaagagcagucgggugcucuuacccacugagccaucucgccagcccgcaagcagucuuaaaacuacuauuagucaacuucugaugugacauaagaagaaauuaaaauaucaucuaguacucaauauuuucucuaauggccauguguguguuacacacaauccuucuauugggagagaguuggguauguagcuaagagaaagccagaaaugguauuuuacucuggcaacagugaucaguccagauguucaaaaacccaagcuauuauauaaacauuuaaaagaauuacaguugaugaaaaagacugucaaggagguaauaggcuaaaguugagaagagccucuggguguguuccacagccuggugagaacugcagcugaaagaaugaagagcggugggguauagggaaggagagaccgcaggccagcacagugcuguguucccaaauccucugucaccuugcccuugcccuuugaguaguuucaucaaaugagcaaguucuccuuuuuaaaaaguguggggguaggguggggugaggugaggguuaagugcccuaacuucugaauuuugcucuuuaugcauauaaagaaauagugaugucaucuuuucuaaucauuuauagauuaauucaugguguauauauaaugugauaucauagugucauacauacaugcugcaucugcuguaaaugugguucccuguugucaugacuaccuuuucauauuggcccagauuguccgaggaauugcugucgcaaaauugcuggaauccuuuuagauggauuaagauucucauagaguuaaaaaugaccuucacuugugaaugagagcucugaaauaucaaacuucugaugcccaguauuagaacagugggcauuaaguugauguuugcuuucuaacuauuacacagcaaagucaugaugaagugucauuuuaaaaccucaguuuugucuguuugguuacuggucaugacuguccaaaaauaagacuuguagcugaaauacuuuacuuaaucuaguugcuaugauauuugccuuuucacuuaggauuuuuucccucuguuuuuaucaagguucuugaauuuuuauccacacucaccaauguggguuuuagcuccauuuguuuacaaggaaagcaugagauauagucaggagucugacuucaagauauguaguucccagcacacuguagaucuaggcugaaaccuaagcacagucuaacauacucauaaucuaacccaaaucugcugucucguucuccagaaccuucuuaaaaauacagggagaugugcaauacccuaaaaaccauuuaugugugugaguguguguguguguguguguguguguguguguguguauguauguguauauguauggauggauggaugggugaguguaugccaugguguggguguggcgguuguggaggucagagggcaguuucugggagacagugcucuccaauccauggagguggacucagguuaucaacccuggccaucagcaccuucagggccaucuuccuggccucugaaaagacuuagggaauucacacauuuagugugagaguuuuuaaaggugacuuuuaacaugagggucuuugagacguacccacuuuuuuuuaaaagcucugguuuguaguguguguguguguauacauugacuuugaccacagcgaugaugguggcaguggugauaaugaaguaacccaccauaacuuucauggaacaguuuuucucaagaacuucucucaauaucuuuauuguccuaauaaguauacauaaaauaauaauuauaaaaacugaacuucaaggcugcuugcugaggcugcacuaauggguaggaauucugagaaggaaagguauguugucucaguaaaguacuuauuauuucucauauuucuuuaguguagcuuaagguggccccaucuuccugagcaguggucccuuaucauacaggccacugaccugcucagcuggucuccacucagguuaaagauuacuucaucuugaccagaaguuugcuuuauugaacuucuccugcuguuggaucuuuuuuuuuuuuuuuaacuaauuuuaagccaaaauuuauuuaucaauuuguguuugugugcgcauccacccuuuucuuuuccucuuucuuucuuucuuuuauuuauuuuuauuuauuuauuuuuuugagauggucuaccucacugcuuuagaacuugccaaguacccuagacuggcuggcuagccggcuucagggaucuuagugggugugcugucaugccugacuuuuucauguggguucugaggagacagugcaaacccucacugcuuucaaggcaaguacuuaaaugacugaacuggcuuccccaaacaucacuuaacuuugcuuuuuaacauggaacucaagucagcaccucaaacagucauuuuuaaaaucaaacguuugauguaguacaauccaaagauacacugauuucauacaugcugagagaugaggauaggaaaauggcaaaggaaucuuuuuuuuuuuuuuuuuuuagaaauuauagcuucauguuuccauaaagguaagaaaaugauuuauguaguaaaaacucugcaguuucuaacacguauaauuaugagaggcaggacagcguaugugugugugugugugugugugugcgcgugugcgugcguggagccaggcugcagggcagugguauguguggcaccugugagugugcagggaaccuuagaugugcuauguguuugauuuugcauuaagcuuugguagcuguguagcccgaagccuuuuacuguuguuaucgguuuguggccugcgcuuagguacuagagccacagcugagagcugggucccaugguuguuccugcugacgggcccuucaguagucuuuguuucuuugcucuugccugagcuuaucacacugcuccuguuugaggcuaucugauacuagaacauuuuuacugaagaaucaaaauuaggaaaugugcauuggaaguuauuuuuucuaguucauugugguaucacaugcuuauaaucucaacacucuguaagugagacaggagaucccucgagauccaggccacucuaggcuuuaaaguuuaaguccagccuggacuugccuuuacaacaucaucaucgaaaauaacagcaaaaucaagcaaacaaccccccaaaucuaaacaacaacgaaaaguuaacguauaauuuacagacaccccccucccaugagaaauuguaagauuagggaauuuaucuucuugccuuuuaaaagccuacuuuagagauuuuugucaaauauaucaagaauuccagaacccaaacaaagagaagaacuaagaaauggcauggcuugaauuaguugaauuuaguggggaaagcuuguccuuugguuuugggagguaggggauauucugugacauacgaaaacuacucgugaacuuuaaaaauucucuaaugaauggauuuaaaacagagacuagucaagguuggagaauuugccagcuaaauuuuaaauaucuugcagucuguuuaucuuuaaccaugggaacagacauaaugaugaaguaauuugguaaacuaccaauugacaaccuauaauuagaccagugugccagcuuugaaaggagcuggaaagaccaaaccacuguuucuaaacugcuccauauuuauaguccuagaaaaaaauggcacuuguaaaugcuauuuagcagggugccuuagaugcuaaauugcuuucuggagucgcccaugguauuuauucaaauaaaagaaguugacucacuacugaggaucaaaucacagagaauaaagcacucauaguagacgcuaaaacuguccugucugaaccuuuauacagaaugcauauuuuguccugcuggugaggugaaauucugcuuuauuuuauuuuauuguuuuuguuaccuucccccccccccccaccccacccccccccccccccgugaugaaguacagauaaagacaacagcuauauaccaagcauaguggcaugccuuuaaucuugggagagguaaguuccaggacauccagcuacacagagaaacccuuccccccauucucccauccccccacccuccacccccaccccacgcccaggaaaucccuccuaguuuccggaccauccuaggcuagccugggcugccuaaugagaucuugccuuuacaacaucaucaucucuaagagaugggggguggugggggguggugguggggugguaaaugaauaaagagaauauggcauguauacaaaauggacuuuuaugcagccagaaagaaaauugaaaucaugacauuuuuaggaaaaguaauguaauuggaaaucauuacguuaaauuagucagacucagacaaauaccacauuuucuuuuauaaucagaaacuugauuuuuaaaauguguauauguauguaucuuuauagcuuuaugugugaguauguaguuauauauuuguguauaggcuaugaaguggacuugagaguagaggaauagaucucagagaguugggagaauagagaggguaauagauauauacaauaaaauauagguugggaguaacugcagaagaaagggaauccgcuggaagggagaguauaggagaaggggacaaauaaguauaacggcauaucuguauacacauacuguguugaaauuuaauuauuuuuaugcuagcccacccaaaagcuaaacaguaaaaugauauauauuuugaugguauaugaagagaaacagugagguagucuuuuaaaacuaauucauuuagaauucugaaaagcuagaagauggugucuuauuuuuccaauuuucaagguaauagguagcaggguauaauuuuaauuacguuuuuucugucacuuugaucuuuuucuauggcuuauuuuuauuuacugguauaaaaugggagaaauuaccagggagccucauuaacuucauguagcuaaaauacaauauuuaauuuuaucaguagacuuuaauuuuuaauauuuuauuagcaauacacaacuucacaauaauaauacucuugagggauuuauguuaguuuauauugaaaugucauuuaugacaggcauauaugugucagacaugguucuuuuuuucaggaagcucugaagcuagaagggaucagauguagauuccugugagcacuacacugggaguuguacagggcuacucaaaauguguccugcuagucacuguugugucaccccuuaggcucccagcgcuucucaagucugcccuggucucuuuaguauuccuugauccuuggcaauagaguuucucuucaccucugcccaagacggcuuauuguaaaaacuuggccuugucucuuaccugccuaauguucuucagaguauccucuuacauacagugcaggguccaaguucuucacagaacuuucagauuuuuauucugguguaauuccaaaaguauacgugugugugugugugugugugugugugugugugugugugugugugugucugucugucugucugucugucugucugucuuucauuaacucauacacacuuacuuguuucuugguuuguugaaguaagauagcccuuaccauaguaaacucaggcacagugacugccuguaaaugcuccggcaucacuucuaucauuuggguacucuggacaaagggcuccauuuugccauuuucaccauuuuacaguaauugagggaggacugaucuccuuucucuuacucuuaagaguuguauacuacuucuuagcaccaucaagaagucucaaagcagggucaagaguugacuccuuggacaaagugugguaccugcaagcugcuuaucagcaaagaucagcagugucgucugaucaagagcaauucaugcuuuauccugguugucagccuuugcaucuaguaucuagccucuucucuaguaucccaaccuccaaugagauugcccuucccagaaaguauuuuuaugacaaucuuagcuuaccaucuaacugauaguuaagaaagcuucagcuagaguuguagucucauuacauacaguggcugaaaccuucaacuuucgaugcuaccucucaauacaguuuauugaagucugccuguguggguuuuuuuguuuguuuuguuuuuuauuuuuguuuuucgagacaggguuucucuguauagcccaggcuguccuggaacucacuuuuguagaccaggcuggccucgaacucagaaauccaccugccucugccucccgagugcugggauuaaaggcgugcgccgccacgccuggcuccugugugguuuuuuaacuuguuugaacuacccacuuuguuuuuuauuuuuuaaauaauuaauucuacuuggucuuuaaaaugcaaagccuaucuuguccuaaggggcaucuuaaauaauccucuggagacuagguaucuacuccuaggaugccuauagaaaaagauguguauguguguguuuuucauaacaggagaguguuuuuggucucacaauccuucucuuuuuuaagaaagacuuuauaaaguaaugcaguuguuucugucacaguguuugugaucccuuacacagacucaguguaauuaaagauuuguucauuaggugcuagccaaaugaacuaucucugaauuugagaguaccaugaaggaggguuaugaggaaggacuuuuaaaggggaaaaccacaccaagaccuucaguauuugugcaggcaagcagaaacuguucuguucagccaaguuaggugguuaaggcaacucaaaaauagucuugauaucagcauaagcaaguuaaaaagaguuugucacaucauaacaaguaaauagccauggcugugcauugggguggggguggggcacuaagugaggauuccuaggaacuuacuuucuagggacuggaaucagagcugguggguaccaagauagaugccuagcauaaaauggagcuucuuaagccauaacaauuucuagcaugcuuacaaaaucaguguuuuaauuuguccugaugauugugaccucuuggccuguaagguaaugugcaguuucauuccguuuuuauuacccuccuuaauggcuguuguauccuccauaaggagcuuguuugaguuggcuucugaggcucuuuuguuuaacccuggcaguuaguauuagacuauauuucuugauaaaacuauuuuaaaugagcaauaucuuccuugcauacagcuuuggagagcucuuuauuuugauugguuuuugccauucuagguauaaacaugcugaaauguugcuggcuuucucuaccucacaguuaccggagaguaaguagcuuuuacaguagccauuacucucucuucugugcugcagugacauuggucugucauagcucuuaucacagcaguauaaucagucucuccugcuaagacauuuacuaucaaacacaauacuucauucugucguaacauuuccugaaguguguucugucugaccguagaaagccuucuaauaaugacuauggaggaagacaaggguaacuaagcucugugaacauaggcuuuaacagugcagacaguguguaguguggcugauuguccaggagguagauagagaaaaugcuucccaauuuauuuugacuuaauuuuucccacauuacuauauuugacagagacuaggucuuuaggcaugguuuuaucucaguaaguggcucguuacaagucuaccaggcacugaauauuccacuuccccuguccuacuucuuuaaucccacaagagcaacgucguaauucugaugacugaguaggaauaaaaugcuaaguguucuuuaaaaauuacaaagcuauuuaaauaaccaaagcauguuaauagccacagcauuacgauaugaagaagcuuuccuugcugcuucugguaagcuuaaaaaguauauacaagaaggugcuugagguuuuaauuaaguacacgugacuuacuugaugucuuauuuuggaguagucagucuauucuaugauuaauacuaaaagcaugcaauuacacauuuguauucuuuccuuauucuacaauacaaaggaaaaggauuggguaagucauggggaugacauaucuaauaucuuuugaacuuuuauguauuuguuacuauuguuaacuacauauuagcacauuuaauucugauugccaucugauuauaucaacucuuucaauuuucugaaggguuuuguauauuuguacuggcuuuacuaggaucugacauuuuucuuuugacauggcagcccauggaggaucaguagaggcagaagggccagaaaaugaguagacaguuaaugccacucuucccauacacuaguuagugaugagagcccaagccaaagaacagugagggagggagugugugugugugugugugugugugugugugugugucuaggggaugucagaauuacuaacaacgguucaaccauaaaguuaaccuguuuuaggauguuaguauuacugacaaggguucaacuguaaaguuaaccugucuggauuuuaaauucuguggucuaccauuugcuauuuauguguguauaaucucuuucuguaacuauaaaaagaauauuuuauuauccacuuuauaguguuaugaaguuuggguuaguguguuuaacaugugccuggcauuuucuguuaacuauucauugguauugcuguuguugccauucuuauuaacauuaaauguuuuagcuagcagagaauuagacacuagaguuucuaguauccuaguauccaauaaucagguuuagaucuuuccuccaggucucaguugguccagguugcaguugucaaauaguuagcugagaguuugacaucuuauacucucaccuugggugccuuagaaauuauguuuuguuuaaauaacuauuauuuaauaucaacacuuuaacccacaaauuuguaaaaauuauuuaucaaauaaaacuuuugauacagacauugcuauuacaugauuuuugaguagaaaacuuauuggagagaacucuuaaaaagggaaauuucuucaaaaaguucuguuauaauaaugagaaaacccagaguugacuguuguuuuaaaaacaaaaaucacagcuguuuaguuuuaucagugaagauuuaggagccagaugcuaugcugaaaaccugcuaggucagagaggcagagaaagcacccagcuggccuuccuccuccaccaccauuccagaaggagagagcucauccuuuuccaagcugucuuaaauaccccucaacucagagacccaccuuuuuacguccuauguuuacuuucuguuaauuggucgcuugcucuguuucuuuaccuacaguagaguuuauuuaacuuuuguuuacagaaaguucuuagguuaaaggugugugcuagggcugagccacaccacaacuacuuguuuacagacaauagaaagcucuugcuuagaugaaaggucuguccuaggacugagccacaccacagcaguguuuuuccaguuacaaucuugggguucacaaucugaucaaauauccugcaacauuuccuccuuuuuggcuaaaacgaaagacucuuuaacaucaacaaacuauauucucucuggcaagaauauauucacaaugucugguccaguauuugauaauguuggagaaaauacuaucugaccuaucucagucaguucaaaguacugaaccuaaaucacuuucuauuauaacuugcauuugucaaccuaaaaacauccuuuuaaaccuaaaaccuuuccuuaaauccuuaacaacuuaagcucaauugugagaucauagcuaucuagucuucaacaguaagccuccugguugauaaagacuucaacgugguuguaaggaauucauucccaacgugauuagagaagaagaaagcagaggacauuugacagagguauuucagaggacaggagacaucugacagaacgcugcagagaaguuugccugggaucaucuccagagcaagcaucaguucuuagaguuugguuggaugcccaaaacacucaggugaccuggagcagcaggagcuuccgagacagcgacucauuggaucagagugagccaccccacaagacaauuuuaauucuauagacagauucuuccugcauuaaaaaaugggaaacuccauuucagauccauugggagcaaggguaggaccugaggggauggacgcaguacuugaaaaagucaucgcagugcucauugcauuuuuaaccagaauaagccccucucuacuuccaauugcaaucuuuauauuuuuuuuucucaaaaaacauugaaaaaauagcuguacagcaagaaaaauuagcuagguaguacaaaugcuugagagacaaaagacagaggaaauaaggaaacaggaagugguuaauuaugagccuauaguaccuaaugaaauugaggauuuagcuugaucaguguguaagaagcuuggcuagguaguauggagcccagcucaagaaccagacauagaaugcaaaugcccaaaugucuguuuuauuuguggauucauaaagaucuaauuguaccuugauaaacagaaagagggaauuagauuaccugaaagacacuagauuauaggaaaaaaaugcugaauuagaucaaccuguauacuuuaaagauguuuuaacaucagaauggaacucauggaguauguuaaguugaagagguuuugccuaugaaacacuggguuccaguaaaacuacgagaggcaugaaucaaggaaugaagagaaagcaacauaggcaccacagaaagcagauuucuucuccauggagacagcucaacaaaccgucugaaggaggacagauuguccaucagacuggcagacugggaaacccugauacugagaugggcaucuccugaaggacggaugaucaggacugcagcugugaaggaucauggaguccauggcucuuaauaaggacauucagacugguaaauuugugggacugauaauuguuucuguuguaaagguaaacuauacaauuuuuagaauagacaaaaagaagaaaauguugcaggacauuugaucacacuaugaacccagagauuguuuuauuuacuggaaaaagcuguuucuacuuguaguguggcucagccuuagcauacuucuuuaaucccucuagcuggaauauagacacacuguuaguacacacuuuuaaucccacacaaugaagggaaaguucauuuguagaagaaagcacguggguuugaaaaugaugucuaauugaguggccaacggagugaugaaucagagaaagaucugacagaauaguauaugcccagcucucaaggagaggaaaagagucuauguaagagagagcagugcagagaagaauagaagaauggcaguuuuucugggagaguuuacagagacagguugaagaaagaauaggccagacaaaggucaagacagaaugagccagagaaugagaaaaagucagaagauuagaauagauugccagaguuaguuugaggcuaagcagagcaaaaauucagagccccagagaagccagauugaauuggucaguuuggggaggaguuugagccagaauaacugaguucaaccagccagccagagcucagaaggagcuagaaagagugagcuuauuuagcagcaagucucagaagcugaaagcauucuaggccuagauuagauuguagggcgccuagaaguuucuaggagcaggccuagcuuagcagcuagaggcaguaagcacuggaggugacaauuauaucaggcgaauaaaagauacuuuuacaguugaaaguaguagauugaagucagagaguuuaucagugauggaguugggucuuaagccaggaaucugaagucuucucauuuuauuggugcuuaguuccuuugcuuuaaaacacacuuuuaaaaugaauauggguuuucugauuuaauuucucucuacauaaacuguuaucuuaaauuggacacauaauauauaaguuuagguucugucuuuuuaaaauuacuuuuauuucuaaguacagagaauucuguuccucaaaauaucuuggagacagaguaaagcaaaucagcugcggcgucaguaaacuguagucuguuaaaucuuugaguaauacaguaucgacguagaauugaugcuuagaugugcauucuacuuaagaauuuacaaugacuacuuagauugucucuuucggacaguuaugaaucagguugauauauuaacuugugcacagaccuuuguaucgucauguuuucauuucucuuggguagauuaucagaagugaaauuacugguuuauaguugcaaauuuuuucagaguuauugcugcaucuucuguguggaugaauuuccuccucuccuuccuuccucccuuucucucucucucucucucucucucucucucucucuuucuccuuuccuuuccuuucuuuccuuucuuuccuuccuuuccuuuccuuuccuuuccuuuccuuuccuuuccuuuccuuuccuuucucucuuucucucucucucuuucucucucucuuucucucucucuuucucucucuuucucuuucucucucucuuucucuuucucuuucucucuccuucucucucucucucucucuuucuuucuuucuuucuuucuuucuuucuuucuuucuuucuuuccuuccccuucucccucccucccucccucccucccucccucccucccucccucccucccucccucccucccucccucccuuccuuccuuuuguuugacaagguaucccugacuacccugguacuugcuaauggaccagacuauccuugaacucaaaucuaccuauaucugcuucuccauugcuaggauagaugugugaaccauuaugaaccuuugcuguugucuuucuauuguagucauucucaguaucaguaaacuaguaccuuugucacauuaauuuguguaggcauuucuugugguugauuacuuuggacuuuaguuugaauugccuauagcuuuagaagcucugaaugagacgcuuacacugguaugacuuauauaguagcuuccugaagauucugacuguccugugagcuaaaaucucaauugggauucuuuucagguaaaauaaaaaaggaagugcuggggcuggagagauggcucaguggguaagagcaccaacugcucuucuagagguccugaguucaauucccagcaaccacaugguggcucacagcaucuguaaugggaucugaugcccucuuugaaugugucugaagacagcuacaguauacucacauacauaaaauaaauaaauaaaccuuuuuuuuuuuuuuuuaaggaagugcuguggauguggcuuggggugagaacuuuuucuuuuuggcaugucacaguaaaaaaauaucugauagauaucacuuggcauaaaaauauaugagguuuccauuuuuucauaaauccuaauacugucucugauuggguguuggaagguauacugaagugaauaguuaauuuacagcuuaaauaaguaaaaauaccuguccaguucuuguguacaugugaucuuuucaucuugcuauauugaugaauuccuguuuagagaacauacagggcuggaggaacuguagacccaguuuuaccuggagauggugaugcucagugagugcuucugggaggugagccuaugaaugcaccauuaugucagcaggcgcuccuuccccuccacccugcaugaagugccuuccacgacagcauauggucuuuuauauggaaaagucauaaaacuggauaugaacuuguaauugugaacacaaaacgauagcaguuauucuuaggaaucugauaaaaacauuuaaagugugcacguaucuuagguagaugauguauuuacuuaauuuuuuaucuaaacaaguaguuugaaauguuuucugcuauaaacugcuauuguuauuaguuuuagaggugacaacuugucagaaaguaacacuuuguaauggcaauagaaaagaacaaaguacucaauguguuacaacaugaaugaaucucagaauauacuaagacucuaugcuguacaacuuuauaucuaauaggaaacacaaaugagagguaaauauguaaguuuauaggccagaaguaaccaguggucugugcuagaaguagaaauaaguagugauuauaagugaauaugagauuuuuuuuuaugguaacgaaaauguucugaauuagaauguggagaugguuguacuuucaaguaaacuuacaaacuuacuaagagcuguggaauuauauacuuuaaaucguauacuuuaaauaaaugaauaaauaaauaaguaaguauauuuuguggcaucucucaaagucuguuuuaauuucuacauaaaauaccuaagacugaacaauguauaaugaaaagacgcuuauugaaugcacaguucuaugaaggcaagaacacaacaucaagcaucacucauuucugguaaggaugucuggcuagcuacaucacagccugacuaacgggcucaggguaggaggaggggaagaaagaggaguaauuuagcaagacaagaagccagagauuuaggagccagccuugcuauucguaauacucugcucucguggggacugucuagagucaagugagaacuaaguuagucccuuuugaaggcaucgugaucucauuaccaccuacuaggcccuauuucucaaagguuccaauacuugguugccacacuagggacuaagcuuccagcacaggaaacuuugagguauacauccaaacuacaacauaaaaguuguguauuucauguaaguagcuucauaaaaagugguccuauuucagacauuuuaaaaaauaaaaucauauaaguacuuagaugcaauagcuccauacagagggcuauauauucuggguuuccuagugagacacgaguaaaauagaauaguuuccaggauguuuccacucuuacaaggcugccuccucuauauauucacagaacuguaugguaccacuuccccuuuacuguacauaaaaggacauuuuuauuauuuuucuacuguccuaguaacuuagauacuuauagguuaagcuuuccaagugacuugaaauaauuaagcauuauauccuauaaaugauacuuuucugcaguugagaaaauaaauguuaccacagagaaauuggcuaugcuauauaaauauuauauauaguaguauuuacuuaaaacuacaaaaauaaacuuguugcaaauugaaguucagaagcuuugccuauaggagaugccucaguuacgucuggccuuguguacaauaucaccuuguccaacugcacagaaacuggguaaaauagucgugcuugaauuuuuagaucacagugcugaauugaaauuaugaguucuuauuccauuacaaauauaguggcaauaucuuggcaagugauggucaguuaugauuaugaauggaauccaaucuggcuugaaaguuuguggcccuugggcagcacuaccucagucuuccugccaguuguguguuaaucuguaaaggaagaguagggugaguuugcuuuucauuauguuuuuucuguugguggauggagggggacagaaauucuagcacauuaucugggagcuuuaauguacauauguaguuuuuuacuggggcauaccaaaggaaaaagaauuacguggucacuguaucaauuaucacacuuccaaaagcuauaaaauaaauaccuuuuuauuuuugugugaacaauuagaaaucuauccaauagagauccuucuuguacucugaguccugauaacucaaaggucaaagaggaaugaaagcaaaaggcaaaaaccauggucucuuuggaaauggauauaacgucgucugcuucaaggaugguuguuaggauuaaaugucacuguguaaguaguugucacaguuuuuagugucucacuuuaagucauguuuagccuugggugaaauauuaccauguccaacugcagagauucugugacuguuguugacucaauaacugcagcacuuacugaacacuuaacauguaugcuccacgcugccucaaguaugucacacauauuuagucaucacaagaaugcuguggagggacuuacugcccuguuggugauuuuacaaucaggaaagucaggcuccaagaagccuagcaguguccaauugugcgaauacugagucaguggagcuguagugucuguaaccuaccugcaaagugacucugcaacccaagcugcacauuucuacuuuugauccacuugacuauggcugugaaaaguggcaauaaauuuguccuuuguggcucauucccuauuugaacugcuaucaagaaguuguagaugcuuaaauaaauaguagcaguaguuagucuuuauuaacgugguuggcuuacguuuuugcaaauuuuauucucauuucuuacuacuaguguagguaugugcaugccauggaggacagcuuugugagagggugcaggccugccuucugcagucaguuccaguguuggagcucagguuagcaggcuugcaggucaucugaccagcccagcaguacuuuuaaaugaagcauacugucauuuuugcuuagcagcagggcuacuuucucagaaugugucuuuuguuacugagaguuccuacagcugauguagaucauucacuguggucucucaguguagcuggagucauauaugugagauguagcaggcuucuccuggucaccugaugcacucacucucuugcaguagaggugaaucgauacuuaguaaacauaguaacacucuugucacuuaucaggcugucagugcugucuagccauagcugcauguccuccucuuucauacagaugugguuugugugggucaguuucacuacaaacacaagagagauaagugcuguucuaggauggccccaaggucaccaggugacagggguguaggucucaguauaauguaaugccucauagguggcucaguauggcucauagaugacauaugcgcuuauaaugcaguacuuuguugaccaaaugucaguggugcauggcuguuguguugacucuauuagaaguguuguuaauuacugauagguuauguggauuaauguuuauaacuauguacaaagcucagagaauuuucauuaauguuuaugaauguuuuuucuuuuuuuuuuuuuccauuuuuuauuagguauuuaacucauuuacauuuccaaugcuauaccaaaagucccccauauccacccacccccacuccccugcccacccacucccccuuuuuggcccugguguuccccuguacuggggcauauaaaguuugcaaguccaaugggccucucuucccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucauaagagacagcuacaucuggguccuuucaauaaaaucuugcuagcguaugcaauggugucagcguuagcgugaauguuuuuucuuaacauuaggugggguaauaaaauucauggguuuuggagaucccccccuguauuagucaggguucucuagagucacagaacguauggauagucucuagauaauaaaggaauuuauugaugacuuacagucggcagcucaauucccaacaauuguucagucgcagcugugaauggaaguccaaggaucuagcaguuacucagucucacgcagcaagcaggcaaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacaauccaccccuugucaacuugacacaaauaauaucucauguucacaugaaacaauaacaagguuguaaauacgccuaacaugauauaacuaucccucguacaaucgcaaacgcauuaguaaauuuacaaugggcauucauauuacuuuauaauccucguuucugcaacugguuacguggccuuaauugguauuuauaacuaccuuccucuacuacccauucuguauuuccuucaccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccugcacuccagacauaaucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaaugaaauguuuguuguagcuccugguaggagcacuccccucucuggagccaaaacuucuaagccagcagaaccuagaguuauggggacaggaagcaaaaauuuuccuagagggucacuaggagugauaguaaguggaacuauuccguuuuccaccccuugauuccuggacccaugaauccuggcuaugggugaaacuguaccauauaucgagcgcugauucaaagcauauacugccuucugaagaacucugccccagccuuccaagcuguuaccaccuaauuggcgcuguaacugcgucuucaaaaggccauuccaucuuucuaucagcccagcugcuucaggaugauggggaaugugguaagaccagugaauuccaugaucgugagcccacugucguacuucucuggcugugaaaugaguuccuuggucagaagcaauacuguguggaauaccaugacgauagaugaggcauucugucaguccgugaauggugguuuuagcagaggcauuacgugcaggaaaggcaaauccauaaccagaauaaguaucuacuccaguaagaacaaaacgcuguccuuuccacgaaggaagugguccaauguagucaaccugccaccagguugcuggcuggucaccucgaggaauggugccauaucuggggcucaguguugguuucugcuguuggcagaucuggcaaucagcagcagcuguagccaggucagccuuggugaguggaagcccauguugcugagcccaagcauaaccuccaucucgaccaccauggccacuuuguucaugugcccauugagcaaugacagggauggcuggggagagaggcugauuguccacagaacgggucaucuuauccacuugauuauugaacuccuccucagcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugagucaguguauaaucguacaucuggccauuucuucuugcaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucagucgaucauagggaacaccccaugggcuauaggcacauguuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcgcgucccacuuuaugacuugcagggucugauaguacccagcucaugauggguaguucaggucgcauaguaacuugguguccuauugucaaacguucaguuuccacuaaggcccaauagcaggccaagagcugcuuuucaaagggagaauaguugucugcagaugaugguagagcuuugcuccaaaaucccaaaggucuuuucugugauucaccuacaggggccugccagaggcuccaaacagcaucucuaucagccacagacaccucaaguaccaucgggucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauagacccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugauccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaacgaaacuacaucugguacagcagcugcaauuggaguuaccaccugauuuaguuuucgauaaucaacugucauucuccaugauccaucuguuuucugcacuggccagauaggagaguuaaacggagauguggugggaaccaccaccccugcaucuuucaaguccuugauaguggcaguaauuucugcaaugccuccaggaauacgauacuguuuuugauucacuauuuucuuuggcaaaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaaucaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucagcggaaccuggccaccccuucauucaagggguucuggaucugcaaacugucucaagucuggaaauugauucacuggccgagauugcuguuuaccacgaucuaauguagccuuucuuucauuuggcuguuuuccacgaucuaauguagccuuucuuucauuuguuugagaauuuuucugcuuauacagaucaaacaaauaugcaguaggcuuccuauguauuucauuccuggaaacaccaugauugguuagccaguaccaaagguccaaccgagucaugccauuauaaauuucaccucuccugugcugaccauuacuggguauguuauuauaaacauucuuuugucuacgcuguccauuauaauaacuagaaucaccuugucucgggcgauucaaugcugccaccuggcccuuguuaccucggaauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccauggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagcgaauuuccucauggacuacacuuucuaccuccccucuaggagccuguuuugcuuugagucugguuacaggucuagaagaaacuauuggugggccguaagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccgucccauguuguaggaucccauucuuugccaauuagagcccuuacuuuaacugucgacacacucugaggcugagacuugaauuuucucuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucacccaauucauuaagaaaaucaagggcauuagcuucuuuaaguucggaauauaguuucaaccaugggucuucaaaauucucugagcucccaggagggagagaaucuggagagguuucaauauuugaaagugcugguggaucaacaagccaauuccaguauuuuaaaagauucauccuuguacuucuguuacucuagaaccacuccugguaccaacuucuguauuagucaggguucucuagagucacagaacguauggauagucucuagauaauaaaggaauuuauugaugacuuacagucggcagcucaauucccaacaauuguucagucgcagcugugaauggaaguccaaggaucuagcaguuacucagucucacgcagcaagcaggcaaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacacccccccauacauuuguuauaaaaauaugagcaacacuauuuggugauaaaauaaagaugaaguaaaguuuguguuuggucuuuuucuguaguuuacuuagagcuaaagaaagucaucuuuuaguuuuuaagaccaaacuauauuuuuaauauauagcuuuugaaagcuauuuuaauaguuuaaacaauuuuuaaaauaauuucuacucuauaguaauugaaauaacaucaaaaaucuaaauaaucaguaauugagugguauugauuugacuuuaaaaacuuuaagaaucaauaugguagauuuguuagaacuuacauguugaauuuugaccucuuguuggauaauaaaaauauauuugaacuacuuuuuuauuguuaguagaauacugugggucaaaaauggggucccgcauccagcucgccacagggcuagggccauucauggagguggaugugggaaguuugacugcgcgcaucccacagccccugccaggcaggcacuggacugugagacacuccucugggacuggggaaggugcagucugaggucccuguggaccugcuggaagcuggcuugggggucccggcccacgcagaggucuagacccacagguucucacucuugggcacugcagaugucacugaaugccguggaagagcugagaacggaguagggggccugcagggcuggcucuggccuggagccgaagggaaaagggcaggaggaaggcuccaacagcuaguuaucugguggagaguccuuuggcugguugguggguagcugacuuggcuggcagccguggcugaaacacagggagaccucccaugggagguuagaugcaaggcucauuaggcgaagaccugcuccauugcuccuacacaucagauccugaugagaagaggcaguccaugguuuuaaggcaucuauuauagaaagauagagagagggagaagaguagagaaguagaggcaggccacggccacauggagagaggggagagggggagcaaaaagagagagagagagagagagagagagagagagagagagagagagagaaagaaagagagaaagagagaaagaggguaagagaaaggaaggggcaaagagccccuuuuauagugggacccuaccuggcuguugcaagguaacuauggggaggaacaugccuggcuguugccagauaacuguaagaguggaauccagacagaauaccaggagcuugggcauugccgaagugacugauggccacacuccucucugccgggggcugugggaggcuguagcuaugaaaaggggccgggggcccagggggcuuggcugaauaucugccaucccuaguaggcagaagccaccuacuggaucacagggguucaaggccugugcucagaccugagaccaggcuaucugugcacagcucaccgccccacagaguacuaaaucuuuuauguucucacuaguagacucuucacaauucaugauccaaaguuaguuuaaauagaaaaguagaccuuaaauuaucuuugcucagauaacuucauaggaaaacuuauuaaucagacaguacuuuaauaaaaccacugagaacauacuuggugucccagcaagcuggaaaguaaacaguucuuguaaauuaugcagggugguguugguuuccauuaccagcucucuuuaaaguugggccaggaaacaacacugcuguacccugcuucugcuucucccagcacaugugaacugccaacuacugacagccuagaugucagacggaaagacuggccuggccacucuccacagcaguguacacaaauauuucuauugagcuuguaauauuuauuuuguuucauucuguuagucauacuuuucuuugacauuuuuuaggaggagacaaccugcuuggcucagcuggaguuggaugucuggccuugggucuuugugggguugggggaagauaugcuggaucaaauagcauggaccuggagugugggagucacuucagaacacagcagaacuuuaggccuuuuaugcuuagugaucucauuuucccuaaguguauaagagauaaguaugguacaugcuuuuaagauuuaauucaucaagaccuuauguauuaaaguuguuggcuuuucauuaguaguuaauaugagacuugaaaugacacaguguaacuugugucacuaccuugagaguggacaggcaggaagguuauucaugacuauuuuugccucucagguggcaaccauuguuuguuguuauggaguuaggaagguuuucuuuggcucccucagcacuuggccaucucccagucccacuuuacaucugucugucaggcucucuucccucugcucccaucugguccuuugugagccagcugagucuuuucugccacaagaaucuuaccuggaauaugguguuuccuugugcaaauggcauguguuaguguguugguucuucaucuuuuuucuguuuugaaauguucugugugugugugacuauguccuuuugugggauuuaaauauuugacuguuuuguuaagcuuuuuagcuaaaugguucuccaaaacccaaaacucuuaacguguuuucuaccagagacuuuauuaaugagcauuuguagcugcuuuccccacugugugguuccuucuacucggucuucaugugagauugcauucaaaaccacgcugcuuaguccuaaccugacacuuacugguucuugagaauaugaacuauuguuuucucuugauuuuucuaaauauucugucacagucagaaaaguaauacgugucuguaauaggaaaauggaaaauucaggaaguggaagagagauugaaaucaauuucuauugggcaugguggugaaaucccagaauuggagaggcagaggcagaugggucucuaagaguucaaggcuagccaaagagaccccaagucaaaaaaacaaacaaacaaacaaacaaaaguguguguguguguguguuuugcuagggauugaacccaaagucuccugcaaauuaagcaaguacucuacuaccgagcuguucuccaggccucuaaaacuacaguuauuucuuuaauaauucucaagauagauuugugugcagucagaagcauugcgggcauugggacaucagggccaugcguucagucagucucccuucuggccauuguccacucuguguacugaacuucguugucguagucagggcugguugcugcgcucuuccuuucgcccuuucucaccuuuauguccccuccaugcccugcuugaaccuugacaucugugcugguucaccaucagcuuguuuuuccugcucaagcugacagccuuaauacagagucuccuuuccuaucccauggauagcccaggccugagccccucugugucuggcaaccugguguuaggucccauaacccuguuucauccaguugcuguagcagugaauuguccgggagaaguaaggggguaggguccuggagggggaaagaaacagugugcauaucauaaguguguagcagcaagcauaguguaagguauuugauggcccuagugucaacaguugaauucacacccugccauaaaauaccuaccuuucugguuucuaaaacucuuuuuuuaaaagauuuauuuauuauuauaaauagguacacuguagcugacuucagacacaccagaagauguugucagaucucauuacggugauugugagccaccaugugguuucugggauuugaacucaggaccuucggaagagcagucagugcucuuaccugcugagccaucucuccagcgguuucuaagacucuuaaguugacuuugagucuucucuuucuuugaacauguacuuguuuguucuugguuucuucaaguuacucuguuucucuagaaaugaucaaauaggcaauauaacacacagacacaguuugugcuacugaguucuggacuuuuuacauuuccaucucuugaauuccgguuauaauuucugcuugucuuuuccuaacguguguguguguguguguguguguguguguagucccaguacucaagccaccaaucccugucuuuguucuucugcauaucaagguccacaaaggucauguuaucccucaaucauaguguuuauuugauuguuuuuugaauuauuuaugcaaauauuuguuguagaaaauuuuaaucccaacccgggguuucuacccugccuuugaccauucaguuccuggaugaaagacacauacaacuuuuguuuuuacauuaagccuuaaacagcacaacagcugggcagauaccuaccugcugugcuauuagaaucuacuuuccuaucaauaacccugaguuauuacuuaguauguuccaucugggcugcucauaacuccaauuggccagcccucagggccauguucucuugugccuucuccaccauucgccuuguucucauucucaaugauuuucuggucccaagccaggaaauccuaaacuucacauaugucucuucuccccagcuauuggcugugggcaucuuuguuuuccaaucagacauaacuugggggcaaggccacauagagucacuuggaucuaugugcagaccccaggucuugggggcccacacuuagcauuacaauacaaagcaagaccaaaccucaacaguauuuuuucuaugguacugacuccuuagagccaaauccucuaguaauuauuuuuuuucauuauauuaaagaguauucuucaaagcuuguuuuucaaaauuugaaucaguguuucaccauaucauuaacugguucuuccuaagcuguagaaacauggucaugauuugugaauagauuguuuauauggccuauauauauuauuaaauguuugacaaguuuuuuuaguuuucuuagcuaaauguuucuauguaucuuauugaaaaaacaugugacugcgugugcgugugguugaaugugugugugcgugugugugcguguguguguguguaucauauaguaucuuaggguuaguacagggaaggugugguuuugaauggcuguggaaagacagucauugguuacaauuaacuuaggaugaauggaagcgucaguaguuaaugagguguuauuaucuagugccuagaauuugccccccaacuuuuauuuuguguggguguaggcuugcauguaggugugugugcauguguauaggucagaggacagcguuaaggaguugguucucuucuuucacuguggguuagggaaauuaaacucagguuguuaggcuugcuugacaggugcccuuaccugaggaauuugccgccccaagaaaaagucauagucuccauagcaaaggauuucaggucucuagucaaccaucuuuauuuucucuaguaauaccuuuuguuauuguacaauccuggugaugacugauuaaaacaguaagcaguaguuaagucauacacguuuauaggcucuagaguuaauguucauuccauagcuuagaaugauuuucacaguuacacucuaucuggauccuuaccuucuuucauuacugucuguauacugcagggauuauagugggagauuuaaaaauuacaggauauuugucuauuugcagggggagcauaugcacugucacauguuuguguaggucagagaucaacuugugggagccacaucucucuaagcccagcaugugggcuacagggcugaacucagguccucacacuugacagcaugugcuugugcauaccaagccuaaggggauauuucuaauagcuguuguaaacuuacgauucuacugaguuaggacuugauuaaaaacaaugauggaaaugaccacuccuugguccucaggccacaccuugaggucuggcaucauuaucauucacaaggaaugaugcggcaugauuaaaccucuuccuuuaguccuccucacucaagucacugagugucuggcauacaagcauugauuccuuugguaaagggaaacagauauuuuuagauuugucugugaggcaguaguuaaaaauaaaacacuguggaaaacuuuaugauuuucagagcuuugggaccuugacuuuggaguuaaauauuguuuaaaagccagaauagcuagauccuguuaauucugggagauuuaucugcagguccuaaguucuagagcaagugucgguuacguguuuccacugugugcuuuacaaacaugauagcgcuugugaugcuuuacggugccuaccagggcggcggguuucggagcauugcagcuuucuuucauugcugucuuaauauuucauucuguuauccacugcuuuuguucuuacuuugacucccugccuuuccuuuuuauuaaacuuaaagauagaucauuauggcagcacaagcuguaguuuaggagcccaggaguugaugucagguugugugucaguaagccaucuaucucuccagccccucaagacauuccucaauuuuuuuacuugucuuugagauuuuugggggggggggggugguugagacaggguuucucuguguagcccuggcuguccuggaacucacuuuguagaccaggcuggccucgaacucagaaauucgccugccucugccucccaagugcugggauuaaaggugugcgccaccacgccuggcgagauauucuuuucaugcauuuaauggauacauucuugcaaacaaaggcagacguguaaucaucugauauucgucuagggggucaagccguggagggauuuuacauagauauagauaaaacauuugauacuuaugggaauuaaagacuuguuucucaauguuucuuacaugauauucagaaaaauaagagcauaguaguaguauuagggggaaaguuacaacaacauaugcaacuugaaggaguuauaggguuuggggaucaaacuuaagucaacaggcuuggaagcaccugcaucuauugaguuuuuagugugugguaguuuaguagucuguuuauuauaggaauugggugauaaaaguuguaaguccaggccuccuuucacuuaaguacauuucuagacuuuuagucuuuuauaucaucuaagcauccaguacaauaaauacacuguggacagcuaccuuugguaagauugcugcugcugucucuugagccuuuugauauccuagcugcugaucuaaacguagugacuauagaaguaauuuagcccuuaaaaguaguguuuugguguguuucugagaacuacuuuccuagaauucuugagugcugccuguuuacugucucgugacccaaccauucuaacaugugugucugauaccaucgauuaguuccgauuguuccugaggagcccgaggcagucuuucucuguaucugcuggucuucucuuucuuaucucuucccuccucuuccucucugccuucuucauauuauccuuuuuauuuuguuuauauuguguguagaaagauacaaaacaaaacugagaaucaaagcagaagggaauugauucuuguuaguuacuacguagugguaaugugaaacacacuuccuuucuuagaugauugagucauacagcugcuggagcagaccuggguuugagaacuaggcucccacaguaguaugugcacuguggggaaaaaaaaaaauacggugucaguauaaagcagcagggaaaagugcuauucuuuucauggguguuagggauggucacuguuacuaguuccuggguccuuuguaucuguugcagucacugacagugaacacagcaguguuagcuguaggagucaguugugaguauucauuucaauuuuaaugguuuuguuauuaucaauucuuuuuuuuuuuuuuuuuugguuuuuccgagacaggguuucucuguauaacccuggcuguccuggaacucacuuuguagaccaggcuggccucgaacucaaaaauccgccugccucugccuccugagugcugggauuaaaggcgugcgccaccacacccggcuaucaauucuuuaucucaguuucuuuuauaucuguauugauuuaaggaugcugcuaugugcuuguuuuucuuguuauguuuuuauuuucacaucugaauaagccaacauaaaaauaagagcaaaggggaaauaaguuagaugagaacguaguagaaauggaaacuccaaaaaggaauuggaugucucugcacuuccaggagcgcugauauucauagggauugggauuucagacuuguagggaugagacuauagaguuaucuuugcugucaauaugaggaguauugcaagauagaggauuguagaccuguuguugaagcuguagauaaggaugaaggaugcaauguagagggcagaacacuuguauggucccuaggagugagaagacagcaguagauaagcucugguuagauaaacccagcccagucuacugcauucacauaccuccagaacaauggcaagaguguugauaaaguugcuuacugucuuagacgccagacaaaaugguugguuacaaauaugaauugggauuccagaagcuuugagaauguagaggaaugccuucccuccuugaaacgccaucacaacagcguuuagcuguuucuuacugauacuagcaaaacacagccauuuauauugucugcuccaaacugcacaccuuggaggacugagggaugcaaagggaaacggugaugaaacagaugagauuacagagacaaaaauacuaaguuuuuucccuaguugaagaugugcugucuguauaagauuccucuucuacccagggaauauugcagucgaguuguuuguagguuuguaugacauuaaaacagugauauacuuaaugucuuccugauuuuugauggagaauuguuguugaacuugaccaugccacuuaauuuuuauauaguagaaauacaaaaagaacaccuaucagguuucuugacuuagucaaaucuucuagguguuucugugucagugguaaaacagaaacugagaagccugucaaguuguuuuuuauauguugucuuucagcucugcaaguuguucuugauccaugguccuaauacuccauaaggcauuguauuagaguggaaacugcccuugcucucucccaucaaucucugaauaaaagagucuccagucaaacaacccauuuuaccguuugaguuuguauaggaaaacccucccaccagcccuuucauguugcuuuuacaagaacaucucagugugaaguaccucagucuucaaaagccauccacuuuauaaagccacugcuuuauauagagccuggggcuagugcugguggucuccuaccguaugcugaguagagaagacauuuccauagauacuggccuuauuuucucugauuuuaggguuguagcaaagguauuucugugucuauguacuugaauugcuuugaaauaaaacaauguucuuuaaaagagaauauaugcauucuuucacauaugaaaacagcuuggggaaaauaauaauuuauauuacuauguaacucucuaguaguuuggguuauugucucaccaaaauaguugauguguuggaaugguugguuguacuaguuuguuuuaucuguaugaauguuuugacuacaucugugaccaguuuaguguuuuguuuuguuuuguuuggguacagggaauuaaguggaaacuaaagacaauaagauuuaaauaaauaacugaauaagaacaccaaagaaugacuggucauccugcccuggucaaagcugaguuccgacaacuuccaaguucaauagggauagacaaggaccuguauuuugcuucuuguuucuuccucugucuuuuuaccuauuuccucaguuugcugacuuaaacuggugugguagcucacaucuguaaucucacugcugaggacgccgugcuaggagguugccgugagugaguccagucaggguacagaguaagaucugucugaaaaagaaaacaacuuugugaucugaauguuaugaauuugucauuugggagauuuuuuguuucuucuugauuguacuagcacugugguaauuuuauuauuuaaacugaagaauucuuuagggcaugguuuuaaucugacuaucaucuuagguuuuuuuaauuaaccucacccucauauuucagauccaauaauacuacugugaaccuggaaguuuucugacaagcugcaaggauggugcuaauacugcucauucuguaggcagcucauugagagccacugcagcucagcacuaaccucugacauccaaggcagagccacaucugugugugugugagaaacacugaggagcucugaagaccuggugccagcaaugcucaucuaacacaguauugucuuucuucauagauuggagccuaugaucaacaaauaugggaaaagucuguugaacaaagagaaaucaagguaacaacuuuguuuuguuuauuuugaagcaguucucuaaauugucugucacuuugccauuccauuuguguugacuauauuaguuaauauuacuuuaucugacauuuuaagagauaaaccuaugauuucauaguccugucuuuuacuucguuuuacucuguagcaccuucccuucuuuuuacuuccuuucuaaugaucauguuuuuugccagcuuuccccuuucacuugucaccuuauacuucuaguuugcuuuuccucucucugaugcugucauugcucuguacaguuuauuaaacugguaaguguuucaggaugcucgccaccgagugauucugcaagcucugcugugcuucuuagggaucugccuuuugaugcuacuaacggagugucuugggugcaaaaagacuugcugaacuuaaaggggauuuaggaaacuagaauauuaacucaaaugcuuuucugguaggcacuuuuccucuggaccgugugguuacuggucuuauucugauaggauauucucauaggcucucuggcuagcaugaaaaacaguuuuagagcuaaauuuguuguuucucagcauucuuugauaauaaauuguauauauuuucauuugcuuagauacuaaucaguauguucuugcaugagcuaaauguaauuugggccuagagaaugucacuugcuauuuucuauagaaauauuagauuaguuacuuaaaaaaucugcucaaaagauuucucacuguucagacugcaucaucuauaaaagcggaaauaauucuuugauauuuaauaauuuuaaucuuuaaaguuuuuuaaauaauacauucauuuagcaaaguucugacauuuuacaauaagacuaaaggucacuaggucagaaagacaaggcuauaguuucuaaguccaauauguuauuacagauaagauaaaaaucucugaauagaugggccuauguucagucucuaaagguaaaugcggaaggaaaauguaugaggagauuaggaaagauuucauagacaaaacagcuugagagaggguuugacacauucuggacagucaaauagggaagacauaccagacagaugaagggcguaugaaaauauccaggaaggaagggagggcgagggcacugaggaaggaaaccuucagaaugugauuugguaauuggcuugaggaagaagaugaaggugaugagcaauaaagcaggaaaggaaacuguaagucagcaugugaaggcugugaggccugacccaaggcauaagcauagcuuuguaacagccgggaaggcacugaaggacuuuaagcagaaaauuaauauuacauuuuuauaaauuccuuaaggcagugauagguaugauaggaaauauuggaacauagauuuaaaauuguuuuggaaauagccagguagaucuuaugaguccuagguguguaaccuuugugugaguauagguauagguauggggaugcuguuguacauauuagguauuaugugucuauuaaucaggcaguuuacuuacuauauagauagaaucuauauguaaguagacuuucauugaaugaugaaagaaaauggccaaaaccagaacauugaaaaauaccaguauuuaaugaauaugagaagaaagaaggaauaauacgaauuccauuagcagacagucugaugaugugucaagaagagcugaaagugaaggugccugagagauggcuuagcguuuagcagaucuggcugcucuuccaacgcgcucagauuugcuucuguaguuccagggaguuguaaucuucuggcuuccaacggcauuguaagaacacagugcauauaugcaggagaaacacccaagcauacaaaauuaaaaucaauauucaaaacaaaacagagaagaggaggaggagaaggaagagaaaguagagaaaaaugacuagaauaggcaaaugaauaggaaguuacagagcugccaaaaaaaauuaaaaauuaaaaauuaaaaaaaaaacagugcugagaagguugugagaaaauagaaccccauugcucacuauaacuauaacaauguaaauuaauauagccagaauagaaaauucaaagugaaacuacccuauuauccagcaacuauucagggauacagaucuggaggaaguaaagucagucuaucaaggaaguauccaaaucuacaucuuacuacuguacuauucaucauagcuaggaaauggaagucucagucuucaacaauuagugauggcucuccuguuuauuggaauaugaauucaguuggagcuaguuuuaguuacuguucuguugcugugaugagacacaaggcaacuuaaaaaaggaaucauuuaauugagggcuuuuuuuuuuuuuuacaguuuucgaggguuaguccaugaucauaguggcagggacauggcaaaaacggguggggggcggggggggggcggggagaagcauggugugcuguaacuguagcugagaacuuacauccuccucugauggagcagucagagacagagagggagacugggccuagcuugagcuuuugaaaccucagagcccaccauaagagacaccuccuccaacaaggccacaccuauuccaacaagucauaucuccuaauuucccccaaacagucccauuaauggcaagccauacauaaagauaaaugagccuacgggggcuguucucauucaaaccacuagaaagucauuauauuaugugaaguaagccagccgcagaacaacaagaacugcacagguucaucacacgugaaccuaaaaugauguuuaccuggagguugaaagucggugguggauccuaggcugguagggagagaaggaaaauauguugacguucaaauaugcugcuacacaauuauguacuguauauuuuaauucuagauaaaaggauuugaauauucucaccauaaauaagugacaagccuguuuaccaugaucuaaacauugugcaaugcauacagaugccucauaauuauguacaguuuaaagccucaaauguuuaugaagucacuuauagaggaauaugagggucuggaauuaaacuaguguuaguguccuugauagaauaugaaggugaugguauuucuauacacaagaagucuaugucucaguuguuaagaguacuacugaugggcugaugagauggcucaguggguaagagcacccgacugcucuuccgaaggucugaaguucaaaucccagcaaccacaugguggcucacaaccaucuguaacaagaucugaugcccucuucuggagcugucugaagacagcuacagugcacuuacauauaauaaauaaauaaaucuuuaaaaaaaaaaaaagaguacuacugacugcucuaccagagguccugaguucaauucccaggaaccacauguggcucacgaccaucuguaaugggguccggugcacauuucuagugugucugaagacagcuacaguguacucauaaauaaaucuuaaaacaaacaaacaaacaaaaaaggucuagaucacugagcagaauacguugugauuuaaaauggccuuaaugaguuuuuaugucauuauccauguacuuggugcuuauaaaaacuuggaccuuagagaacuuccugcuaccagggcuguggcauuauagggauagguugucaguuucauacaaaagccugccuuugauccuugaggauuaagugacacguguacuccuucuguguacuuuuucauuugcuccugagugggugcuucauucugcuuuucucagaguguaguuuucugccugcucuccucccuccgccucccccaugccaggcaggcucuccuacuaaggagaacccacagccuguacugacuguuacuuucucauuaaacauaggcucacaguuaucguuagugugcaaacuaugcuuguuuauguaaauguauaaaccaaagaaaauuaaaaguuuaauucgaaucaguguaaauuuuccguuuauaauguccacuuauuuagaaucauguuucguggaauacucauaccuuggugauggcaucucucguuuuugugacuaaaauuaauucuuuggugaaaguuuuugccuaaaaaaugcuuuaaauauuuucauagacugccuucaaguagauuuuacuuauuugcuuguuuguuuauuuuuauuuuugagauguggucucacuguguaucccuggcugcccuauaacucacuacguagaccaggauagccucaaacucagaaauucaccugccuuaccugucaaguguugggauuaaaagugugcccucacacguagucucaaggugacuuuuauugaaauggccauuguagugugccucuguaguguaguuauaguguaguuagugcaaaaucaaaucaugagaggacaccaggagcugcaucuuccaccuauaagaagaagauagcuuacuguuccccuuacaaggagauugcgcuuacauauagaacaguaacuaaaugacacugaaaauaaaccuguauguauacagcaggaaaugaugcuacagauugacaggcuauuaucaaauugauaaagaaguaauuauaaaagaaguaaauaaaaaucuguaaccucaaauauuuuauacuaauaaagauaaaaaucccuuuauaaguuuuguacaaauuaaagugguucuuuauuauuaaaauuguauucaaauauccagcuuuagaaaguguugaaaauauguauaauuuaucaacugcucuauaguaacuuuaagugaaaaugaaguauggcuacaguuuauuauuauuauuaaucuuacuuucuagauagucgucaugaaaauggaaugugaauacugaaccacuacuuguagugggucuucugggccuuuggucacuacacuguuaacuagcuagucagcacauacuguuacguauguuucuccuaaagaugccacugauuuacugaucaugguggcuccuguaguucuagcaccagaauugcagagcgucgacacggguuaagaauucaaggucagccuugguuauguagugagucaaggcuaaccugguccaguucuuaacuuagggauaauuuauuuucccaugguuuuguucuccucacuaaguuuuaccuuguacucuuuagugauagcagaaauuuagugcuaauuaaaauccacuaaucucaauuuuaaauuaauucaauuuacgguaacuguuuucauaaccccuguuccugaucauaggaucuuaaguucugaggugaugagaugacauuacaguauggucagcaguuggcacucaagagauguccauccucuuggggguucugcugguaucacccuacgugcuagcaucugcagagaaguuugcaucccugucuuguccucagcagcaccuccagcaucaucugcgugccucugggcccagugucccucccuuagcuucacuacuuccuuacugcucuaagccuggcagucucccacaucaucuagggccuaggcuguaugcucauauugcuugguguaugacaucuuugauuugaaaguuuacuguccauaauaaauagguuuugcauguugcacauaucucuaaacauuucuuuuggaaaauaauaaaguuuauuggaaugcuguaauguguuccauuuguaacaaaucuuuaauguaucuuuuuggcuaauagguuacuucaggauuuucuuuuaaauugaaacccuuauauaaguugguuaccucuuugcuauuuuguuuggauuuaaacaaaauauauuuagaauucuaauacugcuuuuuacuauauuguagggcuuaaggaauaaaccaaagaaaacagcacaugugaaaccagaccucaucgauguugaucuugugagagguaaguccuggauaaguaacugcagguaacagugguccugaggagacaggucagaauaguguagacauggaccugugcagaaauaaggcagcucuagugugcaugcggacaggaauagcauacaugagagagaacacaaacaccaaccugguuuuccuuccuugaaauauaauuucaaggaauaguguaaaagaauaacaguuccuauuugcacagcaaacuguaaagccuuaauauuaaauuuaaauuguagcugguguugaggcagauagcuaggacccuagcacuuagaacaaacaaacgagugagugagugaaugaaugaaugaaugaaugaaugaaugaaacaaugggaaaaaaaaaaccagggucacauuugguaacccugagugauguagaucaugcuggguuuaaagucaccaagagucacccagcuccgccucuugagugcuguaaagauucgcguacaugaggaggcuggagggugaccucuggugucuuccuggaccauuacuugcugagguaguguuucuuccuuagccuagagcagucauucucaaccuuucuaaugcagucugccacccuuuaauacaguuccucagguuauagugauccccaaccauaaguuauuuuuguugcuccuucauaucuguaguuuuccuacuacacaguguagcugcuguguaacuucaugaccccaaagggguugagaacugcuggccuagacuugcugaugggguucguuugcccccaggcauucccuuguccaguuucagagggaugggauuauagacuggccacucgcucccaggcuuuacuaagugggcacaacccccccuuacuaauuacaauuccuaaugaauuaaguccuggguuuuguuuuuuguguuuuuugcuuuuuuugaaggcaguccugcaacuuuauuugacacugagcagguuaguucucauucacauugaccgucuguagaguuuugaauguaguaacagguaauaaauuaccaguguguagagcuuguuuggggaauccucguccucguuacgcuuucuggacaaacguacucggaugugauggaacauuccuuauuuccuugacccagaugguuuuauugaaccuggugucaauacgcacaucugguguccccauuuucuucauggcaaacuuccaaauuucagugagugcccgaggagcaugcuucuugaagcccacuccauggacacgcuugugaauguugaugguguauucucuagucaccaccucguugauggcagaauagcccuucuucuucucgccacccuucuuugcgggagccauucugcugggccuaaguuggaaaggcauaaguccuguuuuaaugaaagauguggaagaaauccuguuacuuccacugaaaauuuuuucauaguauauuuuaaguaugauaacugaaugaguaagauugcuuuugaaaaugaccauacuaaauauuuuuuagccauagaaaaguaaaauuguaugccauuucuuguuuuucaaacauggaauuuauuucuguaggaaauuaaagcuuaguaaguggagucugccauuauauuuuauuuuucuccucagggucugcauuugcuaaggcaaagccugaaaguccuuggacuucucugacaaggaaagggauuguucgaguugucuuuuucccuuucuucucccgcuggugguuacaaguaacguccagagucaucuucuccuggcuucuuguucucuaucuucuccaagguauaaggaagucaugcaaagcuaacuuggaggauguuguauuuuaaugauuauuaaggcuuuguucuaaacauguacuguuacugugcaugaaguagcauacaaaguauuuagauauuuaaaaugugugagcugggcggugguggcgcacaccuucaaucccagcacuugggagguagaggcaggcagauuucugaguuugaggccagccuggucuacaaagugaguucuaggacagccagggauauacagagaaacccugucuugaaaaaacaaaaacaaaaacaagugugaaggcaguuagauuccugggggccaguaugauaacauggcagagggagaaaacuaauaacccagaguuguucucugcucccacauguucucuguguaaggaggggaagaggagaaggaggaggaaagagagagaaacaggauuuuaauuagauaaaaacuuuugcaucuaccacacauagauacccacuugucuuccuuguguagcauaugaugaccuugaacuacagauuuagcuuccugaguugagauuaucaguggagggcaucaugccugguacauccuuuuauauauuuauuauuaauaccacucugcaaguuaauuuuuucugcauaaaguauggcuuauuuucuguguuuaccacuaugauuugauccaugcuuauuuuauguuaaaacuuuguuuagaccagccauucucuuaagugcuuuuccagauuccuauuuaguagcuacaguaacccagcagaggagaaagacuguuauugcuucuaccuguauggacauggcacuugaaaagccugagguucugaccuuaccucucccauaaacuuguagucaccaaggcacauagccaagcacucugacucgauagccacagacagagcucuugucucgcauccccagcguucuauuacagucuguuaacaugcguugucuacaguucggaaguuucaucaagcacuaucuaggucuuacaauuuuuaaaaauuauuaauuuucuguuuaugaaugcuuugcuugcaugcauguacaucacauacaugcaugccugguucuccagaggucagaagagggcauugcauccucuagaccuggaguuacgaucugcuggauuaugagugcagcucucauucuaggaagggggaggauugccaugaguuccaggacagccugggcuacuuaaugagaccuggucucaauuauaacaaaaaggaaagggggugauuuuuuuuuuuuuguuaacucguauaaaucuuaaaacaaaacaaaaauucaugccuagaguuaccaauauuguggcaaacuaugauuacauuugugccaagguagaagaaauacaccuguucaggacaaacucgugaagguuuuaugcccagcaaguuuaggaaauguaggcagggagaaacucucucuucuguauauuguacugauuaacacugaugagugcucagagaguuuccugggaaauauggacaggcagauuuguguucagaauguuaaaugaugggguggagacguugcuuggguggugggaggccagcauguguagagcccuggguuagcuccccaguaccacaucaaccugggugcacuggggaagcagaggcaggagacguggaaguucaaggucaucauugucuccuuaguuccuggcagggcugagauacaugcgguccuguccugggcugcaaaagcuugaguagaaacaagcguucuguagccuuacugagcacuuucuacaagauugccugacuguguguaacagaaugaauguacuugaaauuaguaugauaauuuuucuuauugugaccuaacaaaaaauaaacuuagauuugaauucauacacuguucauuacaaagcugaguguguauauuuuaguguuguguuaucuuguuccaacaauauauuacuaaauacuaugguuaggcaauggccaauaauaagagucgaaagagcuuauuuggaguaauaaugguggugguggugguggugguggugguggugguggugguggugguggugugugugagacaguaucucacaguguuuuccuggucuaccuggaacucaccauguagaccagccuguccuugaacucggaucagacugccuauggucuccugaguggugggaguaaagugguuggugccaucaugccuggcaccauggauaaacacuuaaguuuaggaaaagaauucaguaagauguaucauaagaacaauuuuuacaguuuugcauaaguaaauacagaucuauaauaaaauacauuuuuuuccucuccauuuguaguugcugcaauaguauuauucuguuccgcuccuagcccacauagcauaccucuaacugaagugauugggccaauauggcugaugcugcuuuugggaaccgugcauugccagauuguuucaacaagaacacccaagccuccacuaggcacaggcgguaaacgaagaagguacugcuuguuaaacaguguagauaucuguuauuugcauaugggauuuuuuacauuuuacuuuuauuguuuuauuugugugagugugccugcccaugugugcaggugcccacagagacgaggaaagcaucagaucccuggauguggaguugcaggugguugugaucugcuggauaugggugcugggaacugaacuuagguccauuucuagagcagccacugagccaucuccacagcccuggggauuguuguuaagugcucuucacuucauagaguaguauguuauguuacaaaguagcucuuuccgauaaaccuggaaacuccagaaccagucaccacgugaugaguuuucuguaucguuuauggcucacuucagugccacgugucugugggguuuguccuugcuauaguaauuuuuuuuguuuuucuuuaaguucauuucuaauuagcaguaccgauacaggaaguagguguuagguggaauaaacuaaguuuauuauaaacuuagaaaaaucccguguuucuaagauucuuuggcaagaguagagccaagagaaaaaaggcuguuuauuaaauguuauucgaagcuguuuaauaauagcgcugguuaaugaguaaacauuagcaagucucacuggcuccucagcacaaugcacuucuguuuuaagauguuuuggaacaauauuucuuuugaauauuauugcuaagacauugugguauuuauaguuugggauuugaggccaccucgguuuugaaagguaauacaaacauuggguaaauaacuuugcuuauuuagguuauaauucucuccaaucuugcuucuacagacaaguaauguucacauagggaaggagugguuuuauaaguaucuugccaguaugauacauauaaucguguauacauugacugccagugugugucugagcaaggaacaauauccuuguauuuauacaaacugaacuugaauaugcaccauaaugcauguuucacauucugucuaguacauuugaacuucauuguuuauuaguaagcuccuguauucuauaauuuuuuugaaugugcuugaaaagguguuaagacuuuaaacuacuuuccacucuuaauguuuucugaugaaggaaauuaagaaaagcagcccauuuggaaguccacagggaaggggacgguucuagcaccacagauaacacacaggagggagcggugcagagccacggcgcaggcgccccuuacaguguuggcacugucuucagagaccuuuggcuugcugcuuucuucuuaucaggguugguauuuacuccaaaccuuaugugacauaaagaugcucuguuccuuuucugauauuugucuacauaaugaaauuaaugacuugaaauauggcagccucauuagauguuuuauuucgauaaucagaguguuagagcuuaaggagaaaaagcaugaaguuuauuugggguuauauguaaauacauuuaucuucaugggaaugaguauauaguagcaaaguagugaagauuucucaagguuuuuuuuuuucuaguauuauuuuacuguguuaauuuacuaauuaauuguuuuuaucaguauuguaggccagaauuugccuuaauacagcuugucacuuguauugccuugucuuuuacaucuaccuuaguuuucuaaaguuauuugagaucagugcuguggugaguuaagugaauaugcuaugugcuacagacaaguucuuauuuguuauugggguuguauuguuuguaccaguuaggagaagauauuuacaucagaucaaacuuagcucaguauuauaguauuaauacuuaguucaguuaagacuuaugauacugguuuaaauaaucaagaaacauacugcaaauaacuucuuuuuuaaaaaaaguaacucaucuaucacuuugcagacgaugucacuagcuuuugcuacuucccaagcucuucacccaucgauuuguacucuuaccauaaaguuuaccgcgcauuaggaaaauguauccuguuguuuauuuuuacuguuuauaauuuuagaagugauuuuacaaaaucauucugauagucagcacuaaauccaauugucuguuuucuccuugaagauaauguguuuuuaugucuauuuuuaauuuggccucuauucugucucaucuaagaguguguguguguguguguguguguguguguguguguguguguguuaguuaacagaguuuucuuucauaagauguaaaaguuuaauuauugcaaagucaguuucuuaaguauuuucaagacuuucagaugaacaguuuaaauagcaaaguagauauauuuaguuuucagggagucauuugguuguuuugauuucugcagcugaugcuuuuauauuauggacaacauuuagauugguuacuuuaauuuacuugcuucuucuacuuaaauaagacccagacuucaguuuuccuucuguugguccauagaaugaaaauggcugagacuaacucuguuuaguuaugacaacuguauuauaaguauccuaaaaggugaaccaguuucagcuuuuuuuuuuuuaggcuuugguuugcuagcauaugaaugagacuaugucaaauauuagguacaaacagauccuaggagaaauguuaauuuuagaagcccuaugcugaauucuaaaauccuagugccccacuuuuuaaaguuuuuauaagugaccacaggcugaaauaguccugaaauagcaccugacacagcgcuuucuggugacaagaggaaaaggucagaaguuucuacuuagguaucugaguugaugauggagaguagguaaagacagcacaguggauaacuugugugagugauagcaugguuucuagagauuagaaugaagagugauuuuaagucuuacuucgucuaaauacauuuuauucuuaaaguaaaacagcuuaaauucaacaaaugccaauuuaaaaauauaaacuagggcuggaaagauggcucaaugguuaagagcacugacugcucuuccagagguccugaguucaauuccccauaacuacaugguagcucacagccaucaucuguaauaggaaucugauacccucuucuggugugucugaagacagcaacaaugaaauaaaucuuuaaaaaaaaaaauuaaaaaaacaaacaaacauguuuguuuaguacuuuaauccaauaaauuguugugcccauugggaauauagcuuucacugaaaagauuaaauagaaaauguuagauuuugaguuguauuucuucaacuugauacccacuucaaaauuucaaaaaaucaugaauuuuuuuuuauagcuuuuaagagcuaacuguuguguuacuaaaaaguaggccaaugaauaggaauuaugcucuugauuuugaguagagaacuggauuuggugaauuaaaaacaguugccagaaugaagcagaccacauguuaguuauaugcuggauugaccuacauugagggccaguaauguugcucagcgguugagcgcuugccuagaaccugggcaggggccuggauuagauaccuugcaccgcaggggugagugcgcaugugcagagucccaccucuauuuguuguuuacagcacuaaagugaaaguuaaagguuuaauacauugauauuauuuacggaguuaaauauacuacauaaguugaguccuaccagaaauuuucagugcaaguauuaagaauugaccuuuuacgaauauagcuggagcaguugagucauucacaguauaagccagguacucagcugucaccugcagacaauaauaggaggaguuuauuugucaguguacccugcgguuuaagauuauugaugaguagaacuugauaacucagacuugucaaaacacuagauucucaugggcaugcucuuuaaaaguuguacuuacuuuugggcuaaaguuuucaauaugaaaauuauaauacuuuaacaauucauuuacaguagaaucacuugaauuuuaaaggaaguaaaaauaguguauucaacuaguguauuuuuaagguucuuuucccuggaguagcuuugacucaggacuucuucaucuugaguaccaaucagaaugcauuguagaaaacucuacaaaugucucaccacccaaaaauuaaaaaggcagaacuguuaacguuggcuauaacagugaggauuuuuaaucuguaguuuuuuuuuuucuauucaaauuccaguucauaaaauaacugauuuuuuucuuaguaaacaucauauuuauuaaguacuuuucagacuaggcauuaugcuacuugcuggcaacaaaacauaaaacuaaccuaguagagaugaguugcauauaaucuaccaaauaguauauggaugccagcagugccuucgugaaggaugcauccuuauuucagggagaucuucaaagugaguuuuguuguuguuuguuuguuuguuuguucugaguuuuuguuuuuguuuguuuguuuguuuguuuguuuggggauuuucaaggcaggauuuccucuguguaucacuggcuauuuugggacucacucuguagaccaggauggcuuugaacucagaucugccugccucugccuccccagugcugggauuaaggcaugugccaccacugcaaagcuuaaggugaguuuuaccaaguaguuggauacaauaaguucuuggaaaauggauaaagccauuucuuuuaaguuguuuuaaggaucauuauaugaaaucacacaaaauuaaaguuucugugugcuaggggaaacuguuagcagagcaaacagacaguccacagacuuggagaaacuuuuucuaguuacucaucacagggggguugauguaaguaaagauuuacaaaaauaaacaccaaaaaacacaaaaccgcuagucaguaaauccacgaagugaucagucaguucucaaaagaaaccaaauagccaguaguuuuuauuuuuacguucagcauccuuagcaccuaggggaaggcaaacuaaaaccacuggaguucccaucucaccuauucagaaaggccaucaucaagaaaacaaaccacaacaaaugcuuccaaguggaugaggaacccacauccacuguuggugagagugcuagcuagcauagccauuuagaaguccuugcaauuagaaguggaacugcugugugaucccacugcaccacuccaggguauguuuccaaagaugcaauauugucucagacagguacuugcacauccaugugauagcugcauuauucacaguagcagaaguggaaccagccaugguguauguugguggaagaauggaucauggagaugugacauauauacauuuauuugacucuuacaaaaaaaugaaauuaugaaauuuggagaaaaacagauggaaaaucaaaggauuauauuaagugaggugacccagucucagaagauaaaauuugcauauuuugucuccugugguuucugauuuuugaaguuuauaugagcguaaauaagagauuagaaagugcacauagauaggccaugaaaugagguaggaagcacugagaaguggggccaggaugagagguuacacacacacgacauggccgucaucugucauacagcguucacuaacugaaucaugguguuuguucuacccucauguuguuuuccacccucauguuugaacuggcguuuugcuucaaguuggcaccuucucuuguuuacuugggaauuucuguuuugcuacuacuauaagauguauuuuggugacucggcugaccuagauuuggucggaggagcucaugagcacuguugagcagcccuugucuuccuaacaaguucuuacuguucuuggagcacuaauauuccagcuucagcuuguacaucggcuccagcccuccaaucagacacuucuucaaggaggauuguuguguguagguuuaaaaacaggcuaccacuuuugcccgggauugggcucucuuuuguuccacccagcucaggucugggauagccacugccaacccuaacccuuuucuaccugccuuugcgcugggagaggucauguaaccagcccacccgcgagacccuugaauccacaggaaaaagacacacacacacacacacagagcuccauuaccuuuuaacgaagauaccucccaccuuccaggcaugcccuuaacaauuuauuaucucugucucuuugccacauccuuggccacccauccguccguagcagaggccacaggcccuaacacuccugcuccucgagaccuuagaugauugcuacgucucuuuuccuccaaggcauggcugaaaagccucucuccuuccuuaugucugccuuuuccuccuuggaccuggaagucccaccuguaccuuccacccaacaauuggcucuuggccuucuuuagugacaaaucgagaaccaguuagagaacuagacuguaguuaucagagccuccccuuacagcgaaugggguuuagaaaccaaauucugggugcaagcucaggguguucagcaugggccaaauucuuuaggguguauuauuuaacucugugccugucuagauaagguauauuuauuguauaugucuucagcugauauuucuuccuugacuacuggcuuccagaccugaguucuuagcugcuuacugcucuuaggauuuugucugcucauaugcuucuagaugucuuuuacuuauauuuccauuagcuucucaauccagucuuaauuuccaucagccuucaugaauacuucuccagcauacuaugaauuuauuugaauuucaagguaauucacuuguugaaauccacaucugcauguuaacauaguguaaaagacaguaaagggaauugcugaucccauaauauucuucccugggcgguaggcaacaaggcagcuuuguguucuuccuugacuuucuguuucccccuucccuuucuccguagcacacuuuguuauaugugaguaucguaauccaaggccuauguucucguggauuuuucgucacuggggaucacauacaaggaaagcguuagcagauugggcuuccaagucuguagcucuuaggauaugugcacugaauaugaaguaucagaacuguauagaguguaaggaaauguagccugccugguucucuuaguucuguagagagcaggaaggagaggggcuucuuuguauaagacaaaaacuuccuguguuuugacaaaauccuaaugggcaguuucugaaaagaggguaguuggaagaauuguggagacuauaaaucaacucauguuuaaggacaauuuuguauugugauuggcuucaaacuggccgcaguauuucaccuguaaccucuuuguguuaugucuugauucuaaaacucaguauuuagaauagguaaguucuaaggcucacauaguugucaauuuuuuaauuaaauaaauuaauaaaaauuaauuuaaaaauuaauuaguguacaaggguauuacgggauuuucaaacagugucugaguagauucuuuauccugcccguugacaccagccaccugucaccuccauccgcauuugcagccucuccacccaguugcuuuuccuucccugucccugucucaccgucugcucagcucuuaagcagauucccauagaacccagucacuaggguuuagaguagaguacauugaaaaccuaucuacaugaagcauuauacuaauuuuauuuuuucuuucuuauaaaauaugcucuagaaaaauucaaaggggguuauuuaaauaaaaacgcuuuuaaauuauauuuuaugaaagacuuccucuacauugaacccacuuuauuuucacuuaagguuucuguuggaaacuacuuucagcuguuguaguuuuuuuaagacuccucaaacaucugccuguuaaaaauuauuauuucucacauuguauuuuagaaauauuuaauuccuauaaaucaauauccuuaauucuggccuuguaggcuccauaaacauggucaucaauuauuuuuugaauucuuuuguugagaaaaagagguuacaucuuaauuuuauguucuucauuuuuacuuuugcagauuuauaacuuuauuuuuaaaaauuuuuuuuauaacuauuuuuuguuuuccuuuuuccauauuuuuuugcugcaaaaggucuuaauguuuuuauuguauauuaaaaggaacuuaucagcugagcaugguggugcacgccuuuaaucccagcacuuugggaggcagaggcaggcgaauuucugaguucgaggcuagccuggucuacagagugaguuccaggacauccagggcuauauagagaggaacuuauguguguguguaccuaagguaaaguauuugggauaguauuaagucauuaauuauaacuuagcugaugaaacuucaaagauaaacuucuuaaaauaaaagcuuaaaauacguuaacccucacaaauugggaaaaauuuuuauucuagacacuucccacagcccagguaauuaagacuaagaauuauacuguaaauuagggcuuuucuuugugaguuguuauuuguaagaccuuaaaaccuaccauaagucuaacuaagauuuuaauuugaacgaccauuuuuuucugauauucuuuuucauuuaguguaaaauguaagaguagccauuaaaauucugagaaauacugcuuuuugaaauaauacuggauuuuaauuucuauugacccauccagaaugagcugaguccacaugaacauguuucuaacuauucuugguucuaggucaaagaaggcaaagaauucaauugauaagucaaccgagacugacaauggcuaugugucccucgaugggaagaggacuguaaaaagcagugaggauggagcacaguaccaugagccucagugugaaacuguuggaccagaagacgcagccugggccacacgaacgccaaggaguguuccugccaaagucagugcaucugcagcaucuguuugaguuuuuaucugccagcguggagugauggaguagcugcucugaaagcaaauguuuucucuggaauggugcugugaccuucuaugaauaauagucaugacgcuagagaucaggucgaugucgcuaaacaugacugcacguguaacucugugcguuccaaauugauuauccaguacagguguuuaacauacauugggaacacugaaaaaucuucuucccuuucuguguuuaaaugugcaguaauuugucaaccauaauuacagaaaauaaguuauuccuccuauccacagguaccccuguguuccuuaggcacugucuauucauccgcugauccucaucuuccuagacucucucucucucucucucucucucucacacacacacacaucuguguauaauacugucaguauaacuguacaguagaugaaauaaguccuaugcagaaagacucauacugugacuuugacuuacuaccaguucuguuucugcugcuuuacaacaaaauguuguuguguuuaugaacugcauaauuuucucaucaucugucaguaauuaguugaguugcagcagucucgguguaucuguuauuaguauuuuugugaagucuuuguucuucuuguucaggauugcuauucaggauccuucacgguuccauauagguuuagguggguuuucuaguuuuugaagaauguuaguggaaugagacaagggugcccacuccauuguuacucaguguaaugcuucaagucuuaguuacaguaaugaaacaagagaaagauauaaaagggauuaacguugcaaaggaaaaguuaaauuuauccuuacuugcagauggcaugaaucuguauuuaaaagacaccauggccuccaaucagaaaaccuuuauauaggauaaacacauaguaauuugcaagauacaaaauuaauauacagaaguuaguaacuuauauacacuaauaacaaacuugcugaaaaagaaauuagaauaucacaaucauaauaguuucuacaguaaaaacuuaaggaacuuacaaagaaccugaagaggacaccaggcaauggaaagauuuaugcuccugaauugacaauuaaauauugugaaaaugaauguacuacaaaaauaaucucugcuuaaugcaauccucaagaacugaggggaggugggguguggauccuaaauucauagagcaaugcaaaaggacauggguagccaaagcaauucuaagcagaacaguguugcuauaggcaucguguuaccuaaccucaaacuauaccacacagccauagugaaaaagcuagcgugcugcuucuacacagacaugaggaccaaugggacaugguagaaaccgaggagcaaaucugcacagcuguagacaccucauuaaaccguuuacaguuuuaaauuuuauguguaguuuaauuuguuguguuauguguauaauuuauuugcuuguguguguguguauacaccauguguauacaccauguguguauacaauguacgugccuggugcucucagaggucaagagaaagcauuaacuucccuagaguuaccaauauugugagccaccacuaugauggugcuggaagauggaccugggucuucugcaagagcaccuacucuuaacuucagagucaucucaccagcccaggacacuuuguuuuugacagaguugucaaaaacauaaauuggaaaacaaucuuuucaacaacugcuucuagcaaaacuggauguucacauuuagaagaaugaaauuugaucuguaucuuucacccugcucaaaagucagcucaaaguguguugugggaaauauuaaaaaggcgcuugggccagcaacucugccccggcggccuggccugccaugcacuggcaggcaauugcagaccuauuuuuaucucguggagacucugacucagagcuccacaaucuccacccagcucacuaaguucccauuggcagguuguuaccaugccaaccccaugcuucaaaacccccaugaccuuuguaguguaccucaggcaaacccacccuuuaccccguaccuuucucucuugaaccuagacaagcugcugcgugaagaaaaacacaacacagacuuuguucagaaacaacgauaacucaauugcugaguacaacaacuaaaacccugacuuacaagccuuauuaaaucuaaauccuucgguggugaauccugauggauccagggacugggagacacuaguagcuacagaaggccuaacacucucuuuuccccuguucaaccuggaagucccgccuacacgcccagugauuggcuccuuuauucaugaggggaauugguucacaagaagucuccuguguaugacucacuccuugucugcaaccccucccaggagagcagaauuaacaucaacauacaaacagcaccagacccauucacaacaaaaguggaucaaagaucuuaaaacaugaaaaacugaaacuaccagggaaaauacagaaaauagguauaggcaagauuuuuuuuuaauacuagaacccaagaagcucaggcgaucgcucugagauuugacaaauagaauauugagucccaagacagccaggacuacacagagaaacucugucucgaccccccacaccccacacuccgcacccccaaaaaaggagcaucugcacaggaggagcugaguggagagagugccuguagaauagaagccguugccagauacacuuuagguaacugguuacuaucuggaauacauaaaguacugcaaaagucuauccuauccucucuccaaaaaaacaaacugaaacuagcagccugucauccaguggaccaaagaaaugaauagaagguucucaaaggagaaguaaaaauagcaauccauaaauaguucugaaaguaucuaauuuucauagccauuauggaugcuuuaaaaauuguacuuauugccagucaacacuggguaucaagaaaagaaaugacagcaagugcuaauaagaauaugaggaaagaugaagcucccuucuggugacagucuaaacuagggcagccauuauggaaagcaguguggaaguucauuaacaaaccaaaaacagaauuaccauguuagcuauucugcuagucagcauauacugaaaggacucuguauccugcggagagacuguuacuguucuguucauaaugucaaggacaggaaucuagucuagauauccaucaacagaugagugaauaaugacaaugugguccauauauauacguguguguguguguguacacgauggaauuuuauucagaagugaagaacuggaaauguacuaaguaacaaaaaccaggcucaaaaagacaugcugcauuucuuauuuuuaccuaucuuuuaaucuauuuaaucuauuaucuguuuccaguugcauuuauccuuuugugggaacccuagggucuaauuuguauauuuguacauuuauguaggagugacucuggguagaaagugcccugugagaggggaaaacaaaccuuaauggagggggugagauagauacugugacauguggacgugcagaggcacguugcuggaggaagggaacaagcaaagccuaguacagacagcagagaggggcaucaccaaaagcaaguguaugugaaaugcugaaagaaaacacaguucugugcuuacugauugucagaaguguggucaagugaaaagauguugcguuuaggaagaugagcaugggcguucuuguauggaaggagaugaaaagauuuucugaaaacuuuuaauagugcauucacuuacguuuuguaaugucagauguaagucacaagucugcaauuuagucuggcugcaauuuaaugcucaagcauuagcugucugauucuaugaacaaaacguguccuagcuuucacacauacauuuuuagguacauauuaccuacugagguauaggcaaaaaaugucaguagagcuuacaccucuugaucaguuucacaauaucuaaaauauaggucuccuacaguugaucuauacauaauaugugagagaugcacacacaaucaacuauucauuucuuguugucucauaacuauuacuacaucagugauggaucuuguaauugaugaccauuuuagcuugauaaaauauuuauaauacuuuucucaggucuuucagcuucuuucaaauggucuguuauauuuguguguuguucauauuucuuauuucuguaagauguuucagauucuuuucugaacaaaauguuacagaauaguauuugauaaauuacuuuaauuacuuuuaaaaagaaaaugcauauuggagaguauaaucacuagcuuuaagacauuucugcugaaaaaacuagguaguccugaucaguuucuugguggcauuugaagauacuuugaagguauagagguauauauuuauuuguauaauuuuuagagauugucaguuuaaagcucaaauaucagucagauguuacuuacaguuuccuuugucuauucccaacuaggauacccaaagaaagauaacaaaugucucugaugaaguauccagugaggagggucccgaaacaggauacccauugcguggucauguggacagaacuucugaaagcggucuucgaaauagaaagccacaccauuauaaaaagcauuaugcaaaugagguauacaauuugacguuacuuaaaugcacauauaccuguguuauauuacuuucaauaauugaguguuauuauugaaauauuucccacuauuaucaauauauuauuguuuuacauuauuauuauuauuauuagagaaauaaucucacuauguucuguuaacuauccuggagaacuguaauggagaccaggccagcucuaaucgagauuuaccuguucucugccuucugaauacugggauugaaggugggccaccacgccagcuuuguuuuacagccuugauggauaauguaacauugauccaguguuuaauagccacucacgcggcuucauuuuugcgguaucuauguagagucguccccuuggugcuucuuuacugucaggcuguuuccuuguugacuggguuaggaguggcgccucuuuuacauguggaggucagagaacagcuugugguaguuuaucuuuccaggugaguuccagggaucuagcucagguugucaagauauugucaggcuugcugcagagugaccuuaccagcugagacagucugccagcucccgugccggucuuuucacaguccguuauauugaaguuacuuuccagguaauuucucucaugacgcuacugccacuuccuaaccucuccauauuacaacauuuaguaauuuucuucuuugauuccaguuuuucuuuuuuauaaauauauuucuuugcuuauuguuuuuuccagaucuuuucccaauuuacugacaccucuagacuuaaaacaauuuagacagaaaaacaguaucauucuguuuagugcuuacuucccaaagaugugccugugucaccucuugucagcucauuagucauuucaaaauauacaaauuucuuuuuucugggugauucugaguuguauuuaugaaaaaaaucaagucuuauucuaggguagacugugagucucuucaggcugcuaggacaguuacuuucacaugguucucucaguguuuccuugggcuuugcuugucuuucccucacggucugcauuagacacacuaagacaguacacccgcuuacugcuuugucacccacacccugcuuuuaaaccaaauaaccaagucuaggccaucagaaucuuacuuuaugcaguuacacguuuauugucacuggaaacaagauagagggccguuugucuccuacccaguuauaugauuuuggagggauuuuggcuucugugaucuuugcucuuugcagagcaaauuuuaaguacuggaauucuugaagagcaggauauuauucuucuaaacuuagauuuuaaauaacuauugcuuaggaaacauuuuaucuggcacuggagagauggcuccacaguaagaacacuuguugcucuugcaguuguucuugcagagaaccuggauucaguucacagcccucacgugaugguucacagccauccugacuccaguucagggaucugacaacuccugaacuucuugggcaguguacaguguacauccauauacgugcagggaaagcauucauacacauaaaauaaaaauaaaucuuuuuagaaagaaacauuuuaacuuauuuaacauugauaguaagcauuacauauacauugaaaguaaaggcuuuagaaugagugauguuuaaacaguugcauucaccacccucagcuuuaccuuagaagcagagccaacuuucaaggcuguguucuaaaagagaacagaaccuauagagcagaagauguggaucuguggguugugacccguuuggggguucauaucagauauccugcauaucagauauuuauauuacaauuuguaacaguagcgagauugugguuauguaguagcaucaugauaacuaugguuggggucacuccagcaugaggaacuguauggauucaaggguugcaguguuaggaaggcugagagccaugcucgagaagcagcagcugaggcagguguguagaauuguuugcacauuuauuuauaaucacugggcucuucaaauaccaaacucuccaaauugcuuugguguuuuguguuuuguguuguuuuucuuaagaauaagccuuccuccccgcagacgaucauuuggguagacuuaaacacagaaugguucauguauuuauuaccgcugggcagugguggcgcacaccuuuaaucccagcacucgggaggcagaggcagguggauuucugaguuggaggccagccugguuuacagagugaguuccaggacagcgagggcuacacacacacaaaaaaacaaaaaacaaaaaacaaaaccaaaaccaaaaaaguauuuuuuauuaccuugugcaguuaaccacauuaguagaaaauucacacaaaauaaaaaaccaaccaacacuuuucuuaaacuaccggauugucguuccuguuuacuguaggaaauacacaaaaugacaauaaaucuaucaaagauaugauggucuuuucaggugacccagaagucaaaagaaaauauuuugaauuuacuuauccguuauaaaacaguuucaacgauuaaaaagagaaguuguuucaguuggagaaauaaguguuucaguaccugaggaaguguggggacccugccacuccucaugcaggucucuaccugaggggguguggggacccugccacuccucgugcaggucucuaccugaggggguguggggacccugccacuccucgugcaggucucuaccugaggggguguggggacccugccacuccucgugcaggucucuaccugaggggguguggggacccugccacuccucgugcaggucucuaccugaggggguguggggacccugccacuccucgugcaggucucuaccugaggggguguggggacccugccacuccucgugcaggucucuaccugaggggguguggggacccugccacuccucgugcaggccuucccucccuggccucugcuccuggccacugugcacugugggugcuggcuccuggccacugugcacugugggugcuggcuccuguguaagaagagacagcagaguuacuugaugagcuagaaggcagaauguauccuagagaguggacucuuuacgucuuuuugcucuagucugucuauucaauucucuuuuucuuucuuucaaauuuugucuguuuacuagaguagauuagguucucaucaaaugaagaaagcgugugauagagaucuucauacagaacccguagguuuggaaucggacuauuuaaaugacuuguuuuucccccacuuuuuugaggcccaguuuaugcaucuguauuuuaggggagcagaacuguucucaauagccaagguuagauugaacagguuuguuuguuuguuuguuuuuuaauuaagauauuucuuauuuuuagacuaaacaguuguuaaauaaauuugguuuuaaauguaaagacuguagguaauuauuuugaaguuuauaucuguaauguaauaaugguaaaauaucuuuggcagaacacagaaucauaaacgcuuccuuacuuauaaacccacuuauuaguuuuaauuaaaaaauaauaccucuuaguuugucacuuuauuucaauauaugacuagaacaucuauaucaaaacuuaauauuugauaauaaacuaucuuuauuaaauauuugaccuggguuagagggcuggcucagcaguuagaacacuggcuauucuccuggagagcccaagcuugauuucuaauugccauauggugacucgcaaccauccauaacucuagcucuggggggauuugaucugcgugcagcagacgugcauauagugcacagacaugcaugcaggcaaaacacucauaugacugaaauagagagcuguaaggaagcaacuuaacauuaucaauuacugaaaacacuuucugugcccuguuacuuacugaaacuuucauuaagagcugggcuagguggugcaugccuuuaaucucagcacuugggagggagaggcaggcacaucucucugaguucaaggccauccuggucuacaaagucagcucuaggccagccagggcaauuaucucaaaaacucaaaaacaaacaaaaaaagaaaaaagaaaaacucuucaaaugaaaacuucucgggcguuuaguacuuucagugacauuuauuuaucugaaauucuuugggaauuuuuuuaaaagacagacugguuuugcccugacuuucuauauuuuacaugugcaguuaaaaaaaauguguguuuauucugacaauuucauauacauuauauuguaucuuuaucauauccacuuccccuguuuucuuucuccugccuagacucucuugucaugucccuuuucuacuuucauuuuccuuaaaaaaacaaaacaaaaaacaacaaagaaaaagagccuuagagugcguaguuauuauuguccauccccaucugggucgugcacuggagcauggcucaugugggaccacggcgugggagaagcuggcuuucccuuuccucgcaguccuaacuggucuuggggccuugagcuccucccugaccuguucugcagugcggacuuagcauccacuguaaaggugaaccauagcugccuuugagcucaugagugcaacagccaggccaugcuaggugacaguagagaguugcagcccucacaggguuucugccuccucgucuaugauauuccugagccuggagguugggggugacauagaugauccauuuaggagugagcauucagcaguacguauucucagcauuggacuaaugugggucucuguauucacuguugucuauuauaaaacucuucuuuggcugggguucagagcuacacuaaucuaugaguauaaacauaaauacuuagccauuuaacaauauaaacauuagcaaaacaacaguagucgauuuuccccaggggccuguaaccucccaaaccaucggcuuuugaccaguuuuacaguagcaagcaugacucccucuuuguggaagcucagagcaguugcuuacucccagaacagcuaugccaccauuggagcuucgugcauugugaccuguaggguucagcucuuggguaagaucuucaugucuuuuucuccuguagcagacuacauauuacuuuauggugcugugaaauacagccaacggguaguuucugcuauguuaaguucaucuuccuguucauuucuuuaaaaacaaauugccucuuauucaucuucccuuccacaaauggguaucaguauauuaauauccauuaauagugagucugcauuuaaaagucauaaagagugcauuucauucaaagcauuuuauuauuuguaguaaggauaauaaacaaacaaaaaaguaguguuugugccugucuuuugagauccaaguaugugagacuauugcaugaacagcuaagaaagaauuauugaucuagaaaguaaaugaaaacaguguuguccuaugaccauaacucacuucagugaugaugucauuugucuagcuagaaggcauuaaagcauauaaacuguaauagucaauuauccacagcucucuaaagaaauacaggaucaaugcuacgguguaaggaaguagucaagggcagaguagcaaagacagcugugauugaagccaggaagcaguccagguucuuuagagaaaaggcugugcacacaaggcaugcugguuaauggaauuugaacuugaucaaggaacuuuaggaagccaugguggaggauugugcuuagaggauuguggguuguggcaguuuuauuuuggaaaaguuagucuauaaagaaggagagggcuuuuaggugugggccauucugcauuuuacaaagguaugaacaacagugucucacuuuuaauguuuauuuuauggguauggguauuuucccugaguguaucgacguguaaccacuugugugccuguggaggccagaaagggccaucaggugcuuugguaccagaacuaacgacacucuaugagggugcugaggauugaacccaagcccucuggaagggcauuuaacaguugagccaucuuuacagaccauaauuuuuuuuaauagucaaaugaaaaaaaaauuaacaguccuuagaggcagaggauaacaaaucuaaaauuugaccugguuauaaggauaaccuuugucuuuauucaguaaacuauguuuuacauuaaacaaguuuuacucauguuuauuuuauaaaccaaaaauaaggauaacaucagucaauagaaaaugcuuguuucuggacaugguaauacuagcacuugggaggcugagacaagaggggcauaggaguucaaguccagcuugggcuauaugaggcucugcuucacuuagagaaagagaaaggagaugggcaggaagaagagaaaaagaaaagaacacucaaaaaaauuacuugggugacaucuuggauauaacaaaucugaagaugacccagguuuuuggagccaccagaugcuaggucuugagaggacaguaccaguaguaaaacacuguaacaaacuaugaaaagugucuuuucuaguuuuuuuuuuuuuaccugugcaauauaguuuucugcuugugugccauagauuaucuugaaaacacaagauaaggauugucuucuugguuuugauuuccauguuuuaccuucgagaaagucaguaauaugaugaaaucuauuuuugcaaauauauguauaugcaaaauagcuccauugaauaagucaggcuuacuggcacacaucucuaauccugguacucaugaaguauaggcagguaaauuguauuucugaagcuaaccugggcuguguuguacacccaaagccagcuggaacuacauggguaaacauuugcauuacuucaugguagagcacuggaggcccuuggauuaagcaggaaaagaucuauaccauaugaacucccugucuacuugaauucugagcucucuauaaauuuuaagagaaaauagacauaccuuuugcaugcagaguaacauccgaucugaaauauaaaaccagagggcauccuuuuguuaguccuaaagaucagucuguacuuuauuguucugcugucucuuguacuguccugugacaagauguuguuguaacaauauacgguucugauaaaauccuuugaguugggaagaauacauaaauuguauuaaugucaaagaauaucuugauuucaggaugccccuaaaucggguacuaguugcagcucucgcuguucaaguuccagacaggauucugagagcacaaggccagaaucugaaaccgaagauguauuaugggaagacuuguuacacugugcggaaugccgcucaucuuguaccagugagacagaugugggaaacccucagauaaauccaugugggaagaaagaauauagagacgacccuuuucaucaggucaguuuacagugcuggauuguuggaacugucagagcaucuccuuugaauguauguacagaucuuacaagaggugacaaaagcguuuacauuuaauggaaugaauacuuacaagggcuuucuuuucguuuucauuugguggccugugucuagcugcauuagaguauuugagucucaguguuuacauugugguuguaucucccacccucacacacauguuccugagucaguagguggagcucuguggaucacacacauguuccugagucaguagguggagcucuguggaucacacacauguuccugagucaguagguggagcucuguggaucagaucugugguuuggaugcacuagucuuuuugucuuauucagauucauguauaccugggccugccuuucggauuaugauucaaaauucgauguccccagaguauccaauuuguauuacuuagaacccauagucacauuauccaguagggauguagugagucauguauguaaguucccauuagccucauuaaaaacagcucuaaaagguggaauuccaauaucuuuacuuaaccaaguauguucaacauauuauuccuuaauauguaauuaaugugagacuagaagugguauagaugacauaagccuacaaacuuuagucuuaacccuuauguacaccucauuuuagacuaaucacagucaagguguucaaaccacaguugcgucagauacuguauugaauccuuuaauguccaucagugcccuaucuuuaacagaaccccccaucuuuguaaaucuuucucccuguacuuagagucuugguauuuaaaauaaggaaagaagcaggauauggugcugaggcugaccagccuacugggcaagcucagagcaaguaagagaccuguuuucuuaaauaaaguaagguagauagcagcugagguugaccugaccucugcauagguaaguguaugugcacucccucuuaugcacaggcccaccccuacacaguucuuacccuuuucacuuacuuucuuuuagcuaacuucuuaucaaauguuaucaagaaaaacaaacauccuuacaaacuagagauagaagacaaguuccuuaaucuaauuaagaguaguuacuuaagaaccuuagccgugacauaauacuauagucuguauggccuacccaguacucauuuguguaguuaagguagccaguagucccagguuaggaugucagcauggucacuuucuugguacccugccccccccccccccauccuuccacuauagauagcaagaucugaaccuaauucuaggaaauacuuuuauuaaaagcaggcaccaggugaagguguucauuauucuguuuuuuuaacaauuauggcagccuuuuuuguucauuuuucugccaguuuggguuggauuugaacuaguuaaaguuuacauuaaggaaugaaauguuaaagauagcaaaaauuuguugaguguuuggcacacaggccuuuaauccccaaacuugaaagacagaggcagauggguauccaagugagauccugucuuuaaaacaaaauaaaaguuuaaauaacaguagauaaacuuucccuacagauagaaacucuuaguuuaaagugagaguaggauaguuuuguauggaugcguaaaccgaccaagaaaaauccaaacacaguguaaagggaaaaagucuaaaacauuuacaaggaauacagaauagucaucuuuguuauuucaguuaauagacaaaugacgcuggcugugaugaucugugccuuuaacacuagcacuuacucagguggcagaggcaagugccucugacagguuggauaccacucugaucuacaaagacagguuaccugaugagauacugucucaaaagagggagagagaaggagagggcgggaaacagagagagggagaaagggaaaaggagagagaagaaagaaggaagaaaagagggaaggaaagagaagaggggugggagaagacucaauagaacaacaaacaaaaggaucugaagaaguagcuuaugguuacaguggagauaaggaauauguuaauaugggcaguuuuguuagugcucaggcaaauacaguucagagcaacgagacaccacugaugagaguuagauuccaacacauugaagaggacaggcaugguggugcaccuuuaaucccagcacucacggacagaagcaggccgguuucugguaguucuacgccagcgugcucuacauaaugagucucaggacauccagagcuaaauaauagagagacccuguuuugaauaaacaaauaaauaauuuuuagaaauuaucaguauugacaagauuuugaaaaaggaaaccauuaagcaguguguugauacagaucuguacaauuguuuuggaguagcuugcuaucaucugauuaagugugaaggcgcacagaagcugauccccucucauccaacuucaguggcauucaaaugauggacacaggaaaaggaaaugcauaucacacuguaugugauaguaaaaauuacaccggacaugggagcggcaauaaucccagcgcuugggagacauagucagguggaucuccguaaguucaaggacagccuggucuacauagugaguuccagaguacauagagaaacucuaucucaaaaaaccaaaaaaggaaaggagagaaaacaguaagugaagauagcauagcugugaugacuuucuucauuauaaacuuagcaggauuuagagucaccuaggaaacacaccaucagaggagugaaugacuucauaaacaggacagacaaagccagcccagcauugauauuuccccuguucuaccucccuauuagugccacauaccaggacauuucuggagucaugccuuccuggcguggcagacuauucaacagcuagacugugaggcagcaucaagaagccuuccugugccucuuccugcugggccuucugcugcagggcugggcagcagagacauagucagagcuugucauaaacaguccauaacaaucacaguaaacuuagccgcauggcagcacaaggcaguuuggggagcauaaguuuucaauuauaaguugaaguauaaauuuguuuuauuuuuugagugaaaguaauuugaagaacuaugcaguacuguuuauauauucauauauaagcauaugugauuggguguaaucacaugaagggagaauaagcuuggaauuuagaguuguagaacuuguugacuaacaaaauaaaaguauacaaaauaauuuccaacuuuacuuaaaauguuuuacuccagcaaguugagaagaaagguaaacuugguaaagccagcugccugaguagcugaaugaagucuuuuacuuuaaaaauaugcccacugguuuuggcuucagacccacugccaaauggcagggggaagcaagcucccugcuaaguggggagagucugaaggagugguggcugagaagcgcagcgugccugcuggggaagauaagguaguucacaggagaggugggaaccugagagcugugcagcacaggaaggggcaugugaggaagcuaggagggggagauggaaagaacuguaaaagaacaacauccacagguccuggcagggauagccacaagcucugggguagcagggaggagcuuauacaacaggcaggcucucugagacccagguuugcucugucuaccaaugagggaaaagaaccagaggacgggguaugugaaucauguuucugugggaauccagauggcagaucggccaaggcagaagugauaaauggaggaaugacuguguuuaagggaacaagugcuucaucaagguuucagagacccagucagaugggagguugcuaacgcugacucauuucagaggugaaacgauucaggguguggccacgggaauaccuaagggccccuggaucugaagccaggagaacaguggagaacaguccacuagacugugaugcggugaggccugugcacacuuacaaauagauuggauggagcuaguuggaaaugccuuugagccguuaucccuguaucuccauaaacagcguagugugacuauuguugucccacuuacuccuugguacauaguauguguuuaguaaauacuaccugaaaaauacauagcacuuaggacuuuccaaaguugcuuaugaaaauauuuaauaauuuagccuaugcauuuaaugccauccuucuguuuuucuauuagacuaaaaaaaccucucagcacacuacucugcauauuaauuauugguuuuagaauaaaggcucuuuuuuuuuuuuacacaauuucauauuuucaaguuuccagaagguucauguuuuucaguauuacuaguuaucaggcguagaaauugguuuccuuuaaugaaaaaaacuaccagauuguuuucuugucuggcuguagguuugcaagaccauuuucuguuuacccugaacaguuagauuggcauauucuuuucagaauauuaccaaauacauauuuuuguuauguuuguaaguaguagcaaauauuucauagaaaaggaauuuuucugcuaauucuggcugggucuauaaugaaauaaaaagccauauucaggugauacuauuuucuaguagguauagccagauuuuaaugacuacauucccauauuuggaaccaccaaguaaagcaguugucauagugaauguauuuggaauaaaacauaacaucauugcaauuuaagguuuucuuuuugaaugaagaugaaagcaaaacacuggagaucugggaagaaggaagauucagcuugaaaaucuauaucuucagugugugcagccugcacaggccacacaugacccauggcuaacugugcgcugcucagcacaucugucacugcugugucgucacaaacguuuaguagcuccuugcucuugccuuucugcugagcccuuuaggauaggauuucucaugucaugaugcucucuguauccuguguauguuuaaacaagaguuuuaaguguauguuugacaaaaacacaaauacauugagagauaacaugguucuucugaauaacuaaauuguccaguucucuuggcauuuagcuguaagaaaaugaagucagauguuugaaaaagugacuuggaagaaguacuuugaggacagcaaagaaguugacuucuuauucugucucuagauugaccgccauuguacaaacauauucuuuguguaauugagcagaccuguaauuucuguuacacaaugagccuggaaaucuguuauuacuuaguuaaagucuguugccuccuagacuuacuguucugugcuggcuagcuuuauuaucaaccugacaggaucugaagucaccuaggagacaagcacagauuuguaaaaaguuacuuacauuagcuaagccucugggacacuccuguguuucagguuuuuauccgacguauacauuuuaugccccucagccccucccuugccuuuaaggcaccaggacugaccucagggccuugugcauugcguacuagaugggcgcccucccucaaagccacuccuaggauguuuugauucuaguagauugaagaauuucuuauuaaguuuucagagagaguuugauauuuauuuugauacaaaauuauuucuguucuaaacuagcauauauuguuaagaaguuaugaaauaucccuuacuucaagugauauuuuacaauauuucaaagcagauaagccccauaauucaugaaauauauaaauaccaugaaaguauuuagaaaagauaaaaugccccccuuuuuuauauauuauugacuuuuuagacaacuucaguugaagucuauuaauucaccuuuauccccccuuaugaaauauuauauuucuuaacuuuauggaaauauuuugaaauaguauaugucaacaaucuauugauuguauuccuuaggucacuaugaaugccaaacauauccuuuauauaaaaugugggaaauauaucaauccuugaguugugaguuagaaaugcuguaguguaaacuaaauaguccuauuccagcuccacuguaaguucuacauuuuuauaacugcauaauuuuuauguuaucuguuuaauuauaacuaauuuuaaauugagguuuuuauguagcuaaaauuguauguguauaaauauaacuaauauacagauaaauguauuccauuuauaaaguauauauuuaccaauuuuauuuaguauagcuauauauaguuuuguaaaacuuugauuugugaaaugcaguaauguguucaauucuuuuuuuuuguagagucauuugcccuggcuucauaguucccacccaggauuagaaaaaaucagugcuauagugugggaagguaacgacuguaagaaagcagacaugucuguacuugaaaucagugggaugauaaugaacagagugaguucucaauuuucacucucuggguaaaggguaaauacauuggcuauugauacaugaacuaaauguuaauaaccuguguaccucccucuuuuuuuccucacugaaaaauuguuacuuuucuuuuaaccccaucuaaaaagugauuugccaacagacccuuccaccauuugaagggacagugaggugugugguaugcaugugucacaacuuacuuguggaagacaggugacagcuuugugcauucuguucuuuuuuuuccacuuuugagugcguccuggggaucacacucaguucaccaggcuuauguagcuaguguuucuauugacgugaaauagauaccacaaugucauuuuucuccuuucuucuuuuuucuucaauggguaagauuuugugugugugugugugugugugugugugugugugugugugugugugugugugugaauuuauuagcaucuaaaagucaagcaggaaaccuguauugugcguccuugcuuagacaugaaguccagugcauacaguggucacacugcaugguugacgcuugguacaaaccuauggauuugguacuuguuucaguuuccauugaauuuuuuucuuuaauuaacauuuuuuuccuuauuucucuggaucacuagacaugaucugauuuggaguuuaaaauuucucugguccuuuauuuuaauaggacuuuugucauuuuaacaggacuuuguauaggacagggauuaaaauaacugcaucuagagauuggaagauuccauauuacguccucucuguggacaguuaaaaccagucagccaaagagcuugaggacuugaaacuagaggaacauuguagucuuaauaacugugagcuguaagauaauuuagucugauugauugauuuagugugugaguuuaaaagucagcucuaugauaauucagcuuuaccaaucuagcauauuuaaaacuuuauuuuucccauacuuaguaucuuuuacuuuauuauauuccccuuaucuuuucaccuccuacuuaauuucuucuuauuuauauuuauuaaaugauauuagggaggcauuuauuugcaugaugaauucaaaagaaaaauacaagcuagagacuuauugaauauuuuuagcuuuaaaauuacauuuuuguuuaauaguuuuggguccaggaugcuugugucuuggugugcugcuuaaagucgaaagcagcgcuccuccuuccuauguggugcuggccaugcucaggcugccaggcuuugccaaugggcaucuugaucugcugggccaucgcuagcuccugaaucuuuucuccagugaauuggguuuaacuuaggaugugaucucaacagucuaauauuaauauuuguagauauuuuuaacuuuaaaauaauaugcauagauuucuaaguaccuaagaucgauuuuccuuucauaucuaguaaugaauuggagaucuuauaauuaauguguaauaggcuugcuucauaauauauuaaaagaaauuaaauuauaaauccuauuauaaaaaguaaaguuccuuaggaauuuguuuuacuuuaaauuugauuauguacacuuucuuuuguccucccgucccugcucucucaggugaacaaccaugucccaggcauaggauaccagguauuuggaaaugccaucucucuaauccugggcuugaccccauuuguuuuccgacugucacaagcaacagacuuggagcagcucacagcccauucugcgucagaacuuuaugugauugcguuuggcucuaacgaagaugucaugguucuuucuaugguccugauaaguuuugugguucgagucucucuuguguggaucuucuuuuuuuugcuguguguagcagaaagaacauauaagcaagugaguaugauaugaagaauauuaguuuacccuuuuuauagcucucagaguauuuuuuuaaguauucuaguauuucacuaaccacugugauguaauuauuuuuguuuauguuuuauauuaaguuguaacaauucauauauugccgauuguuuuuuauacaaaaauauucaucuuaaucuuuuuuagcgauuacucuuugcaaaacucuuuggacacuugacgucugcaaggagagcucgcaaaucugagguuccgcauuuccgguugaagaaaguacagaauauaaaaauguggcugucucugcguuccuaucuuaagguaggaugcuacugauacaugaucuccuaacagacugccuuucccgguaguuccaauuucuugucucuauguauggggugcguguuagagucagcaguuucucacucaaaggcugggcuaaggauuuuguuucuuccuagaauaguaucacaaaccagcagagggagcccacuacuuaaaaaccaaucuugaggaauguaaccagcaagaccacuacuuuuuaaacuaacuguacauagcuguuuuacaugcuacuccuuccuuugauuuuuuaaauuaucuugcuguuuguggaaauaaaguguaaaaacucuagacccuaggaaaaggcagacacuugaauuaauuuuaaggagaccccuuuuucuggagguuucauuuuuauuguaaauaucaguggguuuuacuauauaugaaguauucaggcaaguucaggauguuuguccuugcaacuucucuugauuucuggcauucagucucucacugaccucauccuuucuguguccagaguaaaucugaaaucuguucauauuucucucuccaugcccaccucccaaauugaaaucaucagucaucuguauuggcccgguaaagcugcugcuuagcugguuuuccagcacuaacaucucuccccucgaucuucagccugccaugagagagauuuuaaaucugagauuuggccauaggauucuuacaccuuucuggaauuucugcucuucuuggauaaagaagaggacaguacuauguucugguugcugcuugugaucuaggcauugcugcaugccacucuuggcuugcucuagaacauuucccucucccagccuguggacugcauuaguucugcuuuccaccuuuucuauguaggacagugcugugugccaccauguccuuguucuguaggacagugcugugugccaccauguccuuguucuguagcggauguaaauaccacuuccucaggaagcucguccggcacacaccuguaacccccaaaucuaaaauugcuucucugacauugacuccaguggagaguuuuccuucauagcacggugaaguuuaucaggucuugagccuguuuagugugucacucucuaguccugugaagggagagauuuuuugaguuuugcucccugcuguauuccuagcaccuagcacagugcuuaguuuuggccauugcucaagaaacaauuguugaauaaaugauuauaguguuggauaagagguuauacuaaugaaucugugcugugcagacaccacaucgacaguguuguagaauuauaaggaaauacacgauucaucuagugaguucgguauguuuucagcauuauaaguuauggcuaacugucacaccuuaacugaaagcaugggcgucaucugcuguuuaguaaauauauuuaaagguguuuucccuucccccugcuagcgccgaggcccucagcgaucuguggaugucauugucucaucggccuucuuacugacaaucucaguuguguuuaucugcugugcacagguaagucagcgugcuacguggagacaguuccuaggcaucagguaucauugcgucuuagagugagugagucuugauacucuucucccccuugucuccucauugcccuacuaaugaacucccauaggaagcccucuccugucaaccccaaucucucauuuuuuucaugucuucuguguccuucuuauucuggugcccauggaggucagaagagggcaucacaucccuuggaacuaaguuacagacaucugucagucuuguagguguugggaacaaaaccugucuccuuuuccuuuuugguuuguuuuuuuuuuuuuuuuuuuuuuuuuuuuugguuuuuugagacaggguuucucuguguaguccuggcuguccuggaacucacuuuguagaccaggcugaccucaaacucagaaauccaccugccucugccucccaagugcugggauuaaaggugugcgccaccacgcccggccccugucuccuuuuaagagcaguaaaugcucuuaaccacugaauugccaccccaggcccuagacaaacuuugaaacagauguuuuauaacuuuucuguagaauaagaaauugcaucuuauuuuucucuguaucuuaacuaauaggcaugccuauuaacagacacugaauacuuuuuaucuacaaucacuauguauuuauucuuaucuccuauauucuguagugacaaaauuacaccagccaucaauuccucacaucuaauauuaauuuaaaaaguuucuucuccaugaaccauuacucuuaaaucagaguaaacugcuacagcuuugugaaagaauucucaguggucauguguuuuacaagcacagucugugcuaugaaagacaguguagaaguucaccucagaugugacauauuauuccugcuuuaaaacaccaguagugcuuauauauacuauauauauucaugucuaugugaauauucuuaauauaugaauucacaagacauuaaucauaaaaaauuaagagaaagcuuaaaaacuaaagcaauuagguauauuuagguagucccgugacaacccuaggauaagagggcgagguuuauugucauuccuaauguuccuugaguaaaugguagccaacaugaggagcugaugucuugaagagcaucucucugugacuauacuauaaaaucagaacaaucaagccuacagcguugaauaaagguagggaauugugugccugccuguuauaagucugcccuuacuauagguuuaggguucaauuugguacaucaugucuugucuuaaaacuucccaugucaagacauugauauaaaaagugguccuuacacaugcuccacuauguucauagcagccuuauuuauaauaaccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacacaauauguacucacugauaaguggauauuagccccaaaccuaggauacccaagauauaagauauaauuugcuaaacacaugaaacucaagaaaaaugaagacugaaguguggacacugugccccuccuuagauuugggaacaaaacacccauggaaggaguuacagagacaaaguuuggagcugagaugaaaggauggaccauguaaagacugccauauccagggauccaccccauaaucagcauccaaacgcugacaccauugcauacacuagcaagauuuuaucgaaaggacccagauguagcugucucuugugagaccaugccggggccuagcaaacacagaaguggaugcucacagucagcuaauggauggaucacagggcucccaauggaggagcuagagaaaguagccaaggagcuaaagggaucugcaacccuauagguggaacaacauuaugaacuaaccaguaccccggagcucuugacucuagcugcauauauaucaaaagauggccuagucggccaucacuggaaagagaggcccauuggacuugcaaacuuuauaugccccaguacaggggaacaccagggccaaaaagggggagugggugggcaggggaguggggguugguggauaugggggacuuuugguauagcauuggaaauguaaaugagcuaaauaccuaauaaaaaauggaaaaaaaaaaaagugguccuuagcuuacggauacagagcagaaguaaaacaacacugcccuggaggaugacuuuaacccugauccaacagaauuuacacagaugcaaaaacaugaagaaaaauucggcaugagccagcagaucaauaaacagcaggauuguuugccaacacugucagauaauagacuaaacaggaaucaaguuuguuuaaaaugauuaaagucagauagcacugugagaaaagaacacagauuuuuacaagaaccaguaguagcucugagaaauggaaaaaacaaaaacaaacgguucuugacauuucagucgaaaaugaaaacagucaagagucaaagcacacauuuagugaacugaggcauugaaguaaugcucuguaguccaggacagauagagaugggaaaugcaaaaggacacagagaugugugucagcucagcccuacucuaccaggaguucuaggaagagaagggagaacucaguauuucagagaccaugacucagaauuuuuuuagaauuaaugaaauucuuauaauguaugaggacaguuuguaaaacuuuccuguguccugggccacaaaguaguuaccagcuagacaggguguaaguuauacacgccugcacuuggaaagcugaggcagaaagguuuugaguucaagaggcuagcaagguugucucaagaaaacaaaacacuaauacccagauaauaucaaaugacacaugaucuagcuauaauauaaucaagacaaacacagauagcaauaaggaaauguauauguuuagaaaaucuuuuuuuuuuaagauuuauuuuuuauuauuauacauaaguacacuguagcugacuucagacacuccagaagagggagucagaucucauuacaggugguugugagccaccaugugguugcugggauuugaacucaggaccgugcucuuauccucugagccaucucgccagccccauguuuagaaaaucuuaaagaacauuuauauuuaaaauuuuuuuaaaacaauauuaagcuauuuuacuggcacaauugaaaauugugaguucucaguuacagguguuaccacaacucccacauuuuucuguggguuccaggagaacaaaaucagauccucgcacguucaggacgagcgguuugccuucuccccagcgccuccuuagcucuugucauaacauagccuugaggucaggccagagagagcaugagaaggggaaacucuuagauauaaaguccugcaccaaaguguuacagaggaaaagccugaaauggcacagugaugguaagccuggcagugcaccagcuucagcuucagaauguccauuaaauuaauaguuucaugcaugucgguuaauuuacaaacuucauuugcgcaaugaagagaaaauauccaguuaccucaauagaugcagaaaacaaauuauauuaaauuuucagcagacucuaaaauaugaauuuuuauuuuucacuuuuauuaguauuaaucauacaaaauaauggguuucacugugacccuuuucuaugacaguguacauguguacugaccaucuuugguccucagagaaugguuggcaucacaaucacaugcagauaaacagguguuuugggugguuuuuuguuuguuauuuguuuuguuuguguuuuuuauuggauauuuuauuuacauuucaaauguuacccccuuuccugguuuccccucuggaaagccccugucccauccccccucccccugcuucuaugaguguucucccccuccuguccacccacucuugccucaccaacccuagcauuccccuacacuggggcaucgagccuucacaggaccaagggccucuccucccauugaugccacacaaggccauccucugcuacaugugcagcuggagccaugggucccuccuugugaacucuuugguuggugguuuacucccugggagcucugggaggucugguugguugauauuguuguucuuccuacaguguugcaaaccccuucggcuccuucagcccuuccacuaacuccuccauugagguccccaugcucaaucugaugguuggcugcaagcauccacaucuguauuugucaggcucuggcagagccucucaggagacagcuauaucaggccccuaucagcaagcgcuuuuuggcauccacaauagugucuggguuuggugucugcagauagguuggacccccagguggggcaguuucuggauggccuuuccuucagucucugcuccacacuuugucccuguauuuccuucagacaggaacaauucuggguuaaaaauuuggagaugggugggugacacccccccccccccccacacacacacacaccuuuucuguuuguuuaaguuugguaagcuuuuuggaguugauaaggaagcacagaggcaagaacaguccagagcuuugagggacaaguuaccugacaagagauuagaauuacuucuaagauacaggaagacuaugccauuaauagagaaguggaauguccaauggaugaaguagaguucugcaaauccaugcaagauacaugauauagcguugucauguaucaaggcuuaugggauagggaagugaaacgauacagaaguaaacgaaaguauuucauccuugagaauaaauucuagauagaaaaaagauugaaauauaagcaacaauuuuaaguucagucacaaauaaaaagucugggcugcagagggcaccauccgugacaaaacaggaucugggaaaacccuggccaaccauguugacaucagugggaauguuacaagucuaucuucacaaggcaguaagaaaagcauccuaaccgggaaaaguuauaaaauauaaaaagauaucucagagagaaacacaguggcuaccaggaguguggagcauucuuuucuucccccaaguucagggcaaguuaagaugaagguaaugagcguguaggguacauguuauacccacaggguggcaaauguuaaagacuuggguggguauaaacaaaacugagugcagacagaauuggagacauggcugaguauacagugauuccacuguguggagauaaauaaguuccauccaacaaaguugaggaagugcuaccuaugagcuaguagucguuuccuacagauuaguaccuaaaggaagccuugcauauguggacaaggauacacagagcugcugauaaagacacugacaacuugaaugguacuuuuuggagcagaccaaauuaauuauacguguuaaaaugaacuaauuuaaauuugaaugcuucaguauugguaagucuuagaaacaagguucaguggaauaaaaagaagcaggaacuggcaguguggccuagugggcagggguucccaaaccaacaugguggauggagggagcugaguccuggucauuacacaugcaugcacugugacauguguacauggcuccuucccucccucugggagaauuaacaaaugaauaugagaaagaaaguaauuuggauaugauguuggguacugugauagcacugacuguccagauauagauaaaauaacauauuuaaagaugacuguugaagguugaugaccuggcaccaugacagaguggcagaacuucguagccuacagaaagcucugggugugcuguguccucaguacuaggaaaggagaaauaaaaccacaggaugaauaaaauuuucuaaauuauuaagagccugaauggaaaagauuaaacacaaaauuuaccuugggguagaguggaggguuaguucagaaaucaaggacaaaaauaucucaagguuuuaacugaauuugaaauuuuuuuuaauaucugaaguacauacuguaaaauuaagauucaacaaaacuuauagaacccauagcuguugguuauauuagucuucauacuucugaugugcauaaauauuucaugauaaauuuguuuuuaaaacagcacuacauuugaaauaaacuaaacugcgcacacugcugcuucacccaguguuucucugccucccucccagcugcuccacgugcacgagaucuuccuugacugucacuauaacugggagcuggugaucuggugcaucuccuuaacgcuguuccuccugagguucguuacucuuggaucagaaaccagcaagaaauacagcaauaccucaauccuacuuacggaacagguggguucaccgucagucagucuccagucugggggacagcuugccagcugugggcucuccuucugccauguguauuuugggauacaacucaggucaccagccuuggcaugaacauauuuccccauuuagccaucugacagcccauguauauacuaucuugaaacaguuuugcuuaucuuauauuuuucaggagcaugguuuuuauuugauuauggucauuugugcuaugaagcuaaacuuaaauuuugauaguacacagccauuuuucaguguuucugccugaucagauuucaaauguaaucugcuguucuuauguucuauuuucauuuggcaggaaggaaguaguauuauaaaaaugauagauuuuaaaacauuagugggacacgauggcuuugcaguguaacaaccacauuagaauacguuuaaauuuuuauucaacagaauaaagcauaguaauuuugauaauugauuuuauuuuauaugaguuugcuaaauauuuccucuugcaauuucauaagacuuguacaaaagaaauguuugcuaaugagccuguuggaauguuuuaguuagggagagcuuguauuuuaaauagucaguauucuugauuaggugaagaggagagugaccacuagagauaaucaucucugacaucacugggucucuugcagacagacagacagaugaccaccucccucaaauugauugugaggcugaugcuucucagccugccuucugcaccuccuguccaguuugcccuguaucucacuaccccguguugguuuacaugugguuuggguuugcuucauaugacuucugcccuugacauuagaagcuguccaguucauagcaccuagaacuucuguacauuguuagucccaccaguccauauguugacuguugguuugguuggaguugugguguaucagauggguaaggauagugugauagaggcuuggaguuagagccuuuucacagacagggacugaacugggcagguacuccaaaaguaucuauuagggaguagauaagaaagguauguaaauauuuuuuaucacuuucauaauaaaaaaaucaugggccaauuuggugaguuuauucuguugcuauucauucucuaaauugaucuggcccugagaauacaauguuuaccuuuuuaaguuuuaaguucucuuauuguaaaauaaguuuauuuuaagauuugggauguauaauaaugguuaaauauuauaaucauuuauaacauuaacucagagauccacuauuaauauuuugcucaccgucuuucagaucuuuuuaagaaugugcauuugagaucuggggauauaacucauugguaaaaugauuguguagcauucaugaggcccugaguuuaguccccaacauuguaaaagagaaauauauguugccaucuuaaaugauuuugccuauggggcuuuuuuauauaaaagauaaaccucuacuugaaaauggagaagaaaccuaacaaaaaggaggagcugacccuugugaauaauguguuaaagcuggcuacgaaacugcugaaggugagaccuguggagggugcgcugcccugccugcccugccugugcacggugugcugcgcugcacuacacugccaugaacccuauucucugucugccuucugccugccuaaguggcuuccaaaugacauucgagcacaugugcacagguuuuuuguuuguuuuguugucauugcuuaaguagcccaaauaauugauuugaaaaguaugugaaaacuuuuacuauacuauagauauggauucguguguguguguguguguguguguguguuuaaucuauuucaucuagaauauuaggaaccauuucacaaaagaaggcuagacauuaacucagaaguucuuuuuauuuuauguuucauaaagcagucuucugugugacccauguuagcuuaaaaaucaauaauaaaacuaaaccuuauuuuuaaaggaagaaaaucagugauagacauagauauauauacaggucaucaguauuuaauuugaaaauuauuuuugauaaauuaaagacuauagucuuguguuugaugucauaauauccuugggauugaguuuuuuuauuauuauuaauuuuguaacaggaucuuaacuuuguagcucugauuugcucaguauuaacuguguuucccaaggugacuucaaacuuguggcaacguccugccucagccucccgagugcugggguagaguaugccaccaugccuugcucuugggauaaugaaaugggacuuuucgccauugcuuuaugguauugcuuuuuuuguuguuguuguuaaaacaaaaauauauuuaagaaucucaauuucuauaacuaauagagcauacuacuuaagaguuuuaaauuuuuagagaaugguaugaaauuaguugugacccaguaauaggguuauuccacugucaacuaaaauauugauugguuguagacuguaccucacaggaaauuggacaucaaaaagguucagaggaggcaagaaagggauaauuauuaauugcuuucuuuuaaaaguuuuucuuucaaaagucuuauuacaacagguguuagagaagagaaagaacacagacacaucuuuccccuauuuuuuuuuuccaaaaagaugccaugaguugaugguuuucuguuugcuuaaucuuuuguauuggguaucuucagguauuggucuggcugacagcaggaacuauuaaacuguaaagcagagacagucacaaugcuugaucugcuucgguccaauccagagcuuggcguuaaugugacuuggacucucccucucacuuuccacggcccagaaacucacaaggccaugauuccaaggccauguacucuguagcccacccccuuucccuguuaguacuggccuccaugagaccccgucucuuccuugagaaucuggcacacagaacuucuugcuucuggaguuacugcucuuuaucuuccagcccagagacccuuuuccacuuaacacugccaugcuguacccgcucaagaucuucuagugucaguuuauugucaagucugccuaagggaaagccaguucucagucaguguacugcuuuguguuugggcucuuccagggcucagcaggggguagcaccuuugcucuggcucucaggagugccuuucuuucuuucuuuuuuuuuuuuuuuuucuuuuuuuuuuuuuuuuuuuuguuguuuguuuuuuugaaacaggguuucucuguauagcccuggcuguccuggaacucacuuuguagacaaggcuggccucgaacucagaaauccgccugucucugccuccugagugcugggauuaaaggcgugcuccaccaccaccaggcaggagugccuuucuuaagccccgccuuuguaagccuuggccacuggucucugguaaaggaucagauuguuuuauuaguugcauguuuauuaaacuauauaaagccuuucaguucuaggacugaauuuugucuucccagagccagcauggugccugacauauaauagaccuuuuaauauuugaaucauccaaucaauuaccaaauuguauauuugaagauaauuaaauaaguuuuuauucaaauauuaauauuaucagaagacuuggcuaaugauacuaguaauucuacaagaguaguauucucuuuuagauucuacuccagcucuuaucucuaaacauauucucuaauuuccuauagcuaguuggucagcacuacacauucaucauaacaagaauuggagcuauagauuuauaaaauuauuuuaaaggaagucacuuuucuuaaaaaauaaaaccacuauuaaaauuuacuuaucucaagcuuggauaauaucauucuuucuuaaaauauccauaauuuauaacauuuggauagugauuucuaacucucuugaauauugaggauuucacuggaaauucuuguaggaccuaaggcuaacguuucgucucuucugcuaggaauuggacagucccuuuagguuguauggacuuacaaugaauccgcugcuguauaacaucacccagguugucauccuuucggcuguuuccggugucaucagugacuugcuuggauuuaauuuaaagguaacagcaugcaaguuuuguuuuguuuuauuuucuuuaauccugucacucuuuugagauuucacaugcauaauagggucauuuuggcaaguuuguauacaguuaguaacaacuucagggacauauaaagaugucauggauucucauaguaguagaacuuguaauguggaauacaaucauuauauguaagguguguguguguguguguguguauucauauucuagggugaguaagaggaaccauuuuuuuuccuuauuaauugaaacuaauucucaugauucagcaaugaagaaaagccauauucucuuguuggccaaaaauguauuauuauauaguaguggauacguacuucgguacaugaacaaauaaauguuaguaggaaguauaaauaguguauuaaacaaguaguagauguauguugacauuucucaggaaaagcaaaggagaaauccaacuuugaucacuauacuucagaugaguuauuaaccacggaaggauaauggaguugcauggccugcaaguggaguguagggauaacuguaguaagcgccaugucaauaacaaucuugacuuguaauucuuuauagcuguggaagaucaaaucgugacaguugagagaaauggagguguagccgggaugccagagcacgagcgcugauggagcuggcuggaagcaguggguggcucugcuccaggagucuacugggaaagaaguguuuacaucagaauguauugugcaauucuuauauuuauuuuacuuguccacugguuuuguuuuguuuuguguguguguguguguguauguuuguuuucuuucuuuuuuuccuuuuaaacauuuaguuuguuuuaagcauugaaguuuuucauuguugaaaggguggcagagcggauccagauaccugagauccugguaauuguugacguaauugacaagcagauugugaaaacagaagccauugcuaagcacuguuucuucauuaaugccgugaacuugccuuacuugaggaauacgucuuuaacucugaaauagugcguugucucagcuaaacacauguccucugguaaaccaggguccgcucaggaucgcucuugaaauacuucagaacaguacugggaucuagacugacuaagcugcaguugaagcacccuucaguauuaauagaugguguuguauaacaggucaacaagugcucuuugauaauaaaacucuuaauggagcaauaauuguaaaugguuaccauacuguaaaauauuuugauaaaaauuaauuaguaauaaauguauuuauuuaaaacacugagcuguuugcacagcuccaacugugcaugcucaaaaugugcacuuuuuaaaaugguuucuuuugguguauaucucuauguggauauguuacaguguacuagggcauaauaugguauccuuuugagugaggucuauccucaucucacaagugaagugccuauuguuauuacuaaauaaagugcguuacguuuacucaaaagaauuucccaugguacacuauagcguaugcuguuccuaccacacuuaaauaaagcuuaagaauaaaguugucugauugcuaguuauaaaauuuccaaauuuuccagaaggacagcuccagccuaccaguucuagcuuccagauuuaaucuggugcaccccuccccuggcuccauuacauaagggcuauuuuuagaugcuuuuaacguggaaagcuagcugcucuccccuucaguaacuuguccguguccggugggagcuuaucauguuucccuuuggcaaauagggcagauaugauagucccuacaucgggccuugauucuaaguuguuaccuuuguacaaucaguaguguuuuaagaauuacaugaaacaauguuuuugugauugucuuguuuaagccaaccauuugguuuuuaaaacaaagaaauuauuugaaacaaucuaggauuuucuuggugcaaagucauauugaauauauucauauuuuuagcauauuuuaaggucuuuaaaauaauuaauuguaaauaauuuauuugauuggugcaguucuaauucgcaaaucacucuuaaaaucaggauguguagagaccagagccauguguuaaauguugcccuucccauuccucugagcaaccucagcuaagccucacuggagagugcucucuguauaggaaacggcagacagcauuguguuccgucugccugcgcucuaauauguccaauaaugaccaaagugcauucuggguauuuuucgaggaauguauuacuggagcuuuaagaacauacuuaguuucucaugugaagaauuaggcuuugucugauauguuccuuccuauauugucuaauuugagguuguuuuuaggcacuauauuuuauaaacuuuuucaaaauaagguacauaccuauacagaacuuaccauuuugcacagaguauaucaaauauauuuugagaauaaaaaaguacagcaugaguucuguuaggaauaaagugagauuguuguaucuuaaaaaacuuauuucagauuggagguauuuuugagaaaaguagcugaguauacugacuuaggaaaaugcuugcuuuagguugcagcuguguuuaacguagaguugggguggauuguacaguaucggccgugccguuaacgugggcagcaguagaguucuaggaggaaaaugugcuaagcagcuucauaguucacagagccauuucagaguaguaagugacaucccugccuuuaaguauaccaugaauguaagaaguagaaguuguaacauaucacaucauagagaaaaagcaacccagagguagaauuauggcaaaugcugugugcuguuucuuugccguguguuuuuaaaaguuugaacagcaaguuuaaaauaaaacauuauaagacugacuuguguguguuuuuuuaaguguggguugguuuuugugcuuacuguaauauaagcuguacuuacugcccuuuagacaaggacggugaaaauaaaguuuuaacuguac

SEQ ID NO: 2353 - RNA, 5412 nt, Mus musculus
caguccgaucccuuucguaaucuuuaaaagaccuguucucuucugccuccccagccaaaaacacaccggggagcgggguccucuagacccacuccuucacgcgcguccugcugcgcguuaacuggaaggcgaaaccgacaccgaaaaccaggaguuucagccauccccccggucggcgaccgaaacuccaggcuccauuuacuucuggccccgcggaaggcugcagccccgccggccgccggcgcuccccucccccgcgcggcacccaccucgcggcagcggcuucgccucgccguucucaucccgggcggcggcgccgaggccgugcugccuccgcuucuccuucucgcgcuucuccuugggucugcgcggcuuggcggcggccggcggagcgacgggcgggagcaggacgcggugaggcugagcgugcagcagcgagggagugaccagcaguuugcgcggcagcggcugagacgaggaagcggaggcugaggagacgcucgggcuggcggagaaagaguaacagcuccgagagguggacgaggaggaggcggcgggccgagccgcgaagcuccacgccgccgggcugccgaagcucuggggcugcagcugcccgccguucccgccgcugccccccuccccguucacucuccgcggcgccuucuucuccucggugcgaaccuucuuggcagacauagagcccggcggcucccgcgaggaaggcuguacuuugccagaugcuuccuucucagagaggagagccacggcgccgcgagcuggguucggcgguuccgccauuuugcgcuccuguuguauuuacucuccgccgcuccccggagcgggggcgcggggcggggugccuagguccaggccgagcucccauugggcgcgcuaaacugagagaucccggaacaaaccaaucaaagacgcggacagaagccgucgggguggggucaccgagcggaccuucauuuggaggucagaggucuuuucggcgcggcugauggagagcucgcugagaagggaggaucucccgaccgucgcucgggagccccgaaucugcccggaccgagguagcgcugccguucgcucaaagacuuugccuuguuuguaccgcucucucuuuuuaccuugagguggcuugggucccuucugcagguucugaaaaacgaguucuggguugcucgucucggagaaaauuugucgagaguccgaucagcaaaggcagaaauggugaaaaguugccuuauuuuaacuaaggucguaaaaguucguacuuuaaaagagaguuuucugcagagcuggaacuuggaucacuuccgaucgugaagauaaaaaucacccaccguuuggaggcuuuaaauugagcuugagugcuaaagguuuucacuuuaauuauucuuuaaacgacaccaggaaaaagccacuagcgguguuuguaaauguuugaaaaugcaguuagaguucuguauuucagagucagcgcuaugaaacuucgccaagcauguaccuugauuuuuaucucaaaagauaaggaauuugggggaauggguuacaacacaguucaagcuuuagacaagagcaugccuuaaagucuuagaucuuuugugagauuagaauguaaagauaacacaugaucauauuagcucagcaagaaaaaggaguuuucugauccccuaagagggacauuagcaguuacuuuccgcagcuaacaguugccuuucaggaaacugcaauggucuguuguuacuccucuuuuacuccaaacccacuucuuuaggacucggugaggggaacacaucaaaaucuaacgcuguuuguaaauacauuuuucuuuuuuugguugguugguugguucguuuguuuuuugagucauagucuuccaauauuguccuggcuguccuguaaaccagccuggccucgaacucaaaucuuccugcauuugcccaacucccuuucccccagugcuggaauuaaagaaagguguguaccacugcaucuguccucauuguuuuuaguuuuuagaaguaaauuguuaauauauagaguauucccugaagcuagacccagagagacaaauuuugcauauuuucucuaauguguguaaucuaguuuuaaaaacacacacacaacauaaaaauagaagggaaaugggaaaaagaaaggugaugagcauaagaaagaaagucacuucaucucccucaccugggaaugaguaugucuacauccagggcaggggaugagggagugguggugugacugagcaaauaaggguacaacauggaaaguguuggaaugaaacugaacgcuaaguaagaaaacaaaaggaaaagggguuuccucucuagauuaucuaauugggacauucauaacagugucaguuagucuaaugauuuuuuuuuaauuuuuucgguuuuugagacaggguuucucuguauagcccuggcuguccuggaacucacucuagaccaggcuggccucaaacucagaaauccgccugucucugccuccuaagugcugggauuaagggugugugccacugcugcaaggcucuaaugaucuuuuuaaaaugcauuuuucuauuuuuuucucuuuuagaaagcauuugcuugugcagaggggaacaauguccgggagcagaauuaaugaucuauuaaauaaaaacacaucuauguuaugucugcauggcaaaaauuaaauauccagccagacagugguggcucacgcccuuaaucccagcacuugggaggcagaggcaggcagauuucugaguucgaggccagccugaucuacagagugagauccaggacagccagggcuaaacagagaaacccugucuccaaaaaccaaaauaaauaaauaaauauccuagcagaaagcaggugcugcagugaacuggccugucuuccuggggaguggcauacaaugggggaaacgauaggacuggcagucacccacucaccagccuugagauucuacucaggccgcuuugccugggaagcucucuguugucuuauuugguaaauuugacuacaagguuccucuauucuugauuugccauuuucaagauuugcagaaucacauuguaacuguuaaaguuaaaauaauuucucagcacacuggaggcagaucugcaggcaaaucucugaauuccgggcuaaccuagucuacagagugaguuccaggacagucaaggcuacaaaaaaaaaaaaaaaaaaaaccucugucucaaaacaaaacaaaacaaacaaacaaaaaguaaggaaacacuuaaaauaauuuaccgucagacauggugauacagcccugugcucucggcauuuuagagggagccacaaaaggaucagauccccaacuaacggcauaguaaacucaggccaauaugggcuacaugcauaccuaucucagaaacugaagcaaaguacauuguaaaguaguuuccuuauuauuguguguguacugcuguuugccuccauaugcauguguauaucacauauaugucagaugccuguggaagccagaagagaacaguggauuccguggaccuggaguuauggccgguggugagcugccuugcuagggaacaaauccauguccucucgcaaaacaaguacucuuagccacugaccaucucucuaaagcccaaaauaacuuuuguucccuccccuccccuccccuccucauggaggccagaagaggacaacagauucccugaaauuguucuuagauguuguugugagccagcaaguauagacacuggaaucugaacucaggcccucugcaagagcagcaagugcucucugcuccugcccacugagccauuuccccagcccugugugacucugcuuuuaaaacguuugcuaagauaucggagccaaauguacgaaguaaccauauaaccuuucuguccaaaaguaauguuuuaaauaaaugcagcgugagugacggggaaauuaacugcugauuugaacaguugccgucaguuuccaugacugucucaggaggaaccuuuucacaguauuuacagacuugucaaacaguaauaagugaugccuucauggucuacacaaaggccuuuuuuucaccuacuucuggccgaaaacuuauggguccuuauuuucucuggccgauccugaaaaugcucaugacauccauaaacugcuaacagccccaguuuaaucucucagaacucgguugucccuuguguguccucacugcccaacauccugcauaggucuccugccagugccugcauucuuauuuuuuuuuuuagcuuccugaauccuuauuucuuugagguugaugaaccucauuaaggggguaaaaaagauagagcgugcacgcuaugcaaccuccauuacuccugggccugagguaaaaugucaaggaacccuuccucuaacgcuuucaggaaagcucccggggaggaggaccuuggccccuucucacuuccugaagcuuaagagaaacugacaagauuauaaacguaugggucacuuuucuuaacauuucugaucgcucagguaaacugcacucucacuuccuccccacuaauaucagcuuacaguaaauacugcauaaccaguuucuuaaccacaauuugucguucaguuugaauguguacuuaaguuugggacagaggugagaacuggaggugaaagaucagucagccccugucuaaaagcuuccuuggugagccaguagcaaccacaaagcaggaagcagaagggagagggcagaaucagccgggcagagugaguagaagccaucggguuuuguuuuguuuuguuuuguuuuaaucuauacucuaagugcaucaguguugcuugcacguacgucugaggguauuggagccucuggagcuggaguuacaguggugagcccccaugugaguucuggaaauugaaccgugguccucuagaagagcagccagugcucuuaacugcuaaagcaucucuccagcccuccagcccuggaguucuuuuaacaaauguuuauuggugaaauggcucagcaagaaugaaggcauuggcacagagccuaacaaacugaguucaguccccaaggcccauaugguggaagggagaacugaucccagcaagugguccucugacccugcauguguacuguggaaaucuccugcauguauacauauacaaguccucucccucucccucccccucccucucucucucacacccacaauauaaauaaauguuauaaaaaugguuuuguuuuuauuuuuguuuuuuagaggcagguucucucuacauagcccugacaauccuggaaaucacuauguagaccaggcuacccuugaacgcacaaagaucuaccugcuucugccucccagugcuaggauuaaaggcaaccagacccagcaaauguaauaaaaaaugcuuuuaaacuugu

SEQ ID NO: 2354 - RNA, 5412 nt, Mus musculus
acaaguuuaaaagcauuuuuuauuacauuugcugggucugguugccuuuaauccuagcacugggaggcagaagcagguagaucuuugugcguucaaggguagccuggucuacauagugauuuccaggauugucagggcuauguagagagaaccugccucuaaaaaacaaaaauaaaaacaaaaccauuuuuauaacauuuauuuauauugugggugugagagagagagggagggggagggagagggagaggacuuguauauguauacaugcaggagauuuccacaguacacaugcagggucagaggaccacuugcugggaucaguucucccuuccaccauaugggccuuggggacugaacucaguuuguuaggcucugugccaaugccuucauucuugcugagccauuucaccaauaaacauuuguuaaaagaacuccagggcuggagggcuggagagaugcuuuagcaguuaagagcacuggcugcucuucuagaggaccacgguucaauuuccagaacucacaugggggcucaccacuguaacuccagcuccagaggcuccaauacccucagacguacgugcaagcaacacugaugcacuuagaguauagauuaaaacaaaacaaaacaaaacaaaacccgauggcuucuacucacucugcccggcugauucugcccucucccuucugcuuccugcuuugugguugcuacuggcucaccaaggaagcuuuuagacaggggcugacugaucuuucaccuccaguucucaccucugucccaaacuuaaguacacauucaaacugaacgacaaauugugguuaagaaacugguuaugcaguauuuacuguaagcugauauuaguggggaggaagugagagugcaguuuaccugagcgaucagaaauguuaagaaaagugacccauacguuuauaaucuugucaguuucucuuaagcuucaggaagugagaaggggccaagguccuccuccccgggagcuuuccugaaagcguuagaggaaggguuccuugacauuuuaccucaggcccaggaguaauggagguugcauagcgugcacgcucuaucuuuuuuacccccuuaaugagguucaucaaccucaaagaaauaaggauucaggaagcuaaaaaaaaaaauaagaaugcaggcacuggcaggagaccuaugcaggauguugggcagugaggacacacaagggacaaccgaguucugagagauuaaacuggggcuguuagcaguuuauggaugucaugagcauuuucaggaucggccagagaaaauaaggacccauaaguuuucggccagaaguaggugaaaaaaaggccuuuguguagaccaugaaggcaucacuuauuacuguuugacaagucuguaaauacugugaaaagguuccuccugagacagucauggaaacugacggcaacuguucaaaucagcaguuaauuuccccgucacucacgcugcauuuauuuaaaacauuacuuuuggacagaaagguuauaugguuacuucguacauuuggcuccgauaucuuagcaaacguuuuaaaagcagagucacacagggcuggggaaauggcucagugggcaggagcagagagcacuugcugcucuugcagagggccugaguucagauuccagugucuauacuugcuggcucacaacaacaucuaagaacaauuucagggaaucuguuguccucuucuggccuccaugaggaggggaggggaggggagggaacaaaaguuauuuugggcuuuagagagauggucaguggcuaagaguacuuguuuugcgagaggacauggauuuguucccuagcaaggcagcucaccaccggccauaacuccagguccacggaauccacuguucucuucuggcuuccacaggcaucugacauauaugugauauacacaugcauauggaggcaaacagcaguacacacacaauaauaaggaaacuacuuuacaauguacuuugcuucaguuucugagauagguaugcauguagcccauauuggccugaguuuacuaugccguuaguuggggaucugauccuuuuguggcucccucuaaaaugccgagagcacagggcuguaucaccaugucugacgguaaauuauuuuaaguguuuccuuacuuuuuguuuguuuguuuuguuuuguuuugagacagagguuuuuuuuuuuuuuuuuuuuguagccuugacuguccuggaacucacucuguagacuagguuagcccggaauucagagauuugccugcagaucugccuccagugugcugagaaauuauuuuaacuuuaacaguuacaaugugauucugcaaaucuugaaaauggcaaaucaagaauagaggaaccuuguagucaaauuuaccaaauaagacaacagagagcuucccaggcaaagcggccugaguagaaucucaaggcuggugagugggugacugccaguccuaucguuucccccauuguaugccacuccccaggaagacaggccaguucacugcagcaccugcuuucugcuaggauauuuauuuauuuauuuugguuuuuggagacaggguuucucuguuuagcccuggcuguccuggaucucacucuguagaucaggcuggccucgaacucagaaaucugccugccucugccucccaagugcugggauuaagggcgugagccaccacugucuggcuggauauuuaauuuuugccaugcagacauaacauagauguguuuuuauuuaauagaucauuaauucugcucccggacauuguuccccucugcacaagcaaaugcuuucuaaaagagaaaaaaauagaaaaaugcauuuuaaaaagaucauuagagccuugcagcaguggcacacacccuuaaucccagcacuuaggaggcagagacaggcggauuucugaguuugaggccagccuggucuagagugaguuccaggacagccagggcuauacagagaaacccugucucaaaaaccgaaaaaauuaaaaaaaaaucauuagacuaacugacacuguuaugaaugucccaauuagauaaucuagagaggaaaccccuuuuccuuuuguuuucuuacuuagcguucaguuucauuccaacacuuuccauguuguacccuuauuugcucagucacaccaccacucccucauccccugcccuggauguagacauacucauucccaggugagggagaugaagugacuuucuuucuuaugcucaucaccuuucuuuuucccauuucccuucuauuuuuauguuguguguguguuuuuaaaacuagauuacacacauuagagaaaauaugcaaaauuugucucucugggucuagcuucagggaauacucuauauauuaacaauuuacuucuaaaaacuaaaaacaaugaggacagaugcagugguacacaccuuucuuuaauuccagcacugggggaaagggaguugggcaaaugcaggaagauuugaguucgaggccaggcugguuuacaggacagccaggacaauauuggaagacuaugacucaaaaaacaaacgaaccaaccaaccaaccaaaaaaagaaaaauguauuuacaaacagcguuagauuuugauguguuccccucaccgaguccuaaagaaguggguuuggaguaaaagaggaguaacaacagaccauugcaguuuccugaaaggcaacuguuagcugcggaaaguaacugcuaaugucccucuuaggggaucagaaaacuccuuuuucuugcugagcuaauaugaucauguguuaucuuuacauucuaaucucacaaaagaucuaagacuuuaaggcaugcucuugucuaaagcuugaacuguguuguaacccauucccccaaauuccuuaucuuuugagauaaaaaucaagguacaugcuuggcgaaguuucauagcgcugacucugaaauacagaacucuaacugcauuuucaaacauuuacaaacaccgcuaguggcuuuuuccuggugucguuuaaagaauaauuaaagugaaaaccuuuagcacucaagcucaauuuaaagccuccaaacggugggugauuuuuaucuucacgaucggaagugauccaaguuccagcucugcagaaaacucucuuuuaaaguacgaacuuuuacgaccuuaguuaaaauaaggcaacuuuucaccauuucugccuuugcugaucggacucucgacaaauuuucuccgagacgagcaacccagaacucguuuuucagaaccugcagaagggacccaagccaccucaagguaaaaagagagagcgguacaaacaaggcaaagucuuugagcgaacggcagcgcuaccucgguccgggcagauucggggcucccgagcgacggucgggagauccucccuucucagcgagcucuccaucagccgcgccgaaaagaccucugaccuccaaaugaagguccgcucggugaccccaccccgacggcuucuguccgcgucuuugauugguuuguuccgggaucucucaguuuagcgcgcccaaugggagcucggccuggaccuaggcaccccgccccgcgcccccgcuccggggagcggcggagaguaaauacaacaggagcgcaaaauggcggaaccgccgaacccagcucgcggcgccguggcucuccucucugagaaggaagcaucuggcaaaguacagccuuccucgcgggagccgccgggcucuaugucugccaagaagguucgcaccgaggagaagaaggcgccgcggagagugaacggggaggggggcagcggcgggaacggcgggcagcugcagccccagagcuucggcagcccggcggcguggagcuucgcggcucggcccgccgccuccuccucguccaccucucggagcuguuacucuuucuccgccagcccgagcgucuccucagccuccgcuuccucgucucagccgcugccgcgcaaacugcuggucacucccucgcugcugcacgcucagccucaccgcguccugcucccgcccgucgcuccgccggccgccgccaagccgcgcagacccaaggagaagcgcgagaaggagaagcggaggcagcacggccucggcgccgccgcccgggaugagaacggcgaggcgaagccgcugccgcgaggugggugccgcgcgggggaggggagcgccggcggccggcggggcugcagccuuccgcggggccagaaguaaauggagccuggaguuucggucgccgaccggggggauggcugaaacuccugguuuucggugucgguuucgccuuccaguuaacgcgcagcaggacgcgcgugaaggagugggucuagaggaccccgcuccccgguguguuuuuggcuggggaggcagaagagaacaggucuuuuaaagauuacgaaagggaucggacug

SEQ ID NO: 2355 - RNA, 69347 nt, Mus musculus
gccggcgcuagcccgcggcucgccucguaguaggggaaagcgacgcugcucuuuaaguugcgcggggagcccggccggugccgccgcagccgcagccgccuggcgcggcggggagggagggcgggccggagcgagcuggggaagacggagcgggcgcugcggcgcgcgggcgggcggcgggggggacgcgggaggauggagcaaguggagauccugaggagguucauccagaggguccaggccaugaagaguccggaucacaauggggaggacaacuucgcccgggacuucauggugaguguccguucucgccggcgccucgugucgccagccgccgagcuccccucgccucucccggucggucggggcugccagcgcuuugugugcggugcgaggacaggcgcggggcgcgcgcccagccgcgagcgccgucggcgagcuugcgggaggcgaggucacccccgccccucagccucucuuuuccgcggccgcuaccugcgcuccccggcccagcccgcuccggccccgccgcccgcgacuaccuauugucuccccggccgggcggcggcggcuggagugcgggcucgccuucccacgccugccuuccccgccugccccuccggggagggucgaggcgagcugucuggcugcggccagcggagcggcucgaggcugccggagagcgaggguguagagcauuaacucgcugggucccuguacggaugccggccuugguccgaguggacggcaggacgacuccgugucuggguucacaguuauuagcucagcgcuugccagaggcuugaccauaaggaaucucaugguuuaccugaucuccauuuaucuggucagguuucuuuucguccugagacccagguuugagguggcugugaggccagugugacuuuagaucgaaaagggagggggauaucaguguggauggggguuauccugaaggaagcucacuccggacuugaggggauauugccgaagccggaggggaugugacuaucacuuccuauccgggguggggguggggaagcugggaacaauagucaugguaggguggaggcgacuauaugggcugaagcccugggagauaaccuucccguccccccuuuuccgccaccccccuuuccgcccucugcuuguguaggcaggcuugagugaguggagguggggguuaaaagucuaguaugugaaauuucucuaggugcauaauuggagagaggguaucaauuccgaaggcgugggaccagaagcugacuuccuacauuacccccuccucgcuccuuuuauuuuucuguuggacaauguucccucuaggguuguuucccggcuuuggaggcggugguugcggcugcugcuccuacggauguugcgcaagacuggggcguuguaaacccuggaggucuggggaauggaaaaggaaaugggacuuugggaaguccuucgcucuuuagcggggguugggaauagcaaaugaacuagggaaaauuuugcucuggacaaggugcacuucuaagaauaaucaguucaucugaaauuugguuaugaaaagccauaugcaguugaggucuauaaaaaugaguggcuacgaaacauuugcuaguuuuuauuuaaagugcaaaugaagugauuuuuaguacugaaguggguguucacauuuuaaagagauuucugucuaguaaaacuuuaguguuaaaauuguuaauggcuugaaaaguagacuguuagccuugcacaguauuaguaguauugugggguuuugugacuuccaccuugcaguuuuauaaaaauagaaaguaggaacaagauacagugaggacugaaaauguagaucaaaguccaguuauuccuuauuuuaaacauuuucugauauuuagaugauguuuuggaaaaaguacuuuucuucuuaccaucgaauuuugaugguuaguaucuguugaaugauaucauuugcaaacauuggaaagagcccuccuuuuacuacucuauaguaaauguagaagaaaacaguucauugaggguguguagaacuaguggcuugucauagaaggggccuuguggcccuggcuguuggucgaaugcuugcuaucuugcuguccuggacauacucugucaaggaucauuguuagugcaggccauccggacaggugcccagucccugcacuuuuggacaggggaucuagucuugggguucaugcuuuggggaugacucagggauuccuauuggagaugucauguccaaggaccaaauguguucccauucuuccauaauaccaaaguauagcuagguaguucuacaugagagauuugaugacuaaggcuauuauucuuuuauagggcuugcuuuuuuaauuuccuaacuugauaagcaguagcuauaauuaugauuguuggcaguugccucuguuuuuuucccuugacuagaaggcuggaaagaacuguccucugucauggaaagagaaucaaagaugaucacauaaauucuaacuuuuguuauuaaauucugaaguggauuuuaaaauccauuuuaaaaaagagauggugacauuuuuggaaaguaugucgacugaaaucacuguugaaauggugucacaugaagcugccaguccacugaugccugaacuauuucaucauguaaauaauuuccaugccucccuuuuauaauaaacgaaugaugccuaaacugacagccauugucucugaccuuuaguuucacugaacuguuacaaauauuuccaaauaaaauguuguaaaugaaaaaaaagaaagaaauuaaaaucuuaugaaaauucagaaucaauaaagaugauuaaguggaucuccaaaaagaaacacagucaacaucaaaauaaaauuaaaagucaaaaaaaaaaauccauuuuaaaaccuuaacauuguagaacugagucuuaaaagguaauaucacuauuauaacuauuucauuauaaaguaauaguuucaaaauugcaaauuauagaauauaauuauuaacaguaaugauauaauuauaaugguaauacuuuauauuugggugauuggauugggcauccauacuguggcccuauuuuaaggauggagcuacucccauucucccuauaucuauguuuauaauaggucuaugucacaauaaguacauauauuugccuuuguaaguaguuagaaguuucuguuuguuuuguuucugaggggcagggagcugaacucacucaggacccaggcuguccuugaacuggugucagcccugucuccgccucccuaguacuggcugggaugaaagguaugagcugccauaccugugcuauguucuugucuuuuggguuuuuuuaagcuuagauuuuggugucuuuuauuacagcuacuuuuuaggaauaacuuaagcaugucacaaugugacuauuauaguuaaacuauuggcuuguauuucaauauuuguucuauuguacuuuuauauacuuugauugacaugaauaaagccucugcauuguuuauuccuaauauauuuuuacaagaaguacacagucagaggauacaaaacauaugcuugcaacuuuaaaaaguuacuuuauacaauagucaguaauguauaggugugugggugugcgcauauauauguauauauauaauuaucuugguuuuuauuuagugguuuagaaauuguaucuuguuugcuuuggauuuuuuuuuucuaaaaagacaaaaaagaguuuugucuuuuccagucuggaucuaauacagccuaggccagccuugaacaugcuguguauauuaagcucaccuaggacucuggauccucuugccucuaccacucagaggcuagaauaauuugucacuauucgugacacgaauuucuuguuuacuauuaaugauagaugauugucugccuccauaggcaugugguagucuuuucauguaauuccagcagacaggagaugaggcagggagauugugagauugagacaagcccagcuuaugugagagcugugauccuguccuaaagauggacggaggaaguaggaaagaaggaguuaacuagagcuuauucuucuuggccuuggccuguuguaccuguucucucaaaaggagaaaccuaggcaccaagguuuuguggccaggcacauuguacuugacaugcuaauuuugcuaauaaaaugaacuaauuuaugacaggucuggaucuugaucuuuacucucaacuuucagacuaagaucaugguacacaucaguauuucacaauuaggcuuugucuuuuauuuucauuuauguguauggcuauuuugccuacauguaugucauuguaccacaugcaugucugauguccagaagauggugucaguucccuggaacuggaguuauaauugugaguugucacuggguacugggaauggaaccccagauccucuagacuagccaaugcccuuaauagagucugaaacaacucuugagcccucagaguuagguuuuauuucauacccauugccugaaguugacugaggagagaggcagccuggaaccauguauugaggaccagagaaccaguauauaaugcagagaaaaggugaugccugagacagguagguuuuggacugugaggagagggugguggugaguccacuuugugaaggaucuuaccaauguuuaacaguuaauauucuguagggccauaaugaucacugauuccuagcuggcuugccuaaccuucugacauugcaacaccaaguugucaucuauaaauucucauuggaaaaccaugugguugaguuaaaaaaaccaaaccaaaaaagcuccagaaaaauuucauuauguuuuaaaugaguuuacagauugguguugggccacauucuuccuuaccauguugugcauguggaagcuacagguuggaaauaccuuucaggaucacagggaaaagugagguuauugagaauaacaaauaugcuuguuuaacauucuuguggucuucucuucccuuccucacacccuaccuuccgagccugguuuuuaagauuacuguaagccuuaucuuauucagauauguucugguggagaaacugaaagauacuaugaaccucuggagggcaggcaguggaaugucuuaagaaagguauuuguuuggcagaaagggcuuuaucugaauuaagucaaggaaacuaggaguauauacgacauacuugaugaggguuagccagccucaagcaggauggaugugcacacucauggucccagagcccagaaggcugaggauacugaguugaaaacuagccugggaaaaggagaaagaagaagaaaagggagaggugucuuaaugacucacuagguaccauuuaguacaguggguggaggaauaagaaaagaaacaaggagagcugaucaaauaagauuguaggagaacggcucagaagagaagaugaauuuaguuucagacguguuaaaugccccugaaguguccaguacaagucuggagcucauauagguagcagucaugaguuuguaggagguaauugagcaucccgagugacuaagcugauucggacgagcauuaucuuaaauaggauaggccuugaaaauguguugugguuguuccugggaagguguggucagaguggagggacaggaaccagggaugucugaggagaaaauugucacuagagcuaaguccuagugcuugaaggccuggcaggguguaguugagaaaccacccacucgguuugacuggugggagguuugccaucuagacaaagcaguuugggguuaggguguagaaggaagccagauuacaguccuuggaagagaaaaugggugauguguagguauaguuuucuuccaucuagucuuaacauuuugaaacuagaugguagaaucugaaaaaagacaaguuuugagaguguuuuuuuuucuacuauuuauuacugugcaucuauuuucuuuuaaguacaaauaaguaaaacccugaaaucuucagauuuggugcuuguguuuagaauuuuagaaaacacaaagagauucugaaagucuacagagaucuuaagcuucagagacaaaauaaguauaaaauauuguuuauucaauauuguggccuauaggguuuuuuaaaguuaauaauagcuuuacagagauaaaauugccuauaacugaguucauucaaaauguauagcuggacuagagagaugacucagugguuaagagcacugacugcucuucggaagguccugaguucaaaucccagcaacuacgugguggcucacaaccauuuguaacgggauuugacucccucuucuggagugucugaagacagcuccaguguacuuacacauaauaauaaguaaaucuucaaaauguauaguuuacuaguuuuuaguauagcuacagaguuuuguacagucauuaccacaaccaauugcggaacaucuuaagcaccccaaaagaaaccccugcauguguuugaggucacucccccucuuaguacagcggucaguuacccaccuuuugccuuuggagacuugcugaucuggacagucuguguagguggaauuggaauauuuguagcugaguucccguguuuuauuuucuuugugcucugcccccacccuguuuuuguuuguuugcucuggugucugaguuaggguauuguuguguaguaccugguguuugaguaacgguauugucccuuaccccugcaggccaggugcauggcuguccuuuugcuucuucagucucccgcugccaccacacugggcuggcaugcuuucaagauucauucauguugcaguaugugcuaacaguacuuauucuguuuaugacugaaauauaaucuguuauguggagagugcaucggauuuauucauuagucuauugaggggauuugauuguuuccccuuuuggccacuaugaacaguaaugcuacugugaauguugguguguggcuuugugugggccuauguuuucaguucucuuagacuaaaaccggaauuacuggaauuguuuaguugguugaaucucuuccaaaacuguauauguaacaccccacauaauagaauauauguggaucacaguuuugcuauguccucacguccgucuuucagauuauuguuauccuugcagguaugaaaugguauuuuggcuuagcuugcaggauuuuguauauguaacuaguuuuugaaagcuaguaauaggaaauauuuuuuaguccuuaaaauugagcuaaucuucaugcuuaauguugcugauuuaguuauugcuuuuugcccaucuuuuguguucagacaggcauacuaaaauuuuagauuucgcaagugggcagacaaccuucuaguuuuccagauuuuugagacagugcgcuaacgauuuccuuacugugcuuauuuccuagaaugguuuacugcauuuauuacaauauugcuggguuguuuuuauuuuuguuuuuucaguguuugacaucuaguuuugaaggccaagcagugguuaagucacaccuucuauuucaucccagcacucaggaggcagaggcagguggaucucuguguuggaggccagccuggucuacaaagggcguucaagacagccagggcuacacagagaaacccugccugagagagagggagaggaagagaggaaagggagggagggagggagggagggagggagggagggagggagggagggagggagggagggagggagggagggagggagggagggagggagggaaagaaaagguuuuaagguuuugaaaggacaaaagacauuaacauucagaugaauauaacuuuucaugcauuaaacauguuuauguuucuauaccacucauuucauuaaucucauaaacauuuacauuucugacuucccucaucugaaaaucucuuaagaguagaggcaggcacauaauauuugaucuggcccuaagccuugacuguaauguaagugcugugguccguugcauauagaaacuauaggcaaguuuacugcuauuaagacagauuuauucaucaggugaaucuuucaaaaggccuaaaaaguccauaguagucuuagacuacuaugagagcgauuucuccccuuuccuacaaacaggugucacacaaauguggcagaacuuuuaguaaucacugagaaagaaaaugugauaaauaaucagauuggucaauaauaauuaaggcacuuuacugcuaaccuuaggaccugaguucagucccugggacucaugugaaggaaagaaggcaggaaggagagagggaacuaacugccauauccucugauccccacuugagcguuguggcaugcauacauauguaguauauauguggaaagguuagcucauacuguucuugcagaugacccaaguucaguucccagcacccacaucugguggcucacaucugccuauaauaacuucaguuccaaaggauucucucuugaacuccuugggcaccuauauucacaugugaacccacugacauacacauaaauaggugaguaaaaaauuuucuacuuuuuaaaaaagccagacugaaguaaaaccuuuaaauaaggaugcuuuguuauuuguaguuucuucugcauaaucugauucugugcgugcuuagagauuggggguuuaucuagguggggcacaccccguguaucauguacuguuaaagguguuguguuaauaaaguacccaauuucaacuguuucuggauuuaauaaguaaaaucuagauaauugucacugugguuucuugugaacugguggauguuuggcauguaauuacaaagcaguucuugcagucuuccagugucucgucuccuucagucuauuccauggaucguucucucuuuccuaacauacaugaaaguaucuuuaggccaaagggaaccauacuagugagaugcacuuaaucucuuccuucuuucuuuuaauacauccuuauagaaugcauuggaaaaaucauggaagcauguuguuuucuuuguuuguuuguuuguuuguugcuauuuugauauauuacucuguagaccaggcuggccucagauucacagagaucugccugccuuugccucaagcacugggaccaaaggcaugugccacugauacaugauucauuuuuauuaucucucuucacccuuaucuggucuacacaggcuuuaggacagccaggacuacauacagagaccuuaacucaaaaagaaauaagcaaacaaaaauuuuguuugcuuguagccuaaacuguccucaaacuugcaguaguucugucucagccucuucagugcuggaacuacaaauuuucaccaccauaccaugacaauuaaaagcuuagaaucuuuaccuaaaguguagaaggggacauguacuuaacucccacuuccugggauaaguauauuaguguaguugaucuagaagcacguguucuccccugcagaacugaauguuaguacuauauaggaaaagggccuuugauuagauuugaguugaaaaugugcuaaagugagcaaagcgauaugcaguuguucugaaccaccacucuucacaaagaggcuggaguccuucaacagguuucguguucuuguaguggcuaaaauguguagauuuauguaacuacucacuggcaguuaucucuccugaaaccacacaaaaaucuuguuuccggguauuagguagucaauguguauuguguugcuagcucguaguagauggaagaaacaagcgguaguugcuuucagaagcuuuuccuggggcuugugaggcggagauccuguuaccaagggcuuugggguugaauauuacucacauuucauguagcagguauguagcacaggcuggccuggagcuuaagauagcuugccuuggcauuccgaguaugggauuacaggcacgcaccacuacucaguucaguagaguucuugaagcuagugauuuuacugaugcacgaaguccugcuuucucucucugcccacuugguucagcugaugcuuucuuauuugcagguuuggaaauugagucaaguaggggaguacuuggguagcaugugugaagccuuaggauugguucccuuccaacacuaagaaagcaaaguaaucaaaaaaacuugguuuuugcucuuucuuucuuuuccuuuugacacugaggauuccuccaagggccuugcaugauaaccccaugaucuacuguuggguuauaccccuauuuuaguuaagaguuucuaguacugugaugaagcaccgugacaagcagaaguaaccugggaaggaaaggguugauuucauuuuacaguuuguaaucugucauccagggaagucaggucaggaacucaggcagggcaggagccucaaggcaggaaaugaugcagaggccaaaggggagugcugcuaacuggcuuauucacugugacuugcuuaaucuuuuuuauaucacccaggaccaccagcccagggguagcuauacccauagcaggcuggccuucccacauuaaucgcuaauuaaggaaauacacuacagacuucacccacagaccaaucaguugggacauuuucuuaauuuagguuagguaaguccaaaaugauucuaccuugugucaaguugacauaaaaacuagcaaacacaaauacccuacuacaagcuuaguguuuuucauugcuucugucagauauguucaaaaauaacucauuuuaaaauuacauuuggggcuggagagaaggcucagcguuaagagcacugacugcucuuccaaagguucugaguucaaaucccagcaaccacaugguggcucacaaccauccuuaaugacauuugacucccucuccugguuugucugaagacagcuacaguguacuuacauauaaaauaaauaauaaauaaauaaaauuacauuugagggacuagaaagauggccuggugguuaaaaacacuuaaggacccaaauucaguucccagucagugcccacauaggauggcucauaguugcucuaacuccagcuccagaggagucagugcucucuucugaccucuguaggcaugcacaccacauguguauacauucacacaaacacacacacacagaagugucuguuuagagacuguauuugaaggcuggggagaugacuccaucuuggcauguaaguaggaccugaguuuagcucucuggcaccuaugaaaaaaauccaggcauaguggugcacuaaguaaucucaguacuagagagggagaagcagaagaucccaggagcucagccuuucuaaccggaucagugagcuucagguucugugagagggcccuccucugucaggaaaauagauaggaagcaaccacauucacccacacacacaugcacauucacaugcucaaagaaacuacauuugaaaguguuuguuagugguguggguagguuuaagauugcauuugcccugagaagcacagugagacaggaaggcguucauagacccugugcuacagagcugugaggagccuuucuagggccuuucucccuaccuuaaauaggauggcuuuacuucuggagucauagagccuagugguaaaggaauucuaaaacuagaaguuaagguacuugugaugaaucuugaaaggugacugguuggguguaaccaaaguuaccaaaugaaaacagaaguuuuccuuugacauugugcugcauaggcuaauauuugcucauauuaguuacaaaacauuaauaaagccuccccaaguggagcauaauuaucuugaaauuuuuacaaaaaccuuuauuugauguuaauagccuaccccucaaacuagguuaagauuguaaggggaaaaagcauuaccuggaugacucggcaugucagugcuccugucuguggucucccaugucugucugacggacgcuuuuuacuuggcuuuaguucucgggacuccucuuugcccauuucugcugaauaagggcacccuuuacuaaaccuuacauuaacuaaucuguucugagguuaaggaaagagcucagcacgccuagaacuuucugauaccucacguccagguugcugagaauacaauacacucggcagugaggcggguucuguuuaagugugagagguuggucaaggugagaacuuauucaucuguagaugaaagaaacuucugaauagaaagggagggauguucuacuaggaaggcagcccagauuaguguauaguauaauacaugaucuuuucuaaaaccaaacuugaaaaaacaauuuggcgguuucaccccucgcuagccaccuuuccauuacuggaacagguaugugagguagucaccucuuuauuaaaagagaaaaauggaacuuguuuuugcaguacauguugcugagcuguuacuauuguuccagcucuuucaaacuuuuuuauuuuauguauaugaguguuugcuuaaauuuauguauguguaccaugguaugugcaugccuagagagcccucagagguuagaacuggaguuagagaggauugugaccugccauguuaguacugggaaaugaacccauguccucugcaagagcagcaaguucuaacugcugagcuuucucuccagcauacuuuuugucuguguuauggagugcugcuuguacugcccuugaacuugugugugaucuuggauuauaggccugugcuaucaggcugggcaaaaaguuguaucuggccuacacugucagaggcuccaguucaugauaguuggucaaguugcuuuuggauauguaacaucaugguggagaguguuucagaacggacagcuaucuucauggucagaacaugggaggaauggaguuacccacagucccauuugaggguguuuccccaguaacucaauaaccaccuacuagucuccaccucuuaagauccccagcacuucccaggaguuuaauguaguacacaguauuuauucuucaugauguguuaaagaaagagaaguggaccuuguggugcaugccuuuaauccuagcacuuggcagaugucugugaguuugaaacuagccuggucuacauugugaguuccaggcuacaugaugggacccugucucaaaaagaaaagaaaaagcagauguuuucuuucuguuuaaaguaacaguguguacauuccaaucuguggcuuucucugcugcugcuccaggugaauaacuugggguaccgccuuuacucuuaguuuauuuucucucugaaccguuuuucccuguugagcucuaauuuuauaccaguaguuacuaugaaaccuuuauauuuugaauuaagaggcucagaacuaaauggaaucuugagaaucaucuuccaacucaaaaacauucuauaacagccuaugauuacauucuguaacacuucugugauuguaacuucauaaacugauaaagucauuuccuuuuaaacuaaaugauuuccauauuugcucauuuuaaaauaaaaaaauugagacagauaauaaacugggacugagaaaucucuucauuucaaaauaagccaagacuauauauaguguuuccuauguacauagcuugaugaugaggaaagugacaucauuuugcaaauuucuaauguuuggguucauagaggauaacuaauucuuagccaugcucuauuauguaguaauggaaaugaagaaaaucuaguuuuacagugauaguaaagagggauauguuauuaaucucuuuauagugugguuuuuaaacauuggucuuauauugaauggauuugcuuuaaacugugccuaauuuugacauguuauacauuuguuacugggaaaauauuaguucauugaguucccuccaacuucuaaauguugauagauuuuauuuauaauaucaaauagucauuaguaauacuauugcuaccucacugaagagggagagagggagggagagagagagagauauauaaacauuuugauuguuggcuugaaggcucugugucauuuguuuuccuuugaagcaauaggcuuuuuacuuguuaauuuugaaggaaaccucugggauauggcuuuagcucuuaugugaaguccuuagauuugguuuagcaccagaaaagaaaugaaggagaaugucuaacagauaccaagcuaggauauaaaaaugauauuauucuauggaaggauggcauuagugaacagcaaccuaggccucccucgugcuaggauuacaggcauaugcuaccacaccugaccagaucgaaauccuuuuaaauuuucucaugagguuuugaacucgggaccucuggaagagcaaucgaugcucuuaaccacugagccaucucuccagcccuagaaaauguguuuuuaaucuccaaguauuucuauuacugguuucuauuuggauccuguuucuguuuaauagcauacacuauguaauuucuuuucuucuaaauguguuaaguuuuauauuauaauggccuguauuuaugccucauuauacggucugucuuggucaggguuccugugcacuugaagggaacauguauuuugcaguugcucaugaaguaauuuauaggugucuauuauaucuaguugauugauggugguguugaguucaauuguguccuuacugauuuucugccccucgucugccugauucuguuaaauaggugacaucuccuacugcgguaaguggacuccaacaaucccccuuccguuucugucaguuuuccuuaugugcuguggugaaucgguguuaaaugugcgcagauuguuaugucuucuuggagaacugacagaauccuuucguauugucugauaagcccuucagucuucaucagucacuuguacaguucacuguccagaauuaguauggccauuucuugacucaucuuacaaugguagauuuuugucgguggguguguggauucagggucucucucuauauauagcccagaguagccuggaacucucuucuuuuuuauucuccugcaugcugagauuguagugugugucacuacacacagucccacuauccauuuguuuuuagucuguauaugccuucuuaauaaagugaguuucuauaaccaaacauauauaauuguguuguuucuuuuuuuccuuuuuuuuuuucuuuuuuguguuguuucuuauccacucucaaaaucugucuuuuaauugaugauuuauacuacuaacauucaaugucugcuacauuuguuauguuuuuuugucucccuuguucguuuuaucucacuuuuuugccuuuuggcuuuucacugagcacauuauauuaguaauacuuucccuuuuuaucauuuguacuuuuucaccuuuuaaagugauugcccuagaacuuguauauuuucagcuaauccaacucaauuuucuuauuuuuagguaaguuagguaguauuaguuuguuaugguuuuuguugucuagucacacacacacacaugcgcgcgugcgcacucgcaugccuaugauaaaauaccaugaacaacaacaauguaaggaaaaacuuauuuugaacucuggaugcagagauuagaugucuguaguaguggggaggacuuggcagcaggaucagggauuacaucccaccuaaguaccugggaaguagaagguggugccuccuauacaucggagugacacuauaacccucaaaggcuaaucuucaguggcaugccuucuccagaagggcuccacauccuaaaagucccaucaccucccaaacagcaccaccaacugagagucaaguguugaaacacaugagccucuuaguucuucuguugcugucaauauuauuuuauuuguauguacucaaaaauauaagaguauauacauauguagauuuugugcuaguauguguaugagaacuaccuguuaaguauaagugaaauaaaaguguuagcuuagccuguaaucccaguuguuugggagucugagggagaaaaauaaccauuuucaaggccugucugggcuccggacuugacuuuaaguuguguuugcaacuuaguaauaaauugguuuauuuguuuuguuuuuuagcauuuuauuuuauuuucuccuuguuuaccuagcuucuaaaaucauaaauaacucuuccauuuggccuucgauagguaaggcauaaagaucuguucucuaacuucacauggugaagauggugcacauacacgaaaaguaaacaaaggcaaauuuaaaaguuuaagaacacaucugcgaggcaaacguaagcaguucuuuuaagauaaaauauuuacuguccaaaaacauaaauaucuccuaaagaucaaaacaccugcugggccgugguggcccacaccuuuaaucccagcacucgggaggcagaggcagaggcagguggauuucugaguuccaggccagccuggucuacagagugaguuccaggacagccagggcuacagagaaacccugucucgaaaaaagaauuuuaugguugggggcggucaccacagcaugaggaacuguauugcagcauuaggaagguugagaaucacugcucuagugaaaacccaggcacauggcaugauaauuaaggaaauguaaauaaaguacugaacacugcuggggguggaagggaaccagucuuuccaguaaucagagaaauguaaauuagugauaauucuuuuuuuuuuuuuuuuggagggccuaacuaauuuauagcugacaaaauugagaacaauagcaguauagaagagaguauaggaaaaugauuguaaaacuauucauggggaaguaaaaugacacuuucccuacuugggaagguagguggccacuucucauagaauugacacguguuagguucuggaaauccgucuguaauauaugcauauaaaagauuguguccuaguaucuaaguuacaccaauuuuuugugaaaccuaaaguucacuaacuaaaccuguggacaccuguagaagacgagaaggacuugaagaggaaagacaguuugcuucuucacuuuagacuuauauggagaagagcuucuuagcaggccugagauugcucaucuuagggagaccuccuuuauacggcugcgccuuggcugaugucugggaacuugggccuguagaagaguucccuugucacgagugguucuguucucaaguugugguucaauugugucucgauugcucgggcaauauggcuuaugaucaccuuccuuccauguaggcguuuagauuguuggggugcacuucuuaagaaugccuguguggccaggccgugaacccugggcaccgucucucuagugaguuucccuguagacaacuugcuucagggauucuuggguccuuucauuucacugagagagaauuaggggaaacuuguacuucugagcuuuauuucacacgcuuuuucuuuuugaugcuguuguuuuguauccuuuagccaugacucugagugugauuauaguuuggaucacccuugauucuugggcaaguuuuuuuauacauaaguauucugaccccuuguuuggcacaugacuacauugcuaccaucuuaaaaaggucagaguuuguuggagagccagaguccuuggcaagcugaggaagaacuguucuucaggagagaacagaugaacauauuugggaaacagaggcuacuaggagcugguggaaagauuaagagaugaaccggaagaagccugaguagcaagccagaggaaacaggaugagguuuuauuugcacgcugcggggaauugaaccuugggccuccugauauuagaaaagcaccagugaacuguagccccaguuggaaacuaugaguugccccaaggcaacaggauuuuuuuuuaagaagcugaaauuaaaauggaaguuuugccuugugagauuguugguaauaaagagauggauuuuagaacuucacauacguuauuuaagacaagaugacuguggccucgccacccuggaugcacuccaucucccagcucuuagaagcuaugucagcucaggccugguuaguauuuggauggaagggcaaguguguuuuuauuuaagacagacuacuccauuuuuuuuuuaccaguuucaaaucaguaucauuaaacaacaaagaucaaauuuuaaguagcauuuuauugaugccaguucauuagcugugguguucuaaaugugaauaucaaccccugugaugcgccgggcgugguggccacgcacucgggaggcagaggcagguggauuggucuacagagugaguuccaggacagccugggcuacacagagaaacccugucucgaaaaagagagagagagagagagagagacagacagacagacagacagagacagacagacagacacacucugcuuuacugaaugcauagaagacacuggcauugucgaggaaauaaaaagauaauauaaauauauaauauaaauaggaaaauauaaaagaugacaucagacgcugaauuauagucauuggcaguagugaugaaauuaagcgccaggguuggugaauaaaucuuaaaacgggaaaaucagucacgucaguaauccgugaccaugaugacugccucugagucuuaaccuucuauuauacauuuuugaguucaguauugacucuugaugacucuuuagauuauugacaaccuccugaaaguaaguuucaguagaguuguaacaggaaaaaaagggucguuuuggguuuuuguuuuuuuuuuuuuuguuuuguuuuguuuuguuuuuucagaggauaagugguuuaccaggaaauguaguuuuucuuuauaaaacuucuggucuauugaccacagcucuguggcacuccagccuuguaaaaauaacuauuuuccauauagcggugaauuugaacuguuuaaacugcagacaugauaauuggccucugcuauguuuguuuaggcaaugagaaauaucuauuuuacuaauuuagggcuuugauuugucuuuuuaguugaacauaaagagaauauuauugucaguuaauguauagcagugagucuugauguucuuaauuuuuuuaauggcaguuacuuuaguauccuaugaaaauuggugacuuuucuugaagguaagauacaucaucaccaucuaaaggaagacacuauuaggagccauuguuuucauguauuguuggagacagggucucaaguacacaaggugaucucuaacuccuuauguagcaaagacuugaugcugaugggugagaaggguggggggagacagggucucccuauguaguccuggccuuccuagauggaacucacagagaucugcuuguuucugccuccucucaagugcugugauuaagggcaugugguacaacguugaacauugccuuaaauuuuuaauccucaauguccuaggcacuggaucaccacuacacccagaucaggaaccaaguucugaaaaauucacuucauggacagggagaaaaagagaucauuggaguuggaauuuacuuaggagaaucaguaaacauugguugcauuguucagugaacagaggcauuagauagaaagaagaugcugguaauagaggugagccugccccgugacuugaacaaacgcauuucuguccauuacuuuauaaaauacaucuuucuuuuuuagguaauguuguuuaauaaaacuaauauauauggcaaaauuauauuagauuuguuuacuguuuguggagugugaguguacaucacagugucacauggagaucagcaggcaacuuucaggagucaguucuucugucacauggguccugggguucaaacucaguucaucagacuuggugggaagcaccuuuaucugcugagcaaucucacuggcccaaaaggcacaauuuuauuacccugcugauuuaaauagucuuuuauuucuauaaaauacuuucauaguauggaaaggauaaacuuagauuaaaaguuuguguuucuagcugggacugguagaacauauucgagguaccaggacuucagaggcagaggcugaagaaugucuccuaugaguuuuggugauaggagcugccguuaauaaaaugugaugcccuggccuacgucuucaaggaauucuaguuauaccgaggguggugugcuuguguacuggguugugaccuccauuagcgguccauagaaagagcugggguagagaugaggaagcaguugggaggaaguggaugacaaaguguuacaacaguacuagucuuagggaaauguuugacgaugauuucuauucugguguacugagaagcaaagacagauggaauaaaugaaccagagaagucagcuagggcaaagcacacagugaauuggguuuuuuguuuuuuguuuuuuuuuaucuaagaaaccccgagauucuccuuuauuuuccucaguuauauccuuaauuaaucaguccugaguuacagcuucaaaugaaaaaacaaacaaaaacaggcuggagagaugacucagugguuaagagcacagaccucuuuuuccagagguccugaguucaauucccgguggcucacagccaucuguagugggauccaaugccuucuucuggugugucugaagagagcaacaguguacuuacauacauuaaaucuuaaaaaaaagaaaaaacaaaaaaagcaaaacguggugcuuuuuugccaguuucaccugcugauauacaguuuuguuguguuuguacagaguuggauaauucuaguacuuuccaacagggucuuaaacuucuuucacuuggacaccagauauauacauaaacuagauauauagaucaagccuuuacuaaugaugagucauaauucuuuuuuuuuuuuuuuuuuuuuuuugguuuuucgagacaggguuucucuguguagcccuaguuguccuggaacucacuuuguagaccaggcuggccucgaacucagaaaucugccugccucugccucccgagugcugggauuaaaggcaugcgccaccacgcccggcauaagucauaauucuuaaaaacaauucuuuggcaugcauuugaucuuacuguuuguuaaacugagaguagggcuaaggacauagcucagaaguacagugccuggcauuggaauccacacuaauuaagggauuaagauuagagagauguaugugcuaauaagguagacacuuuuaaaaaaaauuuacaguguguaugagcugguuagucuuuauugucuucuugacauagccuagagucacuugagaagaggugaccucaacugaugaauuucccaaggagauuggcuugucugugaccauguguuugaaauugccaugacugauguggagggcccagcucacucugcguggugccaucccuagguaguugggucugggcuguauaagaaccuaguugagcaugaaucagauuaaucucuaugucuucugauucaguuuuugcuugugcuccuucccuggcuuacgcuguagccuguacgauggaaguaaacccuuccucucuaaggaaucauguuugucauagcaacaagaagcagcgugugggggugaggggaagggagggagagagagcgagcagcagaaugccugugcuaguuuauagcaugaauauggagauaggauaauuugugugggacuugguucucuucuaccguauagggucuguagauggaacucuggucaucaucacauuugacaacaguacccuuagccucugagcuaucuaacuugccugugcuuacauuauauuaagaaauccuggcuaaauauuugcuaguguagcucauagagcaucuucauuguuuuucagaggugauaaaauuugauuuuuauaauuguuugugcuaaaaauaucauuucacauauauaaauaguacaaauauaguacaaaugauaacauaauacuuggggccgucucagaaauuguucuaaauucucucuugaucccaagcuaggauauuauuaagugauuuuuuuuuuaaugaaacauaacuuagaaacucacacagcaguuaggggagccacaugugaaggcacaggaaugugugcauggcgaggucagaaguuggcguugggugucuucccucuaucacuccccacuccguuuugagucaggccauuucauugaacauggaacuuccaguucaucuagacuggcuggccagaaacgcccaggggucuuucuaucccugcuuccccagugcugggauucccugugugaucugcugagcccagccuuauuacaugggcuuuggagagaagccucuggucccaugccaguacagcagcacuuuaccaaguaagucuuacugguuugauucuaaucaagcauuccaagcaaguacgguccagagauaugcuaauuugauaguuacgugccaauuaaagucuguuuucuuuaauuaaaccacuauguuuuuauaguagcugaaaacuugguguguacggguaaaaacaaaagcagacuacaguucauuacaugcaguagucugagaugaguaguuucagguaaugauuacguugcuuagcaugaggucacacacaguaaaaucagcugaugcgugcauuacaggugagcacagccagagccucagaugggcugugcuugacucgggcgucaguuuuggugguugagcuuuuagaacccuguuacugcccagcuuuccucucaaccacauucagcccugugaccccugaguuguaaguaguuuucccacgccauucucaggacauuguaguccuucuguuucugcccuuuuauuguuauagccugagcuuucccuucauuuguuacacggcugugguacccuuucuuccacccucuccagacuuucuaaacuacauguuuuuuuccuuccuuacuaauuucuucuccaauuuccuaugaaaagucucuaauccucuuucucagaauuauuugauacugcaaaccuauauguaaaauaaauacaaaggaaccuaacaguugaaaauaggauucugggggcuggagagauggcucagcaguuaagagcacugacugcucuuccagagguccugaguucaauucccaauaaccacaugguagcucacaaacaacaaucuguaaugagauuugaugcccuuuucuggugugucugaagacagcuacaauguacuuacauaaaauaaauaagucuuuuuuuaaaagaaaggaaaagaaaagaugagauucuguuuuaucaagcuaguuagucaguacuccuucaaaggcuuggucaggcauucagcagcagcaccuguuaauugauuaagaacgaaaguguucugguuaauugaccgcagaccuuuugacugucugggaccucagcagucugaccuuccugguaaacugcuuuacauuauacagccguuccaaucagacaaauuggcccagaauauauuuuuuugauaaucagucuaagaaaucugaaguaacaagucauacuuaaaagguuuuuuggcuaauaguaauuaaugauuauugagucauucuaggcgccagccucuuugcuaagucuggaggcuuuaucugaauucuauaaagguuauaacacuggauugaauguguucauuaucacacauuaucaaaaccaaaauuuuaauuacugcaacuaauuguaaggcuggcuauauuuuugauagguaggaauaaagugucuacuuaaauuucuuuuuaauacagcuugauaaacuucuugauguugacuuuucaaagugcaaaacaaaguuuuauucuguuuuauguugaauaucuuaauuuaaaugaugguuuuuaagauacuauauuuaacuuuuauauauaagacuuaauuuacauauaauaauuauacauaugucuuguacagugugacauguauguauguauguauguauguauguaucugugccuguccauacacaugcauacauauaaaauaugcaaugaccagaucaggcugaguauacuacucagguagacgcuaggguuuuuguuuuauuuucauaaaacauccauuuuaaaguggaauacauaaagcauucugugauaugccagaccuuaagaacauuggauaaauaaaaauuuaaaauuaaauauuuacuuaugauacagagacauucuuaauaauuaucagcuuuuacauaaaaauuuaguaaaauauuucucaguaauuaucccauaaaugaagugcuuggaugaugcagcaggugcucgagaagugcguggcauuuuauacuucaccuuggucgucguccuccuuccuuugcucguaguucuuuucuuaguaagacugaugaaguacauuucucuucugccagugcugcuuuggcuguuuaaauugacauccuucuuuaaauaugauuuucacauaauacuuuauauuaaaguaaauaacuugaaauauaucuuuucagauuaucagaucuuugagcagagaaaguagaugugcaagacgugauugcuaacagggaaucuaugagcauccguuugccuuuucuguugcucuccuuuacaucugauuuuuggguguucguacaaucugaaaauauaaaagacacacggaucucuucacuguccauuucccagcauucccauuuuccuuccaacaacugcaagguuugguauuagauuucuuggggacauguuuuaugcauauguacaaacagacauguuuuaaauuucuuuaaugcuaauaguggaacacuuguguuuucuucuuuuuacauucaguggagauuuuugacauggugccauauuccuauauuuaagacagagcuuccuuacuugcuuucuagccacaucauauuugauuguaugaaacaaauuuauccaguccuauuaauaggguauuuuuuauuguuuguggacuucugcuacuacaaacauugcaauacacaccuuugugcauacuuuacuucaugugugccaauuagaucuggagggcacauguguagaaauuuaagauagguggauuuguaacugccagcucucucucuccuuguuugguaauguucuuuuuggaccuacauugagcugaagucucauuauucugguguaguccagugucccaguccugugagugcuaggguugcaggcauaaggagaccuggguaguuuacacaucuauauaguuugagauuuuuaccucuauaggaaaaguuaccauaagcguaugaauuuuuacuuuggcauugugcuauacuggcacagcaugauuuuuguuaagaggagaaaaaugaauauucuuguguucagacucuauaaaguauagucuuuuuuuuuuuuaguaaaacaaaaauaaccauuuacaguguaagugccuauauguaaaauuacuuaaaguaaugauauaacaagaauaagacaagauucuuguguguuaaaauucucuaauuuuaaaaaauauggaaaaaauauggucacgaaauucuuaacugcuugagggucagcaucacaggcuauaaaaauaaacuggugaaaaaauuaaauugcuaccagaccuuuuuucauuucuuuugcauuuaauaaugaguccuaaagucaaaaugcuuucaauaugccuuuaauccuucaagaaaguaaacuacuuugaaauuaaguuuuagaaauauaguugaguagaaccuaaacaauucacaaugccaacuuucaguucugcugaaagcaggaaguguauuacugacaagcagaaauauuccagcccaaagaacaucccuacugccauaugugguaagaauuugucacuaacccacaaaccacuucuguaauucagugaauaagcagaauuagucuuuguuggacauuuccaguucagugugaaagaacuuuguuuugcaguguuuuacaaguaacuauuagcaugucuuugagagagccuggcacauccuggguucuccugcacuagugagaggggaaaccugugcuuaauuccccgaguacgauuuuaaagcuuaaggagaccuuauuaaacacagaaauucucaucuuauuaaugucuuuaaauagaauuacuucuaguugugcccccuugcugcuuuaauaaauauuaaucuuuguuugcacuuacucuaaaaagaaauuauucuuaggguuaauuuuuuaaguaauagggaaacuaacagcuuagagcaauaggagaauuaauugugaggaauugggucagcagaauucauugaagagcucuuuguaaaucauuaacaguuuugaaaauaccaauguuucucuaaacuugaauuuuauuuucuuguauuuuaagcgauugagaagauugucuaccaaauauagaacagaaaagauuuaucccacagccacuggagaaaaagaagaaaauguuaaaaagaacagauauaaggacauacugccauguaaguuugaaaugcccuugauagaauaaauagaaaugcuaucuagcccuuugucaccccacgagcuguuccugaacugaauagcuaaggagguagaaucaauccuucccaagguacacugcagagccaucuguggcugugcuucuuagacuccguuucuucucguggagcaguuugugguuuuguuuugguuuguuuuuuacuaaaaacaaacaaaagaaauaaaaaguaaugucgacaauugggauaguuucuuaaaacacugauuuaccugcuaccugauuauaaaggagccuuaauugauugauuaacuguggauuaaaaaugggccauaagaugccucagaaaccugugucugcuauccucagcagucugugucucuuaagcauguuucaaguugaaaauguuauauucucauuacaauuauaugcuaagauacuauuguuuucuagcuaaguaacuguaaacacaugcuuaagucagaguccacauucuaaaaagguaucuuguguuggacaugcauuuucugaaagcugcuguaguguuucccuuccaguaucuauucucccuaacaccauuuccuuaacuguugcuauuagagcuucucucuaaaguguccuuaugucacagggaccuaguagugaccuccuagacccagugcucuuuuccaggguuuucuuuccuguuaguguuaugccauuggcagucuauuuucugaguuucucuucuuccaugauaacccucuuucagaucauuuccuccugcucauucccucuguuccacugauuucuugugugcauguguaccuauguguguauuggggauggucagaagucagcccucaguguggagguucaggagccgcuucugguuuuguuuuucuuuacuugagauuggguaucucacuguggugugggcuuuucaguuagacuagacuaccuggccugcaagccucagggaucugucugccauuguccaucucccuagugcugggagcacggcaagcgguuuacuaucugcgccaucucuccaguccuccucacuaguuucugugccuaaauuuaauccuccuacuguuaacuguucuacauuauucucaucugaggauugugugauuagacacuauuaauaaaauuaacaaagaacugcacagaguaacagugaugaguuaccacucuggaagucuuguagcugugagacucaggacuggucuucacugugucugguuuucucaauuuuaaguugaaguugguagugauaauacaucuaaggccugcuuuggauguuuaauaggucagaugucuuuuacuaacccaacacaguaaccacucaaggcuuuugcucuaaauauacuccacuuuccuuaccaggugcuuuagucuguucaggcugcuguaacaaaaauaccauaaacuugguggcucauaaacaguggaagugcauugagagaaguccagaaucaaggcaugguaugccgugagcacucacccaccgauucauaguuggugccuucucacugaaugcucguggagaacgaggagcaaacaaguuuccuugggccucuuuuuauagugacgaucguugaacucauuagaacaugcucuccucaccuccuaaaggcuugucuccuugaugcucuugcauugggaauuagguuucagcauaugaaccuugugggaauacagucagaccauagugcuaauccuuggaauaagaguugucuuaguuaggguuuuuguuuuguuuuuccugugaagagacaccaugaccaagcaaacucuuaaaaaggcaaacauuuuuuuuuuuuuuaaagauuuauuuauuauauguaaguacacuguagcugucuucagacaaaccagaagagggcgucagaucuuguuacggaugguugugagccaccaugugguugcugggauuugaacucuguaccuuuggaagagcagucgggugcucuuacccacugagccaucucaccagcccaaaaaggcaaacauuuaguuggggcuggcuuacaguuucagaggcucaguccauuaucaucauggugggaagcacggcagugugcaagcagacauggugcuggaggagccaagagugcuacaucuugauccgaaggcagcaggagacuuuuacacaggcaaccaagaggugggguuucuucugcacugggugaaaccugaguacuaggagaccucaaagcccaccuacacaaugacacacuuccuccaacaaggucacaccuccuaauagugccacuucacaugggccaagcauacucaaaccaccacaggaguuaauucagauuucuggauacuuuauuaaacauaauuuucaguacuguccacugaugucuuuuccccccucuggucuagagaaauaaaucuuaacuggcuccagguuucugucucacauucauguuacagaaaguugugagcauauacucugaugauauagaaaagaacgugcagaagucucucauuuuguuauuucauguucuagcauagguaguagacagugaauacaaaugcacauaagcucuguccucugguugauuaguacuaauagggauaauguagaaagggcgagggccauugagaaagcuggaaccaaaggaaagcaucagguuguuaacaggagggaggugaauuuuaguggcaggccagccuuccaaaaaagaaagcccuccuuuauauugguugcugauuuaugugauugacccacacacacacacacauaaucacaacaaaaccauggcgguugauaauauaccauuuguaggugggaaacugagccuggagaaagcuaaguauuuaucacagugcucacauaauggacaauaguuuguauccaaugccaugauauucagauaagaugguuguggcacuuaaggauauuuggcaguauuugaaggcauuuccucuaccggcuucuaguaagcaggcucccaggguaccagugcaauguaauguccugagaacagacuugucuaagcugaaguugagaaaccuuuagaauggccgcucuucaucuguguguuaaagucaggaggaccugguucacaaguagaauuucaauaaauuucuaccuguuuugauuugacauguaauauugaaaguacuuacauauuucuuagaaaauaguuugcuaauuuccuuugaauguuuaacauguccauuguugcauaagcacacuuuuaaacagcuuuaacauacaguuucuauaccaugaaacguacccauuuuaaguauauaauuaauuuucaaaguaaacuuaggucaugcagugacuaacccaauccaggguuuggaaauuucauuacuuucaaaaguucuguauuuagucccaggcagcugcuaguauucuuucggguucuggauuuuguucuuuaagaaauuuaacauagcugucauuucauauauuaucuguggcgcuugauaucauuaacucagcacguuuucuuguuauauuuguguuaugguaguauuggugugguaaagauuuuuguauaaacacacuuuuauucuuaagugcauauguaggaauaucauugcagaccuacagaaguuuauauuuaaccuuuuugguuuuaugcggcagcaaguugcuguguagccgaggcuggauucugaauucuuacuccuccugccucagccuguaacagugaaccuuuaggcauguaccacaacaccuagcuucuguuuagcuuuuuaagaaaauugagauaaauguauuucaaagucacuauccuguuuucuauuuccaacauuaguauguaagcaccaguugcccacauuccuaccagcacucguaaguuuuggauuuuugcuugagacugugucugcuugguauuaagcugcuagcuacaagcauccuuccuuccucagccuccugagcagcugaguuagaggugugagccauuguacuuaguuagcugcaggacuuuccuuuucugaguguguacaccuguucacacgugcuuguggaggccugaggucaaugcuggcaguuuuccucaguugcucuucagauugaagcaaagucuuaaugaaguucagagcucacuguuaaggcuagucccacugucuagcugcucauauguacucagcaagcacucagcugcuucaaccacgagacaucgucccagguccagacuucuggugauaguuuuucuagugcuucuugauguguuucuaauuugauguguuuuucaugugcuguuagcuaauucuuuggugaaaagucuuccaguuuuuuaaagaaaacuuuauuuuaaucuuaguguguuauaagaauucuuuuuuagaaccaguaaaucuaagagguccuauuguuagaaaaaaauaaugaaagauaaaauauuuguuauuuucaguucuguccaaaugaaauuauagauaaaguuuauuacuguggauuuccaguggaagcaaaaacaauaaaccauuugcaauccugaaaaaaaaaaaaaaaaaagaauucuuuuuguuguuccugcuuggguuugaaauagagaucucauacuugccuuagccucaaaccuuccuagugcugggauuacaaguguggauuaauguccaacaagaguucuuaauacauccugaauccuagaaacuauucccagaauuaaauuucucuauuagauaaaagguuacuuaccuauguuuguuuguuuguaagggcuaaaagugagaaaggcuuuggaguuggugaaauggaaauagucugccuauuuuguuguuaaauaggaagauuauauuacuucacauuguguaugguuaaacuuuuucaucuuaagaaacuuuuaagaguaaggaagaaauucccaccuugcacguaggcagccuaacauguaggcuaaggaucuuaacuaucauuuuggaaccaguuguuguacucuaccuuagagguacuuugacuagagagugguaugccguauggauaacaguuauuaacugggaccccuuauuacuggcgaacauaguaagaggaagcauuuacaguuagucagcauuauccugacugaauauucuagccucauguaucagaagcagcauuuuuggaacaucuauuuucuuuucuaaaugguacuuuaaaaagggaagccacauaaugugaaugaaaucagugucagagcacuagcaaacauguaaccauuuuagugccugaaaaauuuuuagagauaguuuacauagagauuauucuuaugucugucuuauaucucuuccuacaaauuuccaaaauaaagauuuuaucccccaaaaauaagaaaaaagaacuuuagugcuuuauauaauauuugaaccaaugaaaaauaaguuacucauuguaguuggccuuguaauaguuuaguuuaugcauagcuguuuccauuucuaguuuuucuuuuuguauguuaauuggcuuucugauucauuguggauuaaaaggccauaaugugauagucauaguuacaguguacauauucugauccuuucuaaaccaaagguaguaauuauuaggcagcucuaauaccuuaccaaccagaugucugagguuucuuuaaauuacaaguaauaagauguguauguaccucaggaaccacccugucuucaaccaugaagcuguacauuaagaacaaauauaauucuguaguauucuuuuuuucuuuauguaugugagcauguacauacauguuugugccugugucgguuuaugugcaccacaugugugcagguucucuggggaggccagaguucaucagaucccuugaagcuggaguuacaagugguugugagccaucuggcaggggcauugagaaucacugugauccucugcaaugcagcaauggccuauaacuacccagccgucucgccagucuuuagucuuaugguauuagucccccaaaauauauaguuuccuccuggucaaaagucauaaauuaggaaaacuuguaauuugaagagacaaagaagaaggaauaacuaaaucuauguguaaucuuagaaaacaucaagaaaauuguuacuuaauaguuuuauaacugaauuuucuggguuugauaauuaugcuguauuuauauaggauuuuagucuuaagacagaaaagggggcuauuccuauaaccccagcacuuaggaggcuaaguacaaagaaucaugaguuuggaggcagagacaggcagauuucugaauucgaggccagccuggucuacaaagugaguuccaggacagccaagacuauacagagaaacccugucucgaaaaaccaaaaaaaaaaaaaaaaaaaaaaaaaaaaagaacauaagaaucaugaguucgaaacuaguccagacuguauagcaagguccugguugaaauauuccuacccaacacaaauuuguagcuauuauuagaaaucucaguagcaguuagcuauaacucuacauuauuuuugcaauuucuaucuaaaucuaaagucauuucuaaauauuuauuauaguuuuuuggguuuguaagauuuuggucuuuuguuguugucuugaaauagggucucucuagaacuuaguauguagaccaggcuggccuuaacauagauagaggcuuacaagaugacuccaugagcuaacuuacuugcugccaagccugacgaccugaguuguuuccagaguccacgugguggaaggagagaagcagaugcugcaguccauucucugauacagcccauguggcacgcauguucaauacugucccaugcccucauauacacauaaguaaacaaacauaguuugaguaaggauuuacguaacucauuaaugcacagcaaaauaaaacaaauccugauauuggaucguaaaagauugaggguuuuuuuuuucuuacaugucuaauuuuuuuccaaucaugucauacuuugguaucuuaauucauuagucaugauuacuuaguuuuuauaauuucugugaaauauaaaagauagguuucuuaauaagaacuuuaacaaagaaacaauaauuaugaaguucugagguuugagcuggggagauagauggcccagcaggcagcaaugacuauuccuccagaggacuggguccagcucuccagcaccuacaucguagcucgcugucaucuaacuucuguggucauugcccacaccugcacacacagauauaacugcaggcaaaacaccuauacacauaaaguuuuauuuuguuuuugguuuguuuguuuguuuguuugucuuuuuuuuuuuuuuuaagauagaauuucucuauguagcccuguauguuauggaacuuauaggccagguggccuagaacucacagauauccaccugauaaugcuaggauuaaaaacaaagaaucaaaacaugcugagguuuaaucccuagacaccacccuaguuaauuuggaucaaucccuaauguuuuauauuucuaaaguuccagagauaauucuggcugcaucuuuaauaugcuuauuuacauuuuuuuuuguuccuuuucucaaagguuuauuuuuuuguuaaaaauuaccuuccugguaccuaaaacuucacuuucuauuuuuuaaaguacaugugauauauuuguaaucccagcacuugguagcugacaacaguucaguggcuuugugagcuacauugaggcccugccacaaaaagccagagaagaaacgcucgcaugccaccuggauauaaguaaugaaaaucuuuucucuuuuguaguugaucacagccgaguuaaguugacuuugaagacuccaucccaagauucagauuauaucaaugcaaauuuuauuaagguacguaugaaaaugaaggaagguuuccuugcuacacuucaugccuucccauagagcgauuuuaucaaagguauuaacuacccaacaugguccuaauaggaaauaaaagaaaacccugucuugcacguccuauuugcuuuucuuguagcuaccuaugccacauagaucaaaccauauauagauuagaagagacaguuuucugugugcuacuuuuacaucaaaggcuuauaagcacugcuaggucauuauguaaauugucuuucaguuuauguguaccuauauauuauugaaccauaugauaguuuccaauuuuccuuaguagugaaauuauaaugaacacuguucuuuugaacaauuucuuaggaugaacuaacagugcugaaauuacuaggugauacugauuuuaauuuauaaaauauaacugaaauuuuaaaaccuuugguaauuguuacuauguguguugacaacucugggccacuguguaccugugaucccaacauuugggaggcugaggucaggauugcuguaaauuuaagaccaucaugagcuaaagaauguggcugucuuaaaaauaaaaaaaaagauauaaacaaaugaauauguaaauaaaacagcauauauauaaauagauauguaaauaaaaacaaagugguaggcaucuuguuagauaacuugaguuauacuugaaccaucagugguagcuagguaggugggugggugguugauuugagacacaauuucuuuauguagugcagacuagcuuggaacuugaaauucucuugccuugcauucccugguagugaggaugugcgcuugcucuacucugcccagccugucagcucucuauacuguuaucaagaaagagaugcagccuccugugagacuuguguuuaaaggcucuaauguguucuauaggcuauuuugugcuuuugagucuaguuauacaacuauuacagcuuuucaaugacuuauauuaucuuauugauaauaaacgauaguaagaguagaaaaguaaauuugacuuacugauaaauuccaaugugauuuucaccuccaguguaaaggugaacuguaaauaauccugcccguguuuaaggaaggaagcuuugagcuuuccuagcuauccucuccagacuccaauggaggucaugaagaagauuaccagggaucucagagcaacaaaaguuuuuaaauguuuggggugagcaagcagaaauguggcccucuguccuacccaauaaagcucugugaaauuugcaaaaaaaaaaaaaaaaaauagaauagaaaaauuaauauuguauuuauaggacaaauaugguuugggguuaaaaaaaaucuuuuuuuuuuuuugguuuuuugagacaguguuucucuguauagcccaggcuguccuggaacucacuuuguagaccaggcugaccucgaacucagaaauccgccugccucugccuccucagugcugggguuaaaggccugugccaccacgcccggcaaaaaaaaaaucuuuuaacaaaauaaaguuaguuauuacacuaagacagaaauuuauggauuaaacaaacaauggauauuuuacuucaaauacugucaauauauacauuuuuuaugggugcuaaguucuagauuuguuuuguuuguuuuuuaagacaguuucucuguguagcuuuagcuguccuggagcucacucuguagaccaaucuugaacucagagauccaccugcuuguuccucuuccagugcuaggauuaaaggcaugagccauuaugcccugcaagaguucugauuuuuuuuuuuuaagauuuauuuauuuauuauauguaaguacacuguagcucucuucagacacuccagaagagagcaucagaucucauuacggaugguugugagccaccaugugguugcugggauuugaacucgggaccuuuggaagagcagucggcacccuuuaaccacugauccaucucgccagcccaagaguucuaauuuuuaacuacucuuagggcacugauucaguuauaucccaguucauuuauuuuaaucagauaucuuguuuuaucuguucuuagcuuacuaauuucaaacccauaugguucugaguaugcucucacuuugaguaaauucuuaagguggucaugggaaaagcugcuaacuaguuucguauucuuagauucaaacuguacuuuuguguuucugcuauaguuaacucucucucucucucucucucucucucucucuuucucucucucucucccucccucccuccaucccucccucccuuucucucuuuuucucucucuuucuuuuuuggcuagguauuaaguuuuuguuguuguuguuguuuccugagucagagucucucaguuauauaguccuagcuguccuggagcuguguaaaccaggcuggccucaacucaaaaagauuacagaguaauaggccucugccugcugagugcugggauuaaaggcaugcaccaucauacccaagauuuuguuuuuauuucuuaguacgaaguaaguuuuaauugcugauucuguacaauauauccaguaaauuagcaaaagcugaaaugaauuggauauauuuuugccauguuuuauacucuaaaagaaaaaugacucuugaugaaaacauuacuaauaaaauuugaaaccuuaaugaaauauucuugauaacuauaguaaauguaaaguuuaccuuucacucuuucaggguguguaugggccaaaagcauauguggcaacccaagggccuuuggcgaauacagucauagacuucuggaggaugauaugggaguauaauguuguggugagugacuugucauagauuuugagaucuauauguuuaaugaccuuaugugucuuacugagaaagaaguaaggcaaccuuuuuuuuguauaauuuauuuuuauuuuaugugcauugguauucuguccgcauguauguguguauaagagucuaaagcccaggaacagaguuacaggcaguugugagcuugcaugugccugcugggaauugaacccaggucuucuggaagaguagccagugcucuucacuacugagccacuccagccccuaagaaucuucuggguaaccuuuguguuguuuuuaaugauuguauucauuuuuauuuauugugaauugguauuagguuuguagauaugucuuugugagggugugagauccucuggaacugcaguuacagacagcugccaugugggugcugggaauuugcugccaugugggugcugggaauugaacccaugucucugaaagagcagucaguacucuuaaccucugagccaucucuccagccccuguaaaggccuagcuuuuuagguauaaugaccuaaguguaauuacauuucuagaaaagacaaaagcuacuuuugaagauggcucauuaaauucucacaaaguaguucacauauuuuaagaaaagcgugacuaagucgggugugguggcgcacaccuuuaauuccagcacuugggaggcagaggcagacagauuucugaguucgaggccagccuggucuacagagugagauccaggacagccagggcuauacagagaaacccugucucaaaaaacaaaaaaacaaaaaagaaagaaagaaagaaaaccaugacuauaguuuaaauuuuguccuaagccaaccaaugauauagcuaguaaauaacuuuaaaaucauuuuucaaagaagaugaaugcuugcauagaccaacgaaaugauugauaguauagguaugcucuuuuaaaaaaaauaauauuuuuaauuuauuguuugagaaauucauacauauguucagugcaucuccaucauauuuaccuucuacuccccuuaucucgccccucuugacuuucccuccucugacuccaccuaaggguggaaggugaucgaucacccuuccaguuucuucccuuagugcuucuuacaagcacaccaauguagagccaugcacugagccugcugagccuaccgaagccuguagcccucgggaaaacugacucagcggucagagcacgggcugcucuuccagaagaccuaguuuugauuccccgaagccacauggcagcuuacaaccaucuacaaccccaguuccagggccuucugugacauccuugggcacuaagcaugcauguagcucagauauacauacaggcaaaaggcccauucauacacacaaaauuuaaauuguuuuaauuaaaaaaauaaagaagaagaaaagacuguuuucccucccacgcagccaucaguugucugcaucuucucaaccaggaguggggacuccaugugccugucuuccauucgugacagacacaucuuuguuucuuucuuuuucuuuuuuuucuuuuguuuuuauuuuauucacuuacgucccaauaucugcuuacuuuuuccucccaauauccccucccacagaacuuccccucauucucccccccccuucucuuugagauggggaccccacgcgccucaguacacacaucaggucacuacaggacuaggcacauccgcucccacugaggccagacaaggggaacuuaauccacggucaggcaggcaaaauacucaggaagagcccccacuacuguuguuguuggaccaagcugcuccucugcuacauauguacauggaggccuagguccagcccgugcucgcuauuugguuggugauuccgucucugggaagccccaagggcugagguuagcugacucugcuggucuuccuguggagucccugacuccucccccagcucuuccacacgacuccuggagcuccaucaaguguucagcugugggucucugccucucuuuccacuggcugcugggugagccucucaaaggacaguucugcuagguucaacagccauauuuuauaacuuuugucugaaagcaggauauuuuggguccuuccuaggaaaauagauguaaauauauuaacuauaaauuauuaaguaaaauaaguuauuauaaaagaauguaaagaaccucucuccucgccccuggucauucagggggaugcauaucugaacuacuagcauuuugguucccuuuggcuuuuuuggauaaaggggaauagugugccccuagguuugaaagcaagaaacuggcuuacaggauccuuuggagcgucgucauuggaauccacacuuguguggcuguggaaaguccgugacaaggagcucucauuacuuucucaugaauguuacaauggcuuuuucugugauguugcagugauucuaaugcauuggcauccuccgcugucccuuugagauuauuaagaggggaaugcaauaacaguacuaguguuugcugacaguuucauuuuaaagugagauuuaaagcaggaacacauuuucuggauaauggcaacauauuaugucugcauagaagguuguauuuucagaaguaugcauuugccaaaauugggagaauugucacuuaagauuuguauuucauuguuauguauuuucaagauaaaauauuccauuaaacaaauauugagcucuagauaauaugcaugcugaguuaccuaguagacugauaucuacuguauacuaaggcauugaaauaccuuuauaaauaaggugauagaaggauaaguaugauaauuguuauaauaguuuaaugauaacagcuuuuacuauuaaaauuuucaacuuuuauauuuuaaauauaaaaugcuucuauaaaaugaggaagcagauagaacuuuuauuuagagguuauuaauuuuaauaaauucaaccuuuuuuaaaguuguauuuaacugugcuuuaauauuugguuaagaguaauacuaaauuagguuaauacccuaacaguauuuuaguauaacucaaaaauaagaaauaaaugaaccagauuagaguuuaauccaaacuaaguaaaucauuuuaaaugaagucacuuuuauuuaguuuuuguuuagaagaugugauuuucauaguucauuuaucuuaugcuuauucuuaagauuuuauucuuaugugugcuuugccugcacauacguuuauguguuauguuugugcagugccugcagagaucagaaaaggguauugggucaucuggaacuagaguuacagauaguuacuagccaccaugugggugcagggaaccaaaaccagguccucuagaugaacagcuaguaucaaggaaacuuuugcucagaauaaaagauaauuauugacauuuguauuucacuugaaaaguaaaacuauuuuuaacugauuuuuuuuuuucucucccaccccaacuccuucuuagaucaucgugauggccugucgagaauuugagaugggaaggguacguuaacacauaguguuuggggaauaggaguuccuggucauuuauuacuucgguuaucugaucccauguaguuaaaggguaugcacuucuuuuuugugcucugcuauuuuauaugauacauggagcacaaacuucuguguuucagaaauucauuuuauaauauacuaaaauuaaguguauuguuauguauaguuuucaaauguuucaugauauuuuaagucaaauguaauuuauugucuagaaaguaauuuuuaaaaugguaguaaaauugaacauuaaaguaguucugguggucagcaauuuaagcuacauaugaugucauacacuuggaaugccaacacuugagaggcagaagcagggagcaugccacaaauuugaagccaagucaguuuacauaaugaguucuaggccaguuaaaucuguaugagaucuugucucacaauuuaaaaagaaggaugaucuuaaaaauagcaugacuauucugauaagucucuuugcaaaaacuaaucuuucuguaugaguguauugcaugugugcauacauaggcauguguaugugugugcagauagagucacaugugguauguauaaguaugaaaaaccagaggucaggaccaguuaguauuuuucuguuugucugucccuuacuuccccucuguccuucuugcuugagauaagggucucucacuaaacugggagcuuaccauuucagcuucaccagcuggccacugaguguccagaauuccaucugcccuacaguauaggcggauauacuaugccugaccuuacaugggugcugggcucaaaauucagcucugagugcagagcagguacuauaucuguugaaccaucuucccagcccuaggacuaaaauauuucuaaaagcuuaagaaaugucauacaguuacugaacuuuguucuauuuauauuuuuugcacaacagaaaaagugugagcgcuacuggccuuuguauggagaagauccuauaacauuugcaccauuuaaaauuucuuguguaaguaccuauuuguauguguuuuaaaaauauuuuuaaaaauuuguucuuugagaauuucauauacaaguacaauauauuuugaucaaaucuaucccugcccccauuuuccagguccucagacucaccaacuaugucuuucucccaacuucaugaccuuuuuaaucuacugaguuggugcacaugguguagggcaguaaacuggagccaugcaaacacccuaaagaaaauuaacugucccugacccagcaaccaacagcuggcaauagccccuccccuuggaguaggacuguauaagccccuccucauccauguuggaaguugauuggcucugucuuguucagggagcugccacuccaguguuuucaguguguaauagcccuguuacacccaguuucauggccguccuuuccaaccuugagcuuuuagaggcuuccugcuugcccauggugguuccugagccuuguggggaggggucgauauggaugucccauguaggugagcauuccacaccacuugcucuuugcuccuuagucaguuaagcgucucuguauuugccucucucuacagcaggaagaaccuuccugguugaagcuugagaguugcacugauggcuuuauguaaagaucaguuuggaaggcuguuuguccaucuagcaaaguaauagaagugguuucuccccuagggcauaugaccuauccaguuuacagugucaggcuugauuuccauccuguggagcagaccuuagguucaaugaaaaggggauccuauaacauucaugccacaauuacaccaguagucuuguuuugccaggucagcuauuguagcucacacaguucacagccagguaagacuuacaccaucaauacguaucaccuuuucugcauuauaaaagcgacacaguggagaggaugccuccacauccacaguaccuauuuuuauauacaugauuucaucagaaaagccgcauuguugacugaacauuuaaauuguaguaugguacaaacucaggcuauuacaagcuaggacuuaauuccaugcagacuuucacuuacaguaaucaguacugauguuuuaaacugcuuucagauucaggaggcuuaggaacaacuuuuucuuuuuuuuuuuucuuugguuuuucgagacaggguuacucuguguagcccuggcuguccuggaacuuacucucuggccuagaacucagaaaucugccugccucugccucccgagugcugggauuaaaggcgugugccaccacgcccggcaggaacaacuuuuuuuuuuaagauuuauucauuuauuacguguaaguacaguguagcugucuucagacacaccagaagagggcgucagaucucguuacagaugguugugagccaccaugugguugcugggauuugaacucuggaccuucggaagagcagucgggugcucuuacccacugagccaucucaccagccuccuaggaacaacuuuuacaacuguuauuuucuuuacuuuuaugaugauucuguuagucuuuuuacaucucuugacaauguacaugugacuguuucuuuggagguugauauagucacuucugaucaaauaaauggaaaagaacauugcuaacugagguauaucaugcuauccuuccucacauuuuaaaauuaggaauaaaguuaaauuugaauccugaaaguaaagauuauucuuuacagcagguaacuugacaugagccugaaguguaggcuggcccugguugaugcuggaauuccagcaucacuaaggaggauuguucaaguuuggccuggucuguguaacaaguuagcagugauucucaaccugugggucacaaccccuuucauaaaccucugucuccaaaaauauuuacacuacaauucauaacaguaacaaaacuacaguuaugaaguagcaaggaaaguaauuguaugcugggggucuccacaacaugaggaacuaaauuaaagauccacagcacuaggaagguccuuggugcaggguugacgugggagaccauuuagugaccucuggaguuaaacuccaguucagauacuaccacaguagaaauuugagaaaaugaaugaagugauucccaugcuagaauuauaguggaugucuauuuuauuaaugaauagcauauauuguccuuguuaaugacaggacuaaacugucugugguuacaacuaacaaggcaaaaccaagaacucagcagcagacaaaugucaggcuaauagacucaaagcugugcauguucaaccauaauaagguaauaacuaaggguuuuucuccccacauugcugcucauuuagauugagcguugagugugacaagggaaagaaaacguggugaaugugggaugcgguggcagacaguaacugacauuccucuggauuguuuccuuaaaugguuucggggaugauugccacuucaguauucucuguuagaugauagagucaggauuaaauaaucacugacuagacacuuuuuaaagccaguaaguaaaaauuagacaaaacaguaggaagcaaaggggguggcucaguguguuaggugauaauccuaccuagcaugcucaaggccuuggggcuuagucccuaccaccauuuuggggaggaaaaaaaaaaaacacuuaaauggauuacuuuuagauuuuuaaaauaacuauuagauacauccaaaauucuaaaugcuaauuuuagguuauggaccuuuacguauuugugugucuguggguaugcccacaagcacuuuuuguucguuuguuuguuuguuuguuuuucaagacagaguuuccucuauguaauaacucugguuguccuggcucuuuguagaccaggcuggacucgaacucacagagauccgaugccugccucugccuccugagugcugggauuaaagauauguguuaccacaccaggcucaauucacaagcuuuuaucuuuuuaggaaaaugaacaagcaagaaccgacuacuucauccgaacacuuuuacuugaauuucaaaauguaaguaauucccauuauagaguaaaaagaguuccuauuuccauucaucuucauucuucccaucucucccccuccuccuucccauucuugcugggaguccgagucuugcuguuauguaguuuauuuagugagugucuugagccuuaugcugaucaaacuguguaauaaagcagucugagguuacuuuacuuaggacaacagaauuuucugugugugucuugcauaauuaugcuuucuuuguugcauaguuuucuucuauuaacacuuugcagauuauuguuuuauuuauuacucacuuguacucagaauuuuuuauaaagacaaaacuaaauuuucauuuaaagauugggauauagcucaguggugggggccuuugucuagcagguacauagguucaauucccagcacuauaagaaguuaaaaagugagcuggagagaugguucagcaguuaagaggacugacuguucuuccaaagguccugaguucaaaaaccagcaaccacauggugacucaaccaucuguaaugagaucuaaugcccucuucuggugcaucugaagacagcuacagugaacuuagauauaauaauaaauaaaucuuuuuuuaaaagagagagaaauuaaaaaguaaauauuaauuuagauuuaaauuaaaguaucuucaggcuguugacuuaaauguuucagagucaaaaaaugauaauuuuucagggaagaaaccaaagacauguauaaaaagacauuggaaagaugcuugucagcuuuuuucuccucuauuauuagucugucuuggucacuguguuagucaggauuucuauugcucugacuuaacaccaugaacaaauacaacguggggaggaaaagguuugcucagcuuacacuucuauguugcuguugaguacugaaggaggucaggauaggaacucagacugagcagggaccuggaggcaagugcucaugagaguucaugggggaggccugcuuacuggcuuauuucccauggcuugcucaaccugacuuauuauagaaccaggaccaccaacccacagauagcaucacccaccaugagcugggcucuagcuauugaucacugagaaaaggccuuacugcugaaucucauggaggcauuuccucaacugaggcuccauccucucugaugcuagcuugugucaaguugacacacacaaucauccaguacagucuugucacagcauucuucccagcucauuguaaggcuaccuacuuucugucuggcaagcgacacacagucuuucuucucacugacuggacuaaugauagcccuuuaguugagucauuucuuuuacucagguugcacauuuuaucucuaguuaguaccuuaacuccuacaaguguaucagauauaucaguuauucuaacuauaaaaguauguauugcauagauaaaagggauuugagaaguuaaauaauuugccuauuuaguaauugacaaauauagaacuugcauauuggaacugaaacccaagcucuguucuuucuacugacaucuagaauaaucaaucuuaaaaguuauugaggggacuaaggagacugcuccaagguuaaaugcccuugcagagcucccagguuaguuucuagcacagcgcugauggcuagccacucacauuccacucagaucuaaaacucucuuugaccauggggcaugaggcacacacagcauacauauguccguggacucauaaaugaaaauaaauaguuuuuagaguuacugaggcaucuuuggauguuuaauuuaugcgggcuaucacuuucaauauuuacuauaagguuaaaauuggggaaaaaauuuaaagacguggaauacauagcuuacaaguuuguaaauacauucuucuaauuacugaauuucugcuuuucuuuuuuuuaauauuuauuuauuauuuauauguaaguacacuguaggugucuucagacacaccgguagagggcaucagaugucauuauggaugguuguaagcuaccaugugguugcugggauuugaacucaggaccuuuggaaggacagucagugcucuuaacugcugagucaucucuccagccccugaauuucugcuuuucauguaggaaucccgucggcucuaucaguuucauuacgugaacuggccagaccaugauguuccuucgucauuugauucuauucuggacaugauaagcuuaaugaggaaauaccaagaacaugaagaugugccuauuuguauucauugcagguacaaaauaauuuucuaaauguagagaaguacaguguuuauguuuugugagauaagguuuuauuucuacauuaauaugauguuuuauuauaucuugagcuuuuccuagcccuguuaugguguguuugagaauaagacccugugaauugauauaaucuaaucugguuaauagacugucuaaauguugcuguaaaacaucauauuuccucauaugaucagugucaggcaaauuuucaugagugaugaagucucagacuuuaaaaacuguauauagauauaaaggccuuacugaucugagaucccguggucugcagagaagugcuggguguagggacacgcuuauaaccccaaaccaaggaggcugaugugagcuuuagccgcucagggcuaccucccgauaauguugucccuuagcagaaagaagggaaggaaagagaggggacagacaaagccuuaccugacacauacuaaacaugagaguuuaaaagaauucauugcuaguuacacagcauagaugucauuuguaagauauaccugaauuucauagcucuuacgauguagauuguaagguguuuuccaagugacaaacauccugugcuggauuuuguucccgaggagcaagcugccaugucuguaccauuguugucauacccugaaauuauaguuuacaaacuucugaaaucuuaagcaaacaugaaacgagcauucuuuuuuuuuuuuuucaccuuuuaaggaauuauggugggugauauuuauuguuaaauauucuaaucuccccacuuuuuuuuuuuuuuuuuuugagaauugaaggcuuaucacugcaucuuauguaggccaggcugguaucagacuuauuaaauagccaaggcuaucuuccuugccuccacucuucugcuuggauuauagaugugugcuaugauaccugacauagcauuuuuguaguaaguuaaauauaaacuguugguauacauuuacuggacaucuuuauuaaauugugcuguguagcauugcccaaaguaaugaccugccccuuaacaggcuuaaguuuagcuauaucucuguuaaacugcucuguaaaauguuuucacucuuuccagguaauacuaaguuccaauuagucuuugcaaauuuagucauguugagacauaagaagucauguaaacacagccuucaaauucugccauucuugaagggguaacuaauuuuguguuccgagugcagguuagagguuguguuaaauaagagcagguguuuuuaacugagcucauugaccuguuuuuauugucugauuauuuuuccuacuuauaagccaugaaauauuuuaaaugaaaagcaaagaaacauuccaguuggaaggaagauagccuuaauuuuuuuucauaucugggaaauuaagaaugugugccuaaacauuuauaggauuuuuauguccuuaaauauugugacuucuuuguucccugucucaucugacagacuuucuacuccaguaaacuccguauuauuuaugauagaacuaacgagcucugaaacacuuuucagaaagguuuguuaauguucuguggcuucuuugaaugaccacuacucuuuuuuuaaaaggcggggucuuaauagccaaggugagccuugaacuuuuaccuccccauuccuaggauaccaaagaaggaagaaacaccuuaccuaacuuaguuuuaauguaaaauuauucaaaggcucccuaaaguggcucaugccuauaaucucacugcauagcgacugucggagcccagccugggccgcagagugagacuaugucucacaaagacgaagagaauuaacaacaauacaauccuaaaggagcaaaccaacaaaaacccaaaaaccagggagacagcaaaggaaacaacuaagcuagguuuuaaacacaggaaaaauagcugcuacuugaauuguauguuuuuucuauugcugucauaaaauaucaugacccaaaauaaauuuaaauaagaaaggguugacuuagcuuacaguuucagaggaugagugugcauaauguuggggaauagccucagcaucagaaaguaaggcaaggcuaaacccugcaagccuaccaauauuuguccuccaacaaggccccauuuccuaaaggucucauguuacaccaaccuccuaaaggggaccaacuggggaccaaguguucaaaugugugagucuggaagacauuacucaucuaaaccaccucauccaugcuuaaggucuacauuuauaguguauagaaaaauguuagggagaauacaacuuuuaaaagaauaaauguugaaucaaucauaaaaauagaagguucacaguaguuuacaguauaaucaugguuauauuguacaguaauguauaagauauuucaaaaccuaauuuuagaauuucacuagauaaauauguauguuuccaaguaguauaaaauuuacuugauuccuuaggcaguuuuucuauuuucuaucuugauauuucaaaagaccuuagaaucagaguuucucaaaaaucacacuaaauuuguccugcuaaacuauuuguaucuguaauugaauuuuacuauaagaaauaaauaaagaaaacacagcacgguaguuaugccuguaaucccagcauucuggaaacugaagcaggaacauuaugaguaggacaccaacaugaguucaauucccagcaaccacaugguggcucacaaccaccuguauugagaucugaugcucucuucugguguacucauauaaauaaaaauaaaucuuuaaaaaaaaaagagagauuauugguuaauuacuuuuuuaaaagguugauuuauuucaauuuugacuuuucuuaccuaacuggugucuuuugauuaguaaagagagcugccuccaggagaauugguuugcugguagauauacagaaaccaucuaacaaauuacuagauuaaaacaaucuuuucauaguuaauuaaugguggucaaaaaagaaagcuuuuguucugauauugaaagauaaagaaaugguuuaacuugauuuuuuuuaacaacuuguuugaaauuauuuccuguuccauccuguuauucagccaauaacuauaauucauaagucuauuucaguaggguuuuucuaguuuuaaaaauuauuuacaggguggugaugguggugcacaccuuuaaccccaacacuugggaggcagaggaggauggaucucugaguuuugaggcuagccuagauagacuacagaaagaguuccaggacagccagggcuugcuacacagagaaaccauguaugggggaaaaaugaugauuuaaugcuguuagaagacaguguguuaacugaaguaacuuaaaagcacaucuacaaaaggaaagaaaacguacccauuuaauauaaaguguguuuguugggaucuuaaaaccuauccccagcuggcugggaccucaaguacucaugccucagucucugaagugcucgucaccauaggcaggccucccacacccagcucuagagcgagcauacuucacaagaaugcuuccuuccauuuaauuaaagucguuguaaaaacaguguagcuucagcguguucugcuggagcccagcccggguuugucagcugccuuuguguauggacuugggucacuaaggucacugcugcuucucugaacugauccuacacuugaggcuuucucucccauaccuacuacaauuuacugggucuucuugaccaaaacaguaaagccauugugagcauucuauuaugcuuauaacuauugagaauaauuuuaucucuacaggggguuacuggcgagaauuagacuuauggggguaaggguuuacagguucuuugugaggcacuuacuuuuauaaauugcugaauuacauuuuuaaauaucaaauauuaauguuaaggaugguacuguacucuaauuuguauuugauuuacuauguagaauuguaucaaauuucuuauugggguauaauuagcauaccuuuuauuuaaagaaaaaaacaacaaauuuuuuuucucaaacuuuguucccuuagugcaggcuguggacgaacaggugcuauuugugccauagauuacacguggaacuuacugaaagcagggguaagaaugccuuuuauauaguaucauauucaguuuauuguuauguuaaauuuauaguguagguuuuuugguuuuugguuuguuuugguuuuuuagauauacuauauuucuagaauuagucuuaccauauaaagagcaauguggguaaguguaaauguuacagcugccuugaaacuaugaacugcaaaccagggugggguuuguuuuccacugagugaauucuuucauguguaguguuuaagagugcugaccccagggccaaagugccuagaaucaauucugggcuuguaguucacuacccauggcauuuuaguugugacaguugcugucagcauuguaguuucuaccuguuauuuccauuaaauuguguuugaaacuguggaagacacaaggaucagagucccuucucugaauguguauguguauguuucuuguauauguuucuuuugcuaguucuauacuauguucauuuucucuguguuauaggcaaacuuuaucuuucauagcuugaaauuugcuaugaauaugucagucagcauuuuguuaaaaaaaaaauagguucaaugcuuaguuuuccuuuuacaucaucuuuuucccccuaccauugcuguccaucuguccaagucuccucucccuccccacccccccaaggcaagagcaaguuuuaaauaauucuuaaauaaucucucugggauaaaacuucauuuuuauauuccccuaagacuaaucuuuuucuaauaugaaacguuuuucaaugaaaaaaauugacuagacugcgcucuucccaguuguuuauguuugguugguugguugggguucuuugcggggaagggggaugaaacacagggucucacuauuugguucuggcuucagagacagacagacagacagaggcagagagaccaggcugaccuugaacucagagauccuccugcuucugccucccaaguuuuuggauuaaaggaaugugacacugugccuguaucucauuuguaacauaaaaguaagaaauuacaggacuagauugaugaccuagcaguaaagagcacuuccugcucuugccugggaccagaggucaguuccagcacccacaccaugacacauccugaaacauaacuuucaggauagccaaggccuucugaccucugcaggcaagcaucuggugcacauacauacuuauauauguagauaaaacacauagaaauauauauguacuugggagaggauagugcuuagacagggcuucacuguagcuuugacuguuguaaaauucuguagaccaggcuggcuucgaacucacagauucaccuggcucugccucccacgugcugggauuaaaggcgugccgcaccaccucacagcauaaaugaauauuuuuaaacuccaaaacuaaaacuggaaaaggaagagauagaaaagggagagauauuaaaauacuagcaaacaaaauuugggaaaaaguuucagaauauuuuaaguauuuguuugaaacaucacuaaaguuguuuauuauaguccccacuugauugaauuuaucuuaacauaacuauaaaccuagagcuuagcuggaacuggauauaaaaaugcuuuuuagccgggcgugguggcgcaugccuuuaaucccagcauucaggaggcagaggcagguggauuucugaguuugaggccagccuuuucuacagagugaguuccaggacagccagagcuauacagagaaacccugccucgaaaaaccaaaaaauaaaaaaauaaauuaaaaaaaaugcuuuuaaugucucucgagacuacagcuuaaaaucauucuuugcuugucagucuuccucauggcuccagaauguuucucucagacaaccaaauccuacucacuucuuccugguucagacugccgucuuuccuggaguagaguugggagguacagacauaccucaguguggacuggauacgcugugcgugugucuuuacagagacgagccugcgggucugccuuagcucuuucacuugugucgugcauggccguggccaaggacacagaggccuagaaaguaaagucaaauucuuuaucuuaggcuuuauccauauucaacgucuuaguucuccgaguaaucaguuucccaugauuuugucagaauaaccuuuuauucacacuuauguguucaugugcgugucaguaugguguguguauguguucaucugugcacugguauaugcaccagcaagugguggucagagguugacuuucuggcucuuuuacaccauaguuucuguguuaaugucucuugguaaacuagcacugggguuucaggccccagcgccacaccagcauuuaugucaguucuguggaacugcagccagguccucauacuuauuuacaugagcacuucccugacuugagccgucuuucucaccccuucagaacuguguaauuuuucccccaccuaucaguuuuuuguggucucuguguuuccugcaugggcuagucacauucugcugcgugauucugaggaccggauacgugcaucugcagcacugucugucuuugucugauagcuagagcgcaguaaauacuugcaguuauccagccuguaucuaaggucugugugaaaacuuggaggguauuuuacuauuuucugauaauguuauauucuuuguuuuagaaaauuccagaggaauuuaauguauuuaauuuaauacaagaaaugagaacacagaggcacucggcaguacaaacaaagguagaguugguuuuucucuuuguaaguuauauuuuuguaaguguuucuccuuggaugcuccucacugucucguacuuuaucauuucucuuuauaauaggagcaguaugaacuuguucauagggcuauugcucaacuguuugaaaaacagcuacaacuguaugaaauucauggagcacagaagaucgcugaugguguaaguguucuuggcucacuagccuuggcagacuugcgaucuugugcuguaggugggugagguggucugaaaaaggaguuucgguuugggguuuuuggggagguggagcuggggguucaagacaggguuucucuguauagccuugacuauccuggaacucaacucugaagacaaggcugaucuugaauugagagauccccaccucugccucccaagcgcugggauuaggcguaugcaaugacugccuggcucacaggaguuaacuuuuaucugaugugggucacuaacucacuuuacuuuuuaucaguuacgguccagaguuagugauucaaacugaauaaguaaaauuuaaaaggaucuuaugucaaagucuacauucacuauuguuucaaguacaaacuaccuuuaaaaacuuaacugcguuacugcucucacccuuaacuacguaauuguacguugaguuuaacugaaauuuauuuuggcguggcaguauaacauuuuguagguuuuugcauguacuccauugcuuguuuguauuguaagacaaucuugcuauguagucccggcuguuggagguucucuugccucggccuccuugaguacugggauguaauauauauacaugcucuuuaagaacagucauaggggacuggagagauggcucagugguuaagagcacugacugcucuucugaagguccugaguucaaaucccagcaaccacaugguggcucacaaccauccguaacaagaucugaugcccucuucuggagugucugaagacagcuacaguguacuuacauauaauaaauaaaucuuuaaaaaaaaauagucauagggccaccagaaagucccuuuuugucaugcuguaacuccuugcuauauuagccuuaaaugaucuuacuggagcugcagauuguuuaguuuauuauuaagggcuguguauuuguguguauacaacaugauguggggugagggauacauaccacaauguggagaucaugugucaaucaaggaaaauuacuuuuccuguaauuuuaguaaaacuuuuuuuuccccuuggcagaaugaaauuaccacuggaacuauggucaguuccauugauagcgagaagcaagacucuccuccgccaaagccaccgcggacucgaagguacucugugccuuagggaaucuccucuagaaggaugcuuacucuacugaccuaacuaaaaugacaacaucggauuuuuucuuaguuucauaacuaguuauuuuuuuaagauguaggacauuugccaauuauuuguuauugauaagcuaagguuuuugauugauuuuuauauauaauaucaauacuacacuauacuaagauacauauuuugguguuagaauacgaaauauccccuuagcugccuuuaaaaugggcuaggaggacucucuagaaccaggaagucagagaacagucaauguuuggagacacugcccagauccucuccugaccaaauucuacugaaggcucauuuguucuauguauggcaggcacaaagggaagaagcgagacuggaaagcaguguuguagaggcuuaaaggagaaaggauuuuauuuuguuugucuaaaguuugguuugacagugcuagugucuccugcaugugagacaagaauucuccucuccccaccuccggccccaggccacaugcccagcccugagggagggcaagcauagcgcaugagugaguguagugagugugugugugugcucccaacagcaucugccugagaugaaaccgcauucacaccugggugcaacacagagcauuuaagacauuaagauuacaauuacaauuaagagauucuagcgaggaguuauggauaguucaugccaaaccauuuagaacugucuaacgugggaagccuacaaacaguaguguuugggaaaauucacuuaggaaugaaaaacaacaaguacaaauuaagaugacgcuggaugucaaaugagcauugaagaaacugaggcaguuuuggggauugcugcaagcuauaaccugggcuacgugguagguuuuuaauuaugguuuagauuuacucauuugaccuuaugugugcuuuaucugcauguaugcauaugcagauaaaucucuguguguguauguaagaaaguggcaucagaucccuuagaacuggaguaaugggucguuguaagcaguugugggugcugggaaucaaacccugguccucuggaaaaggaugcugagccaucucaccagccucaaguuuaacuuuuuaaaagacaauuguaucaaauucaaauaagcuguguuaaagagguuuauuuauaaaguaguagacaguagaaaauagaauuuuaaauagagguuuauuauuuuaguuaguuuuaaaaaaauaaauaaggggcuagagagauggcucaguggucaagagcacucacugcucuuccagagguccugaguucaauucccagcaaccacaugguggcucacaaccaucuguaacgggaucugaugcccucuucuguuaugucugaagacagcaacaguguacuuauaaaauaaauaaaucuuuuauauaaauaaauaaggcuggagagauggcucagugguuaagagcacugacugcucuuccaaagguccugaguucaaaucccagcaaccacaugguggcucacaaccaucuguaaugagaucugaugcccucuucuggugugucugaagauagcuaugguguacuuacauauaauaauaaauaaaucuuuaaaaaaaaaaaaagccgggcggugguggcggauuucugaguuugaggccagccuggucuacagagugagucccaggauagccagggcuauacagagaaacccugucucgaaaaaaaagcgauagauagauagauagauuuucuugguugauaaauuauguauguaauuuagcuuuuaaauaauauuuaagguacuuuuuuuaauuugccaguuuucaaaacaccagaguauguguuuuuaaaacugacaguauguuaaagugcaucuagauucaucaaagccaaaacuaucaaagagcaacuggaggaaaaugagcagaggacuagccuguuuaaagauuacagccuuucagagcaaacgugcagccuggcucccgaaugggaaaggcagaaagaccagaaacucaaggucaggccugucagauggcucaguauagucacucagugucaagggaaucugaugaccugaguucaaagccgggugucugucuucugccugccagugugguccauacauagcugcacauccacaucgaacucacagauaacgaggaaaacuuaacucauugccauccucaacuacauacagccuggucuucacaaggcugcauuuaauuagauaaauauaacaguuuauuuccacuaguuacaaaaacaaauaccagggcuggacagggagauagcaucagaaagguaaaauaggagauaauuccagaguaggugccucugcuucauagacuagagguggagacuauugcuuuucguuaguaucguaggacuuuaacaauaccucuauguuaccuugauaaauacagaauuuccuuagcuuacgaauuagaacauuguaaguauauuguaaucagucaacuuacuuuuaaauguuaagcauuguuaaagcccuaucuguccuccucaguugccuuguagaaggggaugccaaggaagaaauacuacagccaccagaaccucacccggugccacccauccugacgccaucaccuccuucagccuucccaaccguuaccacuguguggcaggacagugacagguaccacccaaagccagugcugcacauggccucaccagagcaacacccagccgaccucaacagaagcuaugauaaaucagcggacccaauggggaaaagugaaucagcuauugagcacauagauaagaaguuagagcgcaauuuaaguuuugagauuaagaaagucccucuccaagaagggcccaaaaguuuugaugggaacacacucuugaauaggggacaugcgauuaaaauuaaaucugcuucaucuucuguaguugacagaaccucuaaaccacaggaguuaagugcaggugcccuaaagguugaugauguaucucagaauucuugcgcggacuguagugcggcucauucacacagagcugcugagucgucagaggagucccagagcaacucacacacaccuccacggccagacugcuugccucucgauaagaaaggacacguaacguggucacuucauggaccugaaaaugccacaccuguacccgacucaccugacggcaaauccccagauaaucauucucagacucugaaaaccgugaguuccacacccaacuccaccgcagaagaggaagcccacgaucuuacagagcaccacaacagcuccccucuguugaaagcuccccucagcuuuaccaacccucuucacucugacgacucggacucagacggagggagcucugauggugcugugaccaggaacaaaacuagcauuucaacagcaagugccacagugucuccugccaguagugcugagagugcuugcacuaggagaguauugccgauguccauugccagacaggaaguagcaggcacgccgcauucaggugcugagaaagguaauacagugucuggcacuuagcucguuaucugccugccucuguucuaagcauuuagcucggucaguucacuaucacuccacaccacacuugaaccugcaacaaaaguuaguugguuuuuagauaacuuuuuguuuauuugugcuuugguuuuuuggagauaggguuucucuggguaucccuagauguccuggaacucacucuuuuagaccaggcuggccuccaaaucccagagauccaccagccucugccuccucagugcugggauuaucaacacgugcaccacuacaccuggccaaauaccauuuuucuuuuuaaauauucuaauucagagucuuuuccucucuccaccuaguguaaaugccuauaaugagcaggauuguuuuauagaaguauacaaccuuauuuaacaucucugcauuuacauuacuauguuuuuauucuacucuuacacuacauccaaucacagguuccccucucuccugucuucccucccccccagaucuucaccccuccccagcaaaagagcaggccacucaggguuaucaaccuacaagcugcaauaagacuaggcacguacccucgcauuaaggcuggacacggaagaaagggguaccaccaaaaacaacagcaacaacaacaauucagggccaguccccugcccuuacauuuuaauuauaaguuuauauuuauuguuaccguaauuugaucuuugugucaauggaauuagugauacaaauacuauagaacccuugcuuagccauuuaauuucaccugugcuucuuguaaauacuuaauaguccuauuuuccuaccaaugacuacaaaauaacuuuuuaaagagcucuuuucauaaaugcuuacaaauaaaguuacuuugagcuggcaaguuaagccauaacuacucagcuaacuagagucaguuuuauucauucaaagcugagcagggugucuauauacccugcuaccagguuugcuccuuaauccuaagcagaugccaaguccagaggacacguguacucacucacacuguaggauuuugagaguggguuuccuauguauuucagacgggccuggaacucgggauccuccuggcuccuuugcccugggauucuaguuugaugcaccaugccugccauagagcauuugguucuugaaaucuucguggcgccuuuccucuugcuuuguuuuagagacaagggccugcagcuucaucuuucuggcucaauccccuauacucugagauacccaggaauguacuaccauugacugucacaguauuuuucagggauagagugauggcucaauuaucaagagcacugggccucuucuagaggacucugguucacuucccagcacccauguggcagcucacagcugucuauauaacuccaguuccaggggaucuaucacucucacacagauaugcaugcaggcaaaacaccaaugugcauaaaauaaaaauaaauaaguaaacaaguagacauauuuuuauuguuccuaauuacuuaccuuguagauuauaucauguacuguuuguuuuauaauugauuauuuaauuuguuacuugcuuuguaaaacaauggcauaaaaauauuaggaaauuuuguauuagaauuuguuagugaggcuggagagauggcucagugguuaagagcacugacugcuuccagcgguccugaguucaauucccagcaacuauauggugauucacaaccaucuguaaugggaucuacugcccucuucuggugugucugaaacauagugugcucacaaacauaaaauuaaaaaaaaaaauuguuagugaauuaacccuaauauuuuuauugauagcaaaaaaauauuuuauauaaguuauuuauugccugaaauuucauuauuuucucaggccugaaauuucauucagauuugacccaaguaggccccacacacuguguaauguugagaagccuuuguaaaacauggcagucucuaguugaacaagucuuggguugggggaggggcuacugggaguugacuugagucucuuacaugcucuagccuagaacucuaacuccagucaugauauguaaggucuacagaaagccugaaaggccauuuauagauccaaggagaagcaugcaguugagaagcaaggaccaguuagaaaacagacaagugauugucaagaaagaaccugguaaauacuuagcagugugcagaacuuagucccaguguuguguguccuuccuugaaauaaugguuucuuacuguggcacuuucucagugccacucuagguaaaucuaucaaguauuguauuggaacuguggacugaaggcuguacuuugugugaugucaccagcucuauaaacaugagggacacggacaguccgccaaccucaaugcuuguugaaaauguacuuaauauugagcuuuuaguacuaucaaauaugguaaaaagauaauguccugccagaccacucauuuucaaagaaaauaaggauaaagccuggacagacuaguauagguucaucaguauaguucccauaucuauccugccuagacuggguauacacgauaauagcucuaguauggucucaggguuugguuugguuuguuuguuuguuuuuucucuuucucucccuagagcaggaauucagagauccaauacacugguuuacccugaguuguaaggcuaaccuuaauuaaugcauuaccuccuaucuuuucuaggggcuagauagguuucuacugcuguaaaagccuuuaaaaugacuucaguuuauauccuugacacggucaggugauaguguucacaguacuuggcaguaaauauaugguuauuaagauauuaguagcuguauuauaucuaauagauaacgugacuuaaaauguuacuguaguugcuugagaugugaccaaguacauauuuuuccaugagugaacagauggauggugcacugugguuccauguuuugccccgcugcuaggguguggaagugccacaggacagacuaaacacugagacaguagacugcacuuacccugugcccacugucaguagcacugauacaccacucagggugcgaaaaugcagccuacgauguagggagcuuaaacugggguccccugauuccuugguguccaaucaccacuggaaaccacagaggagucagagacggugggucagggguccacaagccugcaaugagccaguuucucagacucauggacauccagaugccaguggaagucucagaagagccaagaauggagguggcccauaggcuguggcucuguaggugaaggccuucuccaugcuccccguggcaguucuugauggaagagacuguccuugguucuaaaguguuuauugauuggucaucauagaaaaugugugcauaacaacuccuugaggugaaccagagauuaaauaccuuuugcaggaaggaauguccagaggggaagcuuauuggcuaaacccucaggacuccucuagauaccucauuagcauggaacucuguucugaccaccggucacguuuccucuguggaaagaguggcacauguuccagcccagaaaucugguagggagcgggaggcgccuaccgucucagggaggagccugggugcuggggacugcaccugcucagccuuaccaaguucccugcacaugaaagucaugcugucagucaugagggaacacuggcuuucaccaggugagcagauugcugcucugcacacagagcauccucagggacagcaagccuccgcgcaaucagaguaaugucuccgggucccacagaccuguaggaggcguucgcuuuguacauauauguacagaccuguaggaggcguccgcuuuguacauauauguacagaccuguaggaggugucugcuuuguacauauauguacagaccuguaggagguguccgcuuuguacauauauguacagaccuguaggagguguccgcuuuguacauauauguacagaccuguaggagguguccgcuuuguacauauauguacagaccuguaggagguguccgcuuuguacauauauguacagaccuguaggagguguccgcuuuguacauauauguacagaccuguaggagguguccgcuuuguacauauauguacagaccuguaggagguguccgcuuuguacauauauggagucuguuccaucuuugcuccgugagaugcuuuacucgucuccauugugaauugagcgguaacgauguuuucaguguuggacgguugggguuuguuuuuuguuuuuguuuuuuucaagacaggguuucucuguguagcccuggcuguccuggaacucacuuugcagaccagguuggccuggaacucagaaauccgccugccucugccucccgagugcugggauuaaaggcgugguuuauuuuuuuaagacaucaaggaaguuaguucuccguuuaggugguauuuuacuaauuuuaauugucugaauuuuguguguuuaauucagaugcugauguuagugaggagucgccuccuccuuuaccugaacgaacuccugagucuuuuguauuagcaggugagcguaaugaguauuucuuccauauugcuggguuuauuuaauuugccaacuauuauacugaguaauuaaaaucaaaauguaaguuguaauugaugcugacaguuuuuauuacucacuugaaagcucuuuaaguaguauuuuuccauaccuaaaguugcuaagugacuauauuugugguagucauuggaaacuacuagaaugaagaaggcaaaugcaauuucaaauguauucacagcgagcgcaguugcuguuucauucacuaauccagacaacuucugcugcuucacuuucuagugaauguaaguuaacauucaacuugaguugugaaugggcauguuuaugaagauaguuucuaaaauuuauaggauuuuuuucuaaugacuuuaauaaaaaaaaucaaggauuaaagacagaaguuucaauauugagauuucuuuucuuguuccccagauaugccuguaagaccugaguggcaugaacuuccaaaucaggaguggucugaacaaagggaaucugaagugagucguguggggacuggaauagcucuacguuagcuccaccuuagagcuguuauccucaguuaccagcuuccuccauuccugcacuugaccauuuuucauuaguguuuuuacagguguuuguuuguuuguuuguuacuuuuugagacagggucccccauagucagacuguccucaacuugugcccaggccugcccuugaaccauugacccucccucuacagucucaguucaaggauauauauuacacauaugcacuacuacaucaggcuguauacucagauuaaaaguugauauaaaauguguaagauacacuauauuuucauaaggccaucucuuccaacuguuauuccguuagacugcuuuugaaaaaugcauaaacuagaccauguuuuaaaucauuuuggagguaugaauaggacuuaguauugagggaguaaaccacuauaacuagauuuuguggcccuaucacaaccacccuagguuuauuuuauauucaaggaaaaguacauagugguaacuuggacucagaaacaccacaauuggauaaaauauaguagauuacuauauuuuguguuccuccaugcauuagcuaggugggggugcugguuuuguuuuuaugcagaaguuucccuucacaguauauacaucaggauacuaagcugcagagauggguuaguggcuaagagcaaucgcucuucaagcaugagggagggccuaggugugccccagcccccagggcugcacagcgguagagacaggauaagcacugauccagauucacugagagacucaaaggaauaaagcagagagugguagacuaggaugccggaugucauccucucagcuuuacacacacacacacacacacacacacacacacacacacacacacacacacgcacacacgcacacacacaugcacacauacgcacacacaagugggaaaaacuuuaaguaaagcauaacaaaauugcaagcauaaugauacaccauugcuuucuuuuucuuugauauugaaucaagacacaaaucaagcauggcgugcaugccuuuaauccuagcacuuggggagaugggagaaagaauggcaggaauuugaguccacccuuggcuacauauugaguuugaagcuagccugggcuauaugggauucuguuucaaaaauuaaaggacuuuuuuuauacaccuuaauuucuugggguagaucccuauaauugauuaaguguuauauuuauugcacauaagaugaacuuucuguaauaaauauaaaaugucuuugcagggcuugacaaccucuggaaaugaaaaacauggugaguuauuuguccuuuuuaccagaaacuuuacagauuaauuuauuuaaaauagcacauaccuugcuucaugcucuuugguuauuccuguauaugaaggucucuaggauaacugcuugagaaaacacaguucugugacauaauucuucuaagcugacucacucauagauacuguugaucugaguuggaaagucaugggaacauucacuaucagaaguuaugaguuuauguguugcuucuuggauaguuguugcauuucuuauuuauuaaaacaucuagacguuauggguauagcugugauugagcacauaguuaacaggccuaaagucuagguuuacucucuagcacaaaaauuaacaacaauuacuuagcaguucauuucugugagagugaaugccgcagacugaccaacaagaaggaaaugugcccaugacuguugagggcguuuguguucaaucaguaguuaauacuauaaguuagaaguucuguguuugauggaggauaucucagugagugucuagcauucgaaaguccugaguucccagcccuucagacaucaggcauuccugcagucccagaacucacuugcagggagcggaaggaucggaaggucaaggccauacaaaccugucucagacuggagguggggaaggagugcuugaaggauucacuauccucaaauggaacaaguuacuaaugacacugcugucacuguucccacucuuacucuucugaaacauguacaguagggcucuuggugcccugcuccuucccuaugcuccagguagcaccaucuccuguacccucugccuuucugaaccuugacuucuaaagcugaguccuguuccuagcugaccuucacuugacuaagauugacauuuuagaucugcguccucuuuugucuuagaagguggcccugagaaccucgcuaccucucguuaucucuccuguucccaucauaucugccuguaaucuuaucaugaaguucaccacacuacuaagaugacuugugcaugucucuuacuaggccagcaacuggaaggcuauaacccccagguccuguccugcucuuggcaggacuuuguggaccuuugagcugaauuuguuuguucauuuuagaaaauuguuuuauggcuggugagauggcucccuggguaaaggcacccucugccaaggcugacagccuguguuuaaucucuaggauccacguaguaggaguuacccacuccugaaaguuguccucuggccucuacacgcgugcuguggcaccugcauuaccauaaguaauaaauguauaugguuuaaaaggaaaccaaguagggagggccugaugaugaugaugccugaaauucuagcacuuaggaagcaggcagaggguuuagaaguuaaaagccaaccugggcuacauagcaagacuguuuuagcaaaauggaaagaaaacaaagaaaaauggaauugggauuggagggguaggcaaagaguaacacaacagaccuuaaggacagggaacaccuuuggacuuaucuggguuuccagaaagguuuuucccugaaguugaaggagaaugacacaaacuacaaaggaugcugggugcgcugcuuaucuguaaucugaacacucugaaggcagaggcagaugaaucuccgaaucugaggccagccugguuuacuuagcauguucccucucaaugggagaaggaggaagagagaaaagagggaaggaaaaguuguagaagaauuagucuucauuuuuuuuaauauaaucuuuucacugcucuuuaaauuaguaaaauaacaacaauuuaaacaagaagacuucaaaaaaauuaguauuggccuggggaguaggaaauugaaauugcccagcaauuagaaaccuguuuaaccacucuaaccacuuuaagaaaauauagcaugccauguuuaggguugaugaaaugagguaaguacacaagaacauucccauuaccgaccuguagacugccugacugaagcugggcuucugaucuuagcccacaggagagcuggaacuuuagaccagccugagcuaugcaaugagacugucucgaaacaccaccaccacacacacagagacacauagacacacacacacacacaccccacacacacacccucgucaccccgcuccuuguauuuaucauggaaucucuaggaaagacaaccauaaggugaaacuugcucuuuuauucuauauguuccuccagcaaaguggugugagugugaugcugccuuaacgauggugacuaaugaggacuuuuaucuuagaugcagggggcauccacacagaggcuucugcagacucuccaccugcuuucagugacaagaaagaucaaauaacaaaaaguccagcagaagucacagauauugguaacuuacuucauaauucuaaaagccaggcauaauggcucucuuucaaugcuucuaucuguccuuucccaucucuuuggauuaaaguuggauagaaauauauuuuguuagauauuagaauggcuaugcaagcuugcuucuuagguccauuuguuuggaauaucuuuuucuaacucuuuacucugagguaaugucuaugcuugauauuaggguauguuucuuguaugcagcauacauacauucuguuagacugugucuuuuuuuuuccuuuuaguuuuucaagacaggguuucucuguguaguccuggcuguccuggaacucacucuguagaccaggcuggccucagaaauccaccugccucugccucccaagugcugggauuuaaggcgugcgccaccaccacccggcuuagacugugucuuuuuauuaaggaauuaagaccauugauauugagagaugcugaugaccaaugauuguuaauuccuauuguuuuggugguggugguggguguagauguuccuuuuggauuugcucgucugagguuauuuauuuccuguguuuucauggguuuaguuaaguuccuuggguucaguauuccuucugaaaccuucuguggggcugaauuuguagauagauauuauuuaaauuugaucaugaaaugucucauuuacuccuucuauggugauugaaaguuuugcugggucaaguagucuaugcugucaucucuuagagauguagucucuuagagccugugagacaucucagaugugauucugauaggucugccuuuguaugcuguguggucuuuuucccuuccugcauuuuccccuaagacaggguuucucugugaagcguggcuguccuggaauuuacucuguagaucguucugcuucugccuugggggcugggacuaaagguguggcugggaucaacuaccugacuucccuugcagcuuuuaauaauccuucuuuguucuguauguuuaguguuuuguuuauuaguagugaggggaucuucucuucugguccaaucuauuugguguucugugugcuuauacaauuauaggcauauucuucuuuaguuaggaaaacuuuauaauuuuguugaauuucuuuuuuaucaauuuguguuuucuuuauugcuucuauuuucauuuuuaggucuugaauuguuuuauuaguuuucuucaucuguuuguuuguuugccccccacauacacccuugguuucuuuccauccaauuuuuguuugcguuuuucugauuuucuucgauggaauuauuaauuucuucuuuagggaccucuaucaucuucauauacuuguuauuaaggucuuuguguaugugucugugugugugaguggaaaggaggcugcagcugguguucuguugcagugguaggggugacccugauaauuggguuugggggaacagcuauagauguauucuuaaaaaaauaccuuuuuaaaguccuuuugaauguuaauuuguuauuuugguuucuuuggcaauagguuuugguaaucgcuguggaaaaccuaaaggaccaagagagccaccuucagaauggacaugaugcagggagugaaaggacacuucacauuauacuggaacacucaagugccacugaaagccaggcuuauaguauuccaucuuuaaaugugggacugauagcaguguagauuguuaccuuaauguuuuugcugggaccaucuaccugccuuauacuacacuuaggaaaaaguauuauauuguuuauuuuguaacuucaaguauuauugccuuaaugucucuuaacccuguuacaagcugcuuguagaccuguuaauauaguaauacuuuuaugauaaauugaguuaaaggacuacucuuuugcuguuuuaucauguaugcauuauuuuguauauguacagggcaaguagguauauaauuugauaaaguccuaaaauauuauuaacagaagauguaagaauuucugcauggucuaagucuuuguguaucuuacuuguaaauuauuugcccugaaguuuuagaaaacaguuucugaauuuuaaacuugcuggauucaugcagccagcauugcagguuaucagagaucaaagauuguaauaauaauacauuuuguaaauuguaagcaaaaaguuauuuuuauacuauauacugucuaauuguucauccuaaugguucuuguuuucaucuagucauggagauucaguaagugccuuggaacaauauugaauucucuuagcucguguguguuacuuuaaaauuugaauucaacugggguuagaagacuaucagaauauauguauguuucaggauauuugaccugccauuaaaaaaacaaacaguuuuacacugcuacauauuguauuguuuuuuuuuaacucugaaaaaaagauuuguauuaaca

SEQ ID NO: 2356 - RNA, 395 nt, Mus musculus
uuuauagauuuuugaaugugguaacaggcaguaaguuaccaguguagagcuugucugaugaauccucauccucauuacauuuucuggacaaacguacucggcugcgauguggaacauucauuauucccuugacccagaugguuuuauugagccuggugucaaugcgcacaucugguguccccauuuccuucauugcaaacuucagaauuucugugagugcccgaggaacaugcuucuugaagcccacuccauggaugcgcuugugaauguugaugguguauucucuggucaccaccuuguugauggcagaacggcccuucuuccucucuccacccuucuuugcgggagccaauucuaccaggcccaaguuggaaaggaagugguuuucuuucauu

SEQ ID NO: 2357 - RNA, 943 nt, Mus musculus
aacgcugggacucuucucucuucuuuuuuggcuggaaccauggaggcuguuccagagaagaaaaagaagguugccacugggccagaaacccuuaagaaaaagguuccugcugugccaaaaacucucaagaaaaagguucccgcugugccagaaacccuuaagaaaaagcaaaggaauuucgcagagugaaggugaagcgccugaggaagaaguuugcccugaagacacuucaaaaggcaaggaggaagcucaucuaugagaaggcaaagcgcuaucauaaggaguacaggcagauguaccgcacugagauucggauggccaggauggcaaggaaagcuggcaacuucuaugugcccgcagaaccaaaacuggccuuugucaucagaauccgaggcaucaauggaguaagcccaaagguucguaagguucugcagcuccuucgucuucgacagaucuucaauggcgccuuugcuaagcucaacaaggcuucaauuaacaugcuguggauuguggaaccauacauugcauggggguaccccaaccugaagucaguaaacgagcucaucuacaagcgaggcuacggcaaaaccaacaagaaguggaucgccuugacagauaauuccuugacugcucggucucuugguaaguuuggcaucaucugcaaggaggaucuaauucaugcgaucuauacaguugggaaacgcuucaaggaagcaaauaacuuccuguggcccuucaaauuaucuuccccacgaggugggaugaagaaaaagacaacucacuuuguagaagguggagaugcuggcaacagggaagaccagauaaccaggcugauuagacggaugaacuaaggugucacccauggaauuuuuguaaucuggucaguuaauaaacagucacagcuuggaaaauuaaaaaaaaaacaaaaaaaaaaaacaaacac

SEQ ID NO: 2358 - RNA, 38498 nt, Mus musculus
cauacagcgcgccgccuucccgggaaccugagcgccugcgggugagccucccugcuguuagccuggaucuucgcgggaggcgguucggcgaccgcgguuccuuuucguugguuugcuccuuagucucgauaucugcguggaacagccuuucuggggcuguucggauaccucggugaagugcagcggguuucgaguagguuucuagcacccaagcccugccuccuccuggagaugcacuugugaguggcaggcuucuuuugaauuaccgcaccucuggaguugcggagcuugcaucucuggauccgcuuacgugaagagccaccgcguuuuuaggcgcccagagggaaguagcuguauuugggauuuaagaucuacccuuccugcugcagacucccugguuacagcuccacgauaggaauacaaguggguguaucuucauuugguuguauguaaaugaaugggguccacaacuugcucagagcaacuuauuucagcuucgguguaguauuuauguccuaaaaaaauccauccccaaagcauuauugccguuuuucuuaaaguaagaguaacuuauuuaaccacagaaugaauaaaaguacgaggcgggauuagagaaggauggcaauagaccuuuuucuuucuuuucuuuuuccuuuucuuucuuuuguacuguguuugcucauuagaucggcuauucuugauggcgguucauauggacuccucuucccaaggagcgcgguaugaacccgguuguugugaauaugcguucaaggucuccaguggaaccuggauaauguguacuaacagucagacccagaaaacauuaagggauugagaaaagucaacaacauaaaaaaaaaaaagucugggauucuugcuuugcccuuacuguaggcuguuuauacguuguuaugcugugacuugcaugggugguuuuggcuuagcaugaagucagaaagccacuuuugcaacacacuucucuuaaauuaagaaauaauuuucaucuuuauuaacagauggacguauaacaguucuguuuugucacauuggguagaaguuagugguaacaacaugauuuagaaagaaguuacauaaucuuuaaaagggugauuacuuguaucuuacaacagucuaauuaaaaaaaauaguuugauuuuuguuguaaggaaauguuagcucuguuaaagauuuagggcaaaaaugugcauuuaaaaucagaaucuaagaggaaucgaggguuugaaauggguguaagucaauuggaaauacagucauaauuuucaaagauuuuauuuuguuaauauuuuuacaggcuucaucccuucacgaauuauauagcaaguguccaagagacaaacaucucuaguguauuuaucauguuuccuuuuccacccacaauuccaaacucgaucagacagauucugauuccaaaacugaugauuuuuuauuuuuuauuuuuauuagauauuuauuuacauuucaaauguuauccccuuuccagguuuccccuccaaaaacccccuaucuccucccuccuccccgugcuccccaacccacccacucccgcuuccuggcccugacauuccccuacacuggagcauagaaccuucacaggaccaagagucucucuucccauugaugaccaacuaggccauccucugcugcauauguggcuggagucaugggucccuccauuugaucucuuugguuggugguuuagucccugggaggucuagggguacuggcugguucauuuuguugccuccuaugcaaaacuguuuucuaauguuuguucagugggacuguuuaaagacauuuuaacguaaggguucugucauaaggucagggauguuuuauuggaaaagguuuugguuauacuuuaguucuuugagucacuccuaccuauuuguuugaaagaagucuuauauucuuuuagguauuuagaaagccaaagggauuuuuguggaaauuuaguuuauauuuucacuuuaguuuguuuucugugugcacgagugcguauguguauuugugugugcauguaugcguguguuucucuuaguggugcauagcuguagcuagaguggggucucccauuccuuuucauucuauaugaguaagaauguggcugcauggagcgcccugucuauguagguacuauagauuaaaauaaauacaaguaaaagugguuuaauugaaguacuauuaggcauguauaacauuggcaugaaaaucaguuccagugauuuccacugcaagguugaagcaaucgucuuuuuuuuuuuaaagauuuauuauuuauuuauuuuauguauaugcauacauuguaugcuguacagauggcugugagccaucaugugguuguugggaauugaacucaggaccuccgccuacuucagcccaaagauuuuauuuauuauuguauguaaguacacuguagcugucuucagacacaccagaagaaggcgucagaucucauuacggaugguugugagccacaaugugguugcugggauuugaacucaggaccuucggaagagcagucagugcucuuacccgccgagcuaucucaccagcccgcaaucgucguucuaacgacuacauuccugaagaauucuacaugucuauaacuuacugcuuuacuugacccaucuuuugaaccuaguaaccauuuauucuguuuuuauuuaacuaauugacuuuuacaccaugcuauguauguucuuggcuagcuccaggagcaguccauacauaguuauacucauucuacugccaacuaaccuuaaaugauguauuauaacuuacacuuuuuuuguuuuguuuuguuuuucgguuuuucaagacaggguuucucuguauagcccuggcuguccuggaacucacuuuguagaccaggcuggccuugaacucagaaaucugccugccucugccuccugagugcugggauuaaaggcgugcgccaccacgccuggcuacacuuuuuuuuuucaagauauuuuuggauguuuauuuuuaguugaucuugcugaucuaaaguaccugacuuuauuaauacuacuccauggauuaaagacaagaauucaugaaccugggagauuuuagccauuggguacuuuaaggcaauaacucugauucauguuauacagaugaagcaggcaagccaagaucacacaguauagguugccaaugcaguauauacuguaccuuuaaacuggauaaaaaguuggggauagccauuaucauuggcuguggagucaugggacuagauuuagauggaucagcauaaaucaaaagccugacugaaaaacaauucauaguacugagugugggaacgcaugcucauaauuccagcaugucggugaaagagacaggugagggauugugaguaggaggcuggucugggcugcauagaggguuccaggccaguuugggauauguagcaaaacugucugagaaaaagcaaagggcagaagcuagcauggcuucugccuggcacgcugaacaaccaaccccguuacucuuaaagagagagcucuguguguauauauaguuggaacuuuccauaccaagggacacuaacuaaugaccaaauaggaaaugucugauauacucaugugauuuucuaauccuccucaguuagaagaaugaaguuaggacaucagcgauccuuuaaaccgcucacuuguuugucuugcuuuaucagacccuuggccuacagcuauuagaugaccacagucauuuguuuuggaaguuauuuucuguguuugaaaccccuugcucagucuacagagauaauuguucccguuuuaaaugugugggguuuuuguguguguguguguguguguguguguguguuuuuuagcuugcuuagagaacucauugaagggccgagcucacccuuccuucuacuguaguuaaagagccaagcucacccucucuucuccuggaguuaaagucacuaauagacaauucagcaguuucuggacuucauauuuuuuuuuuuuuaauuuaaacuaaacaaaguccugaacuugagauagagcaugccauuucucuucccggugcggaccaugucucugugugcucugcuaaggauuuuuaggugagaugcgaucuuaauuauccaacgauaauuaaggggagugcauggcuaauagacagucuagacuccucuggccagauccagauccugggaacauccuaugacucuguggccuggcuugcuuggucuguaaggaggucacacauguguugacuuuugucaugggauagauauucaaauggcaagagacccuggaggguauggacuugguucaacugguuagcuuccuccucugcuucucugaggaaagcuuagcuuaucaugaucucuaaaacugcuuuuacccugcagaggugacacccuuuugauacuguugaggggcuguugaugccuuaacgcuggcuuggcauccauguaaacuuuuguuuacaugggauuaaugccagugcacauauguuguguguccuuccagugaagaauuuugaccuaauaaacuuuugauguucucagcaacaucuucuuggcuaagcauaagccugguuaugcacagcuuuguaauuucuuuuugcagggccauucagauacuuucaagucauauuuuaagucagugugcuaccuuuaguauuacugccaagcuuguauaaauuuuguuggcuguaugaaugcauuuuguguuacugaccaguaggccuuggcaguugaaggggcggggcuuaccaggaugcaggacuggaaaugugaauauugggaaguuccccaaaacuauacauauugguccccuaccuggagaugucucuuucuagaaagauaaaaugcaggcugaauuuaugacaucuuuucaaagcaaggaaaguauguucaaguccccauguuuauauuuucauuuuauauaacugaaacauagaaucuuauuaauuuguuaguuaaucuuacuauuuguugaugggucuuuuguauaauuucaaguuacaacacauaauuaaagcagugcaauuugaaaaccaugcaggauuaaaggaguaauuuuuuuuucaaggaaauagggcuuauugaauuccuacuaauagcuuuuuacuuagaaaagaaaaaaaaacacacacacacacauuguugaaagcaaagaugggcaguggugccgcaugccuuagucccagacuugggaggaagaggcagguggaucucugugaauuugaggccagccuggucuauaggcaaguuccaggacagccagggcuacgcaaagaaacccugucucaaaaauacauacauacauacauacauacauacauaaauacauaauuaaaaaagcaaacuaaggcuaaccugucucuaugucaaugcuaguaguuuuaguuuuuaaauuguggauuguacuucgcuguuaaagauaacucauuggaucuuuccuuguagguuggacuugauuaguggaaagcacgggcuuugugguuugaucagcauggguuggacccugagacuuaacuguuacuaacuuuuugacuuuaugcaagccuuaccuuuaguuguuguuguuguugguuuuuuuuuuuuuuugauacucuauuaaacuuuccaguuauggcagcuauauuggacaggacugguauugggacaguuuggaacauugcuuaaacauguuucucuuaaauguggaaaaagggggcuggugagauggcucagcagguaagagcacugacugcucuuccaaagguccugaguucaaauccuaccaaccacaugguggcucacaaacacccacagugagaucugacgcccucuucuggugcaucugaagucagcuacagcauacuuauguauaauuauaaauaaaucuuuaaaaaaaaagaauucaaggucauccuuggcuccaaaacaaguccaaagauaguuuguguuauaggagacacuggcucaaaaguaaaauaaaauuaauuuuaaaaaauguggaaaaaguacagaacuggcauguuuugacuuaguguggugugugccauuccuggagugugggcuccagauggcuuccuguagcaagaugcaggagcaaucuggacagugaucuccuuucucuuagggagacuacgaguagcaguguauguggcuugugguuauaucagacugaucagagucugaccaacguggccaucccuugcuggaaggcuggagauguagcugcucagcugguguuauacccugagcuggacaagggaggcuggaguuuaugguggaucucuuuugucuuuaccugguccagcaguagacuccacccucccagccauuccucauaccuucuccaguuagugggagcgcccuuuguugacuuaagucucuuugcccuuuacucuugcuucucuuuuuauuugauuuccagcagguguucuaauugagcccuguucuucauuuguucauuccacaaguauuuguugaacaguuagcacuuggguauugacugcuagguauuguuauauuacugauuguauuuuuuuccccuuggcuuggcucucuggaagcagagccaaaauagagacucaagugaauagacgauaagucuguuacuuaucaacguuauaaguggcaagguagucuuccccauccaguacugcaaauagccaaugucaggauucuggcaccaagugguaaaagagaagauuaaugccaaccuagccuaaauucuagaauaccagagagacucuugggaccuuccuaaaugccugaaccucuuugugcugaugauuagugacuuaaagcacagaaaugguucucagccuugaucccugaccaaccaaccauggguaccuccuucagagguuuggcucagcagccucaggcacaguauaaaaucuccacaguuaauccugaugugcccucagcacugggaaucaggcaugaggcuuuguucuccggcuggacaagaacuguucuaagaagguuuaucagucacaugcuagagaucagauccuuucuuggcagccugguuugaccauugagaggaggugagagauacuuagauaagugaucuuugacugaagaggccagacacugagaugcuguagggaugcaauuuaucuggagcuggccuugcuugccuuuuguguugucccauuguggacauuuuagcuagggcucugaacccugccagaagugcuggauccaugguauuggaaguuuguagucuuugcucuuggggggacagugaagggacaaaaaggaaugugguagagaagauuguuauuauuuucaaagccaagagacucucaaggcuucugagagcuuccagguggauccagaaggaggucuggaguugguaaaaucuuggguaugguggucuuauuuuugagacuugugugaauucuaagagcaccaaggcuucugucauucagaaauaaaagugaagacucauuccugaguugauuccauuucauuuuauuuauuccauuaucuuuaguucacauauauuaguguuuuagagugcaauaaaauggcaauuuauaguuacugaagguuuacugugugccagauacuggacuaagaguuguaaaacuacagcauagacaggaguaucaguggcaaaguuuggacagauuuauuuuuaaauauuugugaaauauuuaugauuuuacccugacagucaaguuuaguacauuuuaauuaugcucugcuuuuaaaaaugcuuuuauaauuuacuacaugcuuccuguucauuaagagaguauacugaguugaacuucagcgucugaaaccuccuuugaaccucguggcuuuauuaguugaccugaaacugacuucauaucucccuccgauucuuggucuguggugaagaagccagggucugaccucaguagugccugggcugguuuccuuguaaaaaucuuuacuguugauuguaguuucuucuuguaacccuuuccuuuccuuuccuuuccuuuccuuuccuuuccuuuccuuuccuuuccuuuccuuuccuuuccuuuccuuuccuuuccuuuuuccuuuccuuuccuuuuuccuuuuuccuuuccuuuuuccuuuccuuuuccuuuccuuuuuccuuuccuuuuuccuuuccuuuuuccuuuccuuuuuccuuuccuuuuuccuuuccuuuuuccuuuccuuuuuccuuuccuuuccuuuccuuuccuuuccuuuccuuuccuuuccuuccuuccuucuuuuuuuuuuuuuuuuuuuuuuuuuuuuuuugagacaggguuucuggaacccuggcuguccuggaacucacucuguagaccaggcuggccuggaacucagaaauccaccugacucugccucccaagugcugggauuaaaggcgugcgucaccacgccuaaguaacuguaggaaauuuccauuugucagaugaacucaccaacuuucuucuaauaugcaauguagucugcaauaccugacaguaaugaagauucuaaguauacuuugcuaagcuugcccugagauuucuaagugguagacaguaaugccugauuucuuucacuaucucucuuacaauacuagaggcaauucugaaugucacugaauaggcaacauucuuacugaauuccaagcccaaggucagcucaagacuaccuagggcauuggugaaggccaggaagcaaaguucaauuuugcuuagguauuuggcaagucauugcuuggagacaccuauaauaaaacaauacugagggaaagcacacagauccguucaccggcuaaagcaagcauucguuauacgggaugccacggcuccaggagacuaaguuucugugaacuuuuugccucaggacugcguccagguuucuaggccugucaugcuagucacuagcaaccucccacauccaacacaagucaaguuccuuguuggccauauauucaggaaguuaugagucuucccagcggcagugacccugugugucacaugaccaccggugugaacuacuugccaugugaggcuuccucaugaacuugggccacuaguuucagaaaugcuuuauucuaaagacuaucauuuucauccuucaaagcugagcuucuaucgacaugaucuggagcaagcuaacaucaguauggcugcuuaggguuggagccugcacuuccaccccacucucccuucccccuguaccuggaaaauuagcuuggaacaguguuccuucaaacaguguuuacuaaacaugacuugacagguacaguagcagucacccucuacuuagaucucagugucugugccccauuuguccuacagucucuacagucucuucagagauacugugucaugucuugaaacacaugacaucacacuuccaauaacuguucucagauaaaaauacuccaugagacuuuccggucagcuuggggaaaguggcuagacagagaguuuccuuccaggcauuggaaugggagggucuggcuauggccagcccuaguuagagaagccaagugcugggagccugagcugagucuuggcagggcuaaagauuguuacaguucuagaggcagaagugacuuuagcacuauggcccaguccucucauuuuauagcugaaugaaagcgaaucucagcaaaguuaggugacuuucuaaaggcugcagaauucagugcaaccaaagugggagcacucaccaaagugggagcacucaccagauuuggagcacucacuagaguuggaacacugaccaaagugggaacugagcuguucacugcucucuuuuucccaccagagguuacaaagaucccaggucuccauuucuuuuugucauggguugcuuaugcacagaaaguuuucuuuuaguguaguuaugauggaguaggaacaggaaaaaggauacccacauuuuggaaucacaguuuuguuaaaguuggcuuaaggaaagugaaaggaccuuuaaggucauuugcauauuuuaagcuuagugucuuuccugccuuuauccaccaaccucuuuaaccaucuaauucuguauagcauuuagauauuauuaccaccaggaacaaaucuacuuuuguggcuaguuuuauuuaaaguauuaaagaagggauaauuaaauaaaagagacauuuuuugccuauuuucuaaauuugucauaacaugauuauccugaguuauccaguuguguucaguuaaaugguguuuuauaugcuauuuugccugcauguacacagguguacuguguacaugccucauguucaauaaggcuggaagaggguuuggaagccccugaacuggcguugaggauaguugugagccacuaucugggcaccacaccuggguccucuguaagggcaguaaguguucuuaccucuccagaggcuuccuucuaauugccauuaaaucuuuacuuuauuacuuacaugaaaggaaaaacuuguagaggcgauguuuagaguguucauaugguuuagugacuuaaaaucucuuacuagcccauaggugacuuuuaguucaguauacugcauuagucugauaguuaauauuuaaagccuuggcagugugcagccaggacaagcauugucagggcaccugcugucccugacuccucuugcaaagaaaaugugcuuucaaguuuaaagaguugacuuauguuuuguguuuauuccucuuacaauuuacuguuaaaucuaacuauacuuuuguuuaacauuucuuuuaucaaacaauuuguguucaagcaauuuuuuucaauaauuagaacuuuaugagacaaguuugagguuuuuagaugcaagcaaauacuaugauauuaauaagguguaaggaaacaaauauugucauaguuucuuuucuuuuuuucuucuuuuuuuaauuagguauuuucuucauuuacauuucaaaugcuaucccaaaaguccccuauaccuccccccaacuccccuacccacccacucccacuucuuggcccuggcguuccccuauacugggacauauaaaguuugcaagaccaaggggccucucuucccaaugauggccgacuaggccaucuucugauacauaugcagcuagagacuggaguucuggggguacugguuaguucauauuguuguuccaccuauagaguugcagaccccuucagcuccuugggugcuuucucuagcgcauaguuuuuuucuuacauaaaauuaucaaagaagaaauagaguuucagcaauguagguuuuucaauuuuacauuuugagauugucuuucuuuuuuuuuuuuucaccagaaguagcagauuuauuaaacucaucaauagauucagauggaucauguucaaaaguauccuuugguuccuccugugauuugcuuuucaaaggacucucuucuugggguucccccucagcuuuuuugguuuguuuuuccugagacccucgucuuuuagagacaggagauuugcuguauggggaugaagagugagaugaugaugaucuuggagaccuagaagaucuauaugaccggcgagaucugcuucgggaucuuugagaagacaugggucuucuuuuuggacuccuggaccgugacugaccucgucaaggacuccuagagugccuucuauucuagacaggucuauagccaccucgaugguaucucccucuuccuccuugauaauacccuuaccccuuccucuguacccauaaggucgucucauuccucuauuauuuuuguaaucuuaauucuguaaucuuaacgauaaucucuagaauaaauaugaucucuacuaugagaccuugaauauguucuggauugagaccuagaacuguaucucuucuuucuggaaugugaucuugaucuagaacuagacucugaucuagacuuggaucuuaaagaaugugaucuaauuggagcggcccauuucuuuucuccuugggcuuuaugcaggauccagaagucagugaugucuuugagauacugccaagauucuucuuguagagaauguuaugggaaacuaaacucugaauucaaauaccugacacgccgaaacacgaugugcgugcggggguggguugggguguguaccuccgugguaacuacacagcggccauuucccgacuccagaaggagaggaagcaagauugucuuucauauaagaagcaucuugacuggauaaaaugucuuacauuuuuucacucuuuuacuaaauauaaaucauaguacagauaauuguggguccguauuccuccccaccguucgccguagccgcuggggaggugaaacacggggagcuugacgcugcugcugucgggugcugggcuuccggggagggaaaacgcagucugggauguaggaagccgaagcugauauucccugacuucugggcaucuggucgccauuagaaaaccacacagagaugucuggaaugaaguguuggggcuccacaggcccaccaugaguccgggaccacugggggcccgcaggcugaggacagcgugcagcccugccaaggcgggagcuccucuuagcucuucucugauuguccuuagcuuagcaggaagcucugcgggaggcuuaccuuauggcuccauagucaaaggcuuucuccaugcuccccagagugguucuugaugaaagauaguccucagcuccaaacuguuuauuguuuguucaucguggaaacagaugaguaccaacuucucaggguggaccagagauuaaauaaccuuuuuagaagggaauguccaggaagaggagcuuauuggcuaaacccucaggcagggccguuaggaaccucaauagcauggagaacccuguucugggccaacgugaccacaggucauguuuccucauguggcucguguuccaggccaggagucuggcagggagcagggagcugcuuuacuaucucagguguguguguaccccgaguuucuggggacauagacccauagaccuacuaaguuuccuggcaagguccacugucccccagauaacaauuuguguuugguacuucagaguacuaaccuaugguguuauuauuuauucauuuuaguacugcaaagaggacuugauguuuaaagcaaggagccugaguucuuauuaagauacuacuuggcaaaugucuauagaugcaugacauacaugauauguguguguguauguguguguguguguguguguguguauauauauauacauauauauauauauucaaauaucuauuucauaucuauuauauauuuuauauuaaucuuguugcuucuaauauauuaaauaauauuaaagaaaacuauguauuauaugcaauaaaauaucuauugcuauauaauuauuuaauuaaugaaugaucuucacacagaacauucuccuuuuguuauauagugucauucccaggcuuggacauauuugcccucacagcaccuuguuucaugucuguaggugucucucaugaugucuuagagaauuucagggguggguagaauucauuugacucuccugaaguccuuuagagacauuuuagagaacugggauguuguuauuuuuuaaccuaugcuaucuagccuuguaguaaaaggauccuuuucuuccaguaaacguaaggggaacuagaaaguguguguaaguguguggcuuuauucagucugauaucugacaauguagcaucagcacuccuguuguaccagucuccugguauuuauaaaaaucuguuguaggaauucuaaucugcugcuuccuaauuuaugcaaauguugaagccccaaacauacguuguacuguugugauauuuuucccucucacuuuucaaaugauaaagcaguacauugaauucuagggagcuggcaugucuuaaaugucaaaaguaugaaacaauucugaaauagaggguucuuguuuucagaaagcauuuuacccaugugugcaauuucugaaguaaaauauuucuacacugucaugguucagaacucccuuugguuagaggggcugaguccuucagcuauuaaagaagcaguuaauauccacuguacuuggugguuacaguauggagcugucaucuuuuuuuuuuuuuuugcaacagauuuguguuugaaaagcucagaggcagagcuuuucaguacauagaacucgcuucugguuuucgugccuuuuccucuagugaguuucccuuugugagauuguugcuauagacacuaacagcgaccagaaggcagcaguugcagugagagucccucucgugugacucagcucucaggcaggcucugugugucuccauggcauuaggcucagguggucauuuuuccacauccacugaauggccuuucagggcuuugccuccaaaaccuucuuuccagguugccuggguucaguucuccuugugagucuccuccucucagucucucaaagagauugcaugcauguggugucaucaucagcgucacaugacgucauggaaguauuagaaaacgccgugacuacuaguuuucauacaccccucccccugccccccaaucccucagacacuggaaaaucauagguagaauuccuguggaggcauuugguggccucaagguaggaacaguaacaucugagaaucaagguaagggcugcuguuuggaggcaggcgagugugagcagagccagaagccucagccuuucugagccaccuugcugacuuuugcaggagaaacccuuggggccucucucucucuuuuguuucauuugcgugagauuugcuuagaguagaccagcuccgaagacugugucauuguagaagggucaugggagguauaaagcgcggauggucauuugaugugcagaccuauuuuauagaugacucaggagggagcgaggcagggcugggaaaaggagcaggcacccugacagacgucacuguccccuugcugccacucugagcauccuuguagcagcuuggauccugugauuauccauuacuucccggugaugucggacucgauuucagauccagcaggucaggcgucugcuuugccuggggugccgccaggucugaccgauuccaccugacuaucucaucccuaaaguuuccagccauccaaauacuuucucaucuccgagauuccagugucuuuuuugacucuuggauuuacuguaaugauugcuuuucucauugcuguugucucagucuccauugauuggacugucugcuugugagauuaggauaccuaacuucugggcuuccugagagccuuaauugaaaugaacuggaggacuguguagcaggugcuuugcugucauuggguguuccaggcuucucuuuucuauucacucauccaucuccuuagcucuaggguugguuuuuguccguuuucauuugagacagagucucuuccuuauguaacucuggcuguccaggaauucguuauguaggcuaggcuggcuuuggacucggcuuuggacucggcuuccugagugcugggaucaaaguuggcccccugguucagguuucuagaccuuucuuuuacuuuuuuuuuuuuuacccuguuuccagaauuugcuuuccagcagcaccccguuuaagcaucuucauuguucuaugguugcccacaguguagcaaaccuuccugacauggcuuuucuagucuugcauggccucacuucacgagacugccaaguauuguuucccaaaccuaacugugauguagcucuuccuaugugaucuguuuauauaggaaugccagcuaucuaaacucccaaaucugaucucauaaacgaacugaauuuuaauggcuagucacugucuuugccuuuguagaggccucagucuagacuuaacuuuuuuuuuuuuuuuuuugguuuuuugagacaggguuucucuguguagcccuggcuguccuggaacucacucuguagaccaggcuggccucgaacucagaaauccgccugccucugccucccgagugcugggauuaaaagcgugcgccaccacgcccagcucuuagacuuaacuuuuaagacauaaaaagugagucugugagaacucacagugaggcaccuuagccagaacacuuuaagcuuuagaauauacggaauuuagcuguuuggucagcuaacaagguuagagagaaaaggguuagcauucgggugugaacacaauguccguaauaucaucuaauccuuugaaaccuccgcuggguaggugggcauuuuacaggugagaaaaaggaggauuagagaggcuguuugccuaagcugugaagccugggagccccucucucagcucccccggaggguguuuggcuuuuguuagcucugguuuccuuucuccaguggcuauucuccagauggccgaguauuuacccucauguuagagaaagaaaccgggcauguucaugugccgccuggggcuuguguucuuucccuuucucucucgggcaucuuuguaucucaucaccccguagccaggaaaagaacauuugguuuucuguuauuuuuaaaaauaggguuauauguuguguaauuauguauguuuugauucuaaaccaauuagaaagcacguguuuguuugcuuaauauaaucgguaggaaggaaaugaaguucuacauagcagguaacuucauacuuuuaaugcauuauuucccaguucugaguauuuuugguccugcaugauugacagucaaggauugcagugugggugacgguaggugcaguaacggucagugguagcagcugaggcgagcuggugugcgccugagucuccagugguuucauuggcuuaggcuguucagucuuuuucguaacuucgggagccagugaugucuuuaucuuuauuuuauagaugggaaaaucaagaugaagaaaaggugggacauuucuucacagccaggaggcuuuagugucuuggcaguuuuaagucugcguuacuuagaauuuauguuguugcuaggucaguugaugugcugucuccuuccuuggcgggugaccgcaucuguacucucuaggggaauagguuacagauuguuguuaguauaaaauggccaagcuuagcagggguguauagaaggcacuugaaucacugaggcaucuuaggaaacuaagccggucuuacuuuauugcucagaacauugguaguuaugcugauacggauacggaaagggcccguguggcuucuugguuuuguuuugugccaucggccugagggaagcaauuuaaaaagagcaaguauuuguugugguucacagagguuuuggucgaagcuagaggggugcauguuucugggccucugaggaggcugacaccauggccaagggcauguugaaguguaggaggaggaggcuagagagagguugugcguguucucuuuuccugugcacacccuccccccucgccuugucccagugggcuccagcuuucauagugcccagugguuggcucccaguguccacgcccaguggucggcucccagucagugguuggcucccaguguccgugcccaguggucggcucccagugguugguugagauuuuggacccaucacugaugaaggcagagcccccaugauccagucacgucacagaaguuccaccccugaaaacagcucuguugggaaccaagccuguaacacgcgagccauuuggggaggcuggggaggcuuucuauccagaucauaauaguacuucugcuuacucuguagaauggcacucacacagacacgcuuaugucuaaacgcuggcuagggaaauaauguuuuagguugcaacagugaagggacuuuugaaaggcuuggcuggcaggucgauacgauagggaaggcgaacacuuuucuuucuagcaagcagaaauacuggaucuuaaaauccuguuuugcagccagaaguuuugaaucaauacagacauaauaaaugcucucauaugguuggggaaauaccauuggcugagaauggugcuuucuaauauguuuuguugauuuuguuaaacuugguaauguccccuuuccuucuuccuuuugcuuuucaaagcuucucgccgagggacauggaugaguaugaggacagccagucuccagcgccaagcuaucaguauccaaaagaaacacugagaaagcgccagaauucagugcagaauucaggaggaagugugucuucuagguucuccaggaaaagcuucaagcuggauuacagacuagaggaggacguaacuaaaucaaagaaaggaaaagacgggagauuuguuaacccauggccaacauggaaaaacaucuccaucccgaaugugcucagauggcugauaauggagaagaaucacagcggcguuccagguuccaaagaggugggcagcacguggcugguguggaauggcugugugcuuuguguacauauacaugacuuaguuugucugggagguaugggccucuacuuagugauuugugguguuucugugugaugagacauaguuguaaguuuugaagaaacaaauggguccuaugaccacacccugcggguccugggcaguagcacagaauguguaaacaaucuuuccagucuguagccagaggcugggguaaaguguuuuagaaacagagggguggaguggucagaucugacugguaggguuggaguauguguggugguccuagaaaacuguuuugcagagguuuuccagaugaagaugagaaaaugcaugaugcauuuuagaaaguagaaguuuggauggaucuugcaaaguaagccaugaccuagagugugccuuuaauacuuguacuuggccgaugcugcuauaaaaaaaaucuuuugauguccuuugcagagcugugaaggcugacugucuguuagccuuuaaggacaguagcuuugcuauggugucauuuguccccuuuuagcauaagguaggcuuuggcaggggugcaugagagggugaccguucccauuacaggggcaucuucuuuccuucaaaucuuccuuaguuucccccuguacuuccugacaucuuucuuuaacucugauccugccuacccuuuggggaguuaggggcacuccugaaggcuuugaucuacagugggaagagguaaggggacugugccagcggagguggauucuggcauuagaucuguuugauaaauguugcuugucuuuuuuuaaaggauauaggauuggaaaucuuauauggugccaggaauaguggugcacaccauuaaucccagcauuuaggaggcagaggcagguggaucuaugaauucaaggccagccugaucuacauaguaaguaccaggacagccagggcuauacagaaaggcucaagaaaaggggacuagaagcggggagagaugggaaaaaaagaaaucuucuaucacuuccaugcuagaaauauucauagucaucuuuauaugguauaucuauaucucucucuauauauagauaugcauguauacaaacacauauaugcauauauuugcugugcugcagauuaaaccuggggcccgauaaauugcuuuuguugauugagacgggguuuugaucuguagcccaggcuggcuucaaacuuguaaaauuaucaagugccaugaggaguguaccaccaugccuggccucgauauuuuuuuaagauccuucugaauuaggcuagagauuaauagauaaacauuuauauucagagcuuuuuaggaugaggcaaagggacaaggaaacugucauguuuguuuuuguuuuugagacucagcuuccuauguaauuuaccggagcguacuggagcguacuggugcuuacuggaacuuacugguacuuacuggaacuuacugauagcccacacuagccuugaucuugugaucugccagccucagccccugacugcuggguuuacagguguguacccucucaccuggccuccccccucgccaucccccuugaugaacuccaucugagaagaaacauucaaccugggaggagagggcuuaggguguaaggucaggauggugaguugugugguuuuuguuggugugaaucucuuccuuguucugaaccacagcuucuaaaaauagagguugucagugagagguucagugcuggcuguuucauuuggaagagucaguggcugcaugaacguacaguuguaguucuucagguuugagagauucuagaaauuggauugacucugaggaccuaccaggccagugggucuuaaggaaauauuugucccuccuggaaacccaagaaaagccauagaggagcacugccccuggcugcacugguguggaucuuagggccgcaagucucuccguucacucgguuaguuagcugguauuuacugagcauguguugugugccgggcacacucuguuaugugcuaaaacaugaauagacuaagucagccagcuguguguguauuaaaacaccagaggaguggugagucagcagagaugugagagggagggcuauguauggcugcauucuucaguguauuaaaaagauaccaaagggacucauaucuuugaauaugccacuuaagaaugaauucgguauaaucugaaagaaaacaccuuugcacuacuccagugugugccucaccgauggcaucuugucuguccucuuccuugucuucugugaaagccuagaguuagaugagaugcaugcuggcuucccuuacuucugggaaaacuguaacuuuguguuuaaacacauuaaaaaaaaccaugcugagaggaagagcauuuccccagggcagugacagaucccaaauccccagacagaaacaauagcaggacaaguaggugagggcccgagaccugaggucagcucagauuuaaucagauuucuggaggucauuuuaugaguagaucauggccuuaagucacuacucggaaaagaaauuaauauuuacauaggauaauuauauauuauguuauuuauagcauguuacaguauauugcauuuguuuaccuacauaucugaaagugcuguaaaggaaacguaugauuaaugugcacacuaauugauaauucuaaagaaagugggucagaaacaggauacacaguuuaguugucaggcgagaaagaguuucuucccugggccauuccgggugucugucugucugucuguuugucucuucuggaacauuagggcagugugucggucagcucacaggccacacauuguucagagacuguuguugcuuuguguuguuguuggcuccgugacauugucugauuguuauuaugauucauagucaccuacagaggggaaaugaaaaauaacccugggcaggcagcauguuagggggagggaaacagaugacuugugaguuucaugacuuggaggaugcugucaaauuggcaaacaggcugccccagcguggcuggguaaaaaagaguggggcucugggagaugggaaccaauuuuaugcuccucccugacuguguggccuucuuucucucccaguccugggagacauuccucugugguuuaaaucuuacuugaccugcacagcucauguguuaaagguuuauucuucggccucaugcuauugagaaucgguagaagcacucagagguaggggcgguaggaagucuccuggccauugguggcaugcccuugaaggaaaaagugggacucucauuccuuucuccuuucuuucauuuuugggcaggaauguaagggacuugcuguagaucccccaccaugcugugcugccccucaugggcacagagcaacagagccacuugaugguggcuuggaaucuccaacacugagcaaacccagacaucuugcugguaccuacuuucuaaaauuucaccuggacaucuugcuuuuguacucaucccuguagucagucccuagcagguguuuucagucugaaaauacacuuucuauacuuucuucagcugcaggcaauuccuuuaucuacucauuggaaaauuccauccuuuguuuuguuccaaaaugucuagguagucuuuguguacauuggacacaggaaaaaaaauuccaguacagccaaagacuacagaucccaagaguugcuuauaauaggguuuguccuggauguuuaaaauggcaaauugucuaaaaaauuguuuguuugaaccauaaaagguucuccgugaaagucuuccccuccgaggguggauuccgaugagcagagcaguacuuuuuuuguuuguuuguuuguuugguuuuucgagacaggguuucucuguauaaccuuggcuguccuggaacucacucuguagaccaggcuggccucgaacucagaaauccaccugucucuccuccgagugcugggauuaaagacgugcgugcgccaccacacccggccaauauuuucuuucaccaacaaaucaccacucacugggugauuuguauucccugcaaaacaacccacaguuuacugcuacucccugggaucaaagcagucuuuacgucaaaacaggcgugugggugguuuuccuugggaagcucgagggagcagauaaugggaacuagaagcgcccucucuguggagcaccaccugaccuggccuuuuucccuuuccucaaggaaaccaaaacauuaggauucuuuucccuuuugcaguuuccaugaaggaaaguuaaccaagacaauauuggucuagacaagcaacuuuguuugcuucgagaaaucaagaaucccuucccucccucccucccucccucccucccucccucccuccuguucuacauucgcuuucaaacucuguugugaugaaauguuuauaaauccuucuuuccuuuucuggugugugugugugugugugugugagugugugugugugugugugccauugggcaucuuccuuaaucccccucuaucuuaguuuuugagacagucuauccuugaacccggagcucacagacguagcuaggcuggcgggccugugagcuucaggaauccuuguuugcgcccauuuagugcugaggucagcguuuguggggauguggggcggggggccagaacucaggucuucaugcuugugcagcgggcacuuuccccacucagccaucuugacuuccugaagaaguagucuuugcuuugcuuucuuuuuggcugcucaguuguagguuguguuugaguuucccgaggaagcugccaggcaguucguuuguaaauauaagcuguugcuuuguagugagggaagaugggcacacagauguguguguuaguguucuguugcugugacaaaacaccagccaggcgucuuaaaaaaggaaagguuuaucugggcccagggugccaucccuguggagaugugggaacaccagagagcucagaccuggaacugcaagcaggaagcacagagagcugggaguggugccaggcauggaagccccaagccccacccccagugauacaucugcuccagcaaggccgcaccuccccaaccucgcaaacagcgccaccagcugggaaccaaguauuuaaaagucugagccucugggggacuuuuucauccaaacaccacagcgaagaaaagugcucagcucucaucacuacuuuaucuuuguauaagaugcuuucuugagugacgaguaugauuucuugaguauggaaauaauuuccauacuauacaacugauccauuaaacagacaauuuaguaguuucuaguauauucauggauaucuguaaccacacaaaaucauuucuguuuuuuccaaauguaauacucuuguuauuuagucaucaccuuccaacccucauucuuuugcucuccuccguccccugaaaaccaucuacagugaugucuuagcuuagugaauaaaucgaggcugcaagugguggucaguggugggcuuuauggcccagcagccauucgcaugaugcuaaaugccaagcuucaggcggccuuuaaauagagcaaacccaaagugcauuaguuuucagggaucguuauuuuccagacauuucaacacacuguuuaaugugguucugcuuaaaccuuuaaaauaguuuuguuaacauaauacaaguuccacauauuuaaaguguauaauuggaugaguuuuaacauugacuaaugcagaacagauugccacaguaaagaugaugaauguacccacuauccccaauguuuccuugugguuuugugaucuuauugcccuuuauucugcacacuuguuccccgagcucuaacuuucaauaagguaagguacuuagucgaccacaugcuuagcauaggugggguccugaguucaaucuucagcaacacacacacacacacacacacacacacacacacacggaggugggggaguuagaguacguucugguugaagaaggaaagcauauaagcacagagaccagcuggcugacguguguaaggguagcucuguguaauucuuuacuuucucauguauaagaugaaaguagcuuuuaucuuugguguuuugaucuauauuaagucuaaaauuuuuuauaaaccaaugcagccuccaacaguaaaaucuauauaaaggguggcuauugcugauguuauuuuaugcugugcuucaguacuugauaugagagcauuuugucaucaucucugucguguggcuaguaucacgccuaacacauucauuucuuuccuuucucuaaaaacauuccuuguuuaguuuaugugacgugugccugaguguggaccgcaugcuugcacgugccugaagaggcuaggagagggcuucagaugccugggacuggagauguggguagcugcgaacagccuauugugggugcugggaacagaacccaggcccucuaaagaccagcaggugcccucaacugcugagccaucucuccagcacccuuuuucuuccuuuugcccccauuuuauuuuuaaacauuuuuccuucuuaauucucugcaaauagaccaugugauacuuuuucacuaacccuaauuguaaaauuugagaauuaauugaauuuguucaucucagaccaucuggguggcaucuugguuccuuuugucccuugucucuuuucccuuucugugucagccggccuuguaagggcaaggagugagaagacccauuuaugaaugugauccuccccacccacaccccaggaggcaucacacuguuuugcuuugaauuuuaugcucucaaaaaguaaggguuuaaccaucaacugccauggcuugcuuuguaaguuccagggacggggcugcuucucaggcugguuugcucagcucagugaggcaacggugguagcgagcgacuuagaaagaagcaagguacacgcuguguaagagcagagcagaagcgccagguccauuggaugacuuccguuauccccaaauagcacuuccugaaauuuaggucagaauacuuucugcgaugauguaaucucuuucuaccuuuaaaugcugcuguuugccuuucuuuuucuauauacaggaacuugacaaagagcucccggugcuuaagccauauuuugucagugacccugaagacgcuggagugagagaggcuggcuuacgagucacguggcugggacaugcgacgcugaugguggaaauggacgagcucaucuuccucacggaccccauguucagcucccgugccucucccucgcaguacauggguccgaagcgguuucgccgcccgccguguacaauaagcgaacuccccacgauagaugcuguccucaucagucacaaccacuacgaccaccuagacuacggcucgguccuggcguugaacgagcgguucggcagcgagcugcggugguuugugcccuugggccuucuugacuggaugcagaaauguggcugcgagaacgugauugagcuggacuggugggaggagaacugcgucccuggccacgacaaggucaccuucgucuucacgccuucccagcacuggugcaaaaggacccuccuggacgacaacaagguucucuggggcagcugguccgugcuagggccuuggagucgauucuucuuugcuggggauacuggcuacugccccgcuuuugaagagauuggaaaaagguuugguccuuuugaccuugcggccauucccaucggagcuuaugaaccaaggugcguacgugugcgcuuuauaggcuguaacuuguugagacgauguagucugugugugguuucaguggugggcuugguuaucacugauggagguugaagucggauucacguucaguuuccugugcaccgugccagagccuacauacccugcagcuuagagccaguagccagagugaacucuugcuauuccuuuucacguggaugacucuagagauaacugucuuuuccucugugaauggaauuuuccaaucccugcccugcagcuguucuauguuuaacagagcgagaaagcaaggaguuggccuguaucgcuaguccuugcgauggucuuaauuucagugagcaggcagagagucugguccugacaugccauugcucacuguccccccuccagccacgcuggacuccgcagauacgggccacacugccacuaacgacagauagacccuguaacccgccuguuuuucuuaagccuaucugucuuaaucuccuuaaggaagagcgauaaugguuucugugauuggucaagcagauguacaggugaagugcagcagagcagauucuaacaaagugcccuaggaggucggcuuacuggguaauaaaauggaugcugaccccagcagggagacauacgcuuggauccucagaacccugccugacagagcgggagaugcaggcgggaggguccuggccagccagucuaaccagucacugagguccaggcuggggaaauggauucaugguaaagaggagcaccuuggcaaagccacgaggcccagauugauucccacagggucugugagcucucuucuagcucuuacuuacauucacccacaugcugugugugucacagggaaaggaugaauacauggggagagugauagaggaaagcaugcacacgucuggccugcacacgcccgcacacacaugugcacacacacauacacaugugcacacaccguuuuugcuuuacuuuucugugcauguuaggcaagcacucugaucgcugagcuauauccccugccaaauuuguuaaccuuuaagcucaccaagccauuuuucuuauuaacaucuauuguuuuauucuauuagcaucuuauuuauguccucauuguggguagguuuagacacuuccaccuguucuggauucuugguaauuauuaaagccauugcaacuugccagaugagguggcacaggccacugaucccaaaccuuagaggcugagcaggaagaccuguuccagaaaaccaccaccacuacauaccacagcagaaacgguguaagucaguaugaggauuugaauuuugcuuuuuccauccaaauuauuuuaguucucacgaaacuucugaaaauaucaacauggcuuuaaaaaaacuuacagauaauuuuccaacgguguuaguuuuuccucacuacguuagaguagcucuuuauaauuaugaaaacaggucugcacaggcugcagcauaugcgcgugaugcacgugucuggcgaugcagcaagcugcaggcuuacaguuggccccuucucugcagugcugccuucucucuagacugugaguggcggggcuggggacaucgccugcuuuaagaacauuaaaugugggagcucacauguauuguggaaucucuguguguguguuuuguuuuugucaauacuguuuuaaaauaaagaaaacucaggaauucugugcacauguaagcugguuauagaaaaaaaaaacuacccacccccccaaaaaaaaaaccaaacaaaaacaaccaaacaaaccaaaaaccauuggcuuuuaguuuugugcugggcauauuucaucccuuccucuggguucucucaugcccagacauuguagcuaagucagcuggaauuuagcguuuccugcuuuucucaggugcagcgcuggggauugaauccagagccgggaacaagcgaggccgagugauugauaacuagccuggccugacuccuuagcuagagaacacagaggcuuuguuuguggguuccuggagcauucgaccgcuguacaguaaacaucacccuugugcugaugcacacggcugggcucuuccgggaggaguucugggaaggguggggcgccgugagagcgcgccccuuugaucucucuagcguuuguuucgaguggcagauuaggaugaaaagauaugaagaaaaaguuuuuuccucagcuaaaccaacggcuuaaaaaguuaaacagguguguccuuuguauacagaauaauuuauuuuuccccugaagaugauguuuuuguuaguuauucucugggcaggugcugcauucaaugcucucacgagcugucuagguaacccaaccgucgcgaguccuuuagaggcaggaucagaguuuauacuucauagacaaggaagugagagcucaggguauuugagagaacuuuccacaggcauuguagccauggcaggaacugggaccagaaggcucugugcuucaggagccugggcugcuucuaaggcuccagucggccucucagggcucugucacguggagucacuugccuguuuuuuuuuguuuuuuuuuuuuuaaaccgcaccacacccuucaguuuuguguuuuuuuuuuuuuuuuuuuuugguuuuuuaaagauuuauauuuuuauuugcauugaugguuugcuuucgaguaugugugugugggggggggggaggggugccagcuccucuggaacugaaguugacagacaauugugagcugccauaugggugcugggaauugaaaccagguccuuuggaagagcagccauuguuuuuaacugcugagccaucucuccagcccaguuguaugaaguuuuaaguaaaauuccuugacuagcaguaggauuuucugucccuuaucuuuaaaguuuguacacguuaccauguacacuaguuauuuuugggaaaaaaucuugguaaugcaguccagccuugaacuuaggauccuuaucuggacuggcaggguuacaggucugugugcacaguaccuggauugauacaccaacucucggcuuguuuuucauuuggucaguuuguaucugcucuauauuuuuauucuguaguaacuggaguuuggcuuccaguucuuuacccauuauuacauuucuuugauucauuccuagcauugcagaguauuugcuuuuuaaaguauaaagucaugcuuuuaaaauauagcaccaguaaaaaucaaaauaaauaugaaacagagcuugagagucacuuguuuagcaguuuauacacacaagacuuuugcuuuuuuuugcccccagagaaaagugaacugagaggaaaugguuuacugacugugaaugggcugggcuucaguuuagaauauauaugauuuuaaauugaauauauacauauacauacacacacacacacacacacacacacacacacauacguguaugaguguauaauuucuuuauugagguaggguuucucuggguaucccuggcuguccugagacuaucucuauagauuaggcugguccugaacucagaaaucugccugcuugugcgucuugaaugcugggauuaaaggugugugccaccguaagauuuuauuuagaauauuugugcauaauuuugugucugugugagugaaugccugugugugggugcccacagaggucagaagagggucugcuuccuuagagcuggaguucuaggccauugugagccaccugaugugggugcugggagccgaacucagguccucugcaggagcagcagucuugacugcagagcugucucuccagcccugcuugcugucuuacaguuaagucuugacgccuccagacuugcucuggggcucccucucaucacugugugugccccccuggaauucucaauucuggcugcagaagcccagugcuagugucccagcccaagguaguuacaucagaaucacggaguagcuuuuuauuguagguuuuccaaaugaguguggugugaauuuaauggcuaagaagugguuggugucagguaccuuguucuuguugcugugucugccggugauucggucuuaggcgcacugacauagagucaaccuaaggaauaguggaggcuguacaaauaaccauuguauacauggauaaaauccucagauaauaaaaauugugaaaacugugaacacaaaaagcugcuacauucucaaacguucacaguccugugaagaaucuuuuuuaaaaaauauuuauucauuuauuauauguaaguacacuguagcugucuucagacacuccagaagagagcaucagauuuuguuauggaugguugugagccaccaugugguugcugggauuugaacucaggaccuuuggaagagcagucagagcucuuaaccgcugagccaucacaccagcccaugaggaaucuuuuugauuuaaguuuuauuuuauuuuauuuuuugguuuuucgagacagggcuucucugugcagcccuggcuguccuggaacucacuguagaccaggcuggccucaaacucagaaaucugccugucucugccucccaagugcugggauuaaaggcaugugccaccacugcccggcuuauuuaauuuuaacugaguguauguguguguaugucuguguguaugucugagugugcaaguguccaaggaggucagacagaggcacuggaucuccuggagcugagguuauaggcacuugugagaugccugauguggaaacaacucaggucuucugcaaaaguaguuuaugcucuuaacugcacaacucucucuccagauaugcagacuauccaguguugauuagaugaagcaaucauuuggauuuggcuguucgcaaacacugcauuaauuaauggcuguauuucaucaggugguuuaugaaauaccagcaugcagacccagaagaugcuguaaggauucacauugaccuucaaacaaagagaucuguggcgauucacugggggacguuugccuuagcuaaugagguaaguuugauuuaaacaaacaaacaagcuagcuuugauuguguguuuggcuguuggugggauuuagguauugcuguguucuggcuuugagagacaacacugugguaucaaacuccauacaauuauaacagucaccgcauaaacuggcgugucauuauuaguaaaauaauacuugaacacaguuugaauaaaaccugcauggugugcuguugcuuagucugauucuucaguuaucucugugugauguagaacaugaaucgucauggcucacucuccagaugacuugugcucuagcagaagcuagaacccaugaacauggcuuguuuacuggaagguagaaaugcuauacuguaggacagauaaauuggucucagacacagggagggaucuggaauugcuucauggaagaugcaaauuuuaauguggcaagaaggaagguaucuuuccagaagaggaaggggcagaacauaacgggggcagcacacacuggagaagugaggaguuguucagcaggagagugggugguggagggcagccggaauagaagcaucuaaccuauccaguuaacuugauucagugcuuguuaucucugacauugggguaaacauggcuuaguccugaacuacaucagaagaacggacucuuucuuaggggauucauccccagagcucugcugccagccuggguucuggggucaggcaagucuggaucuagaagggguuagaagucaacuucucuuuggcacacugaggcuccuucuaucuccuagcaccucucugcagagacccaauguuuucuugcuugccuucuuguucugcuugcucuuggccugauccuuccuaagauaugguuuguuccagaauuaccuaauacacucccuguucauuucccuaaccccuaguuaaagugccuguuuuaugauaaaauaacccuguguaaugccgcaggucauugaccaugcugcuggagguggaauggagcaauaagugacaaccuacagagccaggaggaaggcuuccccacccccaccagagggacaugugugcauuuggcaagaggcaaccuguugcaugcguauacugccauuugauggcaguuucuucugccaucucugugugguuguguguguggacaucccauggguauccugucagugaccuagauggaauaguaguauuuauuaagccuuuguaaaggaaagccugacgacucagccucagugaugggcagucacgagggagggcucuuugcugagauggagagacagggagaagaucuaaaccucagaugucaagacccauuucacuauuaagccuucaaacaucgugcugaauugucucgaagaauacaguauaaauaaagcuuaguaaaagccugaauuguaaaauuaucuuuuguuugccugauguaauugcugucuccgagguuuacuaccucugucuucuaaccuaugccuggucuuggaagcuuccagccuccaugcaaucuuaucuaggccuagaauguuuucagccucugagacuuggcuacugaauaaguucacccuuauguaguucuuuuucaucucuaccuggcugguucaacucagcugucuuagcucaaaauuccucuccaaucugacuugauucaaucuggcuucuugcucuuuucuccugaauugcucuacuugguuucacacuaacccuagcaaccuguuccaaucuucuggcuccuucucauucgcuggcucauucugucuucaccuguaucuaacuuguucuucccauaaccugucucugugugaguguccucuuuuuuguucguuuguuuguuuguuuguuuuuugagacaggguuucucuguguagcccuggcuguccuggaacucacuuuguagaccaggcuggauucgaacucagaaauccuccugccucuaccucccgagugcugggauugauuguccucuuuuaaaacugcccccccccucucucucuccccucccucccucccucccccccccccucucucuccugcucucuuaaguagcuucccuuuccucucucuucugagagcugggcauauccuauucugucaaaacuuucucugauucaucacuuuuucugccauucaauuagacaucacuuucaaacaugggugcuuccuucuacaaacuaauguuaccuucauuguuugggacuaaagguguguaguaaggaugugucuguauuccagccagagggaugaaaggugugugcuaagguugagccacaccacaacuagaaacaggguuuuuucaguaaauaacacaaucuugggauucacagugugaucaaauaggcugcaacaccuaauuauuuaguaguugguugaacgcugucagcgacccucuaaacauagcugcaggcaggaaauaaacagagaggaaaauacccacauuauauguuaagccccaagaaaagcuuccuggcuuuuauauuuuguugauuuucucaucacuccuggaaaggauugagugcugcaggcagcaggccuggccccauccugcaaugaggagacgcagcccagcacuccugcugggcagucugaggaguugcuucuagagacguuguugacuccuguguagcugggaucguaagucacagaagagaauugcagguuagaucagaaucagggugacucaauauuaagaagcaguaaacaccgugggcagauuucaaguguaggcauucagaaagauaagcuuggggcuggacagauggcucaguagauggaguauuagaaaguuauagaaguuuauagcauucuucuggcuuaacugcugccuuaacugcugcuggcugacuguucauuagcugccuuauuccuguugugaugcugcucaggaaagaguagaauugcugugcaggcagucuuuacuguggauuuauuaguugugucuaaagucaguggggaauguaaacuggggcuuggugaaggagcucuuccugucccuuaaucuuccuacugucuggauucuuucaccuuucuagaucagcuccuuccccagucauauuuacauauaagcugucuccuccucuagccagaaccgccucccucuucacccucacagacagcucagccuucaucccacacauuguccggugcacucugcucauuucuauagaagaccuuuacaauuugaaucaaaucacagcacagcgugaccugggagccucauguuuggggugaaaaccugcuugccuacagugcccugagcagcccaagcuauuggguguaugcuuagagggggcuuucuugggagggccccugagauuauugucuuuaagacagaccccauuuccagcacuuuguucccuuuuuauuucccuuuguguuggucucuguauuagaaggguaagacuuuugucugguucaugagcuggcaugcucuguagauaccuagaagacagucuucacagaaggggacagacagacuccccacuggcgacuaguucagaaaaguugacuuguuuuuuaacuucuaaauguuaccuuucuaaguagguagggaaaaagaaacuucgaauccauuaagaaaaaaaaaagcuauuauacagcauagagauuuaggucagaagggaaauaacuuuuaaaaagggggaugaaguuggaauggggcgggacugggaggagaugagggaggggauaaggaguggauguuauugaaauagauuguacacguguaugaaauucucuaauaauuaguagaaauaauauuuauuagugugcuuauaccucuggugguguagcuauauauuucucuuaaauuguucuuuuuacuacaucacaacgauucucuaguuuucuauguguuuuuaaaaauguuuuuaugugcaugaguguuuugccugcauauaugucuguguaccacaccugugccuggugcccaagagggccagaagagggcaucugauugaugggacuggaguuacaaacaguuuucagccaccucgggaugcuaguaauggagccugguccuguagaagagcaaccagugcuuuaaccacggagccauuucucacagcccuuccaaaaauuguauuuuaaaaacaaauuaaguuguuuacuuucauacuuuaaauuucuuuguaaaaacaauuucauucuauguucaaguggucugcacuuucaaaauaauuuacauuggguguuuguacggagcaugggcaccacaggauggauguagaggucgagagggucaauuuuauucguauaccaugugggucuggggaucuaacucagggcuccggguuugaaaucuaguaucuuugccugccaggcauuuugccaagacacuucaaacuuuuuaagaaaguauucaagugugcaaaaaacauucuggagcguguuuuguaccauuuuguuuaagcuuuauuuauuauuauauguaaguacacuguagcugucuucagacacaccagaagagugagucagaucucaauuaugggugguugugagccaccaugugguugcugggauuugaacucaggaccuucaaaagagcagucagugcucuuaaccgcugagccaucuugccagccucuauugugccauuuuuuauggugcuaagaucacugaggaaacguggggagucaggggacugggcugcaguaucuguuuucaggggccaccuucauccucugacaugguuuguucaugggggcuuuguggauaccacccuucuccauccaaaaauauuugcuuguucacacaaacacagauugcagagccccagaugcuuaaauguuaacauccaguccucuaguaucauuucuugguauugauuccaguuacacugaaauguauccugagaugaucagcuuuuguguaaucuaaugccaccgaugcaaggcggcccaugugcacacagacuuuggauggacucauuucuauccagcagucaacaguucuagugacuuaguaauuaacggcuuccguuggguaagaagacguguuugucugauuugcaaaugguucauucaaagaaaaggggauuguuuuaugugggcaacuuuugguguuuugauuuuauuuuccguuugagugcuuguuuggaauagccaucaagugucuggauucuaagugucccuuuuuugccaucacuuccagcauuaccuagagccgccagugaaacugaaugaagcucuagagagauacggacuuucuugugaggauuucuucauacugaagcauggagagucgagauacuugaauaccgaugauagagcuuuugaagaaacaugaaacuaggaauuuucagugacaacaaaagacuaagaaauucacaaauauuaugacacuuuucacauggaaacaauuucugcaaguguguguuuuguuuuauauuauaacuugccaauugauaagacuagcuuacauaaauugugggagucuagggauggguuauuuaagaaacuguccaaaauagacuuuaaaaaaccauaccaaugauacaaacauugcaaaauauuguuuuuuaucaaaacauuauauuuuaguggcaguaaaauuucugagguugugaaaaacugacauuaaaguuccauuucuuuuucuauucagggcuuucuacagagagucaugcuuaccuuucuagauuacacacacacacacacacacacacacacaccacacacacaccacacacacaccccuuucuuauauuuauguaaugauaaacuugaccuccacauggucauuaacugcuggucguggugaugcacaccugcaguccagcacuccaaagaauaagcagacaggugacaaguucaaggccagcuagagcuacaagugagagaagaaaacauuagcuuacgugccaaauguuaagugauuuuguuaaccauaagaacauaguuguuugggcuaaauuuauuuuuuuaaaauagguuuuuuuuauuguggucaaauauacaucucauaaaaugaucauuuuaacuauggugaaaagaagcucuuuggcaucaacuguuugcauaggugugcggccaugagcaucaugcacuuacaucucugagagggcaucauccacacagcugcauuucccagguucaaggcugaugggcagagaaggcaagaguggguuugggacuuagggcagacccuguccaaacccagcuauaacugaagccucucccacaggagaggauguauuccugagugggaggacuucacgcacuggggcggcucucacuuucuacuuccucuguacucucuccugcucccugccccaagaugucagguagacagauguacuagugaguuuuacaugacuuggaugugguauauauuuuuauauuaaaugaccuauaagcacaaguguaccuuuuaguaagccauugugaaaugccaguaguuacucuguggcuaucugcugcccaggcuuugucccaguacgccucugcauucacagguuuguucuguaccuuaaggaagugagcugcggggucuuagugaacguacacucugcuucugcuuucuagaccaaugggacaaagcagugaguuuucuauauauaucaaauauuauauagggaguacucaauaauuugauucauuugcaugggugaugcaugucaccuuggccucucauuggaauuuugcccaucccaucauggacuugauuaccccaaaacaaguaacuuuuauguucagacccaauaucaccauguacaagaggacaauguuaaccuaccucccgaggcagagaauaauauuuuuaaagcacuuuagaaaucuaagggagaaaacuuaugguaucacucugaugcagacaggcacaguagacagcugaagagcaaugcucccguugaugcauuguuccugcccagaugcugaacugggggcugaccaccucacccacucaccuugugacuuuagaggggaauagccaauaugagcgaccaucagaauguaguauuuuuauauaaaagguuuccaccacucacaaggagagauguguacuguaacccugcguguacagugaauguggcucagaggcacuaaugcacaagauuccauuuaaagucagcuugaggaaaaccgggcaagcgucggcucuccacugcaagcggacaugaaucuggaccguagggccacgggugccagccuuggggcacaccgcuccaccggguaccgcugcagccacuguguuacuguaagccacacugaaacuucucuuaagcagcugauauagcuuuaauauuucugcaugaacggccuuggcauagcuuuugugcccacauggacaugguccaggcuucccaugugauuuguggucugguccugggaugaauugggauugccucauguuuuuuucuuuuucucuuucuuucaggcuuccucaugguuuuucuuuguuucuguuuacauguaaguuccacucgugaaguacaccaaaucucucucacacaaccacccuauugaaugguuuucacuuuauuuuucuaaucuacauuucaaaggauguaugcauaaagugaaaauaaauuuugaaaaaaagucuacucuuguuagucuaauauacauuguaaaaaugucuaucuucuaaauaaaguaaauauuauaaaaguac

SEQ ID NO: 2359 - RNA, 3835 nt, Mus musculus
uguuguuguuaguuuguucauuuguuuguuuuuuaagagaaauggaggaggaguggaucuggggaagaaaggaugugugugugcuuguggagggacugggaggagagggggaagggaaaugcagucaggaugugauguaugacaaaagaauaaaagaaaaaauuaaaaucuuccaaugccuggaaagaaaucagauguccagcuacaugaaaaucaaagauacuagucacauuuaguuuaaucaagucuacccuaagacagcuuauaauaagcucuugagguaaagaugaagacgggauuuucuaggccucauuaaaacaauaauauagggauguuccaauuaaucugacagcaaaguugucagcagaaacuucacaggucaguagagaaaggggugagauuuuucacagcuuaggaagaaaaaaaaaaaaacagcaacaacugagaauaucuuacccaagaagguuauaauuucagaaauggaggagaaaugaaggcauccccaacaaaaaccaagagaguggucgccaccagacuuguguguucuacaagaaaauuuaaaguaugccaaacauaaagguacuuuuaaaacugaaagaaauagguagauaaaugggauuagaauugagagagagagagagagagagagagagagagagagagagagaaacuacauagcaaaagaaacaaaugccagaaugaauaaacagcccacaggaggaaaaggaucuguucaaaucauauuuugaccaagaguuaaaauccaggguauguaggaaaucccacaaaacucaaaagcaaaacaccaaaagcaaaacaagaaagaacaaaaguauaugugcaauagauugaaauaggaauuucucaaaaaaugaucuacaaauugacagcagggacucagaaaaaaaaucucagcaucacuagcugucaaggaacugaaaaucaagaccaagagaagaugucacuuugccacagugaaauggcugcugucaaaagguuaagccagguaugguguucuuggaugacugaguucuauaaguuuaaggucagucuggacugcagaguaaagauccuuucucagaauaaaaaagaaagcaaguucauaaacaaacaaaaauuaacaaaugcugguuaaggauguggagaaaaugcagccuuuguauauuaauggucuaaauguauguuaguuaauaaagaaauggugaaaacccuauuuaauuuccuuaaaaaucuaaaaguaauaccacugcaugacuaaggaauucuauugauuaacguauuucacaaggaaaaaaaaaaaucacuguacucaagggucauuuccacucccugucauucagcaugauacgagaaauggacaagaaauauaaccugcagucguccgcuggugaacacacgaaggaaaugcagcacauacagaugauauuauuccuucagaaagugaaugagaccuugcuguucgagacauggucaaacuggaugaucucguccuuaugagaaacugacuccuuauuuuuuaaacaaauucuuaccauguauccuccaacccccacuggcauagacuagacuggccucaagcacacaucuaacucugccucugugauuaaagucaugugccuggccacauguggaauuuuaaaaagcauauaccauagaaacugaacuggugguugacagagagugggaggaagaguguagaauacauggggacaggaaaaccaauggguacuaagccacagucggauggaacaggagguucugaugugcuauuguacagcaaggugacugcagauaauagugucugaugucaaagaacaagaggaaauuuuuuugaauauuucgguggccuucucaucacucgccucaagggacagauugaggguugacccugaugcgccaccagaacucacucggggcgucucgaaguaagaaccacugacugaggggugagaucuuacauuugggggcucauccugggauuugaggagaccccccgacuaggcugaucugagggaaaaagaccaagcuccgccacagcaacaggcgccuaaguguuugucuaucuucugcuuucgcuuuuggcucuugagcgugguguggcugaaaauccucuggucuggugcaauugcugcaggcagauagaugugccuuaacgucgucgccguggcuguggggagucaggaggacgcuucaccgcccucccccaccagagauucgggaggacucugcuccuuuuaggaauggcaagaggcaguauuguugggaguggacccagucuugcuauaaccuaguuucugcgcccguggcagaggcaaacugucugccuaaccugguuucugcaccuguggcaggggugagcugucuguguguugcuugucuuucuguauuuguugguguugguuaucucauucuauguucuuggacuuagacugacgacauuuuuggacaugggacagacugaaucuacccuguuaaacauccuaguuaaccaccggagggaaguuagggaaagaggagaaaacuugucagcaguaguaaagaagggcaaguuaguuacucucuacuucuccaaauggcccaccuucagaauagguuggccacccguagggaccuuuaacuugcaggugaucaaagcaguagaggaaagaguccuuaggccaggaucccucaggcacucagaccaagugcccuacauaguuaccuggaaggauauaguggagccgcgccccaccuccuuggauaaaaguuuguuuguuuguuuguuuguuuguuugucucugagacucuugcagguucuguccaugaaggagaagaaccuguagagaacuacgagucuauaaagaacacucuccaggacuguaacacagggguccucuacugauggguccaugaugcuugcacagagugaaauuaccuaagaaugucccuuuuggggauucauuucuguugugaucaaagcauuauugcuuugacuuugaagcucuuauaggagagauggcuuugacacagucuggagguuauugggagaggcauaagagguaaaaaaaaaaaauacacauauacuagaauuagauauuguucuuccagccaagauagaagaccaggauaaggauaauguggcauaaauguauguuuugcaaaucagccaacuuaaucggcguguaggcuugcccuuacaugaagcacccagcagccuugugaucagcaucauuucuaaaagcagugucauagagugaacaccgaucccccaucccuuaacaaggcaaaaaacuuuccuggcaugcccaauuuaguagugaaaaugagauuugucuuuaguggugagaaaucuccaugccaucugauaacugagguuugcauuguucagaguaauuaauugugauagacaacuccuaaaucucagggguuuaacacaguaugagugucuuucucauucucaccgcagccccacacuggccaggaacaacucucccugcuggaacaucuggaacacacacucuccaagguugcuucuacugggaggcagaaugauaggaagcacacaccagcuucaacuugccucaacuggaaagagagacagagaccaucgguaaacuuaguaaucuggcccuaagccaagggagggagcaaaugagaagaggagagggaagauauaagcuuauucuaugggaaaaggaagugcccacauaagccuugucuucauuguacuugguagaggcaccaccacagagacauugcgugggaguuuucaugaguauuuuauguuguugccacuguaacuaaggaugauucuuaagccagacuccaaaugaauaauagcacuuuuuuuuuuuug

SEQ ID NO: 2360 - RNA, 2252 nt, Mus musculus
cuuucuuucuuuuuuuuuucuucagcugcuguuuauugacauucaggugagcacuauagcaaaaggccuggagacucugcagaguacaagguggagaguggagugucugcagugacagaaguggagugcacaaggaguggggaggccaaagcuguugggaaagcaggucagggccagggccagggccagacguugucaucuacacugggacccugggccccacacccucagccccuacucuuuugcugccuccuaacuccaggcuagggcugggaauucucugacaacuuucuacagaaacaaaguacagagaugcugcugcccuucugugauaaagucagaggguuuccaguccugcauuccuccuccaccccuggcucagguagggcccugaauaauaaaacauauugcauguuuuagaggcauuaauuuucccuggugucccagcccaccagcgccacacuauggcccagagugagcacuacaagcguugcuggccuaauggaaaggauaggggaggggaagggacaggggcuagaagaggggcuccagagggccaucaagguacaggcacuacacgcaugguguuggugaauccagagccagggcgccacccggucagcacaaugaccacauuucccuucuugaagaagccucgggccuugccaacauccauggccaaguuuacacgaaggucgacauccucagcccaggcauucaguaaggcauccuuacacagcacagggaagaugccacgguacagaugggccuggcgagcagucuggggauuucgagucacggcaaugauaggagcccgagggcgguaccuggccacuuggugagcacuccugccagacuuggugagcacgauaauggccccacugcagcacuugaaggaggccuccacggcacccacggcagcagcuucuguggggucgcugguaaugggcgccaggcggcggaauuccucaaauagcugcaagugguagauggcagccucugcucucgggcaaucaggugcugcaugcguacagccuccagaggguagucccccuuggcuguuucuccagacagcaugaugcagucugcuccauccaggacugcauuggccacaucacugccuucagcacggguggggcgugacuucuugaucaugcucuccagcaucuguguggcacagaugacaggcuucccagcucgguugcaucgcccgaucaucaucuucugagccaggaagaccuucucugcaggaaucucaauguccaggucaccacgagccaccaugaucccaucacuggccuccaagaucucaucaaaccugcggacgccuucaugguucucgauuuugcugaugauguugauguucuugcccuucucucccagcaccuuccugacuucaugcacaucgguugccuugcggaugaaagaugcaaacaccauguccacauccugcuccaccccaaacuucagguccuggauguccuuuuccgacacagcggggagauccacagcagcgcccggcagguucaugcccuucuugcugcccaaggggccaccauucuccaccuccgucaccaggaagucagcgccuuucuccuucaccugcagugagaugagcccaucguccacauagaucuugcugcccaccuccaccaccuugcagauguucuuguauccagccacaggauguucucgucacacuucuccauguaagcguuguccagggugcucuucggaguggcucccuucuucagcuccaccucagcgguacugcugcccuugaugaguccaguccggaucucaggucccuuuguauccagagccaccgcaacaggacgguagagaaugggaucagaugcaaagcuuucuguggcuucacgaacauucuugauggucucugcaugguacucaugaguuccaugagagaaauucagccgagccacauucauuccagacuugaucaucuccuucagcaucuccacagaucgggaagcaggcccaaugguacaaaugaugccaguguugcgggccgugauggggggagagucaauguccaggcggcacauguguuccaggaaggugucagccauggcugcauggagcugcugggucugaaugaaggcaguccccgcuucacuguguggcuucggcaugguuccuaaaguccucgggcaaacuucgguugcugcugcgauaccuagagggaugucagucgaguaaggacgagucgcugcugugcggggcaauuuuuc

SEQ ID NO: 2361 - RNA, 52048 nt, Mus musculus
cgaagcuacucgccgccaucuugguuaugggcugcggcccgacgcggccucuccgccgaggcguggagacgucacgcuagaggccgcgagcuggccagacacuccgucuuucccacaacaggugcauucauccauccgccgacgguuggggaggucuugcuagcuggugggcuuggcucuuuacccguuguccccgaguagcccucaagccuggauguaggugagcgugaggaugcuacuaguggguagaaggaugacagcagggacggggacgaccccccucccaucacuuccuaaggugaugcacuugcuccuaccccccaagcagccucagucccggcagcccccuccccccggccuggccugccagcucagggugagcccggucggauugucacucgacgcccacuaguggcugaggaggcuccagugcgcaggcuccgggcaccggauaaaagcggagcuggcgagucccgcgcugucucgauggaggagcgagaaacgcaagaggucggggggagaagccgcagaaaaaauugcagccaucgucagcgccgccucccugccaccguguaugggguaaaagcugccguugccgcugccggugcagucgcugccgccgccuccuauacuucuuagcaccggggaaggauuccccgccgcgggacagugugcugggcggggagcgggaguucguuuguguggcggugauuaaacgagggagggacagagcugguuucucgaaccgaaaaggggaggccaaggaacaaaacaggguucuccacuaaaaucacacagcgauuacggaucuggcuuugggggccuuuccccggaauggcgguuuccgucuucuuggcccgcagcacgaccuugggugcuccguaagaggaguggggagaggcagaggcggugucggcagccaaucggcgucuggugauuucugucgggcgcguagggauuggcugacgaugaccucaugcugcagcagcggguggggccagagucgucggggguggcuguugcaaaggcagagagugagaagugaugacggugaucguugucgccgcgucuucuguggaacccaagcagugccgaaggaagucgcaaggcucuuccccgaccuuuugcuccucucccugcgcgaggugagggcccuggcucggccucugcgagacuuuggggcgcuggugcggccguggaggcgcaauuucuccugugacuuuuguaacugcgucagggcaagauggcgcugggucuccuuggggcgcggggggagaggcacguccaccgccgccgcagcgcaugugaccggcugcauuccugugggguuuggcggggacccaggcagggcgggggaggggaccggguuugggcggaggagaugguggugcggucggcguuggcugcccgaagaggaagagaugacuguuugaaagcucuuccccucccccacuccccgcagcagaacugcugcggggggggggggagccccugaaaggacacuccuuucggggugugccagccacugguggaggagaagguuugacgccuucuuauaucugccuuucuccuugcaaaguaugcuuacguaagguggcaguucccuccuguaagccaacuaggaggcccugagugucacugguauggguaacaaggacagguuaggcucugaaggcaccacagguaggaguguugauuauuucagacaaaacauaaaguuuggggggucugaauagaagacuacagcauucucagaguuugaaagcaagugaauaacacccaggaacacuuaggguuucuaggcagacagcgauuaaggacugcaucacagucugaacggaagggcccugucaaaccuucuccuuagauucuuuguguucauuacccucccugucuguacaucccgugagagaguuuaaguaaucuuacuggugaggguugccuuuucaaauauaaguauucuuaguaauuuuaguauuuuguucuguaugaaacugaaaggucauuuucuauacuucacguugcauuuugucguccuuuuaaaaauaaaaaauggaauuacaaaugcuucugguaaauauucguuaaagcucucuauccugcgucuuuaaagcacauuugcaauagcauaaaacguauuuuuagugggacuuagggaugggaaugagggcucgaauggguuuugcuauuuaauagccuagacuagcuuggaacucauacuccugcccacccuccuauugcuaggauuacaggcucugccuggguacuauuucaacaaaacacuguauuuggugcugagagaaaaugaaugccuacuaggccuagaaacuucauuaaccugggccaugguuauguuaauuuauguuuauuuuuagcgguagacucuuuguaguuggaaaucaagauuugguuuguagcauuuuuguuauuagguaacaaugagaaugagcgaaagucaguauuuuaaauggaguuauguauuacaaagaguuuaacaaauucaaagcuuuuuguuccugcuuaucuauuaaaauggacauuuuguauaauuguggaauaaccuuuuuuguuucucugucaauucccuugcuccuuuauccuaacaucauuuuuuuuuccuuagaaaaagaacuaaauaugaagccguuuguguuaauaagggaaagaggccauuuuuuaggcaaauggagaugaauccuuuguaugcuuccaaauuccuuccaguuauugacuccaugaaauucauaaacucuuaauauuucuuuaccuuuuuuuuaaacuggcauuucaaauucuugagcuagacaugauagcacaaagucaucucaaaaagauuacagaauaguacacaaccuuuauuuuuauuuauuguucacuuguaaucuuaacaacaaauuugcugaggugcuaaaauacuuaucaucucaaaguagacguguguauuuguuccugucuggaggaacccuucccacccacguccaggaagacagcuuuaguguccuccaugccucuucaaacuccucacgugcuuugguccauuguucauaauggugaccaaacgcacugauagacaauugauaagagcuuggguggacucgaacuccuuuagagauuauaagauuaaacacuguccuaauggacuauaaacuaaaaauacuggcucgaguuuuuccagaggcuguuuugaacagaguuuagaugagaggaaacgauaauauagugguaggcaagcaggccggcagaagcugaugauggccaugcucgagacaguucugcaaagacugggaagaaaagcuauuuuuggaugcuauuaaauauagagggcaguuucaucuauaaauuuacuaguaguguauaaaagucagugguuuaaauggauggguuuaugauaccuuaauguguuuggaagcuuauccagguuauagagcauuguuuacucugauauuagacucaauuugcaguaaccuuguuuaguucugucaaugugacagcuucuauuggcuguggguuuuagugaucagaagauuggcauucuaguagcagagcuuauauauuauuaacaugauagauaaugugagacugaaaacucauuuaaucaagccugaauauugauguucguugucuguucuuagagcuuugguguauaaucccugugcuacucuauuugacacagucacagaauaaaugagauacucagagggagacaucauuccacuuuaacuuaggccuagucuuuacuugaaaauccccuuuguuucacccaggccccugacauugaguguccucuugaaaauacagaaagauguaaagauucauaucugaaaaugauggagcugaaauaguuugauagacaaauaagaugguuuauuuggcuugguggcaagugccuuuagucauaacacuuugggguuacagugagaaaaguuacaaguucaaggccagcuugagcuacacaagauccugucucaaauaauuuuaguuauagguaaauaugcacauugucuguugaguuugucuuuaggaaaugauuuugauguuaccugccuguuccuggcuaauguguuuuaaugguaacaacacucagcuccauauuuauagauagggcucugaagauucuaaguagguuguagguaacuugaauccaauuuuuuuuuuuuuuaaugaaaauguaaucuaguagaaagauggagguaggagaggaucaaggggguggggguucaagaccauccugggauacaugagacuccauuucaaaaacagaaaaagaguagcaaauaaccaaaacaaaaacaauaacaacaaaaaaacaguuugaaaguuuccugcaugcugcuagcuacaaagugaauucccuaaucucuguugccuaauguuuagaccauucuguuucccagaauggaauuucaucugcaaaaaccaguaugacacuuugcacuaaaugaaacaaaauaggaauauaacaaaagcauagagaccccacaguucucggaaguuauuuuuaggugaacuaauaucuuauugugacucuaaaguuuaaugccucuauaaauguguuguuaagcggguauguaguaaguuaacuauaugcaguuaaaaagagggagggcaauuccuugaauaucuaguaucagcuguaagcuuuauauccuuaaacagcuagugaggaaggauacuuacuggaggucuuuugcuuacuugaagaaagagcaagacuucaaauaaaauuucuaaauguaccaaguuggucaggauuuguccucuuaaaagaguuugugguuggcuuguuucugguuuuguauuucauggcacuuuccuuccaugucugugcugccauuaauguuaggauaauuuagaauguuugaauuuugaucaguuuuugcucuuuuaguguaaauacuguuucagaacauaauuuucuuuuuuuuuuuuaaagauuuguuuguuuauuauauguaaguacacuguaguugucuucagacaccccagaagaaggcaucagaucucauuacagauggcugugagccaccaugugguugcugggaauugaacucaggaccucuggaagagcagugcucuuaaccccugagccaucucuccagccccaauaauuuucuuuauguauauguauauguuuguguacacagaagaacccauacaagugugagugcagauguacagaguccagaggucaggaucagguaucauugcucaguuucaucugcuuuuuauauuuuugagacagcuucuuacuccauaaaacaguuaggcuagccuggauggccuucuugccccaguagucagccugccucccucccucccuccccagaugugggguuacaagccaacaucccauauacccugguucugaguuuccuuauaaacacggcaaauacuuuaccagcuaagcuagcucuauccccaauggcuuguauauauuaguuuucauauuguaaaaugaauugaguauaaccuuuaaugaauaccauuuuggacagcucaacccaaauuguucaguaauuacagggauuuauuccuaaagauugugauuuuaaaagcccuuguucuugaagugauucuagacaguccaagcaugguagacauggcucuggcagaccuuguccuucucccccauacucuuuccucuaccuuccuaaaaacaguuuaauuaauauucuuaaagcuagccaccaaagucuauucccuuauuuggcuacuucuacugaggcuggcuaccaaaguccagcuaucaaucaaaagcccccuuuugaccaccuuaauuaaaaugcccaaucaacauuaaccccuccuaauauuaguuuccccuuuuaucuuuaaaaacugccauuuucuuaugggccaccugucuccuauccagaggcaguuguuguguccuguccccaccccuuccccccacccuuguuuuuuuuucucuuuuccuuuguccucuauuuccuccugucuuugucucuuauucccugccuucugucccucgguggccuaucaacuuugugcugagaacuuggucuugcaguaucuugugcugauguuguucucuuugguucucaagagauuuuauuuuuaaaguugucuuucccaaauacauugauauaagagucaaagcuaucuugugguuuuucccuucuauuuuucugcauuccugaggaaagugggcacuuuggcccuuauuucagcuaacagauaguucaguuucuacgucuuagguugacuuaaagcuaagcuaauuaguauuagauagaacuuggaacuuuccuaucuaaauguuugccauuuucuuccuuucuuucuuauuaugucuguugaaccuuagcucaguuuuccugccacuuagauuuccuuaugaauuguuugcuguguugcaaacaauaaauagaaaagaaaaaaugauuugaaguaagaacuuguaaugaaauuuggggguugcuugauuguuuauuccuuuguuuuguuuuguuuuuuguuuuuagcaaagugagccaccccagguuauuaaugauucuuuuguuuuuaaaagccagcuuagaaaucuguaaccacuacugugaguucucucaacccgucuccaagugagaggauauuucugcauauauucuuuaucaguuaagugaugcacuuauccaagcuggcagauggugacuucaaugacugccuuccuggucucaccaaugcuuauaaucccuucuuuaugcaguuaggauucuucccccucuuucagugcugagguucagaacuguuuuucacaaauacuaggcaagugcuucaccauugaguuuaaaucagucugaagacuuggagcccagaacagaaaagaguuuaccuucaacuaaacugacucuucacgcccuuaagagaguagaaagaagacuagagagaugacucggagguuaagaacacuuaacgcucuugcagaugaccuggguucaauucccuguacccacuugugggucauauccaucugcaagacuaguuccaguggauugggugccuucugaccucuccaaggaccaggcaugcacgugacacaacaccaaucuauaguguuugaagucuuaggugcuaggucagcaacuaaaggucuaggcaacguguauaaaccuuguccauuuauauuaauuuuuuucuuuauggacuauaccccuuuaucauauagaauguuuuauauauauauauauauauauaaacagauauuacacauaaugucaaaugucaagcuccugcuauguuucugaugaguuuuauuguuguuaauucaaggaagaaccuguucuugaagguuagcaaucucugauuuguuugauaccaguaccaugauaagugucuaggcauaugaucauaccuauucaguugucaguuaugucucugaggacccacuuuggcuuuuuuuuuuuuucccccucuguauaguccuugacuguccuggaacucacucuguagaccaggcuggccucaaacucagaaauccaccugccucugccucccaagugcugggauuaaaggcgugcgccaccacugcccagcuccacucuggccaucuuaagagcaaaugagagugaaaagaauugaagaugguaccuuuuuggucuuguccugcugggacaggcucagcuccaaggacaucuaagugcaagugcucucacaccaguguccauuuccaccucacgcuagggguucuuaauugugacaguagaaacugacucccuucuccuuuuacauaguuucaauuaggaaaauggcuaacuagaaccccagucuugaguagugagugaaaagcuagaccuggacuucaaacaauguccuaauccaaauagaaaacgguacagccugugugcuggguuacagauuccauuccuaaucuuuucuucaggacuaaaagaaauuaagguuaggaaaaaggaaaaguauuucauuuccuaacacacuugucuugauaagugugcauaaagggggauucaaacuaaagaugagccuagaauggugugugcuguauggguauauuccuacugcucaggaggcugagacaggaggauugucaguuacaggacaggcuuggcuacagaaacaugaguucagguauuuuaaauuccauccugagaaucuauguaacagacaaaccuauauuuagcaaaagccagaacuuaacugauuuuuuuuaaacugaucuuuauucauucuauucucuuauuaaaggguuuuaugggguggacaaaagagcucaguggguaaaagguacuuaugaccugaguguugggauuaaaagguaugugccacacauggcaagagagauaacaacaacuauaaaaaugguuuuuuuuagaacccagugauugcagucauaccagcugacuuacuaaauuugaggcucuggaacuuucaaauaaacaugcagguuuauagguuuuuuguugggggguggaaacaggguuucuuuguauaccccugguuauccuggaacucacuguguagaccaggauggucucaaacucagagauggucugccucugccucauuagugcuggcauuaaagauaugagccacuacccaccugguguccuauagaucuucuuuaggacaaaugggaaguuuugguugagugaaguugucauucuaugggcaagguaagugcuggcgccauaacccuccacauucucuuguccagcccucucuccuccaucccuccucucugucgccagcucuuuucccugucugugguuggauaguucugauauuacaagggcgugcuuugugaacuuugcagcaacuaaggaggaauugaucuuauuuauuuuugauaguugauacuaaucaaggaagguauuguaagaauagaaggcuuugagcugcuuggggagaaauugcuuauauaagaacaggguacuaauuuauaauauacagacuugguugaguuauauaauugucuuauuuauuaguaguaguuaaaaaaaaaccugauaguuagcugggcaugguggcacacgccuuuaaucccagcacuugggaggcagaagcagguggauuucugaguuugaggccagucuggucuacagagugaguuccaggacagccagagcuauacagagaaacccugucucgaaacaacaacaacaaaagaauauuggagauugcuguaaccguuucuuuucuaauucaaguuacuuuugaugcugacugaugauaaacucccugggucuggaguguuucaguucugcagcgcagucacgcauuucacauugacuguugaugaauugauguuuguugcaaguuaccaggaaaaguuacagugcacucaacucaccccccaauuuucaggaguccugacaucuaauauaaaaaauaggauuagcucuaggaauguguagaaaguuuuaguaauaacaucuaagagggcaggaagauagcuuacugguuaaguagugcuuauuuuuugcugaagaccuggguuuauuucacagcauccacauggcaacuuauagccaucuuuaacuucaauccugggggauccagaguccucugcugaccuucagagacaccaggcaugaaugugguucagguacauacaugcaggcaaaauacucauacauaaaaguaucauggggccaguuguaguggugcacacuuuuauucccaacacuuaggaggcagaaaaaagugaaucuuggugaguacccauucgccuggucuguacagaccuugagucaaaauauauaugauauacacacuuacuggguggugugggggggagguuaggggaguugcgguaggggugguugguuugguuuuuugagacaggguuuuucuguagaccaggcugacuuugaacucagagauccaacuuucucugucuccaaagugucaggauuaaaggcgugugcuuugcuuuuugugugcuuuggguuuugggguuuuuuuuguuuuguuuuguuuuguuuuguuuuuugacagggucuugcuauguacccauggcucagaacuugcauugaacuguuugccucugucucuagaaugcugagauuacaggcacgugccaucacacccaaagaucuuauauacaucucugcauacauacauagcaauauaguaaauacaugauguguugggaauagaacccaggaccuuaugaaguguuucaaaggcucguuccuuguagguagggacaacaggaaucacauguauguauaugaggggugguaugugcuugugaguguggguguccagggaagcaaaagguauuggguccccuggacucgggaguuaaaagguugugugagccaccugauguggguauuuggaaucaaaucucauaacaaucuucugggagagcaguaugcucuuaacugcucaguuacagaucuccccagcccuuugguuuugagacagccucacuauauagaggccuuggcuggcuugaaacucgccguguagacccacucuacccucaaacuuuucccaccauacuucacauagcuauagaagucuuuaacuugaaaggcaaaagaaaguauaauggauauuuaaacauguauagauaaagaauuguggguuaugaagagaaauuuuuuaaagauuuauuuauuuuuauuuauuuauuuacuuauuuauuugaguacacucuagcugucuucagacacaucagaagagggcaucggaucccauuucagaugguugugagccaccaugugauugccggaaauugaacucaggaccuuuggaagagcagucagugcucuuaaaccgcugaaccaucucuccagcccccaugaagaaaaauuuuuaaagggcuguaaugauucaccuucaaagaagcaguggaggcuaacuuuuaaguaacuuuuaaaaaauuaauauacuauauauauggacaccaggggcagaaaacugauggaguuaaaguuaauggaaugauuguauuuugagguauuugauguuuuuaucaagacagggucucauguaguccaagcagccuuaaacucaugaucuccuucccucugccuuuuagacacugggauugguggcaugagucaccauguccagcuucuuugugguuuguuugauguuucuguuguccuuagagacucaucuaagguaucacugcuucuagagccagcgauugcauaaggugaggaacaagacaccuuauuaaauuccucagggcaguacagcaaguaaacauaguugauccugauaagccacgugauaggauuuacucccuccccgcacacacuguuuaaaaaugcuuuaucucaaauguuguguaucugaagagagauauaucugcagauuaucacaaauguuagucuuaguaaauaauuaguggggaggugcagaacuuaggauuaaccugaagccuccuuaagauguauuagguaauuccucuuuuaguauuaagaugcuauuuaaauaaaacaguuauuuugaucagcuucuucuuucucucuaggccccuugauugaauuuaaacagucuccuagauugauucugccucccaacaagaacaaacugaggaagugaugagccacguagccggugacccuuagaguuuuagaugugcgguucccuucauguauacuuuacagaaaaccagcuaagccgggcgugguggcgcacgccuuuagucccagcacucuggaggcagaggcaggcggauuucuacaaagugaggccagccuggucuacaaagugaguuccaggacagccccagggcuauacagagaaacccugucucaaaaaaagaaagaaagaaagaaagagagagagagagagagagagagagagagagagagagagagagagagagagagagagaaaagaaacccagcuaaaguagagaaagguguuuagaaaacuuaauguuaacuuuuuuguuuuaacuuuuaauucuuuaggaauguuucuuaaguagugauuuauauuagcuacugggauuauaaugcuaagcuuuagacauuuuauuuggaauaaaauguuauauggauucuuuugucaugcaugugauuuuugugcucauuuugcaauaaaguuaaguauuuugguuuuauuuuguuugggguuuguuuuugcugaauuccucuucuccuagggcacagugcuaguaaguuuuaguacuuguaguaauuagccauucauaagaacucagagauaauuuaagaugccagaaagcuuuguggugaagaccaaguucaauuaaaucgccagccaguaccuacuaagguccaauaaucauucacgugugcauggguggacuaagaauaagggaacugcaguaagucacacuacgaguugaauaguuuuuguggauuuuuuuuaaaaaguaugggugggaugauaaauauaucuaagacuggucucuuacacauaauauuuuccauguaggaaauaaggaaaaagagugaauauuuuuaaaugaaugauuaaauuauuuggacuuaagauuucuacaacuaaaaaauguccccugcuaacucuguuauaaagggaucuguuaguauauauaagaaaacagggagaauacaaauguucagaauugguuaauggaugggugauauggauagguauacacauauaucaaugguuuuauauauaugaugucccagacacuagauggaauuacauaccaucauaaagguuauugcuuagugauuauaccauugccuauccugugugauacccuggguucagguccuagcaucacacaaaaguagguuuuaucaggugagguaaccugagguaaccaaguacaugagagacugcaggcaggaggaucaggaguucgaggccaacuuggacuacguaagacugucucugaaaacaaacccaagcaacccaguaagucuaaacuauauuaucaauaugggcccauaucuugcugacauaaaggaagaaagguaaagaaaagauaugccaucauagugacuaaagaauacauacauguuacuuuaguaugugugucuauaguauaaccucauaccuagacaguugaugauacaacauucccuaggguauugccaauaucuuuuuuuuaagaaaaaaugcaaguuaaaauaagacuacaaaguuagaguuuaaugcacuaccaucacuaaucaccaugaauauuucauuacuugacagguuacuaauaaaguuaggcacaguaaagauuuccuauaacauuauggacccugugacauaagcguuuuauaaaguaucaaaagcuauguuagacuuaaaaauuaaucauaaaugcauaucccacaagcaucguccuuugacaaugauggaaguuuuaaaaacaaagauuauuaugucagccagaugggcuguauuaaucccagcacuccggaggcagagacggguggauccaaauugaaggcccaaguggucuauauagugaauuccaggucagucaggacuaacaguaagaaaaguuagggguggagcuggcaaagguuuucugccugauuauagaaagagcaguguguuggguuguuuuguuuuuacugauuguuucauaaaaggggcugaugcuuuguuuaaguuguaaaaauaggaguggagaauagcuuaguaguuaaaagugcuugcuuuuucaaaggccugggaaauaaguacaccccccuacacagucuguguugccucuguacaguugucuccaaagauggcugcgugagagaggagggaggaaagggugauuaaagagccugucuuagggagaacauuuuagcaauggaaggcaguguacaaauuuagcaaguguaauuuuauaaguacucagaagcagcaaauaugaucuguuccaccaugugguuucaggccuaguagaugucacagagugacacugccauauaugaaaguauugcuguuauguuuggagauuauacuacuagauguagccagcuaguuuuacugacaugacaguacauagucacacacuuuuauuccaguccuuuauccugaaaugccugccuuuuuccucaccccccccaccccgauuuuagcaaauuaccucaaccuaagcaucaagucaguauuauccaaaguaaaauuugaauuuuaagcugcaucucuaagcacuugcaauacagauuucccuaugaaaagaccccaauuacaauagcccagugcaugauacaaacugauaaagaggagcagcuuugaacagucacuggcuuuagagagcuguguauugacagugcugggaugagcagcuacacacagccacaucacagcugagauuuaauaguccccuuccugagaacggaaaaacugcacacuuuaaacucacuguacggagacuuguacacuucugaagauucuaucgagaggggauucgcugcaacaaaugauuuaacagauuuagagaaagugccuaucuagucagcucaauauuagcagaugugcuccauaaguggucaguuacuggggcuuuuagauuauauagggcuuuggucauagcuugaugguagagcacuuguuuaguaugcuucaggucauggguuugucuuguuuagaggacaaguucucaguggcuggccuggaacuugcuuuauagacuagacuggccucaaacauaggagaucaccugccuugaguugaaauguagucuucgucaguuccagcacguuugauucuuaguacugagggaaggggagggguuaggggcugagugaggcguagcucugggaaagcacugggcucaauccccagcaaaaguuaggguagaagucugugaacccagccacaauugaaaaauaguccuaauagaaaaucuaggcauagugggaaaucacugcagccccggcucucaggaaguaugaggaguuggagacuuagcuuuuacauagguugagaagguuuuuuauaagauugacuccaugguccacaugaccuuaauguggguugcuuuucgaggacgagggugggcaagaguuuaaacgaggucucaggugacucagacugacugaccaccaacucaacacugccucuagaguuacaggcuuggcacaauacacugcaggaauucggaaccagaaauccauccuaauuaaugcuucugaaaggcggaucccuucucggaaugcuguuaaugugcguagaguagcauagugcacagauccuguuaaauucuccauggacacuccugcuuagaaauccugugcaagguguucagauucuaagagaaggcugacaaauaaugaagcuuagacauaauggugcccuaaugggacuaaauaauuuuauuuuuuaaaggcgaggcgugguucguguaauucaggcuggccucgaaaucacuugguagucaaaagaucaacgccuuuuuuuuuuuccuguuucuagcucagguuacaggcauacaucaccaugccuguaacgcgcagcuagcuauucuagcguuuaauguucuuguagcuuucaacuggagugauccuuucccuaacugacauuagaaauuaguccaguaaaaguggccugagugaaaagcuguaggaaaggauuuuucuuuagugagaaguacugaggauccauucucuuaagcccgguuugauugacgagugguucaguagcuuaguuuugaccuuuuguaguaaucgggcuuuuaccguauaauaccuauagccggcguguccuaaccauggauaaaaccaagcuaccccguuguggcugccaaauuuuacaccagaggaaaaacaccucuuggcgaagcauagcgugggcuugugcucuagaccucaagccuugagucccacagugacagagcgagugcuuguaccacagagcagggcguuuccccggcgcugucugcgucacggcggcugcccuuccgcucgggagagcagcugcgggagcugcgccugcaggcuggccgggugcgcggcgcucgagccgggcggcguuuuccugggaccuucacggagcagagcgacgaggcuacauacagcggccgagcuuaucccuucuuuaauccucgcuguaaagcaccguagugcagcuuccugcuuaacucggucgucugagcuuccagcucacauuuugagcccagugcagccgccaucuuccggaaaugcugauggugguuagucugcgcccaguggaaauaacaauuuuuuugcuuuuguuuuugaagcggucuugcauuuggcccgaucuuuuugaggacuuggguuacagaauuacaucaugccugguuaguuucaugaugcucaguuuggggaaguagagcaguguccuuguugaaauauaaucucuuuaguccagccuuuucucacuuaaauuagauugauggauuaaaugagauaauguauaccagauaugcaguaguaacuaacagagaaagaagggaauggugggugggggaguugcgggggcggggggaugauuaacuuugcuggguaucaccaccuaaaacaugaagguauggagaagcaugcuguagcacaugaguguguauuuugacagcucuucaguauaacugaucccuccaaagcagacuuuacuggcuucugguuucuaagggaugcuucuuuuuuguguggcuuccuuuuuugcagguccauacugaauaaauaugcuguagggugauggacaaggccaaguuggguaguccuaccaugauuuuaguuuacagggaaaaaucaggcugaguuuaaguacauuguagguuucuagguguuagaaguuuucacacaugugcccguuuauuuuuagggcgcggcuucacuguuuggcuaggugguuuagaacuggguauagauuaggggacaaaagcaggagugaagucgcuugggguuuguuguuguuuugcuguuuuaggugcacuaacgauguaauaauguguuugggauaacuuaggaggcagcgaugaagauuuaaacaguaaaagauuauuacacaaaaaauaaccccaaacuugugcuuuaccgcggacccaccagguuggaauauacagggaacaguuggaccaucccuguuucaggcuggggguuugauuucuuuacacuugcugucuacaaaucucugcaggacaccaaacccacgacugaaugacacagccagcauccacaauucacacagagagguaaaaaugucagauccccacaccaguugaaccagaaguucuuuguacauuagaacauuuaaugggaaacugcauaugaacuguaaaguguaaauacagucugauugggauuagaagagcccucuuguuuaaagccuuguugauggggaggaagccacacaguagaguauacuugcaaauaauagaaaggucaaucuaguacagacuuaagauguacuauuuauguaagcuauguuaacaguaaaaauacaaaccaaaaugaaacaggcgaggagaguuguggcucaguacuacucgccuggcaacgcugcacggacaaucauuuaaaaaugcugauguggaaagauggcuaucguaggccuugaagugauauuuacaagauaauccuaauuuugcuuuaaaaaaaaaaaaccucaguauguauuugugugcacuuacuaagguguuagugcccugcagcugucagggugcuggaucaccuugccugucuauuugugaccuuaaauguucagugaaaaugugugacaguggagaauaauaaaauauauuuuguaaaucugguugcuugcauaaaaugaguauucuguugaggaaagaaaagguggcacgucaauaaaucaaaaaauaaaaauauucagaaaucaggcauucuggguagaagauauuuucucuagauuucaauuaaauaugaauguuuguuucuguuuuuaaaaauauguacgaauuuuacuugucuaaaauaaaauuuaaaagaaauggugucucuauuuaguuccuaggauuugaccuuagggcucaguaguaaaguaugugcguuccccagcaccacccccugaauaccgagacccguggugugagcugaaacugcgcacauucauucccccaagccacacccugaauacugagaccgaggugugagcugaaacugugugcauucauucccagugccacacccugaauacagagacuguggugugaacuuaacuggauaaucuaguuguucccaccuaaguuacuugcacuuucucugucacuaugcagcaaagaaaacgccuaagugaaaggcaccuuguacagcagucaguaucaaguagaaacagauuauuaauugcucgacauacagcuucaagcuuuggggggcuugaggucuuuuguuguucuucucuuccuuaguuggagggacaaggguacacaacaccuuaucauaaaaugcaucaugcuucuucugaggagagccuuuuuggcuugaagccauagcugauuauauaucuuguaccagugugagacuugacauuugcaaagcccuggucgcaguuuguguauuuagcgcccucuaguggguuacuuuauaaaagcauaguuuaucuuuagcuaaaagagauuaaauuguuuaccaccgcaguguaauucguuuugcuuuccauugcauccaaagagacccuuuccugcuacaauaguuugcacuuggccaagagaugaccuaggcuguggccuuugcgcuguagcuccucaguauuucuagguuucagguuccuaguguaaagugaugauagauagaagugccagcuugggaucaucuaaagcuaaaggagcuguaaugugggcaccugacacaguaggagccuaguaauguaggaggagccuaguaauguaggaggagccuaguucuauauauugcaaaucuaaggucuugaguguaauaagauacuugaggccugauauagccaauauuaauaaagguaaagaagcagguguucuaauucugcuaguugagagaaugagagcaauguucaaugggaaagaauaauuccuagauauaacucuaauuucucuaggaccaucguuauuaaguuggaaaggggcagaggacaaguuuggaaucugcucuccaaccuacugugaauucuggggaucaaacucgggucaccaggcuugcagacagagugccuuuagcugcagagccaugccacaagcugcugcuuaaugagauagucauaccauuucugcagccugggagcauguugguuuucuuugcaucugucacagcacuuagauaaacugcaugugcucagcaucuaaauuugaccuuuccauguuagaguugacuguaugguagacuuuagaaaacaagacaaagagugguagauaguacuuaaaucgagccagguacaugaaauagccccaaagauuucuuguuuguagccuuaucuugcauugguagucaaggacuuugguacuuagacuuuaccuccucagccccacuccccaggaacccauguacuucaggaaagcacugggugauuaugaccugugaaugaccagagucuuugaccaagugucccuaggcccauuauuccugugugccauguguuagacaugugacuguugucucaaauucccuucuguuuccuuagugauaggccaaauuuguuuucuugugaacugguuaaccuuuaauugagcccuaguuaaugucaggacauuguacuaagcauuuuuauauucaugacuuaaccuucacagcucugaucaguaagaugcaaaguacgaucccauuuuccacacaaaacuccuaguggcucucuuaaguggcagucagacuucugaccuaaagcugccucuauuuaaagccaauggaaacagcugucagaaacacugcaaugagaacuuugagugccguuugugggagucugacaaagaagaaucugggcuuccuugaggcacuacgcccagcgauuuuuuuuuuuuucuuuuuaaguuucuugcuuuccaagaaagcccacuuaucugacccugcuguaaugguaauuauggcucauaguuuugccauaccucaccguuuuggaaggcuggcacaggcguucugacauuaucucuucuuggggaccuuuuguuugugucauccauugauccucuaagcuggagaagcaagaagaaggcagcugcuguuaguuauuccccaggggauacgcagcaaaucccaagccuuccagcugggaaaacuucaaucuggcagugaaagcauacaaaagaaaucuagacaaagcgggagggaaugggguucacacgccagccagccguccugguuacagcgcuuugggcuaugagcuguccugggccaagcugggccacagcacugaaaguucugucuugguggacacaaauucugcaguccuuccaacagcaggacacacacacacacacacacacacacacacacacacacacuuuccauacccauguucccuuucaguuuaggccaagcaggagauuucuauuaauugccuuuuuucucugauguucugauguucaacccuuaacuccuaacacuguucuuaauaguuuccuccugcuuuauaccuuggccucuuugaaggaucccagucaauguuagagucucuguggguggaugguuaguuagcaaucaaagccgcagacacuggcgugggaguggaaugacucuggguggagggaccacaguuugaaaacaaaugagccucuuucauaaucccaguaagccuucuguggacucuuaaggucugcuguuuuggcgcggggcacuaggguuucugggacuuugagaaagaguaaacaggagcuaguuuaccaucuccaguagccucagcaaaacaucaguguccaaagaaggccuggguuguugguugguuuguuuguuuguuuuuaaguucgucucuucuucagcagacuagguuugguauuuucaaagcagcauaaagcucagagucagagcacugauauuaucuccucaaucuagaaguuucacggagugauggaugggcucaacuuugagaugacugaaugucuuuuuaaaaagugaauucuuuagaauauucagcuauucguguuaguggaggagauccagagaccaucccacgggaccuuuaauucacuguucauuugcacuugggguuaugagacacuuugguaauuaacauuuuaauaugggugugccugugguucuggaaauuuacaacuguuuacagcaaauaacaaagcuacccauugaagaugcugacuggacuggaaugcugucuaauggcuuuuccagccuccggaccagcucaggccuggaagcuucuagcuuuggcuuugcucgaagcuuucaauccugaugcuuugccacuuuucagauuucuccuuugaaacccagaggaaaugaaacaauagcaaguuccucucccugggaucaaagagugccuuagcuagagguuuugaggugauucucagagccaugagcuguauuuggcauucaguuuuuaauggcagugaaguugaaaaacaaccauacauaaacuguaguugcuaauggaagagcuugagauaacccaucuuuaauuuauggcugaagauuauaaaggaaacccuuugauacccaaaaacgucucaccuagaacucucuggccagugagcaaccucaacuaggaaagcaaauauauuuuguacuccugagacccagcccccaacaugaagauuucuguuaaguugcugcuggauggaggaccugcucuucuaauagccaccuaggugagaaaugauucagcacuuugaccacagccugcugaaugguucugaguuacaggcacccggguaagcugcgccccacagcccugacccacgaaaacuggguuaaguauuucaagauagcuuuuaaagugcugcugcuccauaguuuaucuuaucuuugugcuauggcuugggcaauuacaaccaccaaauucauuugaguuaucauuggcauguguggcuucaguucuccacauuaccuaagaggccagguagccagaagacucaaccugggcagccuuccuacauaaaccucuuggcuccagauacaugaguucugcauugugucuggagaaagagguggugguuacagucaggaaaaacuggaaacuacguggccaaguguauacaaucugaaaacaagaugcaaucagucuccuguguccuucucuucccugucacaucacacaccacagacucaggagacaccauuacugaaguagaacagguucuugugccuaucgacaaaggaaagcuugauuaauugaacuauacauucuuucuaaaaaagcacauuuguuuuuaggucaggaggucagagcacuguucuguuaaauguuuauaucugguauuaccuaaaauauguguugaggccgauggcauaagguagaggcagucaauggcagagacugccgucgcuuucaacacauggauuucauuuugcagucugaguugguucagcaccggcucuacauuguaacagggagaagauggaaacacuccuucucugucagaauggacugcuugcuccauucuucuacucccaccuggccauaucuagcuacaaaggagguggagaacuugcgugaccaugcgcccaccuaaaaagucuuauuuaggaagagaagagcuaagaguggcgacgcccccucgaaguuucaacugcacgugaggcgcaggcuagaggauggcuuguugagaccagccugaguaacagagaaggcccgggcccaagaaaaagcaagacacggauaguuccuugggaaaaaggccacaguucucaggcuugccaccucagacaugccuaaucaauagcucagaagugcugacuuagaagcacaaagaaaaggguuaagaacuggaaguccuccuacuuucucuuaauuuuagauagcuuaguaauuauuuucuugaggaggcuagaaggcucggagguuaaaagcacuugcugcucuugcagagaaccuuaauuugauucucagcccugacaucagaugggucauaacugccuguaaguccaguccuagggaacccaacacccucauuuggccucuuugggcaccugcacacaugugauauacacacauaaacauggauaaaaaugaaaaaucuuaaaagaauuaugaaacuguggagaggagggggugggggaggcgguucucuguguagcccuagcuguccuggaacucacaguguacaccaggcuggccuccuguauauggcugugguaaguggccaguacuauugugacaugccuggaguaaagauaggacuuuuaaccugucauagaguugaaaguagaaacugggaaauuuggauuuuuggauucuaucucuuaacaaauaagcauuuuuuuugcuacagccucagcuuacaauguagcccaagcuggcccuuggauguguggcagucguaccucuaccuccugagcacugagauuauaggucuguacuuuuaaauucucuaaaacuuuguaaauuugaaaucaguugcucauuuugucuguguguuuguuguuugaaacaguguccugcuguguggccuagucuggccaagagcccagcacccugaucccaguguccugggcucaagugaccuuaccaccuucagucuccugaguggcaggaccacaugcaggcagcaaugucuccagcuuggaaauaaguucguuugaucuuuccagcccugcccuuguuuuaagauauuuggggaaaucaauuaauccuuuuuacauuucauuaaguacucuuggguacccacuguguagaguauaucaaaaucugacccaccccagcuagcauacauaugugaaugguuacuguaaaggaggggcuaccaacugcccaucacauucccaggucuuucacaucugcaucuauccacucuggcagccugaacugcugcuguugugccccucugccugugccucacacucugcuagccucccucugcugcuuuaggaaucagugucaccgaauuuuaucuugucccuucuguuugucuaaccuccagcagggaaguaggaagacagauuugcagaagucaguaaggaaaacgacugucaaaaaagcacaguuccauuucuagauccaagaaaaacuuccuguuuuguuaagggcccuucuuaggagcggaaacuagcgcucuccaaagaaaaccacaauaaauaauuucaccauguguccuguguguuuagcaagacuuaaaucccaagagaaaugugaauaagaagagaaaccauaggacacaaaccgccagcuuccuucccucucugccacuccccgaaggaacagugacaacuccggaagcagaaagguuuuaggagagccuagcaggggaacccggcacagccucagcagcucacucaagcaugucguggcucagauugcucagacuuucucuacauggaguuucccucuucccagaaaguucuagaaaagcugccauuugaccuacacuuccauucaguaacaacaguuacuggcuuaccacaaguuuguaucuugcuuuugcuacaugaucuauccauccugacuggaggcagugugaggucagugacaaaugccagaacccugcuuauagacccugcacuuuguagcgcuaucuguggagcuuuccgccuccaccauccuggccauaggaggagaaaauucauacacguuaccugugucuuggccugcaauugguaagagugucuuaguggcuggaaugaacagaugaaggggaugggacaggcaaggaaccacaggaauauggaaugggggaaauagcagugccuccucugcaacauuuuaaaacuacaggcuggggcuggcgagauggcucagcagguaagagcacugacugcucuuccagagguccugaguucaaaucccagcaaccacaugguggcucacaaccaccuguaaugagaucucuucuggugugucugaagacagcuacaguguacuuacauauaauaaucuuuaaaaaacaaacaaacaaacaaacuacaggcuuacaacauguuacagcaacagggguccccaucagaucaucucuguuuuaccuaagauucucaacuauuuucuaagcauccuaacagacaagccucaggugacuaucagucugccccacuuaaggguagaaucuauggaaagguuuuauccaugagcaauucuacuccuuuucugaguuuaauuaguuaauuaauuugaguuuaaaauaaaaaauuugcugcuccagaggaacuaacaguucaauacaagucugaccuagccucuugucucuggaaauacacugaguaguaacuggguuuuuguugguuuguuuuuguuuauucuuuuugagcccagaggucagguaugaugguacaugccuguaaucucugcacucagguugcugaaacaagagcucacugcuguaugaggccagccuuggcuacagagaacgaucaucucaaacaaaaccaaaucuuaaaucuacauuaaguguuaacaugaugacaguauaaaucuaaagaguugaagucagugagaagguccacuaggcacuugcaacguuugccugcuuggucaguuccuucccagaacccaugucaauuuggaagagaagugagugcauggggugguccucugaucucuacacacacacacacacacacacacacacacacacacacacacacacacacacacauuucccucaugcaauaaagauagaugaauggauggauggacugauggacagguauguuuuaaacuggagacgguuacgcgcaaaaggcggcacuaauuagacucagggauuaaaggauaaagaauaaauggaugugaggucaggagagagguguuggggauugaguggagguggaggggguagauaggaucaaaacacauuguacacauaggaaauucucagaacaaacaaaagagauuguuuuaaacugaaggcuuguucacaaaaauuguucaggauagaugauugaagccuccgcucacaguugacucacgccugacuccuggugaggguucccaugccagggggggaagcucugaguucaucaccaucaucuguuacauaaacacauaguucauaugggagugacagugcucccaaguccuccagccgacagucuuauccaggucuuaaccucacuuuggagacacuuugucaucccccagaaaggcaggagaguaaaggaaaugcgggcaaguucaaagcaggcuugcuucauagggcgggucucugcucuuuuguuugauuuggccaguuuuggagcuguuuugggacacaugagguucucuagccaagaagccuuuuccagacccgauuuccccuuggaaugacacaguauccuccuuuaaauguggcaauuguaaauuccugccuggggaguagccauugauuugaauugaagcuauuugaauaaaccuguacuagguuaacaaggcuguauuguccugcagccucuauugaggucuacuaucaucauuucugaugacauuauauccccucacccagcauuugacugcagaggaacaccucucugcauucuaguucugccucuuuuacuugcguguaauagaaaccucuucucgccguuuuaucaacacugagcaugaaaaucccagucucagggcuuuuuguuuuguuuuacucuuuguuuuccaucucugauauaauucuaugccuuagagguuucucagauuugagguacccagaauaguacuucguaaguguuauguacauacagaagggcacucaguacacucacagaagguagaaucacuucuuuauuaccugugcacauucuaguuacuaaauggaucacaggagcccaggauuaaaacagcaauaaaucugcgucaugauacacucucauaauagcuuugggaauuuuuuaaauguguuuuuaugggauugaagagauggcucagcaucuaagagcucaugccuacuuuuguagagaacccacguuugauugcuagcagccacauccauuggcucacaaccacaucuaauuucaguuuaagggaucuguuagcucaggccccugguaucuguagacauacacuuguauauacauauacauauauucacacauaaguaaauuaaaaucuuuguaaacaucuuaauguguguggguauuuuaucugcauacaucugugcauguccaugaagaccaguaguaggucauuuccccuggaacuggaguuacagaggguuguaaguuuuaauaugggugcuagaaaugaaguccugguccucuggaagagcugccaauacacuuaacugcugagccaucucuccagacccuagaguauuuuuuaaauuaauaacugaagacaaucuacauuaauuucaauuaccccaccuuuuaaguuuuugcuuuuguguugaaagacaagaccucagcuuguaacccuggcuaguuugaaacuugcuauauagaccaggcugaccucaaacaucugccugcuuuugccucuugauauaaagagaguugguauaaaacuguuggacuugacccccuuucucuuuuuuucuuuuucuuucuuuaucucaaacuccagcccccuuucuauuuucaucccuucagggccccagccuggcacugucuaccuguaggguaaaucuuuccccuggaugaacuuaaucuagauaaucaucccaagaaugcccagagguuucucuucagugauucuagaucuuguaaauuuggcaauauuaacauaaucccauccuuugucaaaacccaaacacaccacuuuuaauccaguaagcucauggcuaccucauaauucaaaaugaauucaguccaacuucaaacauagccauagucuuuagaaaucucaacucuauuucaaaguccaaaaaucucaggcccgugagauggcucagugggaaagcacuuuguugugcaaggcugaguuccaucccuuugaagccacggcagaaagaacugccuccuccaaguuguucucugacuuccacguagacaccauggcauguaugcaucaacacccaaacacacacacaaaacguguuccaguccaaagucucaaggcacucucuuaacuguaaguaccuacaaaaucacaaguuauguucuuacaauacacaauggcacagaacaaacuuuccuauuccagaagaacugaguuauugcagugaaugcugggaccaaaguaagaugaaaagccugcaggguaaacacgaaguccugcagcaacaugucuagugucuggaauuugugaucuggguaccaacaaggcuuuagaagccccaccccucccagcauacucagccucuuucuugagccggcuguacauagccaugcggcuguccuuggcaaauacccuaugguuccagcauuuccaauaucuuggggucuucacugaaauuugggcuucgccuuuaugauucccuaugauggccaugcacggccuccuugcagggauuccaguguuaccgcacguugcaugaccucagcaguccucuggaaccacagugcaaggcgcuacgauccccucaacacugcaucuuuuguagccgcaaaaucauuuagguaacacuguagucagcuucagguggaaucugacccuuuuggauggcacuuuuuuccaguagcuucugugcugucccuggggaaauauuucccuagguagcugcuuucugagcagggcaaccacaauuucaguucagccucucucuuuucaagugaauuugcauuuucaaauuuuaauggguagggccuuuccuucuccccacgcccuccauccucggugcagaguaggaagcuccucuuuuaccagucacagccucuuuuucuucaacuuuaaauguacuugagcccuuuuccaggaauacacggcguacuuuaucuuccugcccacuuguugcuguuucuuacuguaguuaugaaugagaggggugaguggucaccauaucacagcccgcaugcuucucaccugccuugaauuuccuccaccaaacaaaaugaucuguuacuccucuccugggccucaccugagcuuuagagacgcagccagaaugcagcuggguucccaugcuaccacaaugaugucuagcccaguucccaauggaguccuuguuucccacucugagacuucagaaaccaggccuccacuuucuacuuuuaucuugauccucaggccuacugaguucugcuuccagcagucaggccuuuucuaguccauaguuucaaacucuucuauauuccuucugcaaaccaguuacaaaggccaguuaugguaaggcuuaucacagcaauaaucccauuucucuguaccaaguuucuuuguuugguuugguuugguuuuucgagacaggguuucucuguguagacuuggcuguccuggaacucacucuguagaccaggcuggccuugaacucagagauccaccugccucugccucccaagugcugggauucaaggcgugugccaccacugcuugacgguaccauuuuuuuguacuagauauuugucuuguugcugugacaaaauacugaacgaaagccacuuaaagaaagggguuuauuuuggcguaaaguccaggaaguccagucugucugcagggcagcggaagcggcagcggcuacucaaaucucguccacguuugggaagcagcgaguguggauacuugucuguucgucguuguucagcagcucgcuguauacccauccccagcuggccuagaacucacagagaucuguccaccucuguagugcuggcaucaaaggcacgugcuaccaugcccagcugaauguuucugcuuauugaucugaugugacagucucucaugcaacccagccaggcccuaaauuugcauugcagucaaaggugucuccacccaaccuccuaaguguuggaauuacaggcacguacagcuaucccuggauuuacucucuacuauuuuauacacacacacauacaaguguguguauguauguauguauauauauauauauauauauauauauauauauauauauacauauauguauauauauuagguauaguagacuuuuucuauauagccccaguuauucagaagacugaagcaagaggacauuaaguuagaaagcagccugcacuacauagcaaagucaagaagaguuuacacugugcagggaaacccaaaaucccaaggacugaauauuugccuagcauuggcaagagcuuggguuccaaaucuggcacuagcaaaaaaaaaaaaaaaaaaaaaaaaaaaaaagacaaaaacaaugaaaagauacaguuggaaagcauuucuuucucauuuauuauugcuuuaaucaucugcaaguagaacuuaauaucaaagaauagaccuaccaauauuuacuuccuagcuagcauuauuucuaacagaacccagcugcaaucgguuuguagagauaauuucugaagguagaacaguaaaaauaccaaugucaagauguuuaacaaggcuuuaagucgcugauauaguagagcuagcauagaaucuuuucaagcugguuuugggccaguuaaccgaauaaagaucaugaagauagaaaagcaacccgaagacaaaauaagcauugagaacaucuguauuccuuugguaauggaaugguaaugaaguuaagucuguguaucgcuggacaaaaacauaaauuccacuuucuuauuuauuauagagaucuaggcuuacauugcuguuaagccuccaacagcggcagccagauggugcaguguuuuugaaacaggcucugauaaauccacaaagagguaaucuuacuccccuguccccacacugaccaucuuuucagaucuugcaucuaaaaucaaacuuuugugcaggaggaaguugggagauauuucggauguagucauauuaucaggaguacaguggauuauucugaaguuuuuagacaaugaacacuuaacagaagcaaaucugucauucgcacccuuucauauuagagaaauaaaaugacugguuauugcuguuguuaacuauuggaguaaaagaucaauagaauggcuuccuuuagugucagaucccaaagaaacccgggacaagucucgcucggucccuguugcuccucccagcgcuugucaccccgcccccuagcccaaaccuguccagcccaggggcgggacuuugcuucccuucccaauuucucuugccuuuauaaaccugccaguucaggcgugcgcuccuuagucuuggcuucucucuuggucugcuugcccucucucaucucuuucucucucgaucugccccuuucccuccucgcaaugccuaguucaguuagauccuuccagaugccucuggcugaggucuucucccucgugucuacaacagucuucuccucaccuguacugugaacagccauguccucauuucuauucauuuaggaaacucguuucaaaguugaguuguugcuaaauucuuacagcaugcccuuuaagucagguggcuucaauaggcacuugacucauagauaauauaaaccaaaagauccaaaaaggucuuaaaaaggcacagaucaagacugugaagcuauauauauauauauauauauauauauaccagauacuuuaagcgauagccuaaagagauuuucaaacaaacaaacaaacaaaccucagaagcaauuagaaaaaucucucugaaguacagaaaaauugccaucuauuugagcuuuuuuuuuccucuauaggaguaguucaugccucuaaaauaaguagaaaaagaaaaauggcaggaaauuugaaauucaaacuuccaggcugcuaccaauacaguuucuaauaggcuuucagaguugcuucuaaauuaaaucaaaacaaaacaaaaacccauugaguccagaguuucucauauuugguaaacuauuugggaaauuucacaaacucugcacgccaaggggcuuuguuuauucucagacuucaaccuugccauuuuguuuagcuucagcaauuguuauaaaacuaaggagacagcugguauaaaccuaggagcucucuuuuccaagaauagacuacacauacaucccaggcagauaaggaaagucuuuuucuucuaaauccaggcccuuguuacuguugagaaauguaaccccuccccccccccacccccccacccccccccaccccccacccccaccccccccaccccccacccccaccccguguuccuguguacugcagacugcaguguccugacugcaucuccagaacaccagaugaucauacuguuaggagcugugcucugacagaggacagcucacacugaggcucacaaugagucacugaaggccacggaugcuccagcaagaacuuaggcucagccccaucaagcuuguaauuagcucccaguuuacaggagagcuuugagaaccugccaggucucccuugucacagcugcuuuucugcccuuuuagcugaccuuccaugcugugaggaccuacuucagaccaucuccugccucaguuugucuccucaggacuagagugaaguucuccuguacugcuuuuuuuacaggcuugucuuccuauucaucugucuuccagcagcccccugucugggacucuuuggaauaagucaguugccccaggacuucuuuaaagugucaguguaacacccagacuaccacaacuacuccugcugcuuaguuuggucucugugaggauccuauaauuguccaaaccagauauuuugccaagccagucuguccugcugggugagucuccuugcagugaucuaucaccugauucgggauccacccucuucccagggccggcgcugugaaaauguugaugauggcaguaauuaaugcuaauuaagagcuuugucaagaacuguuuuggguacuugauguacuuaaauuccuuuaauuacgacuacaaugcaaagugaaacucaggugaauugcucaagcucacccacacagaagcacggccgggacuuguuccuaaccuccaggccaagggcucucccugcucauguugcuucugccauguuaccauaugcugcacaguugaggggugcuucccucaaggcgcgacaaaucuuagccaugccgcuucccagcaggccuuggaagagcuuuauauacauacucuccauuagaaaagcauuugugaucucugccucauacaguuggauuggcuucacuauugucuuagguacuucccucuuguuguaacagcacugaacaaaagcagcuuggaggauggguuaauuuugcuuauuacacuucuaggucacuucuauccuugagggaaguuagggcagggacucgagacagggaaaccuggggacacuggcucaugcucacccugcuuuuguacacaacccaggccuaucagccuagggacggugccacccacagugggcaaggcccucucacauucaucaucaaccaaggcaaucucucacagucauggccacaggccaaucugauugaggcaguucugaaauugagguucccucuuuccaggccacuugagguugcaucaaguaaccaaugagaacuaaccaggacaacuaccaacagaaaugcccuuuugccaacugacaaauggugcuauuuaguguagucguuuugucaaacuucucaggugaguacaagcuucccuagcuucucagaagccccaaauuagaagacccggaaucaaagccuucuucuauuccagcacugagaacuaaaacuagagaagaaauucauuuuguuuuacaaagaauagcaaaacuaccuuauuaauaauuuguucaaucgcuaucacgaaauaguugauaaaagcaacauaaggaaggguuuauuugaaguacuugccuggguaacacaggagagcuggaccugguggcagaaguuugggugagcaggccccaagggugugagcaugggagggcugguucuggcacuuccuuaucauaagguggcaugggagagggggagaugcccucuccacucaccuugccaccugcagcagguaggagagcuggccucuguggcaaagguucuagugagcuagccccaaggacacaagugcuggagagcuggcccagucccucacuggcuguagcacucaggagagcauggacccacaccucaccugggcagaacaguagagauggccaugguggcaugggugugggugagauagccccaagggcaugagagugggagagcuggcccugacccuugcuggcuaugguauuggaugaguuaaccaggcaagugccagagagcuggcccuggugguaugggugugggagagcgaugggcugaucaauucagcuaccgcccuggcccagauccaggccucugagucgguccaccucaguaucuaccucaucuaugaacugcugagcaugugaaggggccgguccugcagauccaaagcugcaggaacuccaugacacgggacaacaggauauccaagaagaguccugaugaggaucuguauuaaugguauaacaguagccagaggccuuaaagcacaccaaugaauaauugcaaugaaauugaauuugcagguaaagaaguguggacaaaggguauacuguggaacguacugugacacacugugauacacuacagcuucguuuauuuuuauuuuuuauuuucuuugggguggagguugcaaggguggagaucaggagacagggcaaugaauggaauugggguaucugauguaaaauucacaaagagucaauaaaaaguuaaaaaaaauuaaaaggguuauuucagcccaugguuccaagauacagcucaucacugugggguggggcuugucuguaggaccuuugaagcagcugcucacaucgcauccgaagucagaagcagcagaagaugcaguuugggacuccggcccaugggauuguguuauccacguuuaaagugacuccucucuucucaacgcaaucuagaugaucccucacagucuugcccagaggcuaaccuaguaucuaaguuucaagcuugagaccaguggugagguggcuauauaacaucgaaguggaccuggcuccagguucuccuggcaguucucaguuucuaccugcuaaagguacagcaagaauacccugccccucuaccccucaguaaugguagcaaaagccaggagccuugcaacugagaaguugcaagguaaaauguuauuuacagccagaucaaauuuauaaaaucacuauaauaaaaagcaguuuuggagauccagauaugauaucuuuuuuuuaaaaaguuuuuuuaaaaaaaucuuuuuucuuuucuuuuucuuuuuuuuuucuuuugguuuuuugagacaggguuucucuguguaguccuggcuguccuggaacucacucuguagugcugggauuaaaggcaugcgccaccacugcccagcucuuuuccuuuuauuauauucaauacaauauauauuuuuaaagauuuauuaauuuaccauauguaaguacacuguagcugucuucagacacaccagaagagggcgucaaaucucauuauggaugguugugagccaccaugugguugcugagauuugaacucaggaccuuuggaagaguagucaaugcucuuacccgcugagccaucucgccagccccacaauauauauuuuuauaccaaucauaaaaaugauagacauguuauuaaaugaacacaaauagauaaagucuuuuuuuuguuuguuuuguuuuuaguagaguuuaaaaucuugacucuuacugugguacaaauccagaauaagaacaauuuuuagacauuggaguucauuguaauaaggcuguacuucaaugucccucacaucaccaaaggauuuuaccuccauaguagcuaagcuaagaguugacaguucugcugugccaaggaaugaauuguaggcacgauuuuuggauacagauuuccugcuauggucaaagcuguuuggcuugagugauugucaccauucucagcccacaggaaacagguuagauucauuuaagaaaugguguguguauuaagauggucuaaccaugaagucauucgucaacuguuucagugaacaacgguucugcuuggaggguggcauagacauuaggugagggcaagauucugguucauuggcugugaugauuuugaaaagcacucaucucagaaaaaguaacuuauaaguuccucuucuucaaaauugauaaaauaauuauaaauaucaagcaaaacucuuuucucacucuuugcuguucucuuacaagccaccucccaaauuaauugucuacauuucuuuuggcugcauaaauaauuuugaaauauguaagcucuucugaaccauaguauaguguaaaaacaucaaauaaacaauucuacuaauagagaggcugagauaggagaaguaugauuucaagaccauuauguggcgcacagcaagacacugucauguacaaaccagauauaauauuuuuuaagaaaaagauuuauuuauuuauuauauuuacaguguucugccuacauguaugcugguauaccagaagaggacaucagaucucauuacagaugguugugagccaccaugugguugcugggaauugaacucaggaccucugagccaucucuccagccccccagauauaauauuuuaugcuuguaaucccagcauucaguaaguaaugcaggagggucaagaauuugaaggccagacuugaagaaauggcuuaacaguuaaaagcacuuccagaagaccaggauuagauucucaaugcccacauagugacucacaacccucuguaacuccaauuccaggaaaacuagugcucucuucugaccuccucaggcaccaggcacacauguaguauacagauauacauguaggcaaaacacccacacacgugggauuuuuaagaauuaaauaauaauaacuuguaaagaguuauuuauuuuauguauaugacuacacuguugcugucuucagacacaccagaagagggcaucagaucccauuacagauggcugugagccaccaugugguugcugggaauuaaacucaggaccucuggaagaucagucagggcucuuaaccacugagccaucucuccagcccccaauaauaauagcuuuuaagcuagcuucagguacauaguaagguauaauuuuuaaaaagcaccaaaacccaaaccaaaacaaaaaaagaccuguuagcacccuuuacaggaacacuuuuaacacuuugcugcaugcucugggaaagcauugcugugaacuauaaucuguucccaaucugcgccuagcaagagguaagaaaacaaggauauccaaggcgacccagauggagacguacagaacugggauauggaugagccaucuacuucuaggcuccacaacccuaacuuguacuccaugcuaguucuccuaggacaugggcaugggaguucuugaagaugcucagaaagauagaaugaucugaaaccuucuugucucagaaaaagagcaaaugcccagcaagcccucaaguuaaaguuuagcuacccacuaaguguggcccuuggugacccucugugaacucugccaagucacuuugcccgcuuuggccucuaggucacucucagagugcuuuauaaucauuuccauugccgagguuaaaacguagaacacacaagguacacagaaacauggaaaaggaaccaaauaaaacuaacaauaaacuuuggcaauuuuugauuuucauugcauaacucucugcuugggaagaaaugcucaaaaaucaacaaaaggguaaaaaaacaggauguaaaacucacuuauuauuauguuuucagacguuuacugccaggcuuagacuaugucugccaaaaguaacauuucuuuccuacaaucuacacaauuuugcauuugcuggaaauuugguaggauuuuucaacaugaaaccauaguuuauuuuucuaaaauaagaaugucucggacaucaagagagagaaagaaccucuggguggaacuaaugguccuguagucccaggaagcuuagguucagagaugagcaucugauauggaggcucuuuguuggaccaugacugcuugagguaucugacugaagauuucuguucugugaacugggaucacaacguaguaccaggucauaaagccguaggaaggaccugggaugaagaacugaacaaggcugagcucaaauccuggagccaacagauucaguggugugauccuucugaccuucuacccugugaagugagacaugaguaccauuuuguggaagugucagagggccuagaaggaggugagcaugggugcucacuguugaucuauuucuaguacaagcaaugauuauaauuaauguacacugaucagcaaaggguccaaagcagaauagaaggauggacagaugugagugacagaugcuaagaagagacagagggaauccaagaaugagagagagcucaaauuugaaaaccauuauucuagguucauggcagccuggcgaaaacgucagaaguaaaagcaaaguucacuagcaaguauagaaacacuguucaggcugaggguugacacagagaggaggugauaguguagacagaagggcuggugaguagggcuagaccugacugccaaccacucccaaggaagcucuaacucuugccugugcuaaaacgcuaugcuuguugccucccagcaagaguaaacagaggacuuacacuuuguuacauuaggcuuucucuuuguugucugauaggcagaagaagguguugggucugaguucucacuauuucuuacagaggaucuuuccucaauacauccuguuuauuaguccuuggggaaggaaaugguguguguguagauuccuaauggugguauacuggggagaaaaaggagagugagucuuauaguugauuucaggugaaucuaaaaagaauaaagccgggugugguggugcacaccuuuaaucccagcacuugggaggcagaggcaggcggauuucugaguucgaggucagccuggucuacagagggaguuccaggacagccagggcuacacagagaaacccugucucgaaaaacaaaaagaaugaagucaagguuaccccugaacccagacaaagacaacaacuauuauaaccaucacuguauuggaaacaaucgaugcuuggcauucccacuucuuuuuaggguacauuuauguguggcagaggcugaaaauuuuagaaucacaucucccagcuuucuugcaguuauggcuaauacaagucacucaacugaaggugagucucagaagguagagguaagcagaagucauuagccaccuuucuuggcuuaauuggucaagcuuugugucuauuacuaaguaccagaacugucucauguucuugugccccuggcuccucuagccucuggugcaauuaccuccaugcagcccucucuccagguccccuccccugccguucucugguugccuuugaagaucuuguauaggaaaugaugauaaaguacagcauuagacugccuacccagcauccacaggugcuggcuucauccccagcaucccacagauuggacacaucugcuguucuaauacucuggagauagagacagaagagucagaugucaggcuauguaauguauuugagggcagccuggggcuacaugagauccugucucaaacaaacaaaaaaaucaugacaucaaacaaaacucaugccuaagaggagugagguagaagaggaguccugggcuggaaguuauugagggaauguugggcuuaaaagucuguucucacaaagucccagcugguaucuaucaucaggccaaacugcagaacuccccuuuccuuccauucaguuccuuccacuguaacuuuccacuccacugucugggaagauauuuuuucaaccuccaccaacaccucagccuggaaauccaaguuuagccaagcaaugccucuccagcucgucagccugccagcccccagcacaugucucaaacuuccugaguccaugugugugguugaauugagccauagugacauuagucauguuuauuguugacugaaaacaaggauacgugguauccaaggccugacuggucucugacuacauaguggcucuaacaagaauaugaaaaggaccaaaauagacacuguguacacagcaaaaguugauaggaugagagacuggacucuucuucaguggugaaaaagggcuugucuccuuuacuguggugaguauucuuuuguuuuguuuugacauuggguuuugauguuuagcuuagggcaaccucaaacucacugugcagcccaggcaaccuugaacucaugaucuucccaccucagucucccaagugcuaaguguauaagcauuuauuguccgacucagcccuuuaaaacaaccaagucagaccugggaaaagauaucaccucaggggcagcgcaucggguuggagugccugagguguaagcaagcacaaggauccaaguucuagcuacagaaccacgggaaaaacuaggcauggcccccgagaggcugaggcagggggauaccagggacugcuggcuaccagucugucugaaacagcauauuccagguuaagugacagauucuguuucaaaguaggaggaagccagugacagaggaagaccugauguccugcucuguccucugcauguggucacauacaagugagcaucgacacaaacacccucacauacccaugcaugagguagcucaauugagagaauuauguuugauuagcaugcucaaaccccagcacugaaaaaaaaaacaaacaaaagcaacaauaacaaacagcguuuguggcacaugccugaaauugcaacacacaugaaacaaguaguagcacaugcccauaacugcagaugcugcagaugcacacaggaggacccagaaugcaagagcauccuuggcuaaggaucuaauuggaggccagccuaggcuacuugauacaagacaaaaagucuuaugaagauacaauucacauuuccuacagacugcacauuuaaaauggacaguuacauuacuuuagucacagauguggagccaggaacauaaauaauuccagaauuuuugcugacuuuuugguuugguuugguuuguuuuuuucgagacaggguuuuugagggaaaugaauucuguaacuauuugcaguauucucucaaggggguuguauccauuaguuuucucauuaguuuaugaaaugccugcuaaagcggugaaaggaaggaaggguuuauguggcucaggguuugaaggaauaugggccaugccuuacuuggaguuucuacugcugugaugagacgccaugaccgcagcaacucuucccccccccuuucccuuucucccuuuugcuccggggccccacuugcuccagcccauagguuuauauuuguuucucauuauggaugguuaugagccacacuucuggaagagcagucagugcucuuaacgcugagccaucucaccagcucaucagcaacucuaauaaagaaaagcauuuagccgggcguggugacacaugccuuuaaucccagcacuugggaggcagagacaggcagauuucugaguuugaggccagccuggucuacaaagugaguuccaggacagccagggcuauacagagaaacccugucucaaauaaacaaacaaacaaacaaacaaaaaaagaaaaaccaaaaaacaaaagaaaagaacaagaaaaacauuuaauugggucuggcuuacaguuuagagauuuaggccauuuuugucaugguggaaaacauggugacaugcaggcagacaugguacuggggagguaccugagguucuacauccagauuggcaaacagcaggaagagccagugauacugggccuggcuuaacugagcaugugaaaccccaaagcccacccccaaugacacauuuucuccaaaaagaccacaccuacucuaaugaggccauaccuccuaauagugccacucccuaugggccucugggggccauuuacauucagacuaccacaguccauuauagugagaacgggagaacaugcagcugggaccuuacaucugggcagagaggaagaagugcuggagcauccuaccagcauccuccuuucccucuucucauuugguccagggauauagcuauuuauauccugugaacaggcaacagucuacugacacuaacuucuuggggauaaccaacagcuuucuaguuggacuuagggaccauaccaugggagggaaggcacaccugauacuguaaaccuagccaaaaauguggcuagagggaucuugaacccuaaaggagaaccuacugcugccaucuugguaaauuaauacagauccuacugccuucuaaauucucauccuuuaacuauagguaagagcugcucuugccccucaucaaagaagcuccuuuuugcaguagacagagcuauuacagagaacuacaacuggucaaaaugcaaagaauaagugaaaugcccagcccacauggaacacauacaacacuaucuccaaccaaggcucagggaacaucuaggagcccgcagcucagggugcucccacacugucgcucgcaggcgcccacagcucugcgugcucucacacugaugcucacagguguagcuccaggugcaggggcucugccaccucuucugaccguugaggacuccugcauguauaugguacgcaaaguaaauaaacaaauacugucauaaacacauguaguuugagaguuuaagaauccuuuggcaaguauaugcagucauucaaggauguccauuuguaacaaggcucucuagagacuuaauagcauagagauuacaggagguuggcucauuagggagaggaacugcucagcuacauaaauuuaaaccugaagggaaagaguaacugaacugugcaggaacaguggcagaagugagagaaaagagagaaaggcuucuaacggaggccuguucuaagacaugagagcugcucucagugaacagcucccgugauaccugagaccugugcagacagcucugggccagaagagcacccgcucucaucucuaaacauguauacaguuacuucagagcacgcccccaucccaaagaccagcuugucuucucagccccuacacucagccaaagagaaaugaugaaaucaaaucacugacuagcuauuuaauuaaucugguagacagcuauuaaguccuaguaaaagggaaaaacuagaauauggggauaaccauaacuacaugcccacccggggacacaauaugacauuuucaaucacuaauuguuggggaaaaugcgaaauaucaccuugccccaauaaaaauaacucauuaaaaagacaaaaguuguaaguauuggagaggauguagagaaaaaggagccugugcacccuccguuguaaaugaauacaauccuucuggaaauacuauggcaguuauggggaaaacuaagcuuauugugcacaaaugggauuuuagcacucagcaggugggggcaggagauucaugaguuugaggccagccugggcuauguagugaguucaggguauccugggcuauccugucucaaagaagccaaaagggggaaaaaaagaaaagaagauaaaauagaaguauaguuugacccagcacucccacuacggugggaggaagaagaaauaaaauugaaaggaaauaaaaucagucuguuaaagaaacauguauaucccagguucauugugcacuguugauaaaagccaaaaagacagagaagaaccuaaauguucaucaacuagugaaaagccaggcccccaaggacaagcaccuugugaucucacccaaggagucuggaaaagcugaugguguuucucagaggcgggaggggagugggccauggaacaccguuugaucacuagguacuagguuacaguuagacaggaccaggcauucugguggcuccugcugcuggcacaccacagauaacaauuuugcacugucucagaacacuagaagagaagaugggggugguuuuuacaauguagaaaaaaaauaauucagaagauagauguuuaaccugauugauuguuagagauguauugaaacauugcauggugucucuuaauauauucaguuuuuauacuuucauuccagcuaaaauauauuuaauaagacaaaaagcaagccucaauauaucucaggaucuuuaugaacacacaaagugacuugcuguugccuuuuucagcuuaacaguauuccacugugguugucuucuaccacugggcaauuguguugcuccuggucucuugcuauugcauaaagugugcucauagcuuucaagcacaaaagagaaaacugaauuaaaucuacucggauccuccacccauccauguuucuauaguucacucacuugcuggaacuuugcccucuucuacuuuaugguuauucuacuuugcauaaggaauauggcaagaagaacucagcuguucuauucagguaagacccaugggaucuguucggaggguggugggaaaccaacagccuauaguucucugucacuacuacucagcagucugcuuccucguucuuugccuuguuaaggguaauacaacauucuuccaucugccucauucaguccuaaggagcgagaccacauuggcuugagugccuugucccauggugguguggaaagccagcugccccacugacuucaacaaaucuuauaagaagacguaugugcuuugugccagacaccauacugugcgcuguaaacaaagcagugacuuaaacauagcgcacacuacugucuguucuucuggcuuucugacagugaugcugagacacugugaucugcuuauccacuucaguuaacacaugagcaucccuuggucucucucucucucucucucucucucucucucucucucucucucucucucucucucucucucucucucucucucucucucgugaaagcuucauuacauugccaucuuccuaaaguggacaucaugccaugucucuucauuucuugaaaaguaaugaagaggcccauagaguuuaguauuuucagauagggcuucgcucccaaaggcacgcuugcaauucccuccaaucuuccuuccuugacuccagcuaucuagaauguagagccaaaggaguuagucacucuuauucuaaggaagagcaacuguuuccuagguuuaugucaacuugauacaagcuagcguuaucagagaggagggagccucaguugagaaaaugccucccaaagauaugccuguagcaagccuguaugguauuuucuuaauuagcgauugaugggguagguacagcucaucguggauggugccgccccuguacuaguuaguggcccuggguucuauaagaaagcaggcugagcaagucauaaggagcaagccaguaagcagcaccuuuucauggccucugcaucagcuccugccuccagguuccugcccugcuugaguuccuguccugauuuucuucaaugaacagcaauguggaagugcaauaaauccuuuucucuccaaggguggugugauauuucauuacaguaauaguagccuuaacuaagacagaagucaacuuuuccuuuacacaccucgaagucaauuuugucuuuuuuuuuuccuuuuuuuacauuaauuuugcuuugaacucgcaagcuucuuuuguuaccguggucacuauucaauacauauuuaccagguuccagguaccaugccaagacuguauaaaaaauaucaugugauccucucuaauacaggguaaguacuauuauauauaucguaaggaggagggcaucuuagagaaguuuaguaacaugcccgggguugaacauccaacaagggcagauacaguccgagagaucacagcggugcaguaggaaagucucuggcaugauuaauaaaccacagcuagaauaauaaccagcuaagagcuuuuacuugguguuucuugugugccaagcaucauguugcuuuaugcauauuauuaggaucuguaaagauucccccucacuccugacaguuccuccauguggaagaacuucugcuccagcauuucugacuuauuccacuccgaauuagugcuuccccaggaagaagaaucaggcugggagaggagugauuucuuaauggugauuugaggagaggacugggagccuguaucucagacucccuucaucacauagcagccaaacucuucucccucccgugguuacagagugaauuccugggguugggggguggggagaggagaagaaagagaggaagggaggaagggagaaagcugaagcacacaaaaucccaagacugggaaacaaaaugagugacaaagaaauuauacaagcggcuucuagucccaaguguuccuucugcucugaggggaggaaguggggcucaucaaggugguagaggaagauuugguauccaugagaugguccagugaaaucugaggaagacaagugcauacacacaauuuaacaaggaggaaacggacagagugucucauaauaaacuuaaauuagaagaagagaaaccugagaaacaggacaagcuuguggaugaagauacaggagacucacaagcugguacuuaaccagugaaggagaugcugccgaagaccugcugagacccaacuaauaacaugaccaaaugaaaucauucuuugauaguauugcuuauggugauacuggagaaaggagcccgaguuaggcugaagaaagguuagaugcugaaauguucggaaccccaauuuguccagaugguggccauggagcuaccaaggcagagaaguguuggcuuucauauggcaggguacgugguaguggccgaggagggaccaucacugccccucaaguggauucagaggcaucauggagcagagagugcagauuuugacuauaggaaagauaauaaagucaccuccuagucuacagacaaguuccagucucuguacccuucucauucuguuuggagaugcuauaauaugagguagcuuauuucagcaguuagggugcugggugguagacagcuuugucagucagcuauacacacaccgguaaauaaacauuuuauauaguuguaaaauuucauucuauucuguugccaaagaaacauuaagaacuuuguauagcuuuuuaaaaagcaacuacguuucuuuuaaagagaauaacuuuuaaaguuuaaaagaaagguguguguguguccugccugucugaucuuggcaguucuuuccuguucaaguauacuaacuucgagucaaugaugacuaggcuuugacagcguccucuuggcuuccucugcgucaucgucaucgaagccauuugaaugcugacuuuucccccugggcuugcuaagcccagucccuaggggacacagccauuugaaacucccugcgguuugaaugggcuggcccagcuggcagagaucugcagcuguguugccuuugguugcguggcaacgcagcaccccacccaucuucuguucucagagcugaagaucaacacugcugaagcucugucugcucuugcugucucacaaggaccggaagaggaugaaacaccagucaguaccgggggaauugcaacggaaaaauauuuuuccauuucggucaagucgccaucgggaaaucauucagacucaauauugagacugauacagggcggugaguggcauuucuugagcaggcuuuucuguuugcagagaaaugcccgcccuuugcgaacaaucagcaccauucagccuggcaggguugacggagcuuggggcaggccgcugauagauuucaucugcuucugaaacuccgugguuucguacaggaacacugaaaaagagacuagaaacaggaaguggaaaaaaaaaacauuucuaccuaauggaaacuaccuuuuguucaucugcaccugcauuccuguuaaacauuuaaauuagcgcagguaucuacuuuucuagggacuauccccagaugguauguacccuagaggggcuuugccucugaucuggaaucuuccugucaccauaacaaaucucucauucucuuuucgcauuccucagaaaagaaacagcuugcccauugccaggaggaauuaagaucagagucagggcaaaguucuaaaccagucucccccucccccaccccucccccucccccacccccaccccucuccccuccccucuccccuccccucucccucccucccucgcuuuauuuauuuauuuauuuauuuauuuauuuauuuaucuaucuaucuauuuauuuauuuauuuauuuauuuauuuauuuauuuauuuauuuuuguggcaggggucucuguaacauagccuggaacucagccacacaacugaggauggcccugaacuugugugagccuccugacuuuccuuccuaagugcugggauuacagggaugcccuugugccaccaugcccacccagcucagaagcucucuuaguguaauuguugaguagcucccgaauaguaaggaacugagauguaguugccuuuggucaaggaggggucagagacaagaggaguaagaugaugacgguuggaagauguauguccgagugcaccacagggaagccaggcucagaacuccuuuucacucugguccuugccugcaucgacccugcuagacgcuagcagauacuuucucacuaaggugggggaggguggcugagacccuugauggcacugugcccagaacagaaaaugugguuguuggcaacuauaucaaagggcaaggcucugcucauuuagaaaccuuuccaccucugcuuaccagaccccauaaccuagcaugcccaaggcccacagaaacuuuggaacaauaggcuuugccccuccugucaguuauuuauucauuuauuuaauuuuucauuuugaagacaggauauggcugcucuuuuaacgugugugaguucaaaucccagcaccuacaugauggcuaacagguaucucgaacuccaguuugaggggauuugauacccucuucuggccuccucugcuaauggacaaauguggcuuagacauaagagccugcaaaaacacucauccacauaaaauaaaaauaaauaagucuuugaaaaaaauguuuuuauuuacuuauguguaugaguguuuugcuuacuugcaugacugagcaccacauguauuaccagaugcccaggaaggucagacgagggcauuagauucccugguacugagugccaccauguggaugcugagaauggagccuaugccucugcaagagcagccagcacucuuaagcacuaaguaccucugcagguccccaccuucaauuaaaaaaaaagauuuaccuuuauuuauauguguguuugugugugccugauacagaugcugagauccaaaguccaggucucugcugcagcaguacucugauacacugaacucugauacagcacuacucugauacacugaacucugauacagcaguacucggauacacugaacucugauacagcaguacucggauacacugaacucugauacagcacuacucugauacacugaacucugauacagcaguacucugauacacugaacucugauacagcaguacucggauacacugaacucugauacagcaguacucggauacacugaacucugauacagcaguacucggauacacugaacucugauacagcaguacucugauacaccgaacucugauacagcaguacucugauacacugaacucugauacagcaguacucugauacaccgaacucugauacagcaguacucggauacacugaacucugauacagcaguacucugauacaccgaacucugauacagcaguacucggauacacugaacucugauacagcaguacucugauacacugaacucugauacagcaguacucugauacacugaacucugauacagcaguacucggauacacugaacucugauacagcaguacucggauacacugaacucugauacagcaguacucggauacacugaacucugauacagcaguacucugauacacugaacucugauacagcaguacucugauacacugaacucugauacagcaguacucggauacacugaacucugauacagcaguacucggauacacugaacucugauacagcaguacucggauacacugaacucugauacagcaguacucggauacacugaacucugauacagcaguacucggauacacugaacucugauacagcaguacucggauacacugaacucugauacagcaguacucggauacacugaacucugauacagcaguacucugauacacugaacucugauacaguucuucaguacagagccaucucuagccucucugacuugguugucugugucugcaggaccucagguaaguagguggcuucaccuccgaggcucugagcauugucucuguagaaagcagcauuacuccgugggcuguaccaaggguuaggaugcugaauccauggcaggaccaccugaacaggccuggggggagcuacuguggcccgauaaucauucugagcugaaggcaucuaaaucccccaucagccugaaaacagagccccuugaagaacucaacuccucguugaacucccuucauuguuuuauuagacaaaggagaaagaggcaauuuuuuuuucauuuuuacagcaaauauuuuauuuuauuuuuuuccauuugccuaagaauuuuauuuuuuuuaauuggguauuuucuucauuuacauuucaaaugcuaucccaaaagucccccauacucccugccccccaaagaggcaauucuaaggauccugauggcuuccuuacuuuucuuuggagucuucucugucuucagaagggcuuucugaagcauugccacagccuucuucucuuuccaaacacagaacuaaaacuccuuuucuggaagaguuuucagagucucaggugggucaacuccuggccaaccccacauggcugaccagcuaccccaccuagcuguuggcucuuugcagccuggaugcaguuccuaucaugaccagggaaucucagaggacuuugcccuuggaaaccuguggccucugauuugaagugggccuuucuuuggaggcccuuguguuucucagggcuccagcauuaguuacuuccagaaaguaucacaagccaggaggguggugggcauauguagucccagcuaucagggagacuggaacaggagaguggcuugagguaaggaguuuagguugaugugaggacuauagcaagacccuguacaaaacauuggaaaugaauuaucucaugguucuggagucuaagagcuuaaaaauccaaauucuagcaggguugaagguaaauauguuucaggauucucuucuaguuuacuacuccuuggcauauagauggcuguggguguguucauaucuuucccacaaauguauaucuuugugucugaauguuccucuucuuaugugaucgguagucaaauugaauuggcauaugcucgauuaccuuuguaaaaagacuauuuucaaauguuaacuaggggguaguguuucaauaaauggacaacccauaacaacagccuaaacacagguaugcagccuucucucgcuccuaggagucugaguggcagauggacccuaagucccauagagugaugccucaagugcauaggggcuggagcuugcaggaaaauugggugauagccaacagggccagucgaaacagaauuuccuggggcugcaagcagaauagugaccacuaaaauacagacucaguccuuuaaaaacugguauucagcaggugagagaagacuuuaauuaggcauuagaacacacguggcauauauauauauauauauauauauauauauauauauauauauauauauauauauagagagagagagagagagagagagagagacuuaauugugcaagaguauuuuauuuuuuuuguguauacuucuuucuuuaauuuguauaauuuucaaacuuuuuuuaauuagauuguaccugccccccagccuugagcagcccaccuagaggguggagucuucugaccuugguggagucuauuguaugccgcaucugcagcuuccuguaagaagccacuacuugcugagcagcugaguuuuccuuccagaugagauucuggcaaaguaggggauaggcuccccacccccgcccuuuaaauucagaccuuagaauuaaaacauugagccuugauca

SEQ ID NO: 2362 - RNA, 1093 nt, Mus musculus
gcggccgcggguuccggagccgcgaccuggcccgucagccugcgagccgcccgggcucugcacucgaccccgcgccccgugccccgugccccgcguccccgauccucaucccgcgccccggaucggcgucccugauccguauccugagccccuuauccacaucccugauccgcaccccagugccuguaccgcacgggucggauagugggcacgggagggaggcggcggcgcggcugacaccugggcugcgggagccagugcgcugccgccucugccaccucccggucccgccugggccagccagcugaaaacccgagcugcuugucaagugguuuggcuccgggcguuguuccuggcgugaguucagcuccgggaccggugcguuucggcgcucggguuuuucauucgaaacuuucugcucgggucgagcguuacuugcgugcugcggcugcgcccaggucgcuugcugcagugggcugugggugugugcgcgggcgggucccgcguggugcuccggacuggauccaccgacuaugauauuucaaaugugccagcgccagccaccuccagccuggaccugcagcccaguugggcagcugcugucggagaagccuuuccccgagagcuggguuuuccuaggcgucagagcgccgccgcguguuucucuuuccucucucucuggguuugcuggaccagcuaucaacaucuuugcucacauuguuugcuucgcuguuccuuuugcgcaagaaauuuguguggugucuuugguacuauagagaaagacagaauucgccuuuaauaaaauuacgaaauauuugucuaucuuuauuuugcaaggggugggauaacccucugcucucuuagguggugguuauaauuuguauuggcccagcagggauuucccacacauuuggugacaucuaggaaaacuggcaggauugucuucauucaaaauugaauauaacuugacuguauguauaggauuuccuaagauguggauauauaaauaugaaagaaaucuauuuuuaggaggcaaaaagacuugaaaauuggaagguaaacauugaaaauuaaaaaagguuuuuauuuuuau

SEQ ID NO: 2363 - RNA, 35903 nt, Mus musculus
cuucacagaagaaugaaacaacuauuuauuugcagaaaaaccaagagccuuuuaucucuacauuggaacagcugagaaucacaaaguuaacaggcgccuccauucuuuauggacaacaucgugcccgcguuuaagauaaugggcaucucuggcagaggugugguauaaaggcucauguggccuauaaaccuauaaaaauaauucuacuuuguguauuuucauuucuucucauuuuugcaguacugaaaacauugggucuguguacugcacaugaaguuuugaaugaugauggacauuuaauacuggauaaauucaaagaugaaggguaagguuuuuaauaucuuaaugacaugguaugauuuugaaguaucaauaccauugcauuuagaguaccaccacccuuuugugugugugcauaugugugcucacuggaguguauacauguggcgcccagaacaaucaaucccaggggucaguuuucaucucccauuugucucuuuguuugcugcugcacuguguagcccaugcuaggcagccugugagcgucuaggagucuacaucucuaccuugaaucuagcuguggaaaaacugaauuccgcccagagcucgcagguuuucauggcucugggcaucagauucagcuucucaccucugcacagcaagcacuuuacugcugagccaucucuccacuccccacaccuacuacccuuuggguggaauguuucauucccuuuaacugccugccauugggaagagaaggcagggaaggcccacccaggcaaggggaggugugaugauggagguagagaaaguucaugcuuuccucacugggaaaccugucaguguggggcauguuagaacacaccucucaucccagcacucaggagguagaagcaggcagggcuauguagugacccugccuaaaaaaaaggaaaccuuaccaacccucacacaggugaggagaccccgucugcuagaauuacuaaaacucuaagcuccacaguaguuggaaagccgccauauagaacaucgaggcggcuggugaggaggugcaaguguuuccucugcaagccaggcagggcacgcagagccugccaggagccuggggacccacauaaaggugggagaacugcugacgacacagcaugcucugcuucuguccacgugcacgcuggcuggcgcgcucucucucucacauacacacacagucacaaugacacauugauacggcucuacauggauaacagagggcauacuuagaaucccaguacuugagguuuaacacaagccuaagcuauaaaacaagcugcucucucucucagaaaauagaacagaagguacuaucuuaaagaguuuucucaaaauuacagucugcaaaguaaauaucaacaaugaaggccacaugcaagccugacaauuuuugagauuuguuuuuuucucuagauaggguuucucuguguaguccuggcugucuuggaacuuacuccauagaccaggcucaaacucacagagauucaaccgucgcugccucucgcgugccgagugugccaccacugcucagcaagauuuguuuguuuauuuauugagacaggguuucucuguguagcuuuauugauugauugauugagacaggguuucucuguguagcucuggcuguccuggaacucacuuuguagaccaggcuggccucgaacccagaaauccaccugccucugccucccaagugcugggauuaaaggcaugcgccaccaccacccagcugauuuuauuuauuuuuauguguaugaguguuugucugugcaccacaugcaugcaaugccucagagacaagaagagugcauuggauccuagggggcugcaguuacagucuguugugaguacaugugugcgagguacuggacccagguccucugcaagaacagccuaccagcugagccaccucuccagcacccaaccugacaauuauagauugagauaggacagcauugaaaguacuaaauaaaugccaugucagaagaaaaaaaugagaauaaaacuuuacagguguagaaaucuuccagcuaagcucaguuuguguaaacguuuuauuuuagucucugaggauuuauuaaugaaggaaucugucugggcugaggauggugguggagcccuuucuugcauuagcaaggcuccaaguuugaucucuaguacugcauacacacacacacacacacacacacacacacacacacacacacacacacaaaggauuuuuaucucaucagcuacauaaucauuaccacagguaaaugacuaaggcaguaucuggccucuaaaauguuucagagacagccgggcgugguggcgcacgccuuuaaucccagcacucgggaggcagaggcagguggauuucugaguucgaggccagccuggucuacagagugaguuccaggacagccagggcuauacagagaaacccugucucggaagaaaaaaaaaaaaauguuucagagaaaaaaagauggccauuguuacaagaaguagaaccaggggcaggugagauggcucagcggguaagagcacugacugcucuuccaaaggucuugaguucaaaucccagcaaccacaugauggcucacaaccauccauaaugagaucugaugcccucuucuggagugucugaagacagcuacaguguacuuacauaugauaaauaaauaaaucuuaaaaaaaaaaaaaaaaaaaagggggcuggugagauggcucaguggguuagagcacccgacugcucuuccgaagguccagaguucaaaucccagcaaccacaugguggcucacaaccauccguaacgagaucugacucccucuucuggugugucugaagacagcuacaauguacuuacauauaauaaauaaauaaaucuuuaaaaaaaaaaaaaaaaaaaaaaaaaggaguagaaccaggaaggacuaacgguaaaguauuuggcacugagaacccacucccuaaaacucaugggaaaaucuaacaugacggugguacacuugaaauaccugucuaggggaggcagaaacagaaggaacccuggggcuugcccacaguccagaugggagccuguuuccagaucaaggugagcaucuugaggaacaggacccaagguugauuucugaucuaaacacacacacacaccccuuacacaccuguguguucacacuugcgugcgcacgcgcgcgcacacacacacacacaaagaaauacuuauauggaaggacauaagaauagaauauuaagaacaaccauagcuuaaccaccaucucauaaaacuauugugcuuuggucuuggguuuuuguuuuguuuuggucuuuuugugguggugaaacagauaagaucucacuauguugcccagaagagucuugaacccucagugauccuuauccuccugccucagccuucaguugcugggguuauaggugucuuccaccuauuauauaaacacugaauucccaaaauggauacaggaaccucaacuaugagcaugcacccaugaguuucuacagucuauugcgacauucagcuuuugacaacagcuccccuugauucggacauggcggucaggaagggcuacccucugcucucauucugucuucagaugucuccauuccuauuugcaauacacuuacucugcuucucacagcugaguuuucauucuuugcuuucuuaggaacgggaggauggaggauggucaccgauuuaguguuaucauaacucaagacaagaaacuauucugccaaguuuucuuuuguccagguucauuaauucagaacuuuaucagagaacuucaauccaacucuugacuuuguuuuuuuguuuguuuguuuguuuguguuuguuuuucgagacaggguuucucuguguggcccuggcuguccuggaacucacuuuguagaccaggcuggccucgaacucagaaauccgacugccucugccucccaagugcugggauuaaaggcaacucuugucuuucuuaaacaacacuuuccucaaagaugcauuauuuuccaguguuaggccaauuuguucucaaauuaagcagaauuucaacgucuuguugagccaguuuguaaaccccaacuucauuuaaggcugcuguggcaggaaugugcucggacacugacugcaggacaucuuucagcaguaaugcagaaccgauguucaaauucagaaugaugcaggcuucuuuuacacuguuuaggaaaacaagaaagaagagaugcucuuuuggaccaccuuuggagagucuacacagccauuuaacuaucuauggacuacuugguucuacaugugcugggacuacacaagcuguacaggguuaauagaucauucaggcuugucuugguacgucauuaggauuugucucaggacacuguuugaugcuaacagauuauuaaauguaacuacgaguucagcuagaauuaggacuuaggggaaaagcaaaggaauaaaaaugaaggcagcaaaaaggcaaaacagcaaggccaaccaagcuauaaagaggcuggggacgaugaugcgaguguaauccccacacucuggaagccaaagcaugaccucugugagcuccaggccagccuggucuacacuaugagcuccaggccagccaaggcugcauagcgagacugucucagaaaaccuaaaccaaacagaauaggaaggcugguguggcggccgaggauaaagcugcugcugccggcaggcucaguccuuggcaucugcguggcaggagagaacuguucccacaaguucucaccuggccuccaccccacacauggaaaccaaauuagaauauuuaaauaauaauaaaaguaaaagggggcugagacuucauguacgagguaggguacuugccuaacaugaaugaagcaugggaggggcuuuggcggguggggugagcaccuguaaacacgguacucagaagacagaggcaggaggagcaaaagcccagggucacccucugcuacugaguacuggguucaaggccaggcugggauacauggaaccuaucucaaaaacagaaaagcaaaucagaaacaaccauaguucccaggaagcauaaccuuuuauguuucaaaggaagguuuccaaauugcacagacucuuuacuuaauguaaauuuuaaaucaauaaauuuuuuacuagauuccuaguaacuguucucauguuuacagcuauaguaagagcuaaaauuaauauuaaauuuguaagaaaacugacuuucaucuggucuaggcuauuguuaggcacuaaaccuaauuuucugcauuuuccuaauuuccuuauuuucuacagguggcagaauuauaccuguaucauuuucuauuuacucucccaguuauaagcaaauagcauugaaccagaugcuauguagcaaguucaacauguaauuuauaguucugaucaacuuucuguugauguauauaccaugugcauuauuuugguuucccuauugugucuugaaaauauuaacagacauacaaugaauguuuuaagguuuuuuuuuuuuuuuugagacaggguuucucuguguagcucuggcuguucugaacucacuuuguagaccaggcuggccuccaacucagaaaucugccugccucugccucccgagugcugggauuaaaggcgugcgccaccacgccuggcuugcuuuaagguuuuaauuauguugggucccauuuuggcucugguuugagccuugaggacaaacccgagccuggcucgaguuuugagaccagucucagucacuucccuacugggaugaccuguuaagcccugccucugccccacuguugcugauguagagcuuugccauuggcccugucagucacuccauacccucugucacccuuccuuacccccuauauacaucaucuuaccccaccaaaaaucccucucccuguguucugaacuuauauaagcaagaggcugaugccauaaaguugaguuccugcuucgacaagacucuaggcucaguguguuucuuuugggccaucgauacuugccaucccacuuagcccccagagagaccccaacagggcaggaccgggaccuuucuccucucuccuggaccugcuggcaaggagccagcaauuuguugcuuuuuagauuuuuaaauuucauguguauguuuugcgugcaugcaugucuaugcacugugugugugccugaugccuguggagaccagaguguaagaugcccuggaacuggaguuaaggaugguugaguuaccauguaggugcugagaacaaaccccuguccuuugcaagagcaucaagugcucuugacuguugagcaucucuagcuccagauuuuaauugaugcuauuacaaaagauaucagcaaaacucugaaacuguuaaaaagaagccagcuccuccagcguuugcauacaccaccaauacuuauggcuggacauuggacuuacuguuuaaaauaguuuucuggucucuugcaauagugagaaaacaaaggaaagagguuccuugucauaucaaacugcagcugggcugcuccuccuucguugaagugguuagcaaggauuaucugcaacaaagagcgauccauguaauggcugccaucccaggcaaggguuaucugcagcaaagagcaguucaugcagcggccgcccucucggccccggccccgucucccgacucacuuccugguagauguacagguccagcuucucugccagcauuugccagaagauucugaauagcgagaaacacagcugcugcuccagcuggagcagacggucccguaaggucagcaggagcgggcaggcugagcuggacagcgacaucacugccuguuccgacugagacggcagggacaaccaucuggaaaaacaaguaaccuucacaagagugacccuuaccacucuguauccuuaaaguuucaaaacgcaauuuuaaaugugagggggaaauauaccguccuggggaaaaucuggaguuuaaaaaaucaugaugucuaauacucaaagcucuaccagaaauaaaugucucuauauuuauauuuuaacuuuuaauuaauauuuccugaaaaaugcccuaaaguuaauuacuuuaucuuuagaauuccaaagauaccaguuaaucuuaugcucugguuuuuuuuuuuuuuuuuuuuuagauuuauuuauuuauuauauguaaguacacuguagcugucuucagacgcaccagaagagggcaucagaucucauuuacgggugguugugagccaccaugugguugcugggauuugaacuucggaccuucggaagagcagucgggugcucuuacccacugagccaucucaccagcccccuaugcucugguuuuagcauacaaacuaacaguauuuccaaacugacuggaguacuguguggaggugccaugccaggguacagaggcaggagaguugugacaggcaagcaugacagggcauagaccacggggcacuuuccuuuguaaagugagugacacucggacaacugaaccucucuaagagguccacaccaucacucauuuauucuaaguaaauucuucaaaagaauagauucuagaacgaucccaucaaaaccagugcuuagagcuaccauacacgaaagccccaaguuccaucuccaagacuuggagugaggauuuuacagaagcuaaaacagggaguagaaaugguaucuugacucagacuagcguguguaaaggguaacugacacaggacacaccuuucuuucuuauacaacuuugcagagucuuucacuucucugaaaacauggucuacuuggcgggucaacauaucaagcuucaaacgcucuaagagguugaucaugucaucgaagaccgagcucuccauggaggccagcugucccagcugcaguuuacugaggacguuauucucugcaaagaccuccagugcugccuguugcagcugcagaaagaacugcaaacaaacaucuguuauuacauuuauuggcacaauucuggacauggcaaaauagaacgucuauaucacacaauuuccuuauuuagugugugcagcucagggccagugggauggcuaaauggguaguuacuugcugcuaagccugaagaccugaguucaaucuccaggauccacacagugugagcaaacaacccuauccucuacaugugugccauggcacaugcauaggcacauacucaagugcaugugcacaccacacacacacacacacacacacacacacacacacacacacacacacacacacacacacacacaccacacugcuuggcauggugaaagauaucugcauucccacacucaggagcugacacuggaagauuaccaugaguucaaagccaguacgggcuacaggagacccugacucaaaguaaacauaaaagcuuucaucucccucaaaaucaaacaugcagcucaggaccacugugauggcucagugcacagaagcacugucacuaagggccagugugauggcucagugcacagaagcgcugucacuaagggccagugugacggcucagugcacagaagcacuguaagggccacugugacggcucagugcacagaagcacugucacuaaaggccagugugauggcucagugcacagaagcacugucacuaagggccagugugauggcucagugcacagaagcgcugucacuaagccugacgcccugaagcuuuaguccugaaccccacaugguggaaagacagagccaagcucugcaaguuguccucugaucucaacaugugugccgugacacacacauacgcaugcacaguauaaaucauuuuuacaacuaaguggcuguaguaacucagagcugugcauccaccauuucucuagagcacugccauuacuuccucccuacaaaauccucauucaugucuaucuccauuuugugcccacuccuccaacuccaggcagucacuaaucuacuguuuauggauucaaugaucauggacgucucaagaaaauggaaccauaugaaguucuauucuucaugaccagcuccucucuuagugccauagcauguucuaaguauguacuucaugcuuuuauugccccccaguacaucacaggaccauacauuuuauacauucgcuagcugauacacguuuggacuguuuccauuuuguaucuauugugcauaauguugcuuagacuaauaugugcauuuuucuguaaaaaguguguuccuuugucuuugucuguccugaggaauggaacuguuggacuuguaacuccacccaccgucuuaagagcugccaggcugccucgcccagaagcugcagcaguuaagucaccaccagccauagccagaggucugaagcucugccugcacagagcagguuuguugcuucagucuggguuggguuuugaugugugaggguuuuguuuugguuggagacugaaucuugcuguguaguugaggcugacaaaugaguaguucaguguagcuuuguacucauggccagccuacaucagccucccaagugcuuggugugcacucuuuucugugguacuauguagucucggcuggccuggggcucugcagauagagcuggucuugaagguguggcaccccuuuugccugugccaccacugcucagaagccaggggugugccuccccugccaguuucuuuuucucacugcaguauuuuuuauuuuugauacuguauuuuucugcuagugagcauguuccuuuaaguauucaguuuuucuaaacacagacugaaggcugucagaaaccuggaguucugacagucagagaacuaaaaugucauuuuuguaguagucagcccagaguuaccgauggccacauguccaggaagugccugagaaugcaaccagagaugaccuguggagugggcaugcccagucuauucauuacacacacccugccugcacuuaucaccgacaguaaaacuggaguucugucacagacaacugaaaagaaaauucugagagguuggacaauuugggaguggcauggcccaacaacaaaugguuaucaacagccaaucagaaacaaaggaagguaagcugccguucucuucucugcaucuggacuugugugggaacagaccuuugaugaagcacuguaaggguggcuggaggacuugcugugaagacaaaucagcaccaucaaggccagaacucaguuaguacagucacagucacagccacagucacagccacagucacacaggcacagucacacagucacagccacacagucacaaucacagccagucacauaguuacagccacacagucacagucacagccacagccacagucacacagucauagccacacagucacagccacagccacagucacagucacacagucacagccacagccauagucacacagucacagccacagucacauagucacagucacagccacagucacagcuacagccacacagccacagucacacagucacagccagucacacagucacagccacauagucacagccacagccacacagucacagccagucacacagucacagugucacagccacacagccauagucacacagacagccacacagucacacagucacagccacacagccauagucacacagucacagccacagucacacagccacagccacacagccacagucucagcuacagucacagccagagacacagcuacagucacaguuacagccagagacacagacagaaacacagccacagucacagccacauggacacagacacagucacagccacacagucacagccacagucacacagccacagucacacagucacaguuucagccaccaucacagccacaaucacacagucacaguuauagccagagacacagacacagucagagaaacagcuacagucacagccacauagacacagacacagucacagccacacagucacagucuuagccacagccacacagccacagccacacagccacagccacagucacacagucucagccaccaucacagccacaaucacacagucacaguuacagccagagacacagacacagucagagacacagacacaguuacagccacacagacacagucacagucacacagucacagccagagacacagccaaagucacagccagagccacaaagucacagccacagucacagccagagacacaaccagauacagacacuaucagucacaaucauagccacagucacacagucacagccauaaccagucacagucacacagucacagccacacagucauagccacagucacagccgcacagucacagacauagccacagucacagccagucagucacagccacacagucacagccaccaucauagccacacaaucauagucacagccauagugacagucacauccagagacacagucacagucacagcuauagucacagccacagucacacagucauagcaacagccacacagucacauccacauccauauccacagucacacagucacaguuacacagucaaagucacagccagucacaguuagagccacagccacacagucacagccagucacagagacacagucuaacauguaauuuuuuggcuugcagcaaagucaacauuugaaaggcuaaaggagauaaagguacuaauaaauuauuuccuauaaaagcacauuaacucacaacauugucagcccagucugccagcacugcugagauauaguucacggcauugagaaucgcacaguaccgaaagcccagggccgcucucgucuccuccuucaucaccugcguuaaccggauccugaaaucaucuaccagguccuucuguagcuccaggaacugcaguuuccgggaggcuguggggagauuuuuauaccugucugcggagagagugaacaauacaugaaugaaccugguacucuccaugacagcugguuuucccuaaagcccggcuuuacugccuuuaugaucaaacucuuaagaaauuacacauguauaacaucucaggacuuccagagugcugggauuaaaggugaguguuaccacaccuggcucaaucaaaagugaggcuacugccacagauuucuacuaguguagaaacaacauuaaguuacuauaccaguguuuguuaacuacuaaaaaaaauagguacaugugaaacauacuauuguuuaagguuuauuuugauguacaugcaugccaggugccugaggaggccaagagaucacuggauacccagggcuggagucacaacagguuauaaaugggagcugacuaggucuucuguaagagcaacaagugcccguaccugcugagcaaucucuccuguuccaugcacugcauuacuuuuguuguuuguucguuuguuuugguuuucugagacagggucucauauaucccaggcugacuucaaacuugcuuuagagcugagacuggccuugaguucaauucuccugcuucugccucacaagcuaggauuacaaguguguacccccaugcccagcuuuaaaaauuaauucuaaauuagcauuguauguuaaaaggccagggcuuaccaguuauaaccaaaagcagggucauaaagacuuccgcacagucuggaaccuucauuucauccacaucagagaugucuuuauacugggauacccaggcagccucugacgaaagcauugaguccauuuuuugaagagcaacuaacacgaaggaagaaggaucaguuauuucauccuucaguuaucaacucacacuuuuuuuuaaggaacuauguuuuucauacaaaauaaauuuuuaaucucccacuaacuaaucacacuauacuuaaaaugucuacuucagaguuaaauaagauaccugauucucccucaauaguuaugcugacuagaaguggcacaucugaaaauacccaaccaagaguugaaacuguguauggcagaaaucuacagaacaucacuaccuucuacugguuugcuaucccaacauguagacuguaauuaaaacaaacaaacaaaaagaacccaaaacaaacagaagucuuguggaaagaagacugucuuugaagguaguucaguagauccugcccaggaaagauuuaggcgccuauaguucuuacucagagcuguaagaaaaucaaaacuccgaaacuuuauacaccaaaaccagccauugccaggcaguggugguccauccccuuaauccuagcauuugagagcaaaggcaaguggaucuuaaugaguuugaggccaacuuggucuauacagagcguuccacgucagcuaaggcuacacagugagacucuguguaaaaacaaaaacaaaagcaagcaaaaaaaacaacaacagaaacaaacuaaaaccauccagagagcccucccgcucgacagccauacgggcgcuuacacuuucucuccacagucagccaucucuggaaacaggucuccuccgacaggaugugcaugcagcuggcgaaugugcugggauagccgugaacggugugcagcucccuuucaaacagcagcaccucauccaccaggugacagaagaggcugucaucguagagcaggcaggggauaucagaagccagcuucucaagaaugagcaucacaaggccacgggaaaacucaagcugaaagaaaggcacaggcauggggguugugcccaacuccaaggaagcugaaaggcacaggcucagccucuuacccuugcauuuacugcagagcccacuuuguccaauauuggcugaaucuucucauccagaaacuguguaugguuuccaauccacauaaguaccugagccaaguaccauucaggcuaaggggaagggaaaaugguaucaauucuuuauguauucuauggugaugggaaauucuaauuaaaugcacuuaguuaaaaacagacacaaaaauuaauugaaaauuccugaauguaagaaaauaauucuuaucccgcacuucaauuucacaaaagacuucauaaucaaauguuuaccaauauacuuccacaacaaauuccaauaaugcggcuuaagucaguaaacucauaauuuaaaauaccacauugggauuagguguggcuugcugguauaacaucugccuagcuacaaagccuguuuuaaccccagcaucacuaaaagaggaagagagggcauaagaacaaucaugaagaaaagucucucucacacuuaagaacaagcaucugcccagcacacacaaagcccugauuccagagcaaaacuaaacaagcagacaaaagccacggcacagggugggccgauggguaaaggcaccugccagcaagccugacaacccgagcuugauccccagaauccacaugggagggagaaagccaacucccacagacuguuccuggccuacacagaaaacaaaaaccaaacuuuuuaaagcccuccaaaccuagcaugaugaggcauuacaaacaaccaaaacuuuuacguuguuuuuugaaauagcacuccaaaacagaaggcucugagauaggaucucagguagcccacgccagccucaacgucucuaugugccugaggguaaugaacgcugggucuucuucucuacuucccuagugcgaggguuucgagcaugcaccgucaccugugacuuauguggugcugaggaccaaccugggcuccaugugagcggagcaagcacucugccuacacugagcugcgaauaauuuuaaacaugauuucuuuucugcuuccucuuuuuaaaagguaaaguaaggaaaaagagucaacugcucuaauuacaaauauaccuaagccuuaacauagguguaacuuccuaaaggaaauaggcacaaagcauucacauuucuuccacuuugcucugugugcacgcauguuugaauguuugugucuguguacaaugccacuguguacgggcacaaucagaugacacccugugggagucacuuuucccuugccacuaccaugugaguccuggggaucaaacucaagcuggcagguuuggagguauguggcuucaccuacugggccaugccaccugucccacauacagcauuuuaaguugucuuuagagaggauucugcaagcauuucaaaaguuuuucuagacgacaacuugaaaccauauaguaggcuggggcuauaauucagggauagagcauuugccucccacaugcaaggccucaguucaauccccagcacugacuggcaaauccccauguguccuaaauguuggggauauaaacaagggcugcaucuaaucucaugacugucuccaugacaguguacuaaauucauuaggaucacacuuucaaaaugagccaacacaacgcagaauuuucuuucuuucauuuuuuuuuuuuuuuuuuuuugguuuuucgagacaggguuucucuguguaguccuggcucucgcucuguagaccaggcuggccucaaacucagaaauccgccugucucugccucccaagugcugggauuaaaggcgugugccaccaccgcccggccagaauuuucuuaugcuaagucauguuacugccuuucuaaaugcuaaguuuaugcuuugccucauugacuacugaguacuaaaggauucugcucuuccaauaacacucuaugcaaaacagaagaccccuaaagcacaaacaggaaucuacugccacaaacgucauuuguaugaccugugcaauaccugcugugaucuugcucuuaauucagaauacuuagugaacccagcuccauacacugcauuggcuacagcuaacauuaagaauaaagauuguacccacauccuaguagauuauaauuacagaaaaacccuggcaggcuaugcugaucgggucccucaguucaaguguugguaaugaguuccuuuaaaauccuuauuccaccccuccugccaugauguucucuguagcucugaucacuguggcacugcaccuguacucaaccguccaugcucucuccuguggaacucacuucucuucuuucuaguucucucucugcaggaguggucgcuacagugaagccugugcaucgaucagcuauaaagccugcacacacaaaugcaaaugugauggugucccaaagacagugcagagccugacagccuguuggccuaagccccagucacaucuacaaagagcagccauuaggcaggaacucaaaagggaaaacagaaacgugaauagagacggucuuuaagcuaaacauguaaaaguccaggcuuagguaacguucacuauuaaugaaaacucaggguaaaauggacacuguagccuaaucccagcacuugggaggcagaugcagagggagcguaugucugaggccagcaggaguucuccuuggacccugacucaaaaacagaaacacagaagugaagagaaagugaagcguacgcgcucugggaacacacaccuugcucaugacguuggucugccggcugccucugaagugguaccugaaucucuucugcaggggagccagcaugaccuguaugggcagggucacgggaggggaggcaggaagacaguauuuuucugggaguuguuuuggcucaguuaauaacucaucucugacacaggcaagucaaggaaaaagaaucaaaaucauauuuauaugcacaagaacacacacaauaaauuuuuucaacaaauguaauaauacuuagcaaaagguguaauacaaauaauggaaaaucuaacuuuauacugaaucugaauuuccaaaaaacgcguucagggcuggagaggugacaaguuaagaauauuuguugccgccagggccaaaaagggggagugggcggguaggggaguggggguggguggguaugggggacuuuugguauagcauuggaaauguaaaugagcuaaauaccuaauaaaaaaugaaaaaaaaaaagaaauuaauagaucucaaaaaaaaaaaaaagaauauuuguugcucuugcagaggauucugguucaauucccaacacccacauguugacucaccaucauccuuacuaaaguaucaggggaucugaugcccacuucugaccuccacaagcacaaggcaugguggugcacagacacacaaacagacaaaacacacacucaugaaacaaacaacuaaugacaacacaaaaugccuucgagucagucagcauucaggaaaucauguuacguaagcacuucuccaacacugugucaaccagguucuucccacugcugauuggucuuccugcccuaaugaccugugggcaaugccaguaugggucagcugcugggcugcuuuggauggaauggcgcccauaggcuugcccauagggaguggcacuguuagggacugugaccugguuggagaaagucugucacugggaguaggcuuugggguuucaaaugcucaagccaggcccagugucucucucuuccuucuggcugccaauccagauguucaacucucagguaccucuccaguaccacaucggccuguaugccaccaugcuucccaccaggacaauagugacugaaccucuaaaacuaagccaaucucaaugaaauguuuuccuuuauaagaguugccauggucauggugucucuucacagcaauagaacacaggcuaagacagugauuuaucuuagaacucuuuuuacagcucugccacuuccagacaauucauuuuuuaaagcuaauauauaauuuccaauaggcaguuaaguuacaugucaagucuaacccaggacccucacuuuggcuacauggccacuuggaaaccuuucuccccugacuguggaggcugauccgugccucaagcccucugccacucugcacaagcccagcaugugcuacucacuaaccacaggucuacugucaggggacguguuagugaguuuccacuccaacaaagauacgaggccuguaguuucaacagcugacaaaacaguguguccaggcuacuguacagcuccgggguaccggcaggccggcucccgccaacgguuugcgacuggguaugugaggugaauggccaaugcagcugugccaagacuuccucaaaaucacuguaacagaaaagaaacaaugcuuccuacaauccaucccauuaccaaauacucaucagaaagcagucaacaggagacauuuccugccugguaagcuuguccuugagaauuuuaugccagaauuuaacuguggcucucaugaaacuaagaagaugaguacaggaugacuccugaagcuggauguccaguucugucauggucaccaggagagaggcugccucuggcacacuguuggucaucagguacugcugaauguuaucacugcgggacaaagcagaacacguuaaugagaguuucuguggaguaagugcgugcguguguguguguguguguguguguguguguguguguguguguguguauaugguguguguguguguauguauguguggcguguaugcguguguguacaugugugugaauucauguauaugaguaugugugugcaugauguguaugguguguguguguauaugcaugauguugugugugugcaugcaugugugcauguguguguguacccugaggacaauggcagguaucuuuucaaucacucucuaccuuauuuuugagacaaggucucuuuauugaaccuggagcucaguaauucaccuggagucuacauucuagauucuccaucuggccacugaacuccaggaauccuccugucugcaucuccaacuuagcuuuuuaauucaggugcuaggggcugaacucagauguuuaugcuugcauagagagcacuguguugucgggcgugguggcgcaugccuuuaaucccagcacucaggaggcagaggcagguggauuucugaguuugaggccagccugaucuacagagugaguuccaggacagccagggcuauacagagaaacccugucucgaaaaaccaaaaaaaaaaaaaaaaaaaaagaaagaaaagaaaagaaaagcaagcaagcacugugcugacuaaaccaucacucaaaucccucucuggaauaauuuugagcucagaaaaacuuucuccuucauuguugacauaaaauuacaucuaaaccgggcgugguggcgcaugccuuuaaucccagcacucgggaggcaaaggcaggcagauuucugaguuugaggccagccuggucuacaaagugaguuccaggacagccagggcuacacgaagaaacccugucuugaaaaaccaaaaaaaaaaaaaaaaaaaaaaaaauuacaucuaagguagaaugaagaacuaccauggguuggcuacucauuucauccgacacucacaucugcaggaacauggaguccccuacuuuaacacccuacgagccuguguuccacauguuuuccuccaccugucccuccccauccucuugaggacagaugugucacauuccugcaggcaacacucauggcuacaggcaggacuucuuucauagaagucauagucucugggauaauguaacuagcagcugggacagugaaggacagaaaccuucaguuuuuaucuacuuugcauuauuguuaccauuucuccauuaaaaaaauguaucccaaauuaaauguuucauuaaauuaaauaaagaccauuaugcuuuuuaaaaauguacaacuauaaccagacauagugacacaagcauguaauccuugcacuguacacuggagaaacagaggcagaaggaucaggaauucacagggucaugagaccagccuagacccuucaauuaaaaaagaaaugagauggggcugaagagacggcucagugguuagagcacuggcugcucuaccagagguccagaguucaauucccaguacccacauggcaguucacagccaucuauacugguaucugaugcccucuucugguaugcagguauacaugagauagagcacucauauacacaaaauaaacaaaucuuuagaaaaaaaagagaaagaaaugagacaggugcaagaguacaugccuuuaaacucagcacucaggagguggagacaggcagaucucugugaguucaaggccagccuggucuacagaauaaguuccagguaagccaaggcuacacugagacccuaucucaaaauccaaaauguuauuucacagaagaagaggaaauguacaaguaaccacacaauauaaaauuuccagaauuauaaauaauacuaaaguaugaaggacacucaaagcacagacaagaacagaaagacaauggccaugugacacugauucuauaauguccauacaaaacacucugccaggaugcuaguucaagcgaggaggcagggcuuggggaugggggagggggagggagagggaaacagagagacugacagauagaaggaaagagagagcacagaaaaaaaaaaaccuaguuauuaacgagaaauuuggagaugaagccucauaaguuccaaaaaaauggaaauagaaauguuuuugcaaaggccuaagggagugaaauaacucucuguauggugcucauuauuaauuuguuucuuauucaguauguuucuuggguuaaaauucucuuuuaaauaauucagguaccaaaaaaguuucugaaaacuaaagucuuguuuuggucaaucucuuuggcuacuaugaaagggaaacuuucaagcaacuuagaaacaacuuacucugcuuauaaagguuacuaauauuacuuuuuuuuuuuuuuaaagauuuauuuauuuauuauauguaaguacacuguagcugucuucagacacuccagaagagggagucagaucuuguuacggaugguugugagccaccaugugguugcugggauuugaacucuggaccuucggaagagcagucgggugcucuaacccacugagccaucucaccagcccacuaauauuacuuuugcuauguucuuccagaggggcaaagaaaaacgaagugacaugaagcagggcuuacaguccuuuaggaaagguccuggggagaugucucaguacguaaagcacuccugggcaagccugaagccuggggucuggaccuguaccaccauccaagaagugaggcauggucaugcaccugcagucccagcacaggaaggggacacagagggacccuggcgagucacucgccagcccaccuaggcaaucagagagcucugggauuaaugagagacugucucagaaaauaaaggaagacagccaauguucaauuuggaggagacaggggaccauaccaugaaauagaauaaucuccccacugaggcaaaaauguuucucugacuuaauaggcaagaccagauauaaucaaccugucguguucgcaaauaugugaacuuuauuuuuguuuuuacucaaaagaauuuucuuauuuuuccugacucaaaaauagaucaauucuguuauucaccuaggagcaauguauaguuuauuuguuuucaguuuggcuauguagccauaagcuggucuugaacucgcuauccuccugccucagccucccaauaauugggacuacagcuuugcaccaucacacuggucuaacugugcucuucuuuuuguuguuguuguuuuagagaccaggucucaauauggagccuggguuuuccuggaacuuaauauguagacaaagcuggccuaaagcaacccuccugcuucaguccucaaagugucaggauuacaaguguguuccaucacagccagcucacaguucuuuuucaaacauucauucauuuacuugcuugcuugcuuacuuccuuacuuauuuuuugagacuggguuucucuguguagcucuggcuguccugauacucacucuguagaccagacuggccucuaacuuacagagauccaccugccucuuccuccaagugcugggauuaaagguauauggcacuacuuauuuauuuuauguguacagggccuuggccugcauguacauguaccacaugugugcaaugccaauggagacgagaagacagcaucagagcacccugaacugaaguuacagaugugugaauuccagaaccgaauccagguccucuauagaauagcaagugcuucuaacugcuaagccaccucucagcuucuuacauugcaguucuuauuagaugauacccauauuuuaaaaauucaaauucaggcuggagagauggcucagcaguuaagaguaccaauugcucuuccagagauccuguguccaauucccagcaaccacaugauggcucacaaccaucugugaugggaucagaugcccucuucuggugugucugaagacagcaaugguguacucauauacauaaaauuaauuaauaaaucuuaauuuuaaaaauucaaauucuaguggcaaaauacaauucaauauuugacaauucguaauauuaguaggaauacugacaaucauacucagggaaaucuagcauuagaaagaguagguuuuaccauguguucaaaaugcaacugcuuagccuuaaaaauuuaacuuacagagggcagccuggucuacagagugaguuccagagggcuauacagggaaacccugucucaaaaaacaaaaacaaaacaacaauaacaaaauuuuaaccuacuuauauuacuuucuuucaaguacaaauuaggcuccaugaaaaguuuauguucauuuacaauagggcaaaauaaguauaauaauaauguuauuuuccuaacaacagguaaaauuauaaucucuaauuaacucaauuaucuaaucgcauagauacacugucugagacugagccucaaaggaaacuauaguccuggagcaaugccacccaccucagcuccucagucugcgacacccacuuaagguaugcgagaugccgcucaaucucuuccaucugggugaucauggcuccaaggucauccauccagggcugagccaucagcagauggcugcuaauggagcugaagagaggcgcuuccugcuccagaaacucaucaagaaguuguuuggauuccucugcaucuuuuaaagcacuuugaauucuuuuagggauuucugaugaaauuguaaguaccuaacaacacacaaaaauauuagcaaugagauaaaacaucaguuaagacuuuuccaaaaacacguuccaacagaacucaaaguuuuccauuaaaaauuucagguuagcuggacaugguggugcacaucuuuaaucccagcacuugucaggguacucugguggagucagcuugugaggcaaaaaugccaaaaagcugcucacgagaaaugaauuucuaagacucuccuccuggauauucuggcgaaagccaacucuccaguuuggaucgguuugucaggcgaaaagccugaaagcuguuucacgaggauaagaguccagggaaauuuuccucccagaguuauggcaucucuuucccuaacccauuauauucaaauuuccaccacauuaaucuaguguauagauucacgugcacucuauuaagcaucaccuuauaguaaaugccuuuuaauauuguauucuaacauagcuaaagccuuuucccaguguucuuagauuccagauagcagcaaggagcuuaacccauucaguaaacaauuaagcacuugccauuuuacucagcuguuuacagauagagacuaaaauucucacugagauagaaauucuuauuacagauuucaugccaagagcaaauuaguauacuauacugaaaauggacagucucuagauauacauaagaauuaacgaggccuagagaauuuuggggucagugacacuacauuauucuugaggugugucaagaguuaacuacccuggggcuauuaacucuaaguguaaaacucuugccuggcagaaagugcuaaucucuaauguaaacauuuaucuggucccuacaaauucccuuuguagucacuccccuugcaucugugcuaaucucuaguguuauacauuuaucugguuccuuuugaagucacuccuuuugcaccuggaaaaauucaaugugccuuguucugcaauuuauucuguauuauaaaagucugaugcucgacuagaacauuacauucagauucaacaccucucuuguguguuugacugauugucauuuucauccuaaucucugcucaucuacucuagagacucuuuccuacgcaggcacaggggaccagaaggccugcgacaagcacucagaggguagaugcaggaaaaucuuuguaaauucgagauuacaucugaguuccgggcuaguuauaguuacauacugagacccugucuuaaaaacaaaauauagggcaggagagauggcucaggggcacugacugcucuuccagagguccugcgguucacuucccagaaaccacaugguggcucacaaccaucuguaaugggaucugaugcccucuucuggugugccugaagacagagacaguauacucauauacauaaaauaaauaacucuuuuaaaauaaaaaauaaaaccccuccaaaaaaaaaagguuuggcuaaucuggcaguugggaggcagaaacauaagaaccaggccuuccaggucagccuuggcuauuuauugaguucuaggccagccuaggcuacauaagacagucucaaaaagaaccaaacgagggauggaaggugguuuuguagguaaacuacuuaucacacaagcaugagagccuauauuuggauccccagcacccacauaaaaagccaggcauagcaaugugucuguagcccucaggcuaggacagaggcaggugaauccugcucaguggccagccagccuagcuaaaccagugagcugcagguucaguaagagacccugccucaaauaaauagguggacagugauagauaccggacauugaccucauugacuucugaccuauuugucuggaugcucaugcacacauauaccaucacacacacacacuuaaaagguucaauuucuucauccuguagcaaucaacccaaacauauaaugcuauacaagguauauaaauacuauauauacauauauacauacauacauacauacauacauacauacauacauacauacauacauagagagaccucccaacacauggcucccuagcaaguauuuguaacacuuuaaaagcauacagccagagaucucuugcuucaccuacuaaguuauuuuccuucaaaaaacaaaugcaucugugauucaagcuguacugauaaaaagcugugcugugucucaacaguagaccaccagccuagugugcguaagacuccauccaauucucagcaccacaggaaaagaccuuuuaaaguaggcaggguggcacacaccugcgaucucagcacuugggagguggaggcagaaggaccaggaguuccgugccauccucagcuacagagucugaggcuagccugggcuacacgaagcccugccucauauuccagaaauacaucugguccccuguauuuugcugaagccuagggugagcccuacagaauuggauaugcaggcaaugucuuuaaacaugucauuuauuaaaggauuauuuuuacgggggcuggagagauucuauucccagaaaccagaauggacugaagcuuguggccuauggugacagcuguacucaugaguauauccuaguaguuauauaaaugucugcaaguguuuguuaucauauaugguaaacauagaucaauauuagacaucagaauaaaugacuaauauuuuauuuuuauuuugagauaaucucauauauccugagcuggccuuggacuuccaagcauucuguuuccaucuuaugagugcugggauuacagguuaaugacaccacacccagaacuacacauuacuguacagaauuucagcucagccaacucugauuagacacucugagcccagcacuaugcuagguauauaagggcaacauuugcccuuaaguauggaagagacacauauaagcaugcauucucacaagcgacacgcuagccuggacacggcggcacacaccuuuauucccagcacucgggaggcaggggcagguggggcucugcgaguuccaggucagccugguguacagaaugacuuucaagccagucagagcuagagugaucgaucccucaucaccaacaaaaccgccugaccuaggagcugggagaaagugugcuaugguagcgcuccugacuccugaccaugcacaggaauccccugaagaucuucuccugauacacagaauccaauucaagggaagaagagagagcaggugagcccgggcaguggggauagcagaucucaguagucacagaagaacauuguacaagagauaacagggacacuuacgguuuaggagggaggaaggaagacagggagcacagaugacugggguuuaggaccaaccccacuagggaggcaagauucagacuccuaggauacagggcuggcucgaacuugucaaaccaacacaagcuagagucaucugaaaagaugccuccaucagacaguccuuuaggcaagugugugggcauuuucuuguuuaacguggaaguguccaagccacuauguguaguaccaccccugggaagggggaaggugguccucaguuauauaaaaaccaaacauuguaaaccaaaaccaccuuuauuccccaaguuacuuuugaucacagcauuuuaucacagcauuagaaagcgaggccagccuggucuacagagugaguuccaggacagccagggcugcacagagaaacccugucuggaaaaaccaaaaaaaaaaaaaaaaaagaaagcaagacuugaguguuggacagaugcaaaugcuacuagccacugaggaaaccuguuaagagacaaaugagaauaauauuggacaauuucagauuuguggugguuugaauauguacaguccccauagaugugagugaaugcuuggccuauggggaguggcccuauuaggaagugugguuuuuuuggaguaggcaugcguuuguugaaaggagugugucacuguggggggucuccuauauucaguguagcacagucuccuccuuacucccugcagaucaagauguagaacccucagcuccuucuccaacaccaugucugccuggacacugccaugcuucccaccaugaugaugauggaccaaaccuggaagccagccccaguuacaugcuuuccuuuaugagagcugccuuggucauggcgucucuccacagcaaugaaagaaacccuaggacaaguuucacuuacggacuuuagcaagucucuguggauucaagagguaaaagagcaguggcaagcuagaaaauggagaaugauaauaaacgcuuuuuaaaaauaccugaacaaccaaaugaaugaacagacaccuacuaaaaaaugaagggaaggauuuugguuuguuuucuggggaagaccuaagugugcucgucuacugagaagacaggacuguuggugaagcaaaggauaaagcaaacuaaggccacuggcugccaaggugcugggaaggaaggagcuaggguguagggcugccuuagcacuggcuccuacuagaagacuuaugugggguagaaguguuuccucugucugacaggaacagagagaucagggguuggcagcaugugcaaacuccaaugguacauauguaugaaaaugucauaaugaaaccuacuuaugcacuaaaaacauuaaagauauauuucuaaagccuggggcagcagguggucauucagcagguaaaacauuugcaaaaucagccugaucagccaagucugcacucuggaaccccugagaaggcuccaugcucucugcgucaguucccgacuccagguuccugccuugaguuccugguuggcagugugcaggccuugcaugcauaaggcccugaguuugauccuugggcacacaauuuguugguacauguugaaaauccuagcaucccagagguggaaggaagaagaccagaaguucaaggcccuucucugcuacacaauuaaagucucaucugggacccuguuuaaaacaaaagaacuaguuuaccucugaaaagguaaacagauuauaaauaaguuggaaauaugggauagacuguuaagucaauacauccaugcgagaugcuucgcuuuuugguuagagaagagguaacagcauuucagccacacaggaagaggggaaacuucuggaugacugaggacaauauaagacugcacggcgaggcugaagacaccuauggugucaggccacagauuaggcuagccuugacuaacucaggagugcgacauccuccaccagagccuugcaaaagcagaaaagcugagccaucaggcuacacagagaccaucaguagguaugacaggaaagcagagauguggaggccuaacucaaccuaacucagcacauggggaugggagagcauaaagacacaccaugcccacauauccagaguuggcucgcccuaauuaauuucuuacuuauaugauaaaauauuuucccuuugacagaguacugcaacuauaagaccuucuuaucuuuagcauaaauuauuuucauuggauuucuaaaaauaaaagcauuauauucguaguaaaaugaaccccuaaaaauguuuaaaagcagaagaaaauaacuuuucagccagcacccagaaacaaucauucuuacaguucucucaguuuuuuauuauuuuuuaugacaggguuccauggaacccaggauggucugaaaucauccuguagcugaggcuagccuugaccucuugaugcauuugccuccuaccuccacgcacugaaguuaucagugugugccaccacuccgagcaaccacuauacaauacucauguuucuuucuaucuggguaauuacacacacuuggaaugguuauguguaaccauuucugcacauucugaaauuacucauagaguuguucuagaaguuacugaaugaaagagauauacaaugcuagcuaucauaaagaaauuauuauaucaaaacaacauaaaauguuagcuaucacagcaagucaguaggaacucuuacuuacaaacuacauagcaggggucuuuaaagccugucucucaguuugaggcuugcccucauggccugcaucgacagugcaugaugugcaauacucauaauacugcuuauguuccauguccaugaacacaguugacagaacugcacugaggcuaacacuuaccuguucuucuaacuucacuuugcuuucugucauuuguucuaugaguuuaccaagugucuucaaagacuuaaggucacuucccacuuccuucucuaugaaugcagacacauaggaaaggagcgcgucgucacugccaccuuggcugagcugcucgcuuccagcaggagcugcaguguucacgucaccuacagaaaggaaaagcagcuacucagcagcaccucgaggcugccggagagauacgcaggccaggacaccagagcaccugagggcuggaggcagcgcugugguacagcacuggccuaucaaguacagucuacagguucaauucucagcaucuccugaucauuuaaggagacauauccacacucuaucucucgauccauaccuaugcaucuaaguguacauagauaguaccugaaugauaauagcaaagcaauuaaucaaccaauuaccagagaugcuugugggcugagaaggcuuagagcaaaggaaaaauuccccaaaucucagaauuuacaagagucauauguaugauaacacauaacuuuucaaaguugauaagcaaucaaacaaugauccagaaucaauggguugcucuagcuuuaauaaauaugacaaacaauauugaaauauguuauuggaacauauuggaaaaaaaacaagaugguaucccauacauaaaaaccuguacagacuuuuaaaaacauauugacuuauugcaagagaagaagggcaauggaggacaacauuuacuaaacauuaaaacaaguaaugcagggacuggagagaugggucagggguuaaaacacagacugcucuucaagggcacccggguucaauucccaguauccacaugccagcucacaacugucuguaacuccaguuccaggggauccaacacccucccucgacauaccugcaggcagaacacuaaagcacacaaaauaauaauaauaauaauaauaauaauaauaauaauaauaauaacaacaacaacaacaacaauaauaauagaaaaccaagcaaugcagagggaaggcagagauggucaugagcuuuccucuucucucagauuaggaauccugcuaguuccucuggacuucaaagcugaucuuccuucccugugaccuggccugcacacugcagguucugccuucuaccaggagcagaggagcuuuaccaguuguuaccacgaauacuuuguggagcaagggucaaauacacacaaaauuuuuuaaacauuuugaacaaauuaaaaaaaaacauuuuuuacucaauaaaaauccacugcaaaagcaacuaaauagucaggggugguggugcgcaccucaucacagcgcuaaggagcagaggcagggggaccagagugcuaagccaaccugggcgacacaguaaaaacaauaaaacucuuuuuuaaagagauuuaaaagcaguuagaugguuuccuacuguccuagaaucuguuguucaauggcaucaccuauuuguugggcagcugugccacagacucagccauccuguaccucagaagcgccucaugagagcuacuuggcagagcugagggguaugugacucacaucuggcuacauaagcuuucuucucccacucuacuauuaauggccuguggcaaaugguuucuuuucagaguggcugcuucuauucauaagcuacacacacacacacauacacacacacacacacugguuuaguuuuuguuuuugaaauggaaucuuucuauauagcuggcaaugauccugacuuucugacccuccuaacucauaguaccagugcuugcuuagacuacacgaguuccaccacacuggcuuaugcuuggugcuggaccuggggcacggagcaugcugggaaagcacuccaucagagucuaaaugaaaagaugccuaaaugaaaaccuaaguaugagaugcuggcuaaauauuuauguacaguguacuagaacauaccagugcgugcaugguggcucauaccuaucugaggccagcacucaggggcugaaggaggacugauacaaacucaagccagcuuuaacuacccagugagacugugucucaaaucccuacaaaaacacuaguuacagggccaaagagauggcucagcaggcaaagugcauuucaaauaguacaaccugauuucauccagaacccauauaaaggguuaaauaaaaauaaauauaaaucagaauugacuucacaaaguugucuuuucaucuccacaaucacgccauggcaggcacacacccccacacacaauacauacauacauacauacauacauacauacauacauacauacauacauacauucauacauacauacauacaaaccaaacaacagaaacacuacaaggccagcaggauggcucauuugguacaggaguugcugaaaagccugaugcccugaauucaaccccuggaacucgcaguguagaaacaacuucugcaaacuguguguccugagaugugcacacacacacacauguguacacacacagacacaaaguguaaaacaaaugcauaccaucugucugcugcuggguauuccuucucucucuucuccuugcuccagaaaacauucuuuucccuuuguucuauuuaauuuacaugaauuaaaauauuuuggugcugaggguguagcucagugauagugugcuuacccacccuaagcaaaaacccacauuuaauucucaguucuacaaaaauaaugaaucaauaaagacacacuggccagcaacauggcucagcagguaaaggcacuuuccaucacggcugauguccuaagucugagcucaagacacacaugguggaagaccagagcuaacucacaaguccucugaucuccacacauacacuauggcaugcaaacacacacacacauacacaaaaauaaaaugaaauaaaaaacuuuauuuagaaagaagaauuagaagauuguuugcagacaugaagagcaagaggccacugguaggagaaauaaaacaaggcuaagucucaacuuccaaacuacuaaauaaauaauaaugccugccucagccuauaaagauuaaaaaaugaaacuaaaguucaugcuuucagaccaaaacucuauugucuacuuuauauauuaacagaauugguuuuucuguaucuaaauuuuaauaauaucugacauagaugggaaguucagggucaucuucagcuacauagaaaguuuaaaaccagccugggguacacaagacacagugucucaaaacacagaauaauccaacugcacucacguccugauaagaagauaaucuuuagaaucauccauaaagccaguaaguugugguguguauccacagacuugagcucuguaucugaggcggcuaaugcuaccuucacuugaaacaaaacccacacgcaccacauguaacuauuuaaaggugcguacuacauucugaagcaugugagauccuucaaaacuauacagagauuuuuuauuaccuauuucugucuguucauuugcuuuugagaaagaucucauguaucccaagcuggucucaaacuugccaugugguagucaaggaugacuuuaaugucaauuucuaauccuccugccuccaccucuugggugcugggauuacagucaugcaccaucauacuuaauuuuaucuguuguuucuuuuuuuuuuuaaagauugaucgauugacugauugauuauauauaaguacccuguagcugucuuuagacauaccagaagagggcaucagaugguugugagggcaucagaugguugugagccaccaugugguugcugggauuugaacucaugaccccuggaagagcagucagugcucuuaaccgcugagccaccucuccagcccuuaucuguuguuucuuaagacaggcuggagaaauaacagcucuugucgauuuuguagaggaccaggguuggauucccagagcucauaugugaguagccuagaaccgucuguaguuccaguuccaaguaggcugaagcugaagcccucuucuggccuuccguggcaccagacaugcauagucacagacaucuaaauuuuaaaagcacaagucuaggcuucacuauucuugcccauaacuuuaaaaaaaaagagcuaaaaaccaaauacacuaauauuuguguacaauauuuuagauacacuauaauucugugaccuaaccugaucuccauaucaugguaauccuccugccucagccuccuaagggcugggauuucagaagugagccacaccuggcuuggcagauuuuuaugucucuucccuuucauuuuuuauaaagagccugcacacugucgcacagcaguuaacugagccacugaagacacggacaaaguccuuaacgaaguaguuugcaccugacgcucuaaaaugacaauucggcugaugucaagagucaaggcaucugggcagacaaaaguagagaaaguuuguuugcauuuuuugguuuguuuccuuguuuguuuguuuguuguuuuguuuuguucugcuuuuccccuuuugguuuacaaaugggcuggcagguauuuccuaaacuuuugagauuuuauguguguagguguuauauguaugucuguuuaccacauuagucaacguacauagaggccagaagagagcauugaaucuccuagaacuauaguuacaagcaguuguuagccacacuguaggugaagucagcuccucugaagaauaucaaauucucuuaacugcuaagcccauucugucugcugcuuuguuuguuuggugguguagggcucaaguucaaacccagggcucccaaaguucuaggcaagaaagagcucuggcacuuuaacuucccaggccacuucaggcuuuggguuuuguuuuguuuuauuuuuuuuaauuauuauuuauuuguuuaaggauuuguucauuugauuuaugugcacagguguuugcuuccgugaguuuauguguaccaugugugagcaagagcccugggauggcaggacuguacauuuagacuucuaagacugaaguacugagcugucacguggguuccaggaacugaacccagguccccuguaacagcagcaagcacucuuaagcaccaagccaucuuucaagcuuaucagaagccaacaguaagagcaaacuuccuccugggagccacauggaaaugugggcacccuuucucuuacugucaaggucacugagcuuaacuguuaacauaagggcuuuuuaaaaaauacuucaggcuggagagauggcucagagguuaagagcacugacugcucuuccaaagguccugaguucaggucccaucgaccacaugcuggcucaccaucacccaugaugagauuugacgcccucuuguggugugucugaagacagcuacaguguacauagauauaauaauaaauaaaucuuuaaaaaauacuucaaaagcuccuaaagagguugggcaugugacaucugugaaauagaagacuguggaucuggaguccaaggucauccuuagucacacaaaagucuggggcgaaccuggguuacgcuccaccuugguuaaagagagagagagagagagagagauugagagagagagagagagagagagaaacaaaaacagccccuucagggugcuggauuccuaauaaccugcuacgcuuaucucaagugaaauaacaaauauccaggagucugacauaguuuccuguccuagguacugggucuuuuccaugucaccuacccagaccaagcccugggaccuaaggugugggcuaccugcagcaaacuguaauuacuuacucacugaaggcaaaaguacaauuaaccuauuaucaaaccucuuccuagaacccaguaacagugaccagcauaaccccucuaaauaccugauaacgagcugacaguucauuaaaauggcaggucccagugaagccaaaccagucacuguccuaggaaggagcgucaaugugcucuuucuauauuucacagucuuagagagacaaaaguccacgugcaaagauaacuaauauuuauuacuguuuaaacauuguacagaaagaauacuccauugaaaagauagcagacuaagaaacucuuuugcagacucugaaaaggcgagcuucgaagggcagcuagacaaaaagaacuaaggguuuaaagccugcuuacuuuucacgucuguguucuucguuucgucaccacucucggggcagcacuggcagaaaaacagguguggcaaacaaguuagacugaaguaaguggaauucauacagcgcuccgaaaggucccauacugacgggcggagagguccuaggcgccucucccaggggcaugccugacacuacugccaccuucccagaggucuggaccaccuccccaggguccgaguuacucugcccgggcaccgaggccacuuucccgccaacucucaaaacugucaucuucugggacaucggacauugcacugugacuaccuccccagggacucccuugccugcuuccggccgugggaaccaccgccaaaccacuuccaagguaaccuguccccggggcggagguggggucugugccaccucgcagggucaccagcgucccuuccccggguuuccagggacgccucaccggggcugccggcacuucgccgauaucgucagccgcaagcauccugccuccgcacgaauucuggauuccaugcaccgccagcccggccugcagaguccggcuagggaacacacagacugggcgaccagaccagccuucugggacgcaggguugagcgccaccucgacuuccua

SEQ ID NO: 2364 - RNA, 115412 nt, Mus musculus
ccugucagagaggcuggcggcaguggcggcuguccgggcuggguugucagucagagagaggagggaagauggcucgcccggacucgugcugcuagaaggagaggggcagguggcgcggcugccggcggagcgcagucgcccggucgccguggucgccguggucgccguggucguggggggaggccgcgguagguccggagcugcucuggugagucugccgcgagccguacgccggccccugaggcgccgggagaccgagaacuuucuuuggucugggaggagcggggcugaagcuguugccggcggcggguaggacuucguccuggggcggcggcccguugcggguaacggcucccgcgcgaggcgcggcccgagaacccuaaguuggccgcggccggcugcccgcugugaacgaggcuccguucccgguugggcgaugagcugggggugccccagggucggccuagcacagagcccaccguagccuauggccacugcccacccguccgcgccgcccaaagccuggccucgccgcccacgcuggcuccgcagacccggugcucuucagagcggugcucgcucgggucuugaaucccguggggcuggggguucggagugccagaccggucugucuguccaccaccaggagagcuccucuucugccugcgccgcgcuggacccuggaguucugccucuucugcggcugcugugaccgcccucgaggaucgacaggguuuucuguccacugaacgguuuuuuguuuuuguuuuuuuguaagcuucuuucuuuuuucuuucuuuucuuccuuucguucuuuuuuccuuccuugcccccccccuccccgcacgaaaacaccccagguuugcaagcuucagcaaaacugggucucugcccugcagcgugcauguguuugcuuuguaccuuuagaguuuagagguuccugaagaauuuggcccuagugguuuugcacugcacugaaucgcuucugggauaaaacgcuauugcacgcgggcagcggcuccacugcucagguagggggagugcugcugcgauacagagacugcuacugguugcaugcaggguaacacuggcuuucuguacacuggguguccuuuggguaacaagguagguuuugcaggagaugugccagcccugugguucaugccacgcguugcaguuugagguuuucaguuguuacaacuuuuaucuacauaaagccacaaagauuaggguaaccuugaaacaaugcgauaguucugggagguguguuuuccuaggacugcucuguugccaauggcaccagccuccuccccccaacccccacccccgaucguuugugaccacuuuuccccuuuaggugaauacauuuuaagguuuauaagaugacucuuuguaucacguuuuugaaguacacugaaggacaagaaaggggaaagguuucuuugucaggagugguaucaaaaucaaguauucagauaauuucacuuuaguaguaagggggaagcccagcauguauuuagaaaccagacucuacaauugacucauuuuacagucauuugauuuauuaacauuauuuccagaaacaaauuagaaaucccguuaauaaucaguagcuacagucucuggguaugcaugccagguggagacuggguugggucaaugcagacagaguucugucuuuccuuucaucaggcuugguggcaagagcuuuuaccaccagagccauacugaaggacccugcuuuccuuuuucuacuuuuuuguuuguuuuuauucuucuauuuuauaaaauccccuuugguuacauuuuuaaagaaugguguaauuuugacaauaaguuuaaguauaucuucuaguucacuuuuauucagcauccuguugccuauuuguaaucaagccuaagaaaucuucauaggugacuuuuaagaguguagcuccaaaaccagucauaagauuacuuauggcaauaaaguagagaugugugagugagacuuuucaagaaaauggaaggaaagaaaggagaaaaugcuggcuauggaauagcauuucucugucuuggccacauauaguauuuugcagaacuuaaaauuuuuacucucagaaggaaccuuccccacccuguuuccagcaagggcaggauaggaccuagacaacagcauuuaauuaaacaagaacucucugaaguauaauacauacauauuucaauugugacacuuaauauuuaauauguuaauauuuauaaaaucauugccacaauuaaaauaacaaacccacauaucaccuccuaagauuguuuguauccuuuguuuccuucugauucuuagggaacacuuucuguugguauuggauacuuuccuguaaaguuuauguuuuuaaacauauuguugauuuccuagauauuuuuaaugugugaacaugguugaaaaaccacuugaggggcaggagaacuggcucuguaauuaagagcacuuguucuugcagaggacucugguuugguuccuaguacccacaugguugcuauucacaaccauucuuagcuccaguuccagauuagaugccuucuucugaccuucagaggcaccaggcacucguguuuuucacacacauuugcagaaaaaaacacucagacauguaaaguaagucuuuuauaagaagccccccacaguagagcauaggucgaaagaauuucauguuugugcaugcaugaauaaagagcagcgucaaggcaaaaccucugccgguggguaugaggugauuaauccuaguuaguccuuggggagccggagacaacggugaucaguaagaaauacauuucugaaggcaacaucucuaauaagaaacaagauaaugacgacuguauuucuuuguuuuaauugucaguuaucaguaguaccaagauugguuuccuaaagugcccuuuaaagguccacaaaaaagugaagagagcauccuaguauugugagaacagagguucuucagaagaagaccugugguaucacuguggaaggcuuugucagggguuuuuuggggggcgggguuguguuggacgggaauuagcaguuuguugcuucuuuuugaaaugcaagugcugcuaaggcuucuuuuuaguccuccagaguuaggcugccuaucugaauggaggaaggacauuuagcaauugauuaugacccgggugcuuagccccaguuaaugcauuucaacauauccuccacaccuauggcucagaggacaucauggaagaggggaugggaagauugcuaggagucagaggacagagcuggaaugucugcuauacaagugucuuccauauaugauggaaaucacgugugcaccaggaaaucgcaacaauaugguuuccuaaaccagaccaaaacauaacuguaccaagugacaugucaaguguggaugggggaauucucaugagguuucuuccaugaaggaagagcuacaggcauuagucgguguuugugagaggaggaaucuguuuucuccaagaaugaacccugugguaggcuagacaaucccaagacgacaauccguggugcacaagaaaccuuuagggcuacauagucagacguucaaaaacuuuacuuaagaucuguuuuuaaaaugcucuuuugucuuuuuuuuugaggugugauauuaaaucugaucacaugcccucagaauguugagaugagcaugugucgcuguuuuaaccuguugaugggugguuguagacgucuccaguagacucuggugcuguucuggagauaaaguuucuugauagucgccuguuucugacauguaugaggaugaucucauagugcaccauucucccggcccauaagcuuuguagugcauuguuuucugaauacagagagagucugagcaaaggacaugaggagcuuuuccuucugcccuuggcagguugaaaauaguugagcuguauaaauguguuuguggagaucucaaauugggcuuaagucuuuucuaaguacuuuaaauuuaauuguaaacucuaugaaauagggauuaucauuccuauuuuacaguuaaaauaggacucagauguuaagucucagcuaaaguuaaguguagggaguugaaagacaauuuuugucuaaaaucacagcuucuguugucugugcauugcauauguccccccaaccccccauaggcucgaugucagcaccaguaggcuucuuuagucauucucuauguuacuuuuugagucagggucucuugcugaaucugcugcuaguccauuaggguaggcuagcaaagcccucgagauucuccugucuccaccuccagcacugagaucgcaggcaugccagucuuuacuugaguaugcuggagacgagcucagauccucauccuaguucauauaguaagcacgugacccacugagccauccaucugcccaguccuugcacuuuacaucaguucccuagcauguuucugacuagauaccuuuugcuuuucuuauuauugaaaaauaaacaugaucacguacgugaaaccuuauuguuucucuucuuuguauaauuauauuuuuguacccccaucauaauuauuccucgucucuucugugucgauauugucucuucugcuccucuuaaugaguauugccuaauacagugauaguaguagaugacucugaagugggugaggugagaugggaaaacuaagauugauuuguauacaacauauacaauauguuuaacaguuuaaaccaugugcccagacaaaaguaaagcuuaagacccagacuuguugggucccaaaauuaauuuguacucccaaguccuguuuguauguuguuaagaagguuacuguuaaaguauuguacaucagagaucuaugaguuuggaaaacauagugcuuuuucacuaugguccaaaugucuguucucuucgagcuuugugucaauguagcauucaguaguaaauguuaaauuuguuuggcguuuucuugaacaaugaaucuuuugauuacuugaugaacauuauuaguuucucauucucaugcuaagaauuuauccaguaauuuguauuugacuuaauaaacacaguauguaggaguucuuaaauuuauucuaugaaaaucuuguugaguuucagcuauugaaagauuuauauuuauuuuuguuuaugucuguguaagggccaggcacuaggaugaaugucuguagucagucucagcuagucuggaggcugagguggaagcuaguacuugagccuaucagaccagccugggccacauacugaggcgcccugucuuaaaacaaaaacaauagaaugauggaaugugucggcuagcaaauuuaagagaagaauuuaagauuuaaaagugcuuaaugggcaaacaguuaugaacuuuuuaaacuccugacuuugaaauauaacugaagaguuuagaguguugauucugacaguauccacgcccaucuccccaucugcuguaggaaguucccacucagacuucucugagccagcugcauguguugcuuacccuucuguccaggaugucagaguucacagugaucuguaagcugcugggugcugcagacagagugcuaggcggagugacggcauuguccugagagugcacacagacuuagaugaggggagaccauucugggggauucugaagcaugagguuggccuugcuaagggaauggaggggaaggugacagugguuuagaaauggguggagcaagaagcagaaccuaaaacaugcaaguccaggagagguauagcuggauccucacggaauacuauguccaauuuucugcagaacugccagacugguuuccagucugcaauccuaccaacaauggaggaguguuccucuuuucuccacauccucgccagcaucugcugaguuuuugaucuuagccauucugacuggugugagguggaaucucaggguuguuuugauuuguauuucccuaaugggcauauacccaaaagaugcuccaacuuauaacaaggacacauguuccacuauguucuuagcagccuuauuuauaauagccagaagcuggaaagaacccagauguccuucaacagaggaauggauacagaaaaugugguacauuuacacaauggaguacuacucaguuauuaaaaagaaugaauucaugaaguucuuaggcaaauggauguaucuggagaauaucauccugagugagguaauccaaucacaaaauaacacacaugagaugcacucacugauaaguggauauuagcccaaaagcuuggaauacccaaaauacaauucacagaccacaugaagcucaagaaggaagaccaaaguguggacacuuugccccuucuuagaauuggaaacaaucacccauggaaggaguuacagagacaaaguuuggagcugagacaaaaggauggaccaucaagagacugccauauccagggauccaucccauaauuagccuccaaacgaugacaccauugcauacacuagcaagcgauuggugcaaggaccgugauauagccgucucuugugagacuaggccggggccuaacaaacacagaaguggaugcucacagucaacuauuggauggaucacagggcccccaauggaggagcuagagaaagcauccaaggagcuaaagagaucugcaacccuguagguacaacauuaugaacuaaccaguaccccugagcucuugacucuagcugcauauguaucaaaagauggccuaguuggccaucacuggaaagagaggcccacuggacaggcaaacuuuauaugccccaguacaggggaacgccagggccaaaaaaugggaauggauggguaggggaguugggggggggggagggugugggaggcuuuugggauagcacuggaaauguaauugaggaaaauacguaauaaaaaaaaauaagagaaaaaaaaagaaaacaaacaaacaaaaaaagugcuugcugauaggaacuugauauagcugucuccugagaggcucugccagagccgacaaaaacagaggcagaugcucacagccaaccauuggacugagcaugagguccacaauggaagaguuagagaaaggacugaaggagcugaagggguuugcagccccauaggaggaacaaccauaucaaccaaucagccccccccccccagagcucccgcucccaggaacuaaaccaucaaccaaagaggauacauagagagacccauggcuccagcugcaguuguaacagaggauggccuugugggacaccacugggaggggaagcccuugguccugugaaggcuugaugccucaguguaggggaaugccaggcuggagaaguaggaguggguggauagguggggggagcgccuucauagaagcagggagagggaggaugggguagagguugucagaggggaaaccaggaaaggggauaacauuuguaauguaaauuuuuaaaaaaaucuaauaaacaaaacaaaacaugcaagucaaacagauuacuuagucaugcauaggaaacagaaaacagucacauagaugauaaaaaccagaguguuaucaucugugaggucaagguaguucagcauggaaggaggagacggugcaaaguuaaagcaugaaccuggaagaggagcuggcugacuggcuaccucggaggcugugggaguuuaugcugaaaaccaaaguuagcugguacaggguugauuaagggagcaacugauggcaaguagcuggaugcaauagaugaggcugcugcauuagaaugucgguacagagugacuuaggauggaaguugccuuggaauuggaagaguuggucuucugaugcuguuaaaugcuggaccacauucuugguuguccaaaugguugauuucauauuaguuaccuuauagacucaucuuuucuugagcaucuacagugugccaguucacuaguuaaugcuagguugagaagauuuuagaaaaaggaucagccaagaaagacuaagaaacuaagaguaaaacauguuguuuucuccaugagagcuauaaauauguuuugcaguauuaggucacuccuuagaaaggucagcagcaacauggaaauaagacugaguugguuguaaaacagcaauuggaacagaaauucuccaugucuucauaguauagacguuccaagaauuaauuauaauauagccugauuuauugaauuggaauucuaccaaccacaaauuaauuauugguaaaaaaaaauuugagcaggcuuuaauuuuuuuuuaaaaaaaucacuuccuucagaaacaacagaaaugcuuaaaauacuuuggagauuaacaguccuuauagaacuuucaagcacuuugaguggagccaacauaaaaacuuuugcuguaccaauuuuagcuucuuaugcagugauaaagcaacauuuuguucuauuaauauaaaacuuaauauuauuggagacuauuuuuuaaauuauuuuauacuugucuauuaaaccaaauugauugucaacacagccauagugcuuugauuacuauaacuauuaagacaaacaucuguauuaaugagacccaccaccaaguuucugauuggaaagauauguugucuccuauuuucuacugacgugguagagaaugaaucuaggguaagggucuuucacguguuagguaggugcugcaccccuaagcuacacuggcaaccuggaucugcuguguuuuaaaauuaugcuucguuuguaggcauucaugccauuaacaguguguccuugcauuuucucauuguauugccucauugcucaacacuuuugauugaacaucugggcuccacuggcugacuucuguaaugguuaaaucccauuccaaguuacuaaagggcagugacucacuccaaagcuucaacccacgaguuaauuggaauuuggaucucuugauauuucccucuugcuuuuguccccagcagugaaaaccgccacuuaaaauguaaaaagcguuaaguugaaacaacugugcuuugaagacugcauuuuuguauguuguuauguuuggguaagaggaaggaugggagggauggcaaaaugauuggaacauacuugcucuguguuuccuauucuuaaccuauauaacgagcguuuaccuuuauuguuuuauuucauugcuuucacccugauuguuuugacuucuuucaaaagggauuaaggaguacucgauuuugcuguuuuagguuuacugucugcacuaauagacugaaucccuuaagucagcuacuaugucauauccuuucuguggcaaguaggaccuagugggcaguuaauaaauuugaauaaguggaugauauuuaagaauuaauacaaaaaaagaagagccaggcacauggcaauuaaagaggggcaugaugugaagauggcugcuaccuccaugucagagagaaaagcuggaggcagaguccuguuuccuggcucucagcaggaacccaccuuuaucucagacucuagccuggagcaccuugagaauguaaauuccugcagucuguucuacuuuguuacuacagcuuaagaaauaauggagauggcuuauauucuuguacacagcaacaucuuaaaucccuucauuugucacuugcuuauucccaagaaccccccuagacauuuuauguuuccucuaggcaagauauggcagagaaacugaguagcuauuugccuccucugccagcuccccaguauagugcuacaguggcaaauggcuaaauuuuguuugauugaguuuguuugguuugacaaagagaagguguuuaaggaguuuuaaguucgcaagggcacaggagcagcaaccaacagaccugguuguguuuucaagguagaaaaaggaagacccagugcaguggugucuaguaugacgguaauuugagcuaauugcauuacuguaauuacuacugcagcucaguauuaucugcuuuauuuugccuguggugcagccagcagaggcagcacggugugucuuuuggcucaggcccauuucuuugaagacugugacccucuggucaccaagcauacuaaguugccacagccauguaucaauuuuuuguuacauacuuuagcuuuugucaucaggaccucccaaaccuaugacaucacauaagugacagcaagaccugcgaccugcagacggguugccaaggcaacaggcaccauauucccaacauccacuuggcucaccucccaccuucaccuguaugucauucucccuauaaauaagaacaccccucccucucucucucucucccccccucuuuucuuucugccacuaccuugucucucccuuccaauaaaaccucuuccacguggaacugucuugaccuagugugcuguugagauguaacccgccauucuaacauauuguuagcuauaugcuauguaaagcuguguaaaaaauuuuuuuuuacuauuucuuuacuauuuuuaguuaagucuuauucagauagugcugugucucguuagauuuuacagauuccuugcugaaaaccugguuuugcauauguacccaggaguucuuucaucauguggaggcaguuuaugagccuucugaagugaaugugauuuacuacagaaugcaauagaagucuugguccccaagggaacgcacuuguguuuaucauucaacaaagaaggcauuggugaaggccaacaguuuuuguauuuuagauaggguccucuugccaagugcugggauuacaaguguguacuugcaugccagacacacauacacaugagcacauacacagaucaacauuugauacuggugcuaagaacuuguaauuagccugccacaaaauggccaucaauugauuucuuuccucacguacuccccucccuuucuuagcugccugcuuuguaugcuccuuaagggcagacagagcaaaccuuauggucuuuuugccaauagugcaaaguaauggaaaagccuugcguuacacucaguaagcuaucaagggcuuguugaauauuaauguuacaauuugaauauauaguaauauugacuuuuugcagcuauaaacauauugcaugcaucaguccuuaacacgacaccccuggcugucuguuuuugccuauucauagccucuuucuuuguuccuacucuggugcugccagccuauagucugcauaaauugcgugagcugggcagggauugaaugacugaacugucagccugagacucuggucuaguaaauauaugaaaagcguucuuaaugacugugcugcucacugugcauccacacagcagucaugacaaugagugcucuucagauaaugguugaagcucauuuuuuuucagcagucucuuaaaaucugucagcggccuuuaagauuuuuaugucuucaucauuagagcuaaaugaaguuuguuugauugaggcaauacuugaaucaccaacauguacaacaguuauauuuugugaaagaugauacaaauauuuuggaaaaaauguuggcagauuucugccuaauaguauacuugaaaauguuauuuaugguguuccuauguuuaaugaaguacagaauuuuauuucuaauaagagaucuucuaaaugguuaaauauaucaaucaaucagucuauauugucaucaagcaaggcuuuggaggcucacagauacagugccaugacacugcccuaacauuuuuuccuugcacacacacacaccucaucagcaugagccccgagguuuuucugggcacacuguaaaaagcuaacgagcaaaaaagagacagagcagagagaaguugucgcacagaggccgcaguggauaagggaaguugagagaaguagacaaugccugucuuguagggugaguuugauguguagggcccgagauacgaugccaucugugauaguauguugguucaggaagaucaauauggcagcaagugcaugaugcacugcacagggaggaguccaggagcaggaaugcugcuugaacaacugugcagagacaacaaagcacaggcucuccgaguugcuguggagauggagagcagauggcaaauuugacaagcaucauugugaugggugaaauuuacuccuuuauucagcagauauuuauuagauacuguaugaauuugugcuaauaauaucugagccuacuuuccuauaauuacuaacacaauuuuaagcucuaaaauuguuacauaauuuuauauuuuauauuuauauuuuuauuuuauuguggugcuggagacagaaccagggcuugugcaugccaagcaaguggucuccuaacugagcuacaucacaaacccaaaaugguuacauaauuuguauuugaagacguacuaguuagcucagugugagaacacacucucaggauguagaggcagguaaguuugauacuagccuggcccacccauagcaaguuccaggccaguugaggcuauauagugagacccugucucaacuacccaacaaagcaacaacaacuggaaauaaaauguuauuaaaauaauaaaauuaugaauuaggugugguagugcucacuuguaguccuguaauaucagcacuuggaaggcugaggcaacagaaucaccaugagcuccaggccagccugggcuucauaagacccuggcucagaaaaaucugaaagaaaauccacaauagagugaaaugacgaauaacucacucugaaagaauaauaauaacaacucacucugauagaauaauaauaacaacucacuaugguagaaccucagugugucuuuuuccuggaggccugugcuuuuagaugaaggcuauagguccuucaaaaacgaaaagcaaggacuggagaaacagcccagcaguugaaaacacuugcugcucuuccagagaccuuaguuugguuuccagcaugcaaauuagcagcuuacagcaaccuauaauuccaauucaggggaaugugaugcccuuuucucacucugagagcaaccuccccaacacauacaggaaaaaauaaaaauuaaaaaggaaagcaaaacacguuucucugaauauuuaauaguuuauuugauuagcaaaugggaaggcagcuacuuaaucaguuaagaagucuucuggcaagaaugaaaaagaaaagaaaaaaggaaggaaguucuuuccuggagaguaguacuuaaagcaagcugugggauaguuuaaaaaaaaacuuaaaaguccuuuuaaguuuaaaguaauuuucucugcuuagagucaaugacauaaaaaauggaugaguccacuuaaugguguuagccauucuuauaaaaguguuuaccuuaaguaaauguugauuuauauauaaucauugcaugcugggauauagacguauggacauaaugaggccaagaaguuaucaaucaucaugugagaaaucacguauauuggcuuguugaugagaaaguuaaucaugaacauuuuacaguaguacaguaguacuauaaaaacaguguauucuucuuaccuucuguggcgguuugcaugaaaauggucuccauagagcuucccuuguuguuggaacuguuugggaaggauuaggaggugugaccuuguuggauuucaaaagacuggauugguucccagugucucugcuuccuguuuguggaucaagauuugggggcucaguuacugcuccagugccaggccugccuaccugcugccauguucccugucaugauaguaauggacugcuaucucucuagaacuguaagaccaagauaaaccccuccuucuauaggcugucuuggacauaguguuuuaucacagcaacagaaaaguaccuaauaaaccuucauaauuguaauuguacuuccaacuuacuugcuuucuauugucccucauuagagcucagugaaaaccuggcuuccauugaugccaccccauugucauuguucuauuguaugcucuugggccaucaccaucgucaacuucagggaacuaguccuuucaguaaaugcuuuccucuugacauuuucccuauuuucucauuuagagauuucuauuuuauugcuaucuggaucucucaucagcacaaaacccuauuuaauuucuauauuaacaauacuaugauauggauuuuuguuuguuuguuuuguuuuuugagacaggguuucucuguguaguccuggcugucguggaacucuauagaacaggcuggccucgaacucauaaauccaccugccucugccucugaagugcugggauuaaaggcaugcuccaucaugcccggcuugauaaggauuuuuuuuuuuaaauucuuuuuuuuuuuagauuuauuuauugauuauagguaaguacacuguagcugucuucagacacuccagaagagggagucagaucucuuuacggaugguugugagccaccaugugguugcugggauuugaacucuggaccuucggaagagcagucgggugcucuuacccacugagccaucucaccagcccuugauaaggauuuuuaacaugaguauuuauuuaguuugauaccuccuucccuuggacuacaccuaguuuggguaaaucauuuacugcuauuacacuagcacuuauuuuuagaugauuuucugugucucuaauuauaaucucuacuuuuucuuuaguaugaaauuccugugcuggugauagggcucaguaugguaaaacacuugccauuaagcccagugaccugaguuagaucuccugaacucacaugguagaaggagagaacugacucuagcaaguuguuuugugacugucacauacauauauugcaggcauaugcgugugagugcacaugugugcaacacuuccuuuuuugaggaugacucuuauugcuugcaauggugucaccuaucuugggaugguuaguuaaugaagugagaauggggcugggaauaugauucauuuggaagacugauuucugagcauacaugaagcucugggcuuguuccccagcacagcauaaaccagauguaguugcuugagcccauaaucccaccaucugggagguagagacaggaagaccagauggaggccagccugaaaacagaauccaugcccaaaacuaguaaaaaaaaaaaaaaaaaaaaaaaaagaagaagaaagaaagaaagaaaggaaggaaggaagaaagaaaaagaaaaaguuuaaguauucauccaugaaacaaguauuuauguaccuauuaugugugagccaguaacaaggccaucuuuuaacuuaaauuuuaaaaauaugacuagguaaguauaagaaaauaguggccuuuguuuuucuuuuuaaagacuucaagguuuuacugauucuaauccuaauaugaacuuuuucuaugaagcauugguugcuaaggaaaguuauaaaauuuuagguuuccuugauagaaguauagaauccuguuagauuuuuccugguuacuauauuuacacaaauacuagauauguuuaccauuccuguacuuuaaaggacucuucgaaacaaacuuuuauuuacccaagucuuugccuuggucucaaguuuuggaucaugguugaaccucuaucuguuccagggagcuagucucugagauggcaaggaguuguauucaggcccaauauaaggaaauuagaguuuagaauuaggaaauugagacacauagcuuugauguggaagugcuuguagacacaaugauagaauaacacuuuaguuaggaagccagugagaaaauagcacagcaaauauaacacagcaaacaacauggacuaacagaagacaaggaaaaguauuuacauuugaaaauuaccuguauacucaucuuuuaagauaguaugaguugagauauggauuuuauagucuuucacauauaucuuuuucugaaacacuaagauguuaaaaauugacaaugucuagacaaugugaugaauuuuuacauuucacauuuuaugcaacucauuuuaaugaugcacauagaauaugaagauacuaagaaccuucucauuuauuuccuguuuucuuaugaguuauacuuagucaauacuagacagaugauaaaucucucacuguauuguaagagaacuuuuucuuuaaauugcuguuuaaacuaauucuucuucuucuccucuuccuccuucuucuucuucuucuucuucuucuucuucuucuuuuucuucuucuucuucuucuucuucuucuucuucuucuucuucuucuucuucuucuucuucuucuucucuccuccuccuccucuucuucuucuucuucuucuucuucuucuucuccuucuccuucuccuucuccuccuccucuuccuucuucuccccccccccucugugucucugugugacaaaugcauggguacccauggagggcagaagagaguguuagcuccccugggagcuggaguuacaggcaguugugagccaucucacaugggugcugggaacugaacuuagggucaccuggaaggcaagugcucuuaacugcugagccaucucuagccuucuaaugcccccccuuuuuuuuuuuuaccaaauaucacaguaauaaugauuguuaauuacucugaacccugaauuccauauuguagugaccuuugaaaagucuguuuuggggcuccuguacagagaugguaugcucuaaauguuaaaagcucguguuuuagcugggcauggugucagacagcauuugggaggcagggaccgaagguuuggcaauuugaggccagccugagcugcauagcaagacagaagagaggaguggggguccucgcugggaggguagagccaccgagagggagagugauuucucuaucuguuggucccugucaaaccaccaucaaguuuauuggcuuagcccagcaggacuucuguguaggcuucacagggcgaggacaucuacgauugguggaagucucaaggcugcagcugugcaggggcuccaguucuacccacacagccuucauggcaguuugggcuucauuaacugugcuaccugaguugcagcaggaggagguacaagugcagggcuucuaguaccacguucacuguguuggcuuggucaaaguagcuacaggacuaguucagauaucaacaugguuguugaaaaauacuucuuucuaauuucucauuuagaguucauaucagauauuuucuuccuggacaagguauuuuucugaaguucuggaggauuugaaaagaauaggggauggaaaugagaggcaggaucgccaucucuccuucuauuguccugucuuucccaacaggcacccuuagggcugguugccauagcaagcuguuccaacauguucuuauuuguccuuggauuaggcaaauguuuuauucaaaaauauuuccuugaguuaaaaaaaaaugcucaaauuucaguaaccagauaggugauuugugacuuacagggaaaccaggcuuacacaauggaugcugagagaaugccccugccuuuccuuagguguugaacaguuccuuuaugggcagcuagccucauggcauccucugcuucuuuauacauuuuauucagacucugaccuguaauauccagagcuggaaucaguuuuguucugugacauaauuugaacaguuaccucuacucuguuuucccgaauuucaccuuguaacugugagaacauucugacagcacuuaauuagcugucacaauuggcccuucuaacaggagagacgguucaaauguaaugauguggggcugguaagguggcucaguggguaaaugugcuccaagccugacacccuuagcucaaucccuggaacccacaaggccgguagagagaacuaacuccuacaaguuguccacucaccuucacauguacccaugccccaauaaaugaauaaauuuaaaaauucauuaucuaucacuguccaugaauugauugucaaaauaauaagaugauuauaaauaaagauuuuguuucacuuuguaaugaacaccugaugauguuauauaugaggguuauaggaaacuagaguaggaauaaagaaaauauuagcuuuauaguucaggauguuuuuguauucuucagauggaugaacuagucuacuuccauccuaggcuugaaaggcauuuuauaguaaaaagaaaguagauucauuucuguuuaugauuaaaucuuugcuucucaagguuugagcuauguaugccccaccuauaaccuuagcuacaaaugguucuguagugccuguugcaggaaacagcaacaaugguucuguagugccugucccaggaaaugacaaccacgucuuaguuucaaaaaguuguuaugacuaccuuguuagaacuacuugguugugcuguccuguaaccccaccuccccaauuccccauuuagaccuucucuagcccuuggaugaacaucuuacacauguucaaugcuugaaggcagggggaggcagccugugcacacuauuuuuuuuuaaagcuugcuuuaauuaauuccuugcuacaguuaauuuggccaugaugauuugguuagucuccuuauaucuuugggauuagcaaaaacaauuacaauguaguaugucuuuuggagauuaaaugaugaauuuuggucauagagugagaauacaguacaaugauauauuugggaauauuuuauuuuguuagaaauauagcaauuaauuucauacacuacacuuguuaaaugcuacuuagaaucuuacugaacugucuaauauaaucuuaacugcugugcuccagaacauauuugagaaaaauaggaaauuaguuacccagcagggaauuuguauuuuaauuuuguuccuuucaccuuugaaaagaaugaaacauuuaaaaaaaauguaagaguauauuuuugaauacuucuugcuauaaccaguuuuguaggaagccaacaguuauauaaugaaggcuuugcuguggugucacuagguuccauagucaguagacaugcagggguggauggaguagcgacugugcaaagucucuugcugcuggugguagacagaaagucucuaagccauuguuuuauucuguggucacuuuccauuuuucccuaccuagucuuuagugaugcuuuuaauuguaacuauggcucaucuuggagccagggccugguggaaaacauuguuuaaaacaaugagauaauguuaugcugcagacccuuuuggucccuugucugugugguucuggucacaggugggcaaggagucggugggaauugacagacuccacacgagagaguguggaucugaauguaauuugucaaaucgagcaucaaacuuuuuauacagaagaaaauagggaaguuuggugacacaccugcaccugcaagguacaaagagguuacuggauucuuaaacaaaacagaggaauacagacauggaagaucuggcaggaaccaacugggauaaaacucaauguuaacagcugggaucaaaaacagcuccaccuaagguccacuugaucuuagaagccaggagcaagggcuucaugcccuugccauaguuccuacucuagucuauuguauaguucaccuucccccuuaaauacuuguguauggguguaacucagcuaucuauaguucuaaguaucuacucugguuccucuuuaggucauaaacuuccuucuuccuagauaaugguaaauuuguguagggcagugacuuagcuauccaugcccaaggucagaucaaggacugccuagaaucuaacuuagcuauaugucaaaauaucaauccuuaggagcacuuguaauaaagcaauauuaagggaaagcacacagauccaucgacuaacuaaagcaaggacauuggagcauucuuuauacaggaugccacgauuccaggagacuaaguuuccaugaacuuuucgccuagggacagcgcccagguuuucggggccugucgcacuugucacuacuagaguggauguagcaaugcuauaaaugugggguagggacaagaaaaagcuucagucagccagccaauacuggugacuuuucuuuuucuguuucuuuaucuauccucuucuuuauagaauuacauuagacuuuuuccuauaaaauauauuaauuauucaggucucauuuuuaguauuaauauaucuuucuucuuaugaauuuuuuuuuaaugagagaagaguuucucuguguagcccuggcucuucuggaacuugcucuguagaccaggcuguccucaaacucagagaucugccugccucccaaaagcugggauuaaagguaugcgccaccauuaugauggaaaaauuuuuuaaagaucacuuugauacaacuaggaagaagucaaaguaucucuauuugcagauaugguuuuauacauaaaauacccuuaaaaaagaaguccaccgcuuccuguucuccaccauggcgcaagaucaaggggaaaaggagaaccccaugcgggaacugcgcauccgcaagcucugccucaauaucugcgucggggagagcggagacagacugacccgggcagccaagguguuggagcagcucacaggccagaccccgguguucuccaaagcuagauacacugucagguucuuuggcauccggagaaaugagaagauugcuguucacugcacaguugguggagccaaggcagaggaaauucuggagaaaggccugaaggugcgggaguaugaguugcggaaaaauaacuucucggauacuggaaacuuugguuuuggaauucaagaacacauuaaccugggcaucaaauauaacccaagcuuugggaucuacauccuggacgucuauguggugcuggguaggccaggguucagcaucgcagacaagaagcgcagagcaggcugcauuggggccucagaaucagcaaagaggaggccaugagcuggcuccagcgggaguaugaugggaucauccuuccugaaaaauaaacuuuauccaaaaaagccaauaaaauuuucucaggaaaaaaagaaauccaccaggaaaauucuacagcugauaaacauuuucagcaaaggagcaggauacaaaauuaauacacaaaagucucuaguuuucucauaugcaaaugucaaacagaacagacugagaaaaagccagauaccuuucacaauagccugaaaaaaaauaucaugggguaaccaaccaaguuaaagacuuguagaauaaaaacuuuuaagacauuaaagaaagaaaagaagaaagaaagauuaaagaaagaaaugaaggcauuaggagauggaaagaucccuuaugguucauggauuggcaggauuaauacagugaaaaugggcaucuagucaaaaacagucugcaguguuaguaaaggccauccaaauuccaacacaauucuuccuagagauggaaaggacaguugugucuagguagccaacguaguuaaaagccccugaaugauaaaagagcugcuggagggaucaccauucuucaucucaaauuguauuacagaacuaacuauaguauuaaaaccaguguguuauuagcauuaaaacagacauguugaucaauccacucaaauugcagacccagacagaaggccuauggauaccugaauguugacaaagaugcaaaacagacaaacaaacaaacaaacuggagaaaaaccagaaucuucuuugaaugguacugguacacuuggauggcugcauguagaagaaugcagauagguccauauuuaucaccuuucacaaaccucaacuccaaaugaguuaaggaucccaacguaagaccugguacccuagaucuuauagguggaaaaauggagacuagucuuaaacucaucagcacggaaaagacuuucugaauagcacaccaaugacauaggcacuaagaacaacauuuaaugaauaggaccucaugaagcugaagauacucaguuuggcaaaugguaucauccuuuagguaaagcagcaggcuacagaguuggaaacaaucuuuguacauccaauagagcagugguucucaaucuguggguugcaaucccuuugggggaguugaacgaccuuuccacaggagucaccuaugaccguccuguauaucagauguuuauauuaugaucauagcaacaaaaguaauuucauguuuggggucaccacaaccuaaagaacuguauugaagggucacagcauuaggaaguuugagauacacugcaauaggaauauauaaaguacauauaaagaauuaaaaauaaaaaaaaccugggcaucaagaaaaauaguccaguuuuaaaaaugggccacagaacuaagcagaaaguucucaagaagaaacacagauggcugaggaacacagauauugaacauccuuacucauuagagaacugucauuaaaacuacuuugagauugaguggccaaauuaaugaccaaaaucaauaacacaaaugacaguucaugcuggugaugaugugggggaaggggaaaucuuacuuauugcuggugggagugcaaguuuguacagucacuauagaaauuaguuuggugguguugcgguaaaucuccaacccaaauaugccccggcaaugaaaacacgauacaguuauuaugaauacaugcugugugccuagauugggcagaucuaccgcuauacuaccaucuuccacaucuaugagaccucuuagaacuugcgguuucuccaggccaugugcuucuguucagcuuuucuucgucuuccuccuccucugcaacaucucccucuuccauuuucuucucucuccauaccuucugcuccaccuucucuuuuaucugcccaaucaucagcugucccuuacuuuacaaauuaaggugggaagcagguuuauaggaaaucaccugagugcugacucuuguuuacagccacucacaagagaauggaauuaacaucagauauaauuagccccagagcuauccacaacauuucccccuuucuguccaauuaaaagacgauuuuaucucagauauaauugaacauaacuguucuuauuuuguaauuuauaaaguacaagagaccuaacacccaguccaucaucuuuguuauuaaauagacccucugucaucuauccuuacuuaaagacuccucuauaccuggcuaugucuugucuuuagauugaaugccaucugaaaccauccucucaaaucuguuucucucaaaguauaaagccuggguuggcuaagagacuauguaguuuuucaaccccaucagaaauccaagaaugacugauuucaacugaaaauauauaggaagccuaacacagcuuccaaaauuuagccaauuuauagaaaccacugaucacauggacagucccuuacuucaacaugauggagcaucggucuucagccuacuggccauggucaucugacagacuuagagaaacgggaauauuaaggacuagccuacucugucucugcagaaucaagcuguccuaaccuguaauuguauccuuucuuuggacaguuauuaugucuguagaugaaaagaggcaauucuugccuaguggcuguuuugccacaauuggaguaacucaaagaugcucaguuucuucuuugaauccaagacagggaaagcugucaggagcagacuugucucaacaacaacugaauaaaucauuauuaaacgucacauucuguggacuucugauguuuuugaaaaccaaccaucuaugugaaguaaucuaacuacacucagccauuucuaguuaaauaacugaaaacacccuaacaauaaacuaagagccaugaauuuccuauuuggcucuuaacucacaggcuuaaacaucucagaacuauuauaaucacagcaauagaaggacugggucuaagcccuguacuucaaaauuuucaguaucaaagacaaccuauaauaaucaccccuagccccaaagcuuagggaacugggaugauaacucuucauaacuucuucaagcugaauaugggcguugagauauuuuugaagggaggggaaagguuagggaaaugugggaguuaguuggccuuaagaaggccacaccaaugauuguauuagucucugauguccguguccugacuggauacagaugaaaaaccaagacaucaagaguucaggcaggucaguucaguaugucugacggugaaauucaccaaggcuguauauucuguaacauauaaaucucaaaacaaaauuuuaguaucaucaagauaaacuuuguuugauucucuggaaucuaauucaggggaucucccucuaucagaucugauccauagaacucuggaagguguaaauaccuuaaucaccuuguccaaaaacacuaagacaaaaccuuuuccccaaaucacauauccuucagccgaaaccaggaaaaccuguggcuugcccucugucccagaggaacaauaauaccacaauacucaaaaucacacacauuuuagccuauuuaggccuuucuaauuugucaugucagaauuuaaacccaaaauuuccauggggcccacauuagacagaauaugagucuccugcauggugguuccucaggaagcugggaaucaaucuaccucaagguccagccauaccauucuugggauguaaaggacuagacacccaguucuguagauccuugcucauccauuuucaccaaugcuuuauucacaauagcuaaaaaauaaaaacaaucucauuuuccuucaauugaaaauagauaaugaaaauaugguacauacauacuauggaauacuauucagguguaaagaaaaaugaacuuugcagguaaauggguagaacuagaaaaagaugauauugaaccagguaaccuagaaagauacaugaaagauaaguucucucacuggaggucccuagcuccaaaucuucagaugcaaguuaccuguaguaaguacagaaaccaggaaaguaaaacagaaccauuugcagauuagagaggcuggggaacaacagagggaauggcagggauucaagucaucugaucagggaaauaggaaaggagggcucuuuagcaagagggaagggaagaggauaaaaaugaucugaaaggacgcucuuuauggagggggaaguaauauaaaaggaagaaguaauauaaaaggaaguaauauaaaaggaaggugaaauaacaauaaggaugacugaaaaagcuacucagaaacauacuauuaacuauucaccuggaaaaaaucuauaauacauguaauuguguauauuaguaucaucuauaauuuuaaugaacuuuucuuauauggguuaauggugcucccuucaagagucaaagaccaccucacaaauaucaggcaugagaaacacucuuuugaauuguugaccagaacuguccaagacacuccuaaacuauucaaccuauuguuauuguccuugauuguuucccagagauagaagguaaauucuuuugcugaagacaccauguacuucagaaacagagcccagagacccuugaacuucagcugaccugaaucccuccuuuuucugagggcuaucuuucauggaaccaguaggcaucauguaagcuucuaaauaauggacccaaccaacagucuuacccagcuauaaugcccaggaacuacaucaacaaccagcauggcaagauaaccccaagggugcagugcugacacacuaccuuggcaguaaccaacagucuucuacguguucuuaagacuugcucagcaagagagaaacuaugccugguacuggacaccuaguuaacuacuaaguacuagugacuccacaguuguuagagggaaauccacaaccacuacuuucuuuuuuuuuuauuagauauuuucuucauuuacauuucaaaugcuauccccaaagcccccuauacccucccccugcccugcuccccaacccacccacucccgcuuccuggccccggcauuucccuguacuggggcauaugaucuucacaauaccaagggccucucuucccauugauggccgacuaggccauccucugcuacauaugcaacuagagacucagcucuuggggggggguguuuacugguuaguucauaauguuguuccaccuauaggguugcagaccccuuuagcuccuuggguacuuucucuagcuccuucauuaggggcccuguuuuccauccaauagaugacugugagcauccacuucuguauuugccagguauuggcauagacucacaagagagagcuaugucaggguccugucagcaaaaucuuucuggcauaugcaauagugucuggguuuggugguuguauaugagauggauccccagauggggcagucucuggauggucuuuccuucugucuuagcuccgaacuuugucucuguaacuccuuccauggguauuuuguuccccauucuaagaaggaacaaaguauccacacuuuggucuuccuucuucuugaguuucauguguuuugcaaauuguaucuuggauauucuaaguuucugggcuaauauccccuuaucagugagugcauaucauguguguucuuuugugauucacaaccacuacuuucuuaaaccagcauaaucaccaacaacaaucuauaaacauuugucuuuauacucaaauaaaguuaguguaguccucaccucucaucaaggaaacuucucuuucucauacauggaaaucacuacagaaaaccacaacccaucaguaugcaagauuguagagccuagucccaauggauauaucuacaaaacacucccaacccaaggcuuacagaacuugcagaaaggguagaaagauuuuaagaagaggaucuggaaguuugcugugagauggugucucuuaauaauaucagaagcuacauucauauaaggcuuaccaacaugacugcucagacaugaucugaaaaagaaugacaucaauggacaugccagugugggcagggaaaagcccauagggccucacugaaccuuacaaagggcuauaggcaacugaagaaagaugggaacugcagagaugaucuuucuuagggaagagcacaucaauuggcuguccagugugaaaaugugaacccagaaaacauacauacaaguaacauuauacagacuaagcagguuauauuuaagaaucuaucuaucuaucuaucuaucuaucuaucuaucuaucuaucuaucuaucuaucuaucuauccaucuauccauccaugcauucaguaacuaaugaaagaagaguccaugaauuugaagaaggaaagggauauaggggagagucuggaggaaggaaaguaaaagaaauucuggaauuauaauuucaaaauuuuucaaaaguuaaaaauaaucaccuugaaaggauuuuuuuuuauuuuugaccauguauacauuugguuucuucaaagcuuuacuuaagcugcaauugacaaauacaguuuguguauguuguacuccagagguaaaggcagcuggauuaugaguuugaggccagucuagaccagacccugucucaaaaaaaagaugugcauguuuauuauuauacuauguuucugauuuuuguuuguuuguuuguuuguuuccuauuuuugagaaaaagucuugcuauguaacccagacuuacuuuaaauucucuaugcaacccaggcuggccuugaauuuuccuaucucauccucccaagugcugguacuacaggguugaccaauauauuuugacauguccacauuguaaagugaugaaaucaaacagauuaagacuugcaccacuucacauacuuguuuuuguauguguggugagaaccuuucauaccugcucucuugacaguuuucauguaugccgaguggaaagauggaaugcacucuccuuguccagcauccucauuggucauuuccaugcuacucuguuucugaucuucagguuggcuuauuucuuaacauaguauccuccaggcacuggguugacuuuguaauauaaaacuauuauggguucugaguguugucaugcacacuguaaucucagcacuugggaaacuuaggcaagagaauggcuaagaguuugaugucagucuguguuacauaaugaguuuaaauccagucugagcuacauagcaagacacugucuuagaaauaaacagcaagggaaaaaagcuuauagaaggaaguguccuuuggguuuauggucucagacauauaggacucuuaucacagucaugguaggaaacauggcagcggccagucaauggugcuggagcaauagcugacagcucacaucucaauccacaaacaagaguagaaaguuaacuuaaaauggcaggagucuuccuuccucagagccaugccucuuaguucuccccaaacagccaugaacuggagaccaaguguucaaaugccagagauuuauggggaacaucuuauucaaacucacacugguauuaucagucuuucauucuagcuauauuugggguguguguguguaugugugugugugugagagagggggggagggagagagagggauagagagagacuuccuugaugacuagcaaaguugaauacuccuuucucauuuguuaaguuucugccugguuaagugguggucuuuuuuuccuauuggguuuucugcuuuuuucuuaaauuggucuuuauuauauucugauaugggacuuucaguugcguauguacauuaugaguugaguugaaaauaauuucuucuacucuauaauguugccugagccuuuuagugguaucuuuugaggaauaaauaauucguuuguuuguuugagacaggguuucucuguguagcccuggcuauucugaacucacccuguacaccaggcuggcaucaagccuugagaucuaccugccucugccucccaagugcugggauuaaaggcuugccaccacugcucaauuagaauaaaaaauuguuacauuuagugauaugcaauguauucuucucucaccuaugauaguccuuugugccuuugauuuaggagaucuaucccuauuccaacauuauaaagguccuuucuuacuuuuguuguuguuagaucuauaguucaacuagaaaugggcucugcauguaaugugaucuaggccaucauggcuagcugugacuggcuuucucccucccucccucccucccucccucccucccucccucccucccucccucccucccucccuuucuuuccuucuucugcccacucagcuguccaguuggccuagccacauuuauuuuagagauuguccuucccucacagaauugagaccauguauucugugguccucauguguucugugauauucacaaauggccguguauuuguaggucugcuucuguuagcauauuauucuguccucagagaacacuaugcuaauuuugaguuuguuagguucuacaguaaauucugcuaucugaaguccaggucuuccagcucuguuguuuucaaggccuugacuauccuguaccuuuugcacauccuauugauaucuucuuaauagcaucaaaauugaucuuaaucuuaacugcauuucuuuugaauuuucaugaaaaucuuaccaucccuauuauuugcaaugcuauauugaggccaauuccugauaccuuuuuauuauuuauuaagcaguagaauauaaaaagaaaacaucuguaucuacauauccucuguuucacaaauaaauacaaaaggcuauauaauggauauauaaugucaguagguagaggugggaagaaaaugaguaagaauguaaaguagcuuaaagccuaugauuacagcacugcugaaacaggaagguuguacaucugagggcagccagucuauagaguauaacccucucugagaaauaaccagccaacuggccaacuggccaaccagccaaccagccaaccagccaaccaacuagccaaccauccagccuaccaaccagccaaccaaccagccagcuaaccagccagccaaccagccagccagccacccaccuaaggcaaaacaaaaccaaaacagcccagcaacaacaugaaaggguguaguuaacuaaagcaaaggauaaaguuaauggagacuugccuuuuugguagacagagcagaaacuuugcuaucaacuuuauuagagucaaaagagaauuuuccccagucuugacauuugaagaugugauucccccucgcccccuguugacuuuuaaaggcaguaucugaucuagcagugcuuuggguaauauuugaacauaauuccaaacccgcuuaucuagacaguucuauaaaauacaaggcacaguacaaauguguguuuuucugauacucuugacuugauaaugggcuucuuuuuauuaaaagauaagcuaugcaucacucaagucaccauggauuaauuuauuuguuggcaagaacauguauuuuuccuuuaggguugucuauagacuuugaaagacagugggacccagguuaugcgaguuugugguguucuuuauuacugaguaagaacacuauugccaggcuccauaauaaguguuuuuaguugcagaauaaaauuuaauccaagaaacagugccuugcaauaggauguguaguuaacaaaucuuuugaagucuuuuucacaaguuuaagaugaucauguuugaaauuauacaaucaaaaguaaagaauguuugaauauuuuacaacuggcauuucugaaagcugaaugaaaauuguagaggcaguuuuauuauuuuauguuauuuacacuuuuguuagaauuuugcguuaagguuugccuaugggcauugcaacuaauuucccaaguaaggaguaacuagcugcaggaacaacucuguacaaaguauuaagacugaaauaaaauuaauucaaauauuucauacuuuucuguguucauuuucagguugaagguuugaaacaaauguggaaagauguucaccucagagauaggaguuguggaagaauggcugucagaauuuaagguaauaacaacucuucuaauacagaaauuuuauccuaaacaaauuuugucuggguuuaaauucuaaugguguuuuuauauuuuauaugccccacaugcuaaaucaucuguggggaaagaauauuauacugugucgcaguagggagcacuuauugcauaguaaucuuuuguggacgauuaauuccuuuuucccaagugacucaaagagcuuauucaucuguuuauucucuuccuuccaugugacauuaccauggccaugaauguugaugucacccuaguggccaucagugacccauugucagaaaugaagggaaguaguggaacuggacaugguugacagauaguagaaggcagcaagguauuuccuuaaucuucaccaagaggucuuuuucuagaaggcugaccuaggagcugugagaguagaguuaaucuuugacucauuggugaagaaaauaagauuagcuuuguggucucaugaacucuucucuaugguagcuaaacugucuuccuuaaaccagcuggcuuuuuucuccuguccucguggggcacuucauaauccuaaagcacagacaugaagagauugggcagcaaauguccuguggauuuuaucuggacuaaugagcccagacaucagggacagauuuacaauccaauagcacuaaguuuccuggcuuucugcagggaaggagaugauugcccaacaacagugacaucaccaaacaaaggaaaagauaaaauuuggauagcauuuggagaagaggcauuuuaggugaaauuuaaauaaagccauauuuugauaguuucauaccaaagcaggacuguguguaauguaaugaguuuuacaucuagucuggacuugcaaguggacucaggauccugcugucuuggucugaagccuucaucugugauggaaaccaaggcuucuccuccucggcagugauuuaaacucuggacaggaggggcaugugucguucuuacugauacacguucagaugacaaagucugugauuucagacagggauucucaguacguaagaguacaguaguagucacucagaggaguuguuccuauacuccaggugcuaagcaaccaugggagaagcugugaauccgguuaacugcuggcuuuaucugcagcuuuugucuaguccucgugaacaccagauaggcuuuguuacuuucuuagaaucuauugccaccaacugagugugcuucuuuggacuucucaauucaccacgaagcaguguggaauguagaaaaguacacuauuugacacuuuuugcaaauuuuaauauuuggauuaaauauaauauguacaucccucuugucaaauuuguaauggucauucaaggaguuuuuaagcuucuccucuucuucaaagguguuuauauguuuugcguacauugucaugauuucggagugagggccaguugauggaacuuuucugcuuuaacuguugaguaccauuuuuuuuuuuuuguagaccauucuuaugucaaagguggaaaagccaacauagccaguuacugauuccuuaagaaucacuuaaggggagugugcagagaagaguguuaaauacuggccaugggggagggggcaaugauuaugacaaauguuuaaaaccauagugccugugcuaguucuguuuaguucacuuugauacaaauguagucaucugaguagaggaauccuugauugagaaaaugccuccauaagaucaggcuguugaaucaggccuaguggcucaugccuuuaaucccagcacucaaaaagcaagaggcaggcagaucucugugaguucaaggccagccugaucuacaaaguggguuccagaauacccagggcuacauaaagaaacccugucucaaaaaccaaaauccaacccaaaacaaaaaaaauuggacugugguucagucuauagagaauuuucuuaauuaguuauugauggggaagaacacagcccauugugaguggugcuaucucuggacugaaugcccuggguucuauaagaaaacaggccgagcaaaccauguggaccaagccaguaagaagcaugcuuccauggccucugcaucagcuccugccuccauuuggaaguguaagccaaauaaaccuuuccuccccaacuugcuuugggucgugguguuuaucacagagauaggaaacccuaagauaaugccuaucugcuaauucuuucccauuccuccuguagugcugagauaucaaggggaugcacuagggaggacagagagggcaggcugcaguauuggcaguuguguguucuggugucugagggaacagaguaguugucugguuagcaagaagaugcagaggugacuuguacaagagcuagcuggagaggcuucauuggcagauuagugccaucgaauacauaaguacauauauuaaggauaugagaauuugauuuugcuuugucugagaaaggcacugcaaaaccuggaacggagauugucgauaagaaaucaaggagugggguuagaccagaguuggaagacugggugggaagcauggguucuaaagaugugucagauacgcaugugcauguguacauuucuuggugcugugcuuagaggaccuuguagguagugcacccucucgcauagcaauauagcaagcaccaagucuugcuuuacuaaauacugucuuccacuaaaagaaacuaagaguaugaaagcauaaaggcuucaucuaaguaaugcuuugucauuaggaugcauugcuguggcauaucaacauuuuguaaaguuuaaaaauuuaauauaaagauaaggaaacuuuuccaaugggagagggauugauggaauccuaggccacaugaaacaaaaagcaaugguguaauuccuucuucccuccucaaauuaaauucaccaaaauuccaaucaguuuguuucugugaugcuaugauguuuaaaugccuucaaauuuguauuguuaccaagucaaggaguuuccuaucccuugcuuaauuuggugagcauucugcaguauguuaauguguguugcacucagcuguugguuugauaaagaaaucgagauuaucagcaguaaaccaaguaacacaagguacaagaaugcgugggaacaaauauucuuuuuuuuuuuuuuuuuuuuuuugguuuuuugagacaggguuucucuauagcccuggcuguccuggaacucacucuguagaccaggcuggccucgaacucagaaauccgccuaccucugccucccgagugcugggauuaaaggcgugggccaccaugcccggcuagggaacaaauauucuaagugcucuuggaaugaggcuaccuuuucaaauuauugugaugugauacuauguguuuuaguuaaacauuuuaagacaggaauuuuguuuggauuuuuaauuuucauguacauguauacaugcggaaaaaagcuucuuauaccuuggagguggcugugccaccgcuggcuccugggacccgguguggauucugggcugagacucugcuccucuagaaggauagcaagaacucuuaacugcuggcugucuguccagcgcccacucuccuuuuuguguuuuguuuauuuuuuaaagacaaucccauuuuuggcccuuugggguuuuuguuguuuguuuguuuguuuguuuguuugaguagcacaucuuuggcaacaucauuguaacugacugagugggcagagagucagcaacaggucauggguucucaguucuagaagcaguuuacugaguaaaucauuacagcucagucaguagcauuacaaagguugccguaggugcugugcccuggucacaguuugaacuccuccuuucguaaucgaacucagcagccuccaaaacacagagacaguguaguuugcuuccuguaaaacguuauccgaaaauguacacacaauauaaacuccuguaaauuuuuuucuagugggcuggauaguuuggggggagggugaggguaggggggugugaagguacuugccaccaaauuugaugaccugaguuagagcccagaacccacagagacaacuaauuccucucacugauuguucagugacuacacacacauacacacuaaauaauaaauaauaaguaaauguaagaguuuaaaauaaaaucuugugauuggagaaaaacauucagucucuguacuagcuaagguguugguuguauguucuaaguagacacucauagucucuguacuagcuaacuuguugguauuauucucuaaguagacuaacaaagugacuaaacuagggucucaugaauaauuaauauuuucaaugacuuauuuguaaaaaaaaaguuucagauugcuuuguguauuuuauguagcagauucuaggcuccuaaguuuuucaauuuucugauacucaauauauggcucaaaaauccauuuucauguaugaagcuguugaaugggauuguucucuuuauugaaucuucacccaucugccugucuucuuccacccaauccaugucaccuccuuacauuuuaaaagccaucugccaaaugguacuuaaguaugaagcauucaacuuuuuucuuaaaauuucgucuccauucugcauucaacagcguaagaaacaugguaauugagaaggccgacaguucuugaguucaucugguccuuaagauuaguucuucaaagcaccauuuauuuuguuuuaauuuuuauguauuuaucuuaugccuauggguguuuugucugcaugcaugucuguguaccaugugcaugucuggcaccugcaaaagccaaaaggggaggugggaucccuugggacuggaguuauagauagcugugagucacuguguaggcacugagaguaggaaucaccccagguccucuggaaggccagucaggguucuuauguuaagccaucucucugucucccucguguagcaccguaagcgcaguaguuauacccuucccuuguguagaaaggugacuuuccucacauacaaaccaugagauagugaaggcauuuugagcuguauaugauggcugguuuugccucacugguuuuaaaggcuuucuuuucuuauuuaucaacagaagccccaggauucugcgcuucacagaguuugagauuuuagaaaagagauguacuuuuaacucuggcuauuucuuuuucucuuuuaaaaauauuuuacuuaauauuuauaugugcauguguauuuuaaucaacccuuccccacuucucuccccugcaguuccuuuccuauccuuccuucuuacuuuuucuccuaauuucauauguuuuuucuucuaaucuuuaaaauuuuuuuugaaauacucacuggguccauuuaguugugccuauauguguaggaugugggaccaucuacuggagcauagguagccagccucuuagggccagcaucccugagaaaauucacuuucucacaccccgcagccauuaauuacuaauugcuccucagaugggagagggacuucaugggccccucccucucccugcuaggacuucagcugcuugaucuugugcaaauccugugcugucucagaugcugugaguucccaugugcaacugaggcaucaugucugacaaauauuguuucacugcagacauccagucucucuggcucguacagucauuguuggugcuuacaguguucacaaguaaaacuucccuaguaagaugcauaaagccuuccagcacugagaacuaggaaguaaggcagcaucuaggaugguacaagcuuggcuuuuccauguccuauuauguagauaucugguaucuuuagcaguaggguuuuaccuuaaguucuggaggauauccaagagcaauagcaaacaaaacaaaacaaaaaacaaaaacauaccccaaaacaaaccaaacaaaaaucaccccucccccaaaccaaccaccaacaaacaacaaaaacccaagaacagaaaaauuaacccuggaauuaggaggggaguugucuaugugacccuauuaaguaacagcucaaaaggggguagcucauacaccuuagggggcugucgucauucuccauuauaagguagcucauuuuauauaugcagguguauguguuuacauuugaggagguuucuaugguagguuuccauaaaggccuuuaguguuggaagaaauggggugagggaugggaggacagggucagagagggagaugggaaggauaauaacccugaagccuguggcuucauacuuuaugugcucacauagacuccauagugugcuucacuugcuguguagauuaaaucgugugcuuugcacauaccuuuaggcuugcuuuaaugagauucgacagcugaugcuguuauauaaauuucuccaguauuagguuacucuugauuacaugacagaaauggaauguggccuggaggucuuuguuucucugccuuccggagcagggcaugggagcugcuuuugcuguuguggcuguugcugcuauuguucuggagaaugguggcaggcuuccaaaugcuucacauuuacucaccaugcugggaaacaaagcccuuauuaaaucagaaagaccuagucacuuacaugucuucaggcaaaauaggaccugguuuuaaagaguccagacaauguuaguuucaauucuuucugucccucagugcucucccagcaaaggucugaggcugaggcuuucuguugagugauggggauggagaggggaaaagacagcuuucccuugggaagaaagugaaguaagaaugaaucaaauaacccugcuguaagaagcgauacagcuuaauuuucuaugcauacuuaugcacacguaaaacuguguauuguagccacagcccauguuaaaucaugaaauacuugguuaugggauaugugugaucuggugcgugucuuagcauggcuguuaggagucuuugagaugcugucuguugugggagugagugagcagugauggggagacaaacacugcuaaugagauaagcucuaaaggauacguuuuauuauuguuacaguaaauuuucucuucaguuuuuuccugucaccuuuucacccaugcuuuugaguuacuacugagagucucugucuccauuccucucucugagcugaagaaguagugccaacaggcugugguugauggucuguauuuuaacuggcauuagcagaauuaauuuguggaaguacaguuccgaguuucccaguucugaggagucuauguauuuugccccaccugcaguuuagacucaucucuggcaguagcauggaacucaggaguauuuggacccgguggccugugguguacauguuagacacauuagcacauccucauggaccuaaggagaucuaucacuccugaugcucugaaggcggaacugucuuuacaugugguucaauauuguuucugaucuaaaccggcaguuaaagaugaaguuuucucauuugaaugucuauaaaugugugggcugcaugcguguguucauggguguuugcaugugugugggugcacuugcacaugugggagugcauguguagguccacaguugagacugaguaucuucuuugauuacuuugcacuuaacuaauggaggcagggucucugguugaacacggagcgcaccauuggcuagucuagcaagccagcuucccuugguaauguccuguccccgccuccagaguacugggacuaaagucagcaccaugccggcccagcuuugaugugggaccugggaauccuaauucugcucugcacgcuugugcagcaagugcuuuauguaccgagccauugcccugauuccaaucacgaguucugauggugauugacccuauugguaauaaaagaauaaaacuuuuuuuuaaauuugcuauuguugaguuauaaucuauaucacauaaaauucacugucuuaagugagaaugcaggguuaauuuuauuuuauuuauuuuuguucuuguucuuuugauauuuuuauaaaguuguaccaaacaccagcauggaauucuggaaacuaugucuuuuagucagucuuucuuuguuuccuuccuucuguguuaaugaccaauauauacuaauuuucuuuuguaugaauuugucugauuuagaauuucauaaaaauaauuuuuuuaauuuguuuagacacucccagaaacaucuuugccaaauuaugccacaaauuugaaagacaagaguucuuuaguuacaucucucuauaaaguuauccaggagccacagagugagguaaguacauuacaguuuguaugaauaauauucaguugauuauuuuuauuuaaacauaaaauauaacauacauguguaagguaagaaaauguauauauuugcaaaacaagaauaaaauuaauuucaguguaucauucuccagaaugaaaacuagaauccuuacuguauccccaaauccaucuuucuccguguucuccuucuguaugucucugagucuccauagccuuggaacgucuaagucgugcaaauaaucuuuuuucuucagcaaauauugaugugccugcuauaagccauuacuaugguggacauuaggggcucaaagagcagugaucuucaucauaagagaaaggugagagagacugaguaaccaugcagaacugcgucuuucuaugguuugcauggucguuaccucuaagagucaucugggaauguacuuaccacuguagcaaauacuaagaaaugggccugguggccggagagauggcucagcaguuaagaguacucacugcucuuccagagguccugaguucaauucccagcaacuacaugguggcucacaacuaucgguaaugggauccaaagcacucuucuagugugugucugaagacagcugcaguguacucauauaaauaaaaaauaaauaaaucuuuuuaaaaagagagaaagaaaugggccugggauaugguucagugggagagcucuugccuagcauacacuagguccuggguucaguuguuagcauaacgagcaggagaaaacacugggacgaauaugggguuggugcuguucgcaaggugaguuuggcuuccuuagcuuucuuaccugucugucuuuuguugugaggugauguuuuggucuuaggcuacucaaucugcagagcugggaaggaaugcauucuuuauaaguuaccaggugucauagcaacaacaacaaccaaaacaccaggccagggacaaauacagcuuuuccauguagcaaguaaaacaaacacuccuagcagcagggaaguguaggagauuggaggugcaaagcauucgcugaauuuugccguuuggucugcuagugccuuuccuguucugggacuagaaggagacagcucuggaguagauagaaaggagauaacuugcauaauuccuuuuguuuuugaguuuaggaaaagaugugacagguuuaaagucaaucucaaucucugucucucugucaucugccucugucucucugucugucaucugccucugucucucugucugucaucggccucugucucucucucugucugucucucauccccaccccccuuucucagcagggucuuacuuuguaacccuggcuguccuagaacucacuauauagucuaggcuggccucaaauucauggagagccaucuaccccugccucuccugaacccuggcauugcuggccugccacgaaucucuauucagugguagguaacauauguggauccaugggccuuugcaaccagacugugcacuccaggagcuaguguuauuugaguaauuaauuuguguuggcaggaguauagaguagccuagacucuacuuacugugcuguggcguucacugugaaugagauucuagugggcuuagagauuuucccgacaggccauuagacuucaucuggaguaauugagucagaguugugcuugccuugucuuuucuucaccaagcugcuuuccucuuuuuucuuguugcccaggcuuccuuuagaagcagcacugaacuuccaacaaguuugagcuguguuuucauagggaaauauauuccaaaaugucaccgagccauuagcaacccagcauguucaaucaccaccguaaaauacauucauguuaccuaggccuguauuucucacauuauauaguauuguuuucugacauuuguaaacuucagcucuuucuccuuucuggcucuuauguguacuguccaucaugaucuugccuuucugucuccauuuccuuauauggaaaaguguggcuagucauagucuacuuacaguagagugggaauugauccuguuucuguauaaauagugcuuugcaagcuguaaaacaucaaacagauguugguguugauuuguaucggcuuuaagugaauaauuuuaaucuuuuugcaacauggucuuuuucuuuucuuuaaaucuguuuucacuuaauuaugcuuucauuagguaaaagcuuuuaauuuuggauuuaaaacuggucauaaagacuuugaguauauuuugauuacaguugauuauguguucguacagagugucuuaaaugaauuuucuagcaagguuuauaauugaaaaugcuuguugaacuuaacaagcuucguuauugauucaauucaagcuugcuuggggauuuggaaaugugagugcuggggcacagagagaguauuggagcacagagcagagccacuuuguucuguuugagacagucgaaccugugcuuucuaaugccaccaccacugugagguggaaaaaauacccuaugagugaguacugccagaagguagauaauuuuuuuuuuuuuuuaaaaaaaacaggguuucucugugaccuucauuguccugaaacucacacuggcuggccucgaacucacagagauucaccugccucugccucugccucugcccucccccaccaucugccucccaaaguguugggauuaaaggcaugcaccacuuuaaaaacagucugcuugucucauuugcuuuuuuuuuuuuuuuugccacagagaauagaacccccagccuugggugugcuaggcaaaagcagucugugucggagccacauuccaaggccugguuuuagaagaggauaguugaacuugcuccuuacucuacuuacuuagucuguuugaaauaaacauuuacacuacucauuugguuucucuuuguuguaauuauugguaauagaaagcugcuuggugucuugauuuaaucugcugcuuguuaaugaaauauguaguuuguucagguuuccuugaaaaccacuaccugccacucuccugacgcguucgaccauguuuuguguuugaccgaaauguaugacuuaaaggaacgcuugacagauaugagaguuucuuaacuugcuuuucugguuuuuaagagucuuuaauaaagauauaguuagugcuacuaacauaauuuaauugggaguauagugugaaagaaaagggcuauagaagauuuuaauuuaugcauaaaacgcagggacaguaaccauggcuuuaacaauggguuggguguaauggcucuguaacugucuucacacuaggcuucacacacaugggagcaagcugugggcuuguucccguuuuaguucuuucugcccugcagacaaacccuuauauguugacuucuagucuauuaagaagaaaggcgguaaggaagaggcuuccaacagcuuagccaagauguaagaacagggccugaggaaggguagcugugaguagagaguagcucgcagugguagagcaucuugcugacauguugcaguguaccgccacuagaaucuaaacuuucugggauagcuggccagugacugguuuuacuucaagaaaguuaaaacauuugucuauuucaaacaaaaccauuuugagaaaccuugcuuaauuccuacaguggugccaucacauccauguuuaccguguccccuucuugcaguuacuagagcccgugugucaccagcucuuugaguucuaccgcaguggggaggagcagcugcugcgcuucacucugcaguuccucccggagcugauguggugcuaccucgccgugucggccagcagagaugugcacagcagcggcugcauugaggcucuccugcuggggguuuacaaccugguuuguauucacagaguaaccaugugcuuuuuggaaaacugcuuuucguuuuaguaaaacuacuauucauuuaaaagaacaaagaaccuaaggguauuggggcacacauauaauuaucuaaacaaauuuuuauggguugaaugaaauaauaguaauagugauuuaauaauaaugagaaaaauaccaccaccagugggguuugguuuuauuuuauuuuauuuugagacagggucucacaguguagcccugacuggcuuugaacauguuacuuagaauaaauagacuguccucaaacucagagaccugccugucuuucaggugcuaggauuaaaggcgugugcugccaugccuaauuacugcuauuguggaaucuuuaauuucaacaucuguuuaagugcaucuuuaagcugguuuuugccuucacacacacacacacacacacacacacacacacacacacacacacacacacacacacacacacacacucacagccaguagaaagaccuaagaugagauucacuagucacaccuuggaagucccaugucuccugagcacgugcacuguaucuaacaguuugugugacuccgccugaguaucaguucugacugacauucugaauacuuacggauuguguucuuuaagauggaaaggagaggugagguccuucuguagacacauggcauguuugauugacuuagagacuauaacuuguuaguacagaacagucacuacacugucugugccucagccaucccgagaacagugggacuuuaaugucguuggacauuuucuauguggucugcuaugcuuuuguuuugaaaaugcaacaguacacauguuaccuacugaugcuaaugguaacugauaauggaguuuuaacugucuuuaaauuccuuuaauucuggucuuuaaaaauugucuuagagggaagaaaggggagggagagauguuguaauuauaaccucaaaaaauuaaaccuggauaaauuguccuaauaacuaaauuuuauuuuuaaaauguugcaugcaaaaggugacuuuuaagauauuuccuuuuacuuuuguaggaaauaguugacaaacacggacauaguaaaguauugaguuuuacaauuccaucuuuauccaaaccaucuguauaucaugaaguaaguaguuuuuuaucaaaguacauuuguuggguccuaagcuccaauaguccccuaaguuaggguguaguuaccugugcacagaagugaauuguuaguaccucaaaagguauugaucaucaccacauggaguguuuacucuuucaaaagagaagucaaaaaucacuaaagaacugaacuaagaucugacagugagagccuuaucaaaagcacuuuuuaucuuuguauaaugaguaaggcuugucuuaauuugugucugcauguggggugaguggauaauuguguacucugugauugaauuuuggaaauuuaaauuuugauuuucauuuguaguuuaguuuuaacuuguuauuaaaucuugggguggaaaugugacaggcagucugaauaucccuaagcuaaaugguacaccuaguaggcacucuccaugcuuugugcauucuuaguaucaccuucaacaaaacagcaucucuucucuagccuuccagcauugggucuauggcgcugacggagagugcgcugucccagcauggcuuaucaaaagucguguacaguggaccccauccucaacgggagaugcugacagcacagaacagguauacugcaaaggcacaauucuccuagcaugccaaguuguuuaaaaauuguuucaguaaauuuauaauguuuagugaguuaaauguaacucuguggauaucaagccauuuuagaaaagaaucagacauaccuagauucggcccugugcuuugcugcaggcauuaucuggaguuuggaggaugcaggacuguuacuugcagccuucugucuccuuugaguuuccuuacugugucuguaauguguaagccugguucugcugcacaaggucaguuaacauuccuuugguuugucuucagguuugaaguauugacauuccuucugcuguguuacaaugcugccuuaaccuacaugcccagugucucucuucagucacugugucagauuuguucaagguaaaccagauguccuagcuuucuaauccugggguauaugaauguaagacuacuaauuuguugcauaccuaaguuauuguugugugauuguugguuuaaagcauuauauaagucaaaguacacugcagccuacugagcacauagacagugguuuagaaauaguagccaucaaaaagcacaggcaugacuauccaacugaauaguguuugguguaauggugagucagaagggguuauguuaccuucacaacaaugacauggcaaucauuuuuuaauuuguggaauaugauuggguauuucuuuuuaucuugcuugccuuuauuuauccauauuuacuguguucuaguuuuaugucaaaaaaauaagaaaacauggcauuaugguuuuucuucauuuaaaaaauagagguaaauauguugguuauugggauauauuaugcagcacuaaaauaugaguguaaauggguguucuguuugcaguaaaaguugguuuauucuacuugcaguuauuuuuuccucaguuucccuacuuauuuuguuuuugguacuaaagaguuuugaguuucuugcaauguccaaugaucuuauguucauccuuugaauuaaaggccuuuuaagaaaacauuuguggggccuugacagaucgcuuaucaguuaagagugcuucuuaacauuggauggcucacaacuaccauaacugcaguuccagaagauccaaagcacuuuucuggacuccuugggcgcagacacacaugcccuuacacagagagacacacauacacaaaaauaaaaauaagucugaaaaagaaaauauuuuuaauauuugagauguuuuucaggaaauuuugacuuuuacauauguguguguguguguguguguguguguguguguguguguguguaggugcacaggguaggcuguggaagucaggauaaugcucaggagucaguucucccucccucucuucaccuuuugggaugcugggauugaacucaagucgccagguuuagugauuagugucuccacuugacgagccaacucagcagcuccagccugggacuuuguggugguagugcugucuacacauagaggucagucguauuaauucauuaaugugcuaucaaguugggacuguaucacuccugacacaaagugagaaagcagccauuuucuaguaaguuaccuaaaaauagaaacuucuuguuucucuuuaaguuuguguugaugauagacauuuuaggcaauacauauauacacaaggaaggaaaacaggucugcaaucccauaacucuagcuuucucugagaaauauugugugccuguuuauuaauugcauacaagcugagaucaugcaugcuccauguguuguuuuugcaauuucacacgacccccauuauuuagguagacacucccacaaacacuagggcuggaauucagggcuucacacaugcuaggcaagcacuccuuuaacaggcucuuugcagacaggcucucuuuguauggcccuggccauccugggccuuucucuauagaccaggcuggccugaacucacugaaauacaccugucucaaaggaugcacuaccaccacccugcuccuaaggagauuuuuaaaagcacaguuuaauugcauuauagugugcugacuaguguauauaacugguucuguguugguaguucagaggcaggccucugagcuacggcucacuugucgcuggcacugcuucucaucauaaguguuuuguuugccugaauuuuauguaaguuauuuucuuuggaaaaaaaaacaaacuugcaaacccugcugauuucuguuuagaauucucucaaggguguuguguuuagauacguuguaaacaguauaaaacugccuguacuuuauuucuuauauguuuuuuagcauuauuauuauuauuuagcuucuuuuucaagacaagacuuuuacuauguagcccuggcuguccaggaacucacucuguagaccaggcugacuuugaacucacaaagauccaccugccucugccuaccaggugcugggauuaaaggugugcaucccuaugucugggaagagcauuacaauuuuuuaucugucugaaauuuguaauggauauuuuaugaagcuuuauucuggguuauaguaauuuuuccgauaauaaguuuguaccaagaauuuaaucaggaguuaaagauuauacuaaagaucuguuaaugguaaguuccauguaauguccccagaguuacugauaauugaguugaucaaaauuaguaaaccaaccagugagcgugugacucaccaacuguguacacugccugccuugggcuuuaccgucucuuaccaguauaucauauucagggaaauguuacaggcauucugauccgaagauuguuuuguagauacuagauuuguuauuucuauuguugguucauagauauuagagaaucaucugcacuuaacaaauacguuuccuuccaucuucccagaauaugugucuguggcuauccccgacaacauguaagaaaauacagaggugugagcagcaggauaccgauuucauccggcuucauggugcagaugcuaacaggaguguauuuugccauguaagugugucucauauaaaaagcagaaaaaaaggaguucuauucuaugcagccauaugaagagaggaacaaauuauaaaagacaagagggauacauagccacagucugccucucauagcucugucauucauugucucugcuccagucucucuugcaagauguggugacaaguugucagacuauugacuugaauuccuggaagacaagcucccuguccagcaggcacugcagcccaaguccuucucugccagcgagaggcucuuggggagauugcaguuucuugggguucacagacagcuucagugggcuuacagcuaaagggagggacacaagugucucucucugcacuugccaggauggugucagcaggguuguuauacuguugccauaguuacauucuggguaaccucuacaaguuucccuacuuuuaccuaguauuugggugggagcuggauugcuggcgaguuuuccuccuuuagguuucucuguaugccugucccucagagggggucuccucucccauuuuuaggcccuccuucagcaauagaacgcuguugcuagcuagcccgcccuucaccuacuguagcacuugggagagcagguccugcaccucaccugggugguacaguagaacuggcccuggaggugggaggggggcaugggugagcuagccuggagggcaugagcacaggagagcuagcucuaccgcuugcuggcuguggcauuugaagagcuagccagggcaguacuggagagcuggcccugauggcuugggugugggagaucuagcaggcugacuaacucagcuaccacccaggcccagauccaggacuaugaguugucccacccagcauccaccccaucuaugagcugcuggagugcaaagcugcaggaucuccacagcagaagccaacaacaggauaucugagaggagacccagugaggagccucuauugcuaguguagaagaagccagagaccuugaaccagaccagugacucauuguaaugaacauuugcaagugaagacuauggauaaaaguacaaagggacauacccugugacacacugaagcuucuaccaugugauaggguuuuuguuuguuuuguuguuuucuguguuuuuuuuucccuuuuugggaggguguugcaagggcagauuugaagggauggggagaugaaugggguuggagugcaugauaugaaauccagagagaaucaacacauaaaaaaaaaaggaaaggaaaggaaaggaaaggaaaggaaaggaaaggaaaggaaaggaaaggggaaaaggggggaaaggggggaaaagggggaaaaaggggggaaaggggggaaaagggaaaaacaaaagggggaggggaaggaaaggaaaggaaaggaaaggaaaggaaaggaaaggaaaggaaaggaaaggaaaggaaaggaaaggaaaggaaaggaaaggaaaaggaaaagaaaggaaaggaaaggaaaggaaaggaaaaagaaagauagccugguaauaggauuggcucaucucuccccaaaagcuguacaacuuuuguucauaugaaaaaagugucuggcaggccugugcuuuucccauggcaguggccacucugcuccuucaagccugcaccaucaaaggccaccuuuucugguccccauucugcuucccguguuucuugcugaugccuauauaggaggccugggaaaguccaugaacaguccauguauaugcuccagggguuguaagcucugcuaccuccagagccagcguugugcuguacuagaaucuguuggagagcuaaguuacuucccaucugaugcuuauagccucccccucuuggccucagaaguuugguugcucucccucggcucugugauggguucauuaaaaguuaccauuuugaagauaaccugaguuuaucuuggcuuucagaugggaauaaugcuuucacuauugagccucucuugugcucuugauguaauucaugcgucuuuauuuuguugacagagaccauuauaugucuguugacuuggaugacucaguugauuuuaggauguguuugauauaucacugaaaguugaacauauguaauacacacaugcugaauuucuuaucucuuguguuugcaacaugcuuuauguuccuuucuaaaugggcuucaggaggcaaagcagcagcuacauaggaaaguggguaggcuuggguucucaguaaaaccaugggaacuacaugguaauuuguccauaauuguucagaaaauuauucuaaaguauauaguuuauuauguucugaauuacuuugacaguguaagaugccugaaauugccuuagcucuuugauuucuguucuauaaauacucauguuccuuagagaagaaacguacauguauaaaauuuuauuugcuauuaauagguguucagauaauaggaacuuuaaacauaauuuuuaaggagaauagaauguuaagcaaugugcaaauguggucuguugcuuucuuuaguagagauaaauaguuccucauuauguuuuguuuuguuauauaggauaaauuaaaaauaaugcuuuaacucccauauuuugcagauacaauggagaaugggaucuagcucagaaagcacuggaugacauuauauacagagcccagcuagaauuguauccagagccucugcugguagguucugcacuuaauuaugcaauuuuuaacuuauaauuguuuaguuuaaaacuaugcauugagaaguaauucauagcauaugaaaugccuuuaauaagaaauaucacauuuaaauguguuuguauggggcuuuagaguuggcucaaugguuaagagcacugucuauucuuccagagguccugaguucaauucccagcaaccacaugguggcuuacaaucauauuuaauggaauccaaugcccuuuucuggcaugcaugaagacaguguguguguguguguguguguguguguguguguguguguguguguguguguguaugcuuguauaagcugcuugugguguacaccuuuaaucccagcacuugggagacagaggcaagccucugaguucggggccagccuggucuauagugugaguuccaggacagccaugacuacacagagaaacccugucucaaaaaacaaacaaacaaaaagcacuuguauaaaauuuggagauuuaauuaaacuaacuuaagauauuuaacugaucauacucucuucugcuuaucagaauuucagcuuacuaacacaucuuugucaguuagcauuugcaacugagaaagaaaccuaguuuaauauuuacgaaucacaaagugcauuccuucauagugucuugaaguauaagcaucugucuggcucucuuacccccuauuuaggaggguuagguaucaucauauugaaauaccuuggggaaauauucuccuugugaauuuguuaaugcuuagccuuauauuuuaucuaaaaguaaauaaugcaucuauuuaccaaucuuaaagauuuuuuuuccuuguagguugcuaaugcaauaaaggcuucauugccucauggugccaugaaaucuaguaaggaagguacaagguguauucaaguggagaucacaccaaccuccucuagaauaucaagaaaugcaguuaccagcaugucaauacgaggucacagguggaaaagacaugguaagcacuccucggguccgagcacggcuggcucuuucccauggcgcucugcagcuguggugguagacccuguaaccuuaggaaagcaccgucggagccuaguaaacaaagccccuagguucucauccagggacacagucgagagugugacacuucuuguguuaggcauaugaaugaagaauacuuaaaguuuacuuauugcaguagagcaggaagguacuuuagguugccaaucuuagguagcuguaugcaaucgcagacagucucuugcucagucaggcaucacaaugcaaguuuuuucguguuggaguagaaguacccaccagugaccuuccacucugucggaacucccugguaaagagugccaugcugucgauacacuagacauuucugauuuacaaauucauuuucauucaagauuauauuaguuuucuuucuuaccugcuuuauuuuacuguauuaaaguguugcuggaaguuaagugcauucaccaugcauccccgugcuuugccacuucccucucuucuccuuuaaucuccuccuuauuccaucccuucuuccuguuauaccuucucuccucucuaaccaagaggagagucagacgaguaacgccaccuuccucaaaaaugaccgucagcaccgcuuugccccgugcgugcuccgugcacgugguuaagagacccacucugcuuucuuccuccucugcacugccgugaaaguggcagcucagccugggagacugcgucauagccgcgcuccgguggcccacagaggaaagggaaagggaaggaugucacagguuguaacauagaaaacugauccugaccuugaaggcuugccacuuccccucagacacucugaaagaauaugccgggaaagagggugauguuacuguuuaaccaagggccauugcugaucuacucauuuuuaaaauuacucugugaauccucaagguccaacagggagucauaaaagaguuugugauauuugcuauuaggcaacuacaaaaugcauacaaaauccauuuaaacaugccgaguccaaacauccuuccauuucuucagugaaguuaugcuguuaaaugagaauaaacuauagaaggaaaguaacuuaguggacacccccucaccgugugaaagcaggcgcaggugcagcagacugggcugcacuggccccgagagcacucccaaacuacugcugcagagcagaggcguguaagaggggguucucaggcgcuucugccuuccuucucaguguuuacauggggagugggugggggaauguggguugcacaauucaaacaugagaaauauugaagcucccucgagugugugugugugugugugugugugugugugugugugacugacugugcgcacacgcgcaguuuuggauuuucaagaaagaaauacauauccuuuaacaagauggacauuacuuuucagaaacauuuuguaggaaaaaaaaugaccaaaacaagaaaaaagaguccuuacauauauugggucucugacgcccuuguggaucuaggaucuguuuugguugccccuugcagacugucucaggcuacaacuucauuaaagaagcccuugcauuaccuguuccuuuauguuuauucagcuucacugcacuugagugccuccuguuuaugauagcaaaagugucauaauugaggauauaaaagagaauggacuaucaaaagaaaagaggcacacucaugagcaguuagagugugggcugcagcgccugaguucucacucucugggaugugaaugacucccauccacugggcuguaauaaaugguacuugcuuagucuuacuugacucuuuauagguaggcugcagcauccuucucaaggauaguuagucuuaaucuuuauucuggcuuccuguguuucuauugcaguaacaaaauacccuaaacaccuugcacugggccccacuucugaaggguccccugccucacacacugccacacuaggcuuaccuagcacccagcacccaagccacguggaaaccacacguuccugaagcauugcucaggaaguuuccauguuucugcaugucugugauuucugccuggacauauuauuguucugcuuucgaacaggcaguaguuucuuguggagaggaugguuaucauuguauacuucuuaaauauauagacaaucucgauuuaaaaguagauuuaaaauuuucuucauauguaaaauuuuauguauuguauuuucuguaacaaaaucaaaguaaaacauuucuuaagaaacaguaugaaaggacauguagaucccagcgugagccacaguggccauucuguauugucauguuucugaagcauaguacuaucgaggucacuugaggucaugacugaagacugcgagugccuguguuugaugggauccuggguaagcgcuccauucagcucaucuccccacucugccacagccauccccaugggaggaagggcuagggcuuuguaaccaugcacgaguggugauggagccuggauggagcaggaaaagcagcacucacuguaaggaauugucugcuucugucuuccugacuccuucuguuuuccacaugugacaaggacuaaagcauaucuuuucuguugagcuuuguucucuucuguugcugggaggagacgcuaugaugaaggccacauauagaagauagaguucacuggggucuugcaguuccaaaaguccguggucuucauggggaacauggcagcgguuaggcaggcaagguccuggggaguagcugggagcucacaucugauccacaagcaggaaggaaggagggagggagggagggagggagggagggagggagggagggagggagggagggagggagggagggagggaagggagggagggaggaaggaaggaaggaaggaaggaaggaaggaggaaggaaggaaggaaggaaggaaggaaggaaggaaggaaggaaggaaggaaggaaggaaggaaggaaggaagacagagagcuuacugggaauggcaugggcuuuaaaaccuccaagcccacucacucccagugacucaucucaaacaaggccacacuucauaaucccaaaccuuuccacccaccagacaccaagcauucaaauauaugaaccuauuuucauuaucucccugucuguucuuagccaccuucuacccuugccaccaacccccaaaggaaaacaauacauacauacauacauacauacauacauacauacauacauacauacauacauaaacccacaucccgccaauucaaaacaccacaguugcugugcaaaaauacccugaaaacauauuuaaggaaaggggguuucuuuuggcucacaguuggagggugcagucaucacauagcaggagugcaggcaaggcagcuaggaagaagacauauggagagugcucgcucaccuucuucuuuccaccacuuagccucagugcagagcaugcuacuaccuaggguggguggguuuccacucuguaaccuagaagacaagcauccaucagaggccagugucccaggugacucucaagcucaucagauggacgugugacucguggcugaccuuggcuuguuguugugcacuuuccuguccuugcugccgucuaucccucuuuuuacaucaggcuagaggaaggagugggugggggcugcucccacugagcaggcagacaggguuuucuuuaugacuuuucuuccuuuuuuaucacucagguaagcuguguaggcauagugguuuguauguguaucagagucaucaaagauuacacauagcaaacaaagacauucaauuuaagcaauucaucacauugauucuuuucuacuauuaguacaaucuauucuucuaguccaaacucauggucuguuuuuuauuauuuauuuuggaccauuuaaauuacuucuggaugcucugaaaugagugugguguucuuuccucaagaauugcccacggcucauauugcuaugggaaauauccuaaugaaggcagcaccuacuuucaucuuaacauuugcuggcauuccaggacccagaugucuucagucacccacugucagcagcaccacaguggccugaaggcccgggguucacauaugaucauaauuccuccugauuucaacacaguggaguaguaacaguaacauuucuuuuuaaagaaauguauuacacaacuaauugcauguugaccugaucuccacauuuuuuacuuggugaauuuaauauuguaaugaaucaguuuaguucaguguugugucuuucaaguucuucaagucucugggaaaguuguaaugacucaugagugucugugucugcucuuaaauguggaaauggacuuagagugcacaguuccugcuuugacuuuuuauaaccucauggcuaauguccuuauuuaucugaugauaauguaacuuuccaagccagucguuuccuggauuuuguggugauggguaauucaaggcaaaaguauauuuucaaacauagauuuuuaaagcacuuauauguugacagcuauguagaaaauaaaaggcagguagaagaaggaaaauaagaguacacuuaaagagaggaacuuuaagauaaauagguuguaaugauaaaaauagucaaaaaaugaaaauucugauaagaaagauaagcuaagauauuuauaaaagcaguagcauuauuuaaaaaaacaauaagggcaguuuuacuuaaauauuuucuuuuaaaauguuuuaauuuuauuuuuaauuuauuuuguacauuccauauuucauuccccauuguuccccauccacuccccgacugcuccauaucccacaccuccucccuaccccaccugaccucuaaucucccugggccuccagucucuugaggguuaggugcuucaucucugaguggacacagaccuggaaguccucuacuguauguguguugggggccucauaucagcuggcguaugcugucuguuuggugguccagaauuugaaagaucucgaagguccagauuaauuaagacugcugggccuccuauagaaucgcccuucucagcuucuuccagccuuucccuaccuaauucaacaacaggggucagcagcuucugcccauugguugggugcaaauaacuccuucugacucuuucagcugcuuguugggucuuucagaaggcagucauaauaggacgcuuuuaccugaucugguauugggugagggaaauaauuucuuuuaaaaaaaaaaagauaggaagaaaaggaaaacacagcaugucuuugcaccucauucuguggucaugugagugucugugaaacuagcggcagaugugcaacuccaaccuugaccccagagcugcaggcacugggauuccacucacugccuguccuucucaccuggcucccuucucacagcucucucucccagagcaaacggaacuccugucuuuauuuguuuaccacaaccaacaccauugugacucguucuuccuccacuuuaaaaaaaauuacccacaugggaacaacauaagcuauuuuccauucuuuggaaaugguuacugaaaucacacuuccauuuuaucuaaguccccuaauuaaguuaggggacuggcaagugguugcaaauaaugagcauggaaaacuuugucagcuaguaucuaaagauccacugaacccccaagucguugucaucucuguccccuuuccucugugugucuguccagucacgggggcaguaaggaaagagcauuuuguauacuuugaagugcuacauaaaggcugaguuuaaaucggccaaagguugacuucguucuauaagaauugcuuuguuagcuauccagcaauuguguucuugguaaauuuaaauuggauaauuugccauucaaauaauaguccuuuucuaaaacuuaaauuuugaauuuucucaacuugaaauuaaugugcuuaguuugagagugcuagcaggcgugaacgcaugcacauguuacagagcucggacagaaugucuguuuugcugcuguuccuguggaggugggaggugcccacuaguacuugacaugucauuguuagaaugaguauauuuuaacuaucuaauaccucguaucuuacuucaucuuguuaaugucaaaauaggaaauagaucccacuuguguucuugguuauuuacacuuaaaaccguuugcaucaggaaaguguugacaguaaaaaagaaugaaaaucauauuucuaaaguggagcuucugagcguuacccugcuuguggcucuagcacauacuaaauguuuaaugcuagcaauaguuuaguuuccuuucagaggugggagggauuaaauuugaggaagaagcuauguaguaguccagguuggccucaaacucaaaaggccccuucuucagccucuuagguaccaacauauuuggauacuuucaauuagcacuacuucuaaauuauuuugacauacauuuuagaagauuacaagcuuuuaagguugugaaaaggaauuauaaauaagaaguaauauguauuuuuacauuuucuaacaugauuaucaaaagcaaauaccuugaaaguauuagaauguuguacucuauggaagaaucagauugauacaguuuaaauauauugagcccaaagaaaguacagucacaaguuauuacagcaagcaguuuacuuuuuuuauauauaauuuuggcuuauaaaauguuuuuauuuauuggauaccaugauacuuaaagcuaagcaagauaacauaguucaaagagaauuguaauuauguuacaaaaauaucagcaaaagugguccaugucauaauuugcuuagugauuaaguacugucuucuuagaugaaaaaaaagugggggggggaugauaaaaagauucagaggcuggggaaacagcucaguaguaaaaagcuugccaggcaagcugacgaggcugagcauuuccacugggacucacucguccuuccuucuaacccugaacauucagccauuucugccugcgggccuuugacuuaacucuuugggauguuuggcugaaauuugaauagcaagcggccuuaccaguuggcagucucccuucuuccagguugcuauguagccagcaccccuucauccuucaagucucagcuuccacaaagcagccucccaaaccacccaucugaaguagccuugccccuuucaaauuugccuuucuuaauucuugcauaguaggaaggucuggagucuguuauguuugccauuggcuucucagugccuaaaacaauggcucacacagcauaggugcucaguacauccauggcugaugaguggaggauuggaaaaguuucagggugagcgauuugccccuuuucugauuguuuuauggaaauaggaaggguguuauuugcucaucuauaauccagucaguugagguuuucauucuaugcuuucauauguguauauuguuuucauaaucguacuauauuuuaaauguuuggugcuuugguuuuguuuaaguuuaaauguuuuucugguaauccugcuguaguuauuuuaauggcuaccuaauauauaugcuacauugaguugauaacuugucauuuacuugccuguacccauauauugaauacuuuucuucuaauuuuuccuauuauaaauaauacugcacugguuaguuuugugucaacuugacacagcuggaguuaucacaaagaaaggagcuucaguuggggaaaugcuuccacaagauccagcugcaaggcauuuucucaauuagugaucaaguggggaaguccccuugugggugggaccaucuuggggcugguaaucuugguucuauaagagagcaggcugagcaagccaggggaagcaagccaguaaagaacaucccuccacggccucugcaucagcuccugcuuccugaccugcuugaguuccagucgugacuuccuuuggugaugaacagcaguauggaaguguaagcugaauaaacccuuuccuccccaacuugcuucuuggucauaauguuugugcaggaauagaaacccugacuaagacaaauacuuuaagguauaaccuaguaaauacauaaaaaaaucaccauuggguauaauaaauuauaaucauuaaagaugguuuuauggcuggagagauggcucugugguuaagaacacugacugcucuuccagagaucccgaguucaauucccagcaaccacgugguggcucacaaccaucuguaaugggauccaaugcaauuuucuagugugucugaagacagcaaaaguguacucauguacauuaaaugaauaaauaaaucuuuuuuuauaaaagagaugguuuuaaagaguaggaguugcucaggcaccuucuaccauuucugacugcauaugcauuaguuguaaaggauguguauggcucuuuggggcuuaaaguacuugucacaguugcugucaaagcucugugacucaguggguucuguaaacgguggcucauuauuucacaaagaaguuucaggagccucaugacauacuuuaacucauaagguaauuuggauacaaaauguguaaguccuacaaauaguuaaauuauuuuuauuaaaauuguuaccuuuaauaaauagaacaaccauaaggcaaauaagcacaggaccuaagauuguuucuugggugcagguagacuagauauuugagcuugugaaauuauguuugacaaacaucaugguuuucacgaauacuuuuuguaauguuuguaauucaauccucuuuuuuuuuuuuuuaaaucagaagaaauguuuaggacaaaauuauuugaguugccuuugagaauaaaauugaacuugucugugaccagaaauggucuggaacgccagcugcuccagaggcugaggcagaaccauaaguuugaggccagccugaacuauacagcaagauuuuguccuaaaauagacacuccaacaaagaaaaacuuagcuauucuuaaauuuuaauaaaguaucugugugugugugcacacauaccugcguaccugcauauauauguacauguguguggagggaagggggaacuuacaugccauagugcccauguggaggucagaggacaauuuguagaguugacucuccuaccauagggucuggguuucaagcucagauuuuaggcuugcauagcaagugccuuucccuaaggcagcguugcucauccuaaguaaguauucuuuaacucucuuuaucucuguauaugaagagugcuuauguacauagacauuauaaaauaaaacagucucggggaaauuucuauuuggauauuucaaauuuuuucaaauuauuugaaaucaauuguaaauauuucuuuuuauggauauaaauuuaucauaaugucuuuugcauacauuuuugaguuccaaggaaaagcaacucuuuuguuauauaauuuauauucccuuaaaacaucuucuauauaauuuucuuaaagaaagaauuaucucucucuaguuauaaaugucaguuuuuuuguauaacauaauaaaaaugaacuaguuuauaaaagauuuuugauauuccuaagcauuguaacaaaccuacauuuagaaaugccuaugucauuuuucugaaacaaugaacuuuuguucuuuuguuuguuugguuuuugguuuuugguuuuugguuuuugguuuucgagacaggguuucucuguauagcccuggcuguccuggaacucacuuuguagaccaggcuagacucgaacucagaaauccgccugccucuuccucccaagugcugggauuaaaggcgugugcaaccacgcccggcaaacuuuuguucuuuuuaccaccuaaaaauauuuauuaucuuaagcugugaguuacuugacugacuaaaaggaaaaaacauuuuccaagcuuaccuuuuuccuauguucuauauuuucaucuuaauuuauaaucguguaauagagauucauucaguuaauuaagaaguacauuuauuagggcuaaggagauggcucagugguugggaguacaaccauuuuuaacuccaguuccaggggauuggaagcccuuuucuagcccacacagcacuaggcacaaagguagugcauauguguguguguguguguguguguguguguguguguguguguguguguguguguacaugagaaauacuuguacauacagaauaaacauuuuaaaaauuuaaaaaagacacuaaccaguaauagucucugcuaagcuuguauuaggcauuuaacaguggccaaauaacacuuaaucuguguagaauauacaacuagguagacaagguaacuguagcuuguuauaagugauuuuuaaagaaacagaauagaagagaaggcauaugaaauguagggauguugagacuuuugauggggcgacagggaagucuucauugacgagguuucugaggaaguaagaugugccuuccagcuauuggggaagcccaggaggccaguccaacacgcuggggaacaagggacucaggcacaagagucucacaguagaaaaugcugaagagacauuaaggaaaggauuauguacuaaauacuuggguuauauaaucauguuucuccacugucuaaucuuccuaagaguugucuuuucuuucuugcuguuuccagaauaacauguuuuucuuuuuguuuaguuuacugaguacgcagacauuucaguucccuuagaacaaccacauuuaauuuaauuggagguuauuguuacauuuaauuucaugauuuccucucugcucagccccugaccucuguccugagagugacuaacaauucaucugcuagcuucgcuuuacaaauacccuucuuccauuucugacucccugcaaauuucuauuggcgaaucaacauuuuuaaaccauuaacuuccaucagcauguuuucacaaauaaaaccaauuaaaaauaaaaacaaacugaccuugaguuauaaauucuucagguauucuucuagaguguuuuuacugugacucuuuauucagccacaguaaauuauuugccuucuuugaagugaccaagaaucuagacagauaaauuaaacauuguugggagauguuagagaauguuugcgucaggcugguucugacaaauugaguuagaauucacuguguggauggauggacauuugaaacuaaaagucucauuucuuuaccuagugcuuucugaacugcaguuuccucuuagcaaauggggauuaauuaaaugguccacuucagagucucacuaccauguuguuuugagaauauuauagaguaauauguaagaaugugcuuuaaaaaaaagugcuguugaguaucccuuauucuguuagaacaccuauauguaucuuaaaaaaauuuuuuuuuauaaagcuuaaauauuaguuacuuuuggagauuuuuuuugguugguugguugguugguuuuuauuuguuuuguuguuguuuuuguuuuuaugcccugguaacugccaacauuuuuuauucucccucugaacugaaugucuuuguaauuuucuuucuugacgugguuucuacaguauaagugaacgagucuuggcugccacccaacagugucauggugacuacucuguguugcuauaaccucugccacacaccaugauaagaaccgauuugcccuuacuuuugaaaauagcuguuggaaaguggggguaggcuuagcugguuccacacacaggaacagcgggguuccaaagcccacuagccucagccugccugagaauggggaacuugguaugugaggcaaaucagacaugaucaggcuaggaucauggaugcggggcaacaggagcuucaaggagauggaaaguguucccuguggcuagccguggcaggcagggcccgggugggaauccacuuucaaacugugaaggauucagagcagagcguugauuucuaaacagcugcaugcuagucaccugggagcucaagauguguagugcccaaacuacuucauccuauggaugaaucagguugcuguggugaaaaugggcaccuggaaggcuccaggauggcagaugucagugaagcucggccucccuggaucgugcagcuguggccucuguucuuuuacuguggcaugcuguuuagcagacuucagcaaaauucauaaggcuuugacgauucuagcuccgcaaacaaaaucauucuucucaacagauuugugugcuacaucuuaauggguauacaguguucuugguuuugguuguuuugucuguuguuauggaguuuaaauuucaccacuggucuauuuuucacauauuuauguuauuuuuacuacuuauuauagauauuuacuuaagaucuuuaaaaccuuuuauauuuaaggcacagaauaaaguuaucuugauagauauuuacuaguuaugaguuuuguucauuuguuugaauuacugaggcuguuuucaggguaaacugagaaccaguuggcuuuucauaucuuguuuucauuuuucuucauuguagcacaucaaaauguauagucucaauaggaaccugaagaaauggacugcuuaauucuaccuuaagcacauaaauguuacugauauuugagauucugagugugugagacaagaaggguugcuaagcaccaaggcaugauugaauaagcaguaccuuaauuaucaugguugauuauuaagucagacuggauguagucuaauaaaaaauaagauuugaaguguacaaaggggacuuucuaauuacuuugguuaucauuguugacaagagacagaguuuuugccuauaauuugggagcuuuuaccuaaaguuuauguaaacuuaguuggucacaauauuuuuaaaaggcauucuguuuuccuuugugaaaaaaauguguuucauauuccauguaaaaugugugugaaaauacagaaagugaacugaugcucacugggcuccugugcugccgcaggauuguaaaugaagggacugacagugugcguguuugccuuaaguuauaccauucaaucauccaguuuuguucucuuugguuuuuuguuuuguuuugcuguuugguuggcauuuucuuuuguucugucuucagccaucauuuugucugaucaucuucaauccuagagcaaccugagagcagcugugcugcugcugcugaagcgggcauccuugucauuccugagauuagugucacacauguguccggagagaggaccgggaauggggaaaaaggcagagcucuaggagacauugacgcccagcauaugcagggugugcaggaaacagccacagacccuaggagugagagcagaggcuugcccgaacucaggaggcaaaaaucuguaagaaaaaugauggaggauggaauguccacagcuggcagagugcaguuuuagcagacgcuuuguagccgcagcccaagguaccuugaggcaggggcaccgugcaugcuaugugcgcgcucgacaguugcacagucacagacgauuugcaugucaucugauaaagugcaugaauuugcaucguaauuucucgacgaccuuuaaugcucuucagaauggucacccuauguaguagcaggaauuuguuagagaaacggaggcagaaauuugcuucugaaguaauuuucugcuuaaguuuuggaacuaaaaugauuuuuccauuucuuaaauaugaaggguaauguauauagacuuuuaacaaguuuugagcuugugauaguuacaguguauauauguauguauauguauauauauauauauauacacacacuaagaguaucuagaauggagaacacaaccuuccuaaaaaaaccucucugcauauauuucuguuuuaacuuaaguuuauuaguaggagcuacgauacagaggucaucaccagcauuuaaugucugaccuuucuaauugcuucugcucuuugcaugcauauaggagaacucuucauaaaacuguagugggguaguuuacagcaugcuugugguuuaauauauucuaaaucgcugucauuuaauuacaaugaauguguuuugacauuuauaaaauauuucaacuuauccuuugauuuuuguucuguaaucuauugcuuuaagaaauucuacuaagguauugauugcaauguaauugauuugguauuacucuuuuaaaaguuacuuaagauauuuaauguuaauuaaucuuugucauuucuuuguuuaggagauacagaauuaacaggucaagaagaacugauggacauaacugaaguugacgagggauuuuauuccagggcugcgucuagcaccagccagucgggucuaucaaacaguagucacaauuguaguaacaagacaaguguaggaaagaaccagagacggucgggaggaagcaaagcuggagcgaaggagagagaaacugcaggggagucuugcagagaucacuuugcucgcaagcaaacccagagagcccagagcgagaaccuugagcuucucucucugaagagacugaccuuaaccuccagccagucccugcccaagcccagcagccaaggccuggcuaagacugcggccacuguauuuaguaaauccuuugaacaagucaguggugccccagucccacguagcccuucucccgccauuggcuguguugcuggagcagaugccaauagauuuucugccuguagucuccaagaagaaaagcuuauuuaugugucagaaaggacugaacuugcagugaagugucaagccggccagcagggaccuccuaguauuagcgucacucugucugcagaguaacugucacuucgcuccuggagccagugaagcuggaaagacggcucugcucccuuaugaaagcacugagucuucaugccugguccuggcaggagccuggggucuugaauucugaaggccccccuuugacuaugaagggaauaaugucuaguuugcaguaagcugagauguggucguguuauuucuugggaacucuuuuccccuggguuuaaguucuuuauucuuguauucuccuuuccuguuacuuguuacuguuaacguccucagugagguuauuuuuaauaccuuguuuuuuagugguuguguauuugcccugggaagucaaagagagucugugagaggacugggcuguagagcccagggggaggagcgaguccaugaagccaugcugcuccacaggcaugugagaaaacagccucacgugagagcaguggggaugcuacgagcugugaccacaucaugcuuaggaugggacagugugcuccacaccgcaaguugccuggcaggacaguugcaaggggaagcugggagaauuucuguugcaguccuuagaacauuaaauagcaaaagugagauugcugguaggugaccuucugaagugugugaucuggacugcaggcaugaaagucccuuucggugucuaaaguguaaccagccacaaagcuguugggcugugcugcucuggaaauccuaguuaguuuguaucuuaguggucagagcacacaucauagaagacguccugaaaaccccuguaaaucuuguagcacagcuaccgagauaccagaaugaagcauuuauuuaauaguaaaugucugugaaugaaggaaaccaggucauguuucauccacaaaauguggugaaagaaaacaguaggugugggcagaggacauuugugcauuagcuuguguuuguucuugaauuuaacauaagaaagagugcacuucuuguuugugagcuuuaaguauucuuguuauguuguagaaagaauucagcuaucacccauuccugccaaccaagcaguaagaaaugugguaaggcagaagcuaaacucugcguccucuagauggacgcccaggcuuggugccuguggucugcucaguuggcugacgcuccugugaggugcacgugcuguggugcuacacuggggcaugagaggagcagggucaguggggaggccugggacucugucuacuucucagcuuuccugacuuagcacacugaggccuccuuaccgguggccucucgcugugcucacagaacaugcuagugguccugucucaaaccacguggguccagcucauggagaugagaaagcugcauggguugcagagugcaaagcauuuuuacacuugagauacauuuuuuaaaugcuuaccuccuaguuuaaaccugauuauccaaggccuaugcuuuuuagcauaaaugagcuuaacauuuuauuuuaguuucaguaacagaacgaacugcuggcuuaaauuguccucaucaauuuuaagguaacuagauaguaaaauugauaauuggaauaaucuaauaguaaucuuuuauacaguugaaauguuuguaaaaugucacugugaauuuccuguugucuuuuuguaauuccuuaagaacuuuucuuaaacauaguuacuaacaguguugauauuauuaagaagaaauuuaaagauugucacuaggcaaguugaagugcuuacuuaagcauagaguaaguuuaaagaaacauuagcuggcacaaacaagagaucagaauaauguucagccaccauauugaaaccucauuuugauauuguuguagacauuugcuacuugugugguccaaagaccacugguaucaccuaguaucuuaauaaaacuucaaaauuucgggggcagaccuaguaaaucagagcugaccuuguuaaacuagggaugcuaguauccaucugucuuugugaagacaguuucagagugcuaacugcuggucuaauguaggguccucaguggucucacagcccucaagcaugggcauuagauucuaggucgucacaauugucauagguuuugauaaccaaguagcuuuuuuaauaacauugacaugugacuucuuagagacucucauuucaaauccccacuucucauuuguuucuguaauaaaaaugcagcaccuuuugccucucuuguuggcaauaaaugagcccagcgcugcagacacuucggguuuaagcaggaaagcccucuuugcucuugagcuguuagaugagacacagaggaacaguugcacacacguccauccucuuacaaauucuguaacagcuugcacagugcaaugagucucaaguuugcuccaaaugauuuacaucaauugauuuccuggggugugguguuacaugaacaguaaaguucuuuuauacuacuuuugauacuauuucaaguaaggauuguguacaucaggggcuuucauaccagcugccaaggccggaugcugucaccuguggcaacagcuguucuagucacuuuccuacucaucuuucaaaggugagaaguuguguggcuuuguaggcuuguuucuauuaagaugcuaguguagucaucucauggauccagaggaauagcuuuuaccaagaggauuccacacagaacuggggucuggcaccccauaguuagcucuagauaggggcuuuggauugacucaacccuugcacgccucugacacugggccuggcaugaaccucggcaauccaagugaagagagaagcagaggauccagcugcccgggugcugcuacccuuccacuuccuggagccucgagaaagccccuuggcauggcugggacacggccugaccccuuuaagcccaucucuguagcacagaacagcaggaauuccagaaugacuggcuuguuuugaaaagguaguguuucauugcccuuucgauuguaaagcagcaacucugcaaauagcacucugcuguuaaaaaaaaaaaaaaaaaaaaaguugaauuaaagggaaaucugucuuuaaaucaaaauagauuuuuaaaaaucccgguuuaaagggauugugccuauuuugaaguaucauaguuaaaauguugaaugguaaauuauggaggaaaauauauacacucuaaaacaugauuuuaagcaaagaguuagaguaagacagcucaauguuuacacccgugggcacaugagaccucaguaaaggagagcacgcugaggaagccugugcuaaguauuguaacugacagacaaugcgaaaacgcacaauguuggcacuaaggcacuguagauagaaauuaauguacaauagugucuucccaacccgagugaaaggcuaaaaccccaguccuuuagugagcacgaguuuacacuugcacauuugcugcugagugguagaacauugggaaauggagaugugugcuuuuuaauacugcucgucuucacagagagcacucgugggcugccuucuguacuuuguaacuugcacauauccaaaaagacugagcgugaacaauuugaagauguuuuguauuuuugcagaagcgugcuaguggacaugggccucaguuguguuuuuugggccccaaguugucugucuuguuggaacuggccaucugccucuggccuuuccuucugaucaugugaugcuaaacucuucucacaaauacacgugucauuguaugccuaguguuuacauuccuaagaauaaaucuuggauaucauuaugugcucuuuacauuuuuaagguuugaaauaaacuggaguugaguucuuugaaguuuuguacauuuguauaaauguucuccauaugcaguacuuuauacaucaaguguuuccucuuguuuuguugaaauaaaaacuaaaagaaaaaaaguguucuucuagaucauucuauucacuaaaaacugcuauaaaaucugugagcuugcuauuggggcagaagaaagcuuguguggacauagccacaggaagcugcugggguuggcccgccguuacccucacuccugacuuuaugucucaggaugaggaacuggaaccgagcauccccacugguguccauccgaagcugagccccagggcccuggcgugguggcugacuuauaccagaagcaugagcaaaguggccuucggugugggggcauggagacagggaacacauugggucgcugcuaguuuccagauggugggauacaucacaggauuuauuucuuggcuauaggaggucacaguggcauuccuggucugcauguguuuacugaaaccaaccccauuagaaaggaacuguuuuaguaggcaguugauuaucugugugaauaauuccagcugaucaaaggaguaaguuaggaaauauuuucugauguacucuuggaagacgauuuguagaaaccagcgccugacgacuuagagauuauuacuaugucugugaaaucugaacuccuaguuacugcagagucccugacacguagcuggcuccccuaguacagucugacuguuaauaucuacacgcacacuuuauaaccacuaaucaggacuauaaauaaguagucauucuauaauuucucuuggauuauuaccguaggccuuauuauacagaggccaauuugugacuuaaauuaagcauucaaaacaaucuuugaaaggaaacagcaccccauuuuacaaaauaggaaacugaaacgcucgggcagugggcgccagaugcuagggagcaugcccugaacauaggccuuacaacucuuucuugcuugucgauuacucaaauaggauccuaaguaccgucaaauggacauguauuucaaauuccuuuauuccauuucauaagguuaaaauuuaaaguaaaauaaaguacaauuuucaugaaacuaaaugaugcuauguuuuguagaauaugauauaauuguaugucauugguaaucagauuauuauugcuauacuaaaaguaugcucauuuaaauuaaaauaaaaugguucuuuaguuuuucagauugacagauuggaacuaguauuugcauuuaucuggaguaaucauuagcaucugaaauaauugguggggaaguaaauugcuacaaaugaaugagugaacaauugagcagaaccuuuacccaugcauccugacauaguaaaucuacccuauagcucuucuacuuuuuuuuugcauuaaauugacccauaugaauaaacauuaaaaugcaagauauucauuguaguauugcuuguaaaugucucaauuauuccauauacuggaauauggcauacccauuaaaauccaaguguguauaugucauauacaucgcaagcccauuuaauuacauuuguguugaguaguuaauguguaugcauauucuauauaugcaguauacguguguuuguugauacgaaggaagaaguuuuacucaaaauguggucuuacauaugggcuuggggcucaggaaauagcucagcaguuaagagugcuugcugccuacuauagggccugugucugaucccuacaccugcuggcucuaccagcuccaguuccaaggaaucuaaugcccucuuuuggccucuguggaaacccaaacacaaauggcauauauucauucagauacuccugccccccacagauaccacccacaauuaagucuuaaugaccaccuacauuaugagaaaccaaugcuuuugaaaauggagauguuugggccuugugcuaauucccaaguaucauaaucacuguguguaugugaaauuuggaagcccguauuucuaguaaguuucucaguuuaauacaaagucuggccuaguaacuaccaguaauggauuagguauuugguagccgcuuguucuuagaaaagacuucucaaggagaagaguucucgguauucuuagagaggcuucccaaagaucggaugucagggaguuuauugacagagaccuguagcgaaagacaaaccauccugacauuuuuuuaaaaaagacuauuuccccguaaaagaguacacacccaauaguuaacagucucuuuuaagcaucucugcuacuguuuaacuucagauaacgagucaacaaaacaaaauaaaacagaacuuccuacccucagggucaccuuggcaucucuagcuggaucugcaccguggaguaagguccauggcaaaugaccaucucugucuagugggaagcggguguuggaagaguuaauaguuagaauuugugguggcagcaggcaggguuccuaaagacccuugcuaagccaagcacugaggagugacucaaggacugcagcuauuauuccaaccuguuuagugcgugggaagugaaauggagagucuuugugcuuugacuucauuuguuuccguucuacucuuuucuucauggacuugaauuacuacuccuuuucaggacugguaagucaguguguaggcagaguguauccauguguuucuccugacuucaggaucacccugaagauccccacaguuucaucugaagcaccccaaccccagcagcucuugggccuaacugggugcuccacuacaguuguuuugcaaugugcugugcuccuggucucucuagugaggcuuuuaguacacaugcuacaggugugcuuuacuggacagagucugacucuaguccaggaaggcagcagaaaccagaggcuccguaugccuucucaugcauuccagggaaaucagaaaaccagucccucccuuucgucugcauggaggagaagacugugaaaugugaucaguugauguggaucugcgcaagacgccauaaauugugacaucauguuucuuuguccucgaagcuauagugggauggaaugguuuguuuggcauuaacuuaaaguuuucuacagcaucauucucucuuguguaucuagugcacuuuagcaauaaugagacuccaaaaaggcaacaaaauaggcaagcccugucuucauauuacacauucuucuugccuggguugcaguggcugcagcuagguacagugcugugcagugcccugagaacacccucugaaggcucuugcucucucuuuauccaacuccuuucuacucugagccucucagaguuccacauaaucauccauugcaguuucuucugucucaccacuuaaaaaugagaccccuaccauaaucuggcaccacuuucucuccuguuguuaauuccacacuaguucagaauccuguuucgagaauuacuucuuucucuaagccauuuaauucauuugcaccagucaaguugaaauuccuaaaaucuuugaaaggagaaaacaauccaaaaagaaagccacaagcuauaccugcaauaggaaauaauacauuuugaguucacugaagaggagaaaccauacaagcaauacugcacacagugcuggcaugaacuagaagaagcugagguguuaaugccccuucaggguuggugcuagaggacaguggagcagagugagacaugcaggccgucucagggagccaucucagguguugaucugcauccuuuacacacagccaagugcuuggggaccuggaauucuggacuagaugagugucggaauuugggagcuagagguaugauuggacuucugaaaaugggcacagagugugagaauaauugcaacauaaaugcuagacacaagcaccauugugaaggaugaggguggguaggggugucagugcucuuuggugucccuguucauucaacagauauauaaguaugaggaaagacuaccaauuacgcuggaucaaggcuaugcacagaugucagcaagaugggcccccuuccaucaauacauccuagucaaggagagacgguugucuguccucccagaaaauguuugaucacacagucuggauuuagguuugccuuccccaaaugucaugucucuaugugcaacauuugauacuguguuugccauccugguucucuccgaaggucccugaagaaccucaccuuaauauguaaggagagagagaguuggaguuucauuucuaguaacaacucaacagacaauaacccagaaaggcaacuugagcaaggaagggcuacuuuuggcccuggcgugaagccagaggcaguccgucaugacugggaagcaguccgccaugacaggcaaguucugcagcaggaccgcaaagucacacugcaucugcagcaggaccgugaagucacacugcaucugcagcaggaccgugaagucacacugcaucugcagcuggacugugaagucacacugcaucuacagcgggacugugaagucacacugcaucugcaacaggaccgugaagucacacugcaucugcagcaggaccgugaagucacacugcaucugcagcuggacugugaagucacacugcaucuacagcaggacugugaagucacacugcaucugcagcaggacugugaagucacacugcaucuacagcaggacugugaagucacacugcaucuacagcaggacugugaagucacacugcaucugcagcaggacugugaagucacacugcaucugcagcaggacugugaagucguacugcaucugcagccaggaaggagaaagaaauggaugcuggugccagcuugcugcuuucucuuacucagucugacaccccagccaaaggaaaccugccacccuaugcagggugggccuucucucaucagauaucuuuacagaaacacccucacagauacacucacaggucuauuucuguggugagucuuaauccugacaauggaaauuaaccaucacaguaauuaacaucaaaucuuccauuagauaauaaacaaaaacuuaggaaaagacuguacauuuguuuauuguguauguggcacgcacucuugucaaagggcaaugccuagggguugauucucuuccaccaugugaguccuaagaaucuaauuugggucagacuuggcaucauaugccuuugcccauucacaucucacuggcccaacaaaaaccaaguucuaaaaccaacuucucuccuggggaugcuggcuggggcuagaagaaacacuuaagauguagcuuacuguugcucuucuuauugauccaggaaccuaaagauuggaugacaaagcugccaagucaugagagacaccugagaaaaugccuuagguuaggucagcgguucucagccugugaguaauuuaccagauauccuguauaucagauauuuacauuaugauuauaauaguaucagaauuauguuaugaaguagcaccaaaagaaauuuaagguuguggggucaccacagcaugaguaacuguauuaaagggucucaucaugggcuagagagauggcucagugguugagagcacuggcuauucuuccagagguccugaguucaguucccagcaaucacaguugcucccaaccaucuguaauaagauccaaugucuaguccugguaugucugaagucaguguacucauauacauaaaauaaacaaauaaaucuaaaaaucuaaauguaaacaauuugggggaggggaggucacagcauuaggaagguugagagccacuggcuuagggccuuaaacaucucuaccauaggaguaagcauggaguaaaauuaaaacucucucacagacacacagaacucaggaacccuucaguaaucccaguccagggaaggugugugcugcugucuagcacuugagaggaugaggcaggaagacacugaguucacaaucagcaacgucugcauacacagcagaacugucucaguccccuccccaugucccaauuucugaagcuggguucaaauacaccucuagcugccggguaaaacacaucuccucugggagaugaagcagugcaucaucguguagcaguuucucaaaaacagugcuuagcaagaaggaaaagcagccugaagguuuauagcaauguaacacucagaaaaauaacacugcgugcaauuccuugaaaagcaagcuugaggccacugaacuuuuaaguugggcuuuggcucuggucugagcacuuagcuuucuaagaugcuccugccuuuccugcucugccaacugcuuauacucagcugugcaguuuaugcugagcaccuucuucgggcauucaauacagacccugcaauacaguaagguaguacacaagccacacacgagcuuugacaguaacuaaugagcaucccuagccaggcaagauacaggcugaaucaagcacacggguguggaaaggacacuggacccuuguuuccccuggaucucacccagugcaucaucccuuugucauucccuuuguugaccuuacucucuguuauucugcuguaauaacucauaaccaugagcaccacugcaaacugagcccuuggaacccuuuugugagaugugggagucugccaguacagaggauagucuggggaaggggcacauauuccauagcuauuucuuccauuuggaauuugcugggguuuggcacaaauuagggcaaagggccccugaaaagagucacugugaaauaucagagaagcaagcauacuagggcaacaucacaaagaacucgaaacaaaugaaaagcuaccaaaccagcugguacuugagagagucaaaauuccaguaagggggagacucagagaagugaguguggccuugauagcgauccccuuaagugaauguguuucugucuucaucaacugcgcagagaagaaagacugaugagagaggagagagaagcagaaagauacagagacagagagguugaaaaccaggcuucuaguaaugaaugggcaaaaagaaaaagucuguauuuaaggaccccucaagaggaagagacaaguguauaucucaaaggcucacuuccacucagagcucagagggugcauggugcuaagucacagcuucagugugugcaaagcccuggguuugauccccagcaccagaagaccacaacaaggucacagaaagaccuagaacaccaaagagcuuuacccuagaaacugaugggucagaguaaauuaagcauuauaaaguugcaaccuggaucaagucaacugaauuauugauuagauuaaugcaaucuacacauacccacucucuucucacuaggacauacuauaaucccuuuuuguaaaaugugucauacacaguuguagaauuaugugagaauuacaaauccucagaaucacugaggugacaacagaauuaaaacagauuaacaaagccagguguggugguacauaccuguaaucccagaauuugagaaguugaggcaagagaaucaggaguuccaggcuagccugggcugcauagcaaagugcaggccacucugggcuuuacagccagacccagucucaaaacaaaaccaaaaagaagcugaaccacagaugacccaacuguuugugcuguaagauuugagugaugucacauggggaauuuuaggagaguaugauuuuuuguuuuauuuucugaauauguuuuuguaaaggcauuugggggcuacagauggcucagugguuaagaguacauauugcccuugcauaagacuggagcucaguucucagcaccuacguuaagagccuuacagccaccuguaacuccagcucugggggaauccacugcccucuucuggccucuguggauaccuacagguacaagugugcaugcacucaugcacaaacacacaugcacacuucuuaagaaaauaauaaguugcgagguggugguggugcacgccuuuaaucucagcacucgagaggcagaggcaggaggauuucugaguucgaggccagccuggucuacagagugaauuccaggacagccagggcuauacagagaaacccugucucgaaaaaccaaaaugaaagagagagagagagagagagagagagagagagagagagagagagagagagaggagagagagagagagaaagaaagaaaaggaaaggaaaggaaaggaaaggaaaggaaaggaaaggaaaggaaaggaaaggaaaggaaaggaaaggaaaggaaaggaaaggaaaggaaaggaaaagagaaaagaaaagaaaagaaaagaaaagaaaagaaaagaaaagaaaagaaaagaaaagaaaaggaaaggaaaggaaaggaagggaagggaagggaagggaagggaagggaagggaagggaagggaagggaagggaagggaagggaagggaagggaagggaagggaagggaagggaagggaagggaagggaagggaagggaagggaagggaagggaagggaagggaagggaagggaagggaagggaagggaagggaagggaagggaagagaagagaagagaagagaagagaagagagaagagaagagaagagaagagaagagaagagaagagaagagaaaagaaaaggaaaaaauaaguccuuuggagcaaggcauguuguauuacaacuguaaucccagcacucuggagauagagaguugagguggccugggcugcagagugaguucacauguggacuuggauuacauauugagacccugucacaaauccaaaacaaaacugguacaaccacaauggaaaucagugugauggauccuuauaaagcuaagacagccacugagccagcuuuacaacuccuggacauagagcccaaggacucugugcccuacuucagaucccugcauaugcauguuuacuguggcuucguucacucggaacaagccuuguccaucagugauagugacauauguuccagagaacuuaauucaaauaaacaagaauaacaguaugaaauuugaaggaaaguagaugggucuggaaaacauuaugcugaguguguagcccagauccagaaagacaagugcugcuuguuguccuuuacaggcagguccuagcugcaugcuuuagaguagucugcuaaacagugaauacugguaaaggucugaaaggcagaaaggggcuguuagaguauggagggguacagcagaccacauaacacaugagacggggggcagaggggcuaagcagggaaggacaggggugauagaaaagagggcaagguaacugaaaguaagaaugggaccaucuagugauugccauauccagggaguccaucccauaaucagcuuccaaacgcugacaccauugcauacacuaucaagaucuugcugaaaggacccagauauagcugucucuugagagacuaugcaggggccuagcaaacacagaaguagaugcucacagucagcuauuggauggaucacagggcucccaauggaggagcuagagaaaguacccaaggagcuaaagggaacugcaacccuauagguggaacaacaauaugaacuaaccaguaccccggagcacuugucucuagcugcauauguaucaaaagauggccuagucggccaucacuggaaagagaggcccauuggacuugcaaacuuuauaugccccagaacaggggaacgccagggccaaaaagggggaguggguggauggggaguggggguggguggauaugggggacuuuuggaauagcauuggaaauguaaacaaggaaaauaccuaauuaaaaaaagaagaagaagaagaacacaagguuuagacccaguccuucaaauagcugcuucuauaaacuauuuaggauguuuaaauaauacaaguuauagucauauaguaaacucauggucauaugagauucugacuuaauuacaauaaagugucuucaagauaauuaaaauaguaaauagcuaagaacaaucaauguuuaacaacucaguuauacuauauauagauagaugguugucaaaagaaccagagaucuucagaauauggcauuuaaaauaauuuuauuacuaauagguuuucugacuaggagauaugucugcuccugacaguacccccuucccacuucaaggaaggagcugaacaucaaugcauccauguggaguugcuccaauuguggcaagguagccacugggcaaaaauucccugauuucaucugcagacagaauacuguccagaaaggacaaacagaugcaggauaguugacuacuaagcucugcuaauacaggguaagcuaguaucuagcuaauauccacuugucagugaguauauaucaugugaguucuuuuguuauuggguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguugggacaucuucuggauauaugcccaggagagguauuucgggauccuccgguaguauuauguccaauuuucugaggaaccgccagacugauuuccagagugguuguacaagcuugcaaucccaccagcaauggagaaguguuccucuuucuccacauucucgccagcaucugcugucaccugaauuuuuaucuuagccauucugacuggugugagguggaaucucaggguuguucugauuugcauuucccugaugauuaaggauuaaaccuuguguucuuaagugaguugcauaggcacaaugccuaucuaagaguaacaacauuaaguuuaaauuuuguauuaauauaugaagauuuaugccaaugaaaacaaacuuguaucaauauacaaauucuguaccaauguaagaaaauauaacuucaauuuugcaucaaaauauaaagauuucuccaguguaggauuauggcuauaaaugcuuuaaaaguaaauuuaguaauccauuuccauauaucuaauuucuuauaauguuacucuauccccauuuuucuuuucaguccccuuccauuuaccuaagaaaggauagagaagaagaaaggaaagauagaaauccuagagucuaagcuauuuaguuuccuuccuuuccaaaguuaugaccauuauuuccaaauuaccccuuaaaaugaaaaaagucaauaauuuauaaaaauaaccauaaccagacaggauggugacucuccauaacuucuuccugcugaauuugggugaagaauuccuuuuuuuuucuuucuuucuuuuuuuuuuuuuuaaggggcagagaggagcaggaaacuuagggaaaaaaaugguuagacuuaggaaagcuagcguuagcauuuguuauccagucuacguagcuuggaaguucaagccuugacugaaguccugauugaaaccaucugaaaggcuggaugaaccaaggccaucguggaucaguagcugcuccugaaaauguucuggaagcaagucucuggaaacagcaucaggugaggcaggaucaggcagggagcuggaacagcaggucauuucagcauccccaaaggugaaucuugucagagcugcaucuugguguuuuguucuauaacauaugaaucuuacaaauuuuuaguucuauaaagauauuuguauggacugugcaaagugcacauaucaguuaaggaugaauuuuugcuccuuguuugcacaggugaaaggcaccugucuuuuucaugaguuaguuugaucaauaaccauuuguaaugucuucauccaugccauguggaggauggcaugauaaauuuuaagaauucugaaagcaacaagauuuacuggcuaauucuagcugaaguuuuggcuagagacauuuuuauuucuaagccaguuucaggaauguucccauguagagggaucagcaauucauguuaucuguccuguuuggucuucuugaauuuuucuuuccugucuaaagccaagaucuucaaggggucuuccucugucaugucugaucccuuuggaagaggucuaaagucuuuucuccuuuccuguuuaaacaaauacaaagccucucucccaaaauaguguguccuuggucuggcaaccugaaaucaauugagucaguucagcagccucuuuucuuuaugcuggucuacucuggccucucucccaggggaucaguaaugucauuaacaccaccaaacuuauaaccaccuucauuuugauaauuaaaacaacuaaaaacaauuguaagcaauuauuauuauuuguugagauaggguuucucuaucuccauuccuuuguuuccuacauuugagaucaaaggccuggauuucucuauucuuccacguauaguuaaaaacaauuaccauuauuucucccuucuauccuuaaaacaaugcaauuuuccuuuaguccucccuucuaaagagauuaguaucuguggauauauaauuauauccccuuucucuuuauaaaacaugaauuaacauccuuuccuguguauuuaacuuucauuaaauucccuucuauuuucuauaugagccuauuuuaggccaauuuauggaucaauaucagcugucaauuccagaauuccugcagaaucuacauucaaagaaucugguugcuugcaaagcauugacuucuuaaauuuccauucauuuuucuauuccuaucuuauuuaggccugcucucugcauaaccuuaucccagcaggagcugucagcaucccuggcuuaaccucuccugagcagcuuagaagcuuuugaggaagacucaggcugaaucucuagccugcugcccagcgcccagcgugccugaauccacuuggggugcaggugucuuaguuuuaagccaugaaccucagaauuauguguuccagaauagcaugaauuucguucuaguucugaauccacauggguuggauagaaacuacauugaguaagaaaccaauucucccugccuccuaaucuuaaaggaacagcaugucuuuuccacucaggaaucuccaauuaauuuuuaaaggugaaauuuguccuacauuaaggaccucauguaauauaaaauuuuaauaaauccugacacgggguuccuuccugccuuagaccauuuauguucccagauaaagcacacacacauacacacauccuuuauauuuuaauaugccuuaugcaguacaauagcugggucacugccuaaccuccaugcuguuagaaucuaccuuccacugauaacuccuaguugcuacuuacugaugucuauguuccaucuuggcugcucuacacucguuagucagcccucuaggccuagagcccagggugcucaccuugcuucucuaucccauggcaacucuugucucuguccugaacacccuaaggcauggugucucucuguccuuccucuuccucgagguccuaagcccaggaaaacuaaaacccaucucucucgcucuucucaccagguauuggcugauggcaucuuuauuuaccaaucagaauuaacugagagaauguucccagaagcuaugugcaggcccucucaugcaaacaguucuggcauuucuccauaguacaggcucugaaacauguacauguaugaaguuuuauauacuuggcuuaguaagucagauauaagaccaaagaagaguucuguauacacacaggacucuaauauuacccauauuaaucugaggguuuuuuuauuuuagccugaugaacuucauuuaguauuuuucugcuuauucucucucuuucucucucucucucauucuuugaguauuccauacaucauauuuugaucauacucacccucuauuccuucaacucuccuaagaaccacucucacuacgcaugccccccaauagugauggcacauuuaaaaaaauuuuuuuucuuuaauuacauauaucuuaguuaggguuucuauugcuguggggacaccauggccacaguaagucuuauaaaggaaagcauuuaauuggggcugacuuacagguucagagguuuagucccucauuguggaaaacaugguggcaugcaagcagacaugaugcuggagaaggaacuaagaguucuguaucuggauccucagaaaguaggaagagaggagugagcuacugggccuggcuggagcuucugaaaccucaaagcccacccccaauaacaaggccacacuuccuaauccugucaaauaaugucgcuuuuuaugagccuuugggugccauaguguguguguguguguguguguguguguguguguguguguguguguguguguguguguguguguguaaccguggaggcccaagguguuggauucuccuggagguggaguuauagacaguuuugagcugucuguuguggguuauaggccgcugcaaaaggagcaggugcucuuaaguucugagucaucuuuugagucccaacugugggagugcuuuuuuuuuuuucuuuccauuuuuuauuagguauuuagcucauuuacauuuccaaugcuauaccaaaagucccccauacccacccacccccacuccccuacccgcccacucccccuuuuuggcccuggcguuccccuguucuggggcauauaaaguuuguguguccaaugggccucucuuuccagugauggccgacuaggccaucuuuugauacauaugcagcuagagucaagagcuccgggguacugguuaguucauaauguugauccaccuauaggguugcagaucccuuuagcuccuuggguacuuucucuagcuccuccauugggagcccugugauccauccauuagcugacugugggcauccacuucuguguuugcuaggccccggcauagucucacaagagacagcugcaucuggguccuuucgauaaaaucuugcuaguguaugcaauggugucagcauuuggaugcugauuaugggguggaucccuggauaaggcagucucuacaugguccauccuuucaucucagcuccaaacuuugucucuguaacuccuuccaaggguguuuuguucccacuucuaaggaggggcauaguguccacacuucagucuucauuuuucuugaguuucauguguuuaggaaauuguaucuuauaucuuggguauccuagguuuugggcuaauauccauuuaucaguaaguacauauugugugaauuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuucuggauauaccaguuggggcaucuucuggauauauucccaggagagguauugcuggauccuccgguaguacuauguccaauuuucugcugucaccugaauuuuugaucuuagccauucugacuggugugagguggaaucucaggguuguuuugauuugcauuucccugaugauuaaggcaauaaaaguuguuggagccuucucauuggagcuuuauuccauccaccaaguguguguguguguguguguguguguguguguguguguguguguguguguacauauaucaaauucuuggagccucuuuuucugcuucauccagagugagugaguauuuuuuuucucugugcaugacuuucuuuuucucuuucucuggcucacaaagaguuaacaaaccuugagccucucaccuaaacagugagcaaucuccagauaauccccugcuguuaacagcaggaaauaauugcuagaaacccguggcuuuuagccacagaacagcaagaaagaguuaaucuuccagagucuucuggcucaaacaaucuuuggccuuccucagauacuguuucacaccucaguucugcugaaggccagggcuggucucuggcagggaagguggagaaccaccaauuuagauacucugguagcuguuccaagaaggauggcuauuccacagaacaguggugugcuuucgcacccuuugaguaacuggcuuuuuuuuuugcaugucuuuccauuaagacuaguaucugacuaaacauucacucucuguuacuagccccccauaaguucauuauaaguuuaaagcaacauuuuuuaugucauaaguuagcaugguuuugucacgagacaagucagcugccuuguguuccauugguuuuaaauuuuuguauagauaaaucaguuaauacuuuauuuuuuuguuccugcagcuacaauaaauuguccauucccaguuugugacuuuaguuacuagacaguagucuugcagccaaccuagaagaaauguuuuccuugaucguaauuuuguuccaagccugcuuucuguuucuagugcaacuagcccaugacacaugaagguuuacagagcucuauuugcagcuuuuauacuacagagggccugagauuacuuguauaaacuuaagaauucuauauaaucguuaucagaaauugugaaaucauugauuuguuuacacagcauuacuacaugagaauacaucuucauguugaucugcagaaaaucucauuaggcuauguaauagugacaggaaaaggcauauuagcagugagaagaaauccagggaugacgucucuaagaacucacccaccacaggccaugcagaaugguaggccaucuccaguaagcccauuugcacaccuuagccuuuccuagauggcuucugacacuucccaaugccaugacccuuuaauuucaguuucuuauguuguggugaucccccacuauaaaguuguuucauugcuauuauauaucuguaauuuuguuacuguuaugaaucauaaauagcuaauaugcagaauaucugauacacagcccccaaaggggucaagaccuauagguugagaaccaguagucuaaguauuuaguaguuuucacuaacuguacuaguuuucugagaaggagguccacagaauuccucaugcugucacccuagaagaagcaucaucaucugauuagaaaacaaacaaacugccaucaacucugggcuugagagcugccaauggccuucuccugugagaccaauggauggaccuuuuugacacuaucacuauauccagucuucaggugcuaucugaaccuccuuuugagaaagaacaaacaaaaacaauagggauguggcugcuuugcugaaauggggcuauguaaccagaaacauucaguuaggauagacuugaggacguagugcugggaccagaagcuuuccaggaacuuagaguugaaggcagauauaaaaacaguagaugauaugugguuuuaguggugaaugaucuuguugccaaaaccacugcuaaguuuuaugucugaagcauaaagagugccuguaauaaaagcgaaacaagacuagccccaguaugccaacuuaugacuaacaguaaacaaaugagccaaaacacaaacacaaaacuccacuuucucaacacugcuuucuauuacaagaucucuugaugccuucuaagguuaaggccucugagcagccaccaaauuauugguaaucacuaagaucuggauacaauagcugcuuauaaaggcugucacacaaaaguguguuguggaugucugacucucugucugaaauccaaauggucauaaacaaacacuuuauauacuaguuacuuuacuccugcuaugaaacguuguugucugugggaauaaaaucaaguacucaaaauagaaaugaccagaaagacaaguccuaccccaacaaaauauacacauuagcacaaaauaaugaaagcaucaucauuucuguaaguuuuguuuguugguuggugacaaguacuuagaagcauuuaagcuaagcaugguagcuuauccauuuguuacuucuauacugcggaugcuggagcaggugucuugacaugaguuuaaggcuaaucuguacuauauauaguaaguuccacccagccuaggcuacaauguaagacucuuguaaaaguaacuuuuauucaccaaauguaacuguccucucagaggcuuacaucugaauaacaucacccuuucuaguucuuuccgaacucuggcuggcugguuuaacucagcuguucuggcucaaacuccucuccaagcugacugguacaaacuggcuccucuccacugauugaauugcucuacuuggaaaaacugccucugaauuccacaaacugaacugcacugacuucacugauugcaugaacugaauggaacugaauggaaccgaauggaaccgaauggaauugaauggaauuggaugaacucacugcacucaacugaacugcaccaaacugcacugaacugaacucaccugccuugccugaaaucaacuaaacugcacucaccaaacuacccuccacuccugacucacucugugcugcuccuaagucuccucucuuuccugucuguucuuaugaguuuuggguguauccugucucugacuuauugucaguucuuucucugauuugucauuuugucugccgcucacuuagacaucccuuucaaauauggguacuuccuucuacaaacuaacuuuaccuuuguuguuugggauugaaggugugugcuaagggcaugucuguauuccagacagagggauuacagaugugucuguauuccagacagaggaauuacagaugugucuguauuccagccauauuacacagaccuagaaggucucuggaugugaucccuugccagagaagccaugcuacuggguaaacauuccucuaaaaacucuaucucaaaagaaaaaagccugcucauaaaguauuuucguauagaaacucccaacuaggaguuaacuaaaauuaauuggcugagaaggaugagaaacuauaaugauguauuuucuuacuaaaauuaauugaacagauauaugaacauaaauauagaaauuuaacuccuuuuaguaacauguucacaucguauuuuagcauuccaaaccuuguauuuauacaugugccucuuugguaacuaguucuuacuguaucuaucuguucagauccuucauuaaaaaaagaagaagaagaagaagaagaagcuugacuucuucagaugaaagaaagcaacaauuuauggggugauuugcuguuguuguuguuguuguuguuguuguuguuguuguuguuguuguuuaaagacaggaucucacuauacucucuuggcuagccuagaacuugcuauguagaugagauuggccuuguguaaugagaacucacaaaagacauggaaucggugacaggaggaucagggagaagauguagguggaggagcuauaggaguggaggucugggggcaugaaagaccuugauguuagagagucuuaguacagagugagagagccucaagaccaacuucagguucaguaagucacuaggacuccagggaguucacacacacagcugugguuuguuccagcacaagaacacacuaaaacccauccaguggaagggacacagaguccagaagucccucugugaagccuccuuucuccucuagguuggcucagcacacugcugacuucuccugcauuggugugagacaacaugaagacuugucaagcaggacagcucacucaaacugagcacacaagaguuuuuaccagucaguuacauagcuauuguugacugcccacauaugaccuuuagccucuggcaugucuggaggaugagcugacccuguggucaaaaacacauaauggagggauuagggggucaccuuucaggagcuaaggacagggccugaucuuuccuuggagauaauuaaugaguucuuuccacaucuauguccaaagauucugacuuguuggaagcugagagguagugaggcccagaugaaaacacugugggcuaacaaaugagaaggggaaaugcugcugagggaagacaguucaaaaguauacaugaaauuagcacauggguuuuuguggagugguuuuauaauuguuucccuuagcacaucaccaggaagaguaagaauaagaccaaaaucuuaagagaagggaguuggugaagaagacggaggaagaaucagcccagcguacugugugguguaacagggggcugaauggauuacaccaaagcuaggccaggccaugcaaccagcaaauauuucuuaaauugaagaaauaauggaaguggaacuuucaagaaaacuauagagccaggauguuguaacaauaaacgauuaauccugauggcggguuugcucccugccucaacaauuuauguuccugaaugaaagacacacacacacacacacacacacacacacacacacacacagccuuuauguuuuaauaugccuuaagcaacacaauagcugggccacgccuaaccuccauacuguuaaucccaaguuauuacuuacuaauucuauauuccaucuuggccacuuuugaccuacuugugacacucucugggccauacuuucguaugacccagagcccagguucucuccuugcuuuucuaccccaccacagccucuguguaacuucucuguccacacucuccaccaacaaucauggaucucuuccuucuccuuccugcuccuggucccaagcacaggaaauccuaaaauccugccugucuguccuccccagcuauuggcuguugguaccuuuauuuaccaaucagaaccagcuaagagcagguuccuagaagcuacaugcagacacucgcacaagcagguuuuugaggaacaaaauuaacauucauaauacaagcagcuacaccaggagucauguacauuccuauaacccugguucucagaagacuaagacaggaugauuccaaguuugaggucaugggcuaugggacacauaggaguguuccaaacaaaacaaauagcuaagugcuggucaaauaccugaaaucccaauauuaaggagguagaggaaaaaucugucuaaggcuaaauugaaguuauggauuaacagcuuuggcagagaagauuucaaaacagucuaguauugucuguauugugugguuauuaguggccagucuuaugcagauuuauaaugaaaaggagcaaccaaauaagaaaaaaaaauuuuaauguacaguuugagaagaaaaggaguauuaggaaguuuaauggagucaaauccagugcucaaggaaaugaaaaauuuauagaaaagccugaugcuaaauguaauaaagggagugaucucagggcaagagcccacccaacuaagcuuccagcuugugaaaaagaaauaaagaaggguucaggaccaggugugcacaccuuaaccccagcccucggaggcagaggcaaguggaucuguuaguuugaggucagugugguauacagaccaaguuucugucuagccagacuuagacagugaaagaaacaaucaaagacauaaagcuggugaaaauguauuugaaugaagggccauauuccagccccagcaagcagcagaacuugacagcuucagacacaugguucuggcuuuagugucaagaauacaaaaaagggauuauguaaucuccuugugagacuaaagaaaaccacuaaaaccaggcauaugucaggggugucucugaauggaggcccgaaaagaccauugcaugaagcuaugaaggucaagucuggcuugccuuggagaccccaagauguugagauaccagagcuauacaguaccuacugaggagagcugcuaacagcaaguggaaccaguccaggagaaagaaguguguuacagucaacaaaacugaaaagaguuggacaucugaagagcacuuugacaucagacaugagaugcagaguuuggagucuucccaucuggauuuuauuuccucacugggcucccucuccucccuuuugaaauaguaauguauauccugcaccaucauguguuagaaauaugugaucugcuuuuugauuuugauuauagggauuacagauaaaagauugccaucagucuaauagcuuuuaaacuuuaaacacuguugagacuuugauaggcuauggugacuuuugaaguuggacugaaugcuguccaugcauuauggcauggcuaugagccuauggggggcugggaguggaaucuggugauuugaauaaaaauggccucuauaggcucacaggagcguguuuccauuaggagauauauggucuuugaaggagguauguccuugacagugagcguugagauuucaaaugcucaacccagguccacugucuucucucucucucucucucucucucucuccccccaccccaccuuuucccugcugcuacugaaagacuccgagaugagccccucgcucacgccucaggacaauagcggacacccaagaacucacgacagacccagcuuguugcaaaccacaugaggcuuuauucggggaaagccagagcucuggggacgacucauaucccacgcagggguagaggagucggccccgaggggaaagaggucccaguuuuuauaggcccucaggggggaaaggagaagggggagaguaggggauuuccagaucuaaacaaugucuauucucaaaaaauggguaugggagggguacaaggaaagagucuaaugaaggugcagcaaugggcacacaccuggucagaacauuggcagacacacagguucaaggaguggccagagcauugugcaccucuauuuuucuaaaucagugaagcuaguucugcuaacacugacgucuaucuugccaauuucagggcuucuguguccuuuuacauucugccaggaucuuucacuaccugcugaucuagauuuagaccucucagucuccucuaccauaucugccacacugucaugcuucccacuaugaugaccacggacuaaaccucugaagcuguaagccagccccaauugaaugugguccuuauaaggguugcuguaguccuggugucucuucacagcaauagagaccccaacuaagacagcauacaccugugauuucagcacucuggaaacugaggaaagaguuugaggccaagauaggcuauguaugaaacccugacucaaaauaagcaaacaaaaaauaaauaaguagauaaguaagugaagauguggagguuaaaaugggaugcaaaacaaaaacaaaacagaaaccaaaaaaauuaaacaaaaagaaaaaacacaaaacaaaaacaaaaagucccacacaaaacaaaacaacaacaacaaaaaaacacaaagcacauacacaaaacaaaaaaacacccaaccaaacaacaacaaaaaaccuaaacacaaaacacauaaaaacaaaauaaaaaauaaaacaaacaaaacacccugcuuuuaaagaugagaccuuuuccacccagaacugcagugagcucuuucucuuugccuuucaggaauaaaggaauaccuuuccuuuauaaugugacaauuuuuaugguuuguuuguguguuuguuuguauugguuuugguuuugguuuugguuuugguuuuaguuuuaguuuuaguuuuuucaagacaggguuuuucuggcuguccuggaacucucucuguagaccaggcuggccuugaauucacagagauccaccugccucugagcacugagauuaaaggugugugucacaaugccuggcuuaauuuuuauaccuucuaucuuccuggccuuaccaugcuguugaucuuaucagcuuuauuaauauguuuaaaguuaucuuuauagcuaucuacaucuagguagaaauuuuuuauauuagaauauauggaaaguauaauccgcccauuuuuuuuuucuucaacauuuuauagucaaguaaagcccuucaaacagugaaggaacauggcuccugugucuauaccuucacucaguccggcucccucccacucuccugucagcucccacauugugaaauaucccccaggagaggaaaugagcagucucuggaggaccucacgaugugaggccucuguaaggaucugcaaguuugaaucucaagugugaggguugguguuuccgccuuuauuuuccgaagaauuccacaggcaaucaguguucuuuguuccuugauugaggaauucaccacugaaaccauguggccuugaguucacucugugugauaguggauagaacauucaauguggcuuuaacuuggauuuuuaaaauuuucgguaucaguuauucaugcuuucucaccauuuucuugguaacccaaucaugaguuugccaauuuuguguuguuucuauuugggggcaaccacagauacuaugaauauuucugugccaguuuuuacauggacaagcauuuucauuugaacugaacugcuggacucuguguaacguccuucugggaagucuugggcuguucuccaguguccaucccgcuccucacuggcccaggccauggcagucccuccacuugcccgccaagccagcgaugacacuucuguucucgaggccagcacauugcaagugguuuugcugugcgcagcacucugcugcauguccgcaugacauuuuucagucuuuaccggagacucucuuuucuuuggcugcuaaaauccgauaccuuguucuucccauugacuuugcauauuuuuguguuuucacccaagaaacuuuuuaaucugagguaacuauguuuucuucuagaaguuuuauaguuuaagguuuuacaguugccuguuguauacaauucaacuuaauuuugaauaugauuuaaggaaucagugauuaaucuccucccuccauaaauaccaagcaccuucuguugaacuccuauugaguuuuaaguggcuugguguuaaaaauaaauguaacugacccuguguggggcucuaucuaacuggccuguucuaggcucucugaucuagcaguccuuguaucaaucuuuugccaguacuaaccuguuuucauuacugaugcucagugucucaaguagcagccagcuuaaggcugggaaggggagacagaguccagguaccauuugaucucaaagcucaccacuacaaugacaagcgucagucuacaacacucacaucagguacugacuccgaagcagguggcagagagguucacaggcaagacuuguaaucuguccaucacucggugugucucagguggcagcucuuuccucuggaucuucuuaucucucugcagccaaggugucagucaguuguccccugguuggagagcaagacagcaugacagucuucaccaucacagcaucaaggucucugccugccugcugugagccucugcucuccuuagcuacaaggggcagccacacucuagucagucacgcucuugcaucauuguauaguacgucaggcuuaccugauacacacagagcugacaugagcuggcugcuccucccugugacauccaccugaguccuauucuuauuucuuauuuacaugcucucuacauuccauccccugaauccucauggcacucgaaggggucauggggacacacaagggcacauaggccagggguaccugacucaugcgacacauuuucuguaaacucaguuuugcacagcuugaauaguggccuaauuagccucuccagguuuggugguagguuacaccuuuugcacuuguuaaaauugugacugggggaggaggguuccauguaguauaagcauuaaguugaaacaggauuucaucuaaaauugguuuuaucaguugucuuguucaauaugcuucuaauguuuuuggauaauggggugcuaugguagauuuagcuccauaccagucuccauggagcaaggcuuuugcagauucaccaucauguacgaucagcuuugcacagaucacauugauaaugauugccuuuguuuguauagacuacaaaaauggagacugugcacuggagugccugucuaacugguuccucacauaguggguaucuggccauuggcaaguggaaaccaacaguauugcuguuuuacucagacaauuauaagcuauauugguggucugugucccugcaauguugucuucuacuccuuccagguagcacauguguguuguagugcuacacaugcaagauugugguuuucucccuggugucgcuguugcuguccaugguuauggaauggggucaguaagcacucauggcugucuguaauguuguacacccaacuccauuguuuuccacuguuguuuuaaguaugggaaguuuuuaguuuucuuuuauuuauuuuuauuuuaccauauucuuuaaaauuuauaaaauauuguaacaauaaaaaugaguauuauaaaaguuguuugauauaaaacaacagucaauugaacagucuuaugcagauacuugucuacagcaauacugaaaacaccuguuuuucucaauauaaauuuuaaauaacuccaaauuaacuguaugauauuuuaaaauaauauaucacuauuaguuuuuuuuaaaugaacauaaauagaaaaagucuuuuuguuuguuuguuuguuuugcuuuuaguagagcuuaaaaucuuggcucuuauugugguacaaacccaaaauaagaacaauuuuuagacauuggaguucauugugauaagguuguacuucaacguccuucacaucaccaaaggauuuuaccuccauaguagcuaagcuaagaguugacaguucugcugccccaaggaaugaauuguaggcaaaaauuugcugcuauggucaaagcuauuuggcuugagugauuguugucauucucagcccacagggaacaggcuacauucauuuuagaaauggcauauguauuaaaauugucuauccaugaagucauucaucaacuguuucaaugaacaauggcucugcuuggaggguagcauagacauuauuaggugaggguaagauucugguucauuggcugugaugauuuugaaaaacauucaucucagaaaaagaauaacuuauaagguccucuucuucaaaauugauacaauaauuauucagucucacucuuuguuguucucuuacaagccaccucucaaauuaauugucuauguuucuuuuggcugcauaaauaauuuugaaacauguaagcuguucugaaaaccauaguauuguguaaagcaucaaauaaacaauccuacuaauagagaggcugagauaggagaaccaugauuucaaaaccauuaugugguacacaacaagacacugucauguacaaacacacagaaaguguauauggguuguacaauauugggccuaucucuccaauuaccaaauuagagagaccacuggaugacagacaacaaauuucuaauuccucauauuuuuaaauuucaaucaauuaggauauauugguaauauuaauuuucauguuaagagauauuaaggaaaagugauguggacaaagaggaacacuccuccauugcuggugggauugcaagcugguacaaccacucuggaaaucaguuuggugguuccucagaaaacuggacauaguauuaccugaggacccagcuauaccacuccugggcauauacccagaaggugcuccaauauguaauaagaauacaugcuccacuauguucauagcagucuuauuuauaauagccagaagcuggaaagaacccagacguccuucaacagaggaauggauacagaaaaugugguacauuugcacaauggaguacuacucagcuauuuaaaaaggaugaauucaugaaguucuuagggaaauggcuggaacuagaaaauaucauccugagugagguaacccaaucacaaaagaacacacaugguauguacucacugauaaauggauauuaaccccaaagcuacaaaugaccaagauacaauucgcagacuacaugaagcucaagaagaaggaauaccacaguguggauacuucaguccuucuuagaagggggaacaaaauacccauuggaagaaauacagagacaacguuugggaaagaaacugaaggaaaggccauucagugacugcugcaccuggggauccaucccauauacaguuaccaaacccagacacuauugugaaugccaacaagugcuuacugacaggagccugauauagcucucuccugagaggcucugccagagccugacaaauacagaaguaaaugcuuacagccauccauugaacugagcacaggguccccaauggaggagcuagagaaaggacacaaggagcuaaagggguuugcaggaacaacaauaugaaccaaccaguacccucagaacucccagggacuaaaccaccaaccaaaggguacacauggagagacccaugacuccaguugcauguguagcaguggauggccuugugggacauaaaugaugggaaaggcccuuggucuugugaaggcucgaugccccaguguaggggaaugccaggacagggaagcaggaguggguggguuagugaaaagggaaggggugaugggaugggggguuuucagaguagaaaugagaaaagaggauaaaauuugcaauguaaauaaagaaaaccucuaauaaaaaaauuuuuaaaaaggaaaagugauuguuacuuccuguuauuuuuauuguuagagguggaauuauguuuguguggguguguugaaagauuacuuucuugcuucuucuaggguauaguuuugcuccuuauguugguguuuuccaucuguuauccuuuguagggcuggauuugucgauagauauuguauaaauuucauuuugucauggaauaucuuguuuucuccaucuaugguaauugagaguuuugcuggguauaauagccugggcugguauuuguguucucauagggucuauaugacaucugcccaggaucuucuagcuuucauagucucugguaaaaagucugguguaauucugauaggucugccuuuauaugccuuuuucccuuacugcuuuuaaaauucuuuguuuugugcauuugguguuuugauuauuaugugaugggaggaauuucuuuucugguccaaucuauuugggguucuguacacuucuuguauagucaugggaauuucuuucuuuagguaagggaaguuuucuucuauaauuuuguugaagauauuuacuggcccuuuaaauuggaaaucuucccucucuucuauaccuauuauccuuagguuugaucuucucauuguguccuggauuuccuggauguuguggguuagcagcuuuuugcuuuuuguguuuucuuugacuguugugucaauguuuucuaugguaucuucugcaccugagauucucucuuguaucucuuguauucuguuggugaugcuugcaucuacgacuccugaucucuuuccuauguuuucuaucuccaagguugucuugcuuugugauuucuuuaguaguucuaguuccauuuuuagauccugaaugguuuuguccauuuccuucaccuguuugguuguguuuuccuguaauucuuuaaggaauauuuguguuuccucuuuaagggcuucuaucuguuugucuucuccuguauuucuuuaagggaguuauuuauguccuuguuaaaguccucuaucaucauugugagaaaugauuuuagaucugaaucuugcuuuuccagugugaugguguguucaggacuugcuauggugggagaauuggguucugaugauuccaaguaaccuugguuucuguugcuuauguucuuaugcuugcuuuccaccaucugguuaucucuagugcuaucugcccuggcuauaucugacuggagccuguccuuccugugauccugggugugucugagcuccugggagucaagcugccucugggacccuaagaaccuggugugaccaagcuccugggauccugggauccuggguguguuauggugucugggaguagagcuucuucugguuauugugggacucacugcgaaguuugcacccaaggucugcucagggcacuggcccagacagaccagaaggaaccugugccacuggccuggugcaguuccugcgugccugggucccacuggucccaguuacuccccaggaauuuuuuagguuuaauaccauaaucccaaggauaguucacugaauggcauuagguugccauaccaugguaaauuagggaauuguacuacaaagagccaauuugcuguguuccauuccugucuuaaaguuucaccuaguuuugcuuucaaggaaucggggcaucuguucccauauggcuugggcaaaggugggaucccugaucguaaggccaggguugaacagguaugcuagggcaguguauccaguucaucucuuuacauggauuuauuaugguuauggugguuauggguugugugguugaaucuauaucaccagcauccuccuuaucucccucuucuucauaaucauacucauaaaucugaucuuccuguuauacugauaaccaaguucuccagagcaucuuugguuaugggucaaagcacaacuuuaagaauguggauggccacuucacagucacagguuacuuccguaucuaugccuauauaugugguugaauaaccguuugaauuuuuauagauuuugugagggcuuucuccaaugguuauugaagcucuagcuuuggaagcauugguauacaauucauuaaaauggcauuuuagcggauuuugcucaugaauguuaguauuguuuccaucugcauugucuaacauguaggucuuaaagggaugugcugguuugguggcuucucugaauuggucauauccuuuaaaccauccauaauuuaaacaauaagcauauuuccaccaaauggaaugggugcuaccaauaaaucauguccaguaucucucaucuguccaauaaccuggcaauuuuuaaaaaucugauccuguaauaguggagcagcugguggcauuaaaauguugggagggugggugcguuccaacauuugguacugugguggcugguuuuguugagugaguacuagcacugcugguuucuguggcuccugugcugaccauugugcauauauaagaagcuuuuguauaaaguucaccuaaggugcugguggcuccuguauuuguuggugcacugguuucagugcucccaguuguauuguugcuugauguucccugacauaaucccaaaacaguaagagccacaagaauaauggugcuaauaugcuugcaaccauaaccacccauggccauaguaauuauggcuauaccugcuauugcucccaggaauguauacaggauaggcaugcugagauguuuccacauucagguuauaauuaguauugcuguuauccaguaugaugcuuaugaagugaauaccaauaccaagaggauugccaggguaccuuaacuuguaugaugauguaggaacccgguccagcaaauaguccaauuggugaauuuuauuccugccaacuucauguugguuauguuugucccuuaacuuauuugguugcacaguguguuggagcauuuaccaucagcacuacaguauaaacuacuauaacuauugcuaauauuacauauaugugcauauacauauauaugugugugcauauauguauauauauguauguauguauguauguauauguauauauaugaagcuuuuguauaaaguucuacuaagacacacaguaugucacacauuaucuuccagucuagacaguucuaggucugcuuuaccuuguguaaucuagaugguguuccccugcccuuggaucaccaccucugcuacuuuaagcaacugacccauuuuauuccugugaaugcauuuguagucccuaauuaguaauuuauccuguuccauuggguauucuagaucuauguuauacuuuauucccucuuguaucagggauucccuauucaaucuuggucuaauguucaguucaugcuuaucucuacuugcuagcuuaguuuugagcaggccauuaaaucuuucaauggcucaugcugcuguuggcagauaggccaugugauauucccauuguauauucauaaucuuacaaaaaaauuaaccuaucucccuaugaaaugcauuccuugaucggguugcauacuauuuaggguuucauagugggaaauccaauccuaugaugugaguaugguuaaagauugauuugggugugacccacuuuuggcagacccuaauccaguacauaugucuaccaagaugcaugcauaugccccuuucuaucguuuugaugguccuauaaugucuauuuauaagauaugauugauauucagccuaugcccuguuucccuuauacuuguguaugaaccuaguuccaucucuugggcaacauuugcacugguuuguugaauucuuaauccuuuuccguuucuaccugaaaaccaaugaaauguggcauguguuucugcaugcccaaggucucauguacuuuuaauauuucuucagugguaaucucuaagucucuaauugacuuccguuuugcuuuaaagucuuaacuuguuggagccuaucuguucugcccuccaguuuuguuuuaaucuaauuacuaggcuggguaauuuauccauuguaucguuauguccauauuggucuccuucuuuauuaauuaguauggacauccacauaauauacauauaccuuaacuucuuuggcuauaucauauaauuacacccaaaauuccuuggaccauauauucuuugccauuaauuuucuaguaguucgcuuucuguuuuccugaccacauggcugugccauuggcuacacaccaugagucagugaacaaauguaguaccuuuugcuucucuuugaggcuuugacuugcugcuaacauggcugcuacuacuucuguguauugugcagauuuagcuauuccuugcuccaugaucaccauuccauccccagguccguaggcugcugccuuccacaaaaccauguucuguuuacugguuguggagucauccauaaaccaggcauuaaccagggauggcuggaacucuccuguccccucuccuagugguaccuguuucuggggagggguggcauuugggaugauugaaaaucccuguggggucauugggcagucggucacaaguaccaacuccaacgccuuuggcaccgaccccuuugcagacaggguaccagagcgagggagcucagccaaguaccauuuccauuguaguacuuucccuuccguggguagaccagcccaugcuuccucuggugccuagauccaaacuagggucggaauggugguucugaguauuacuuggcuguucugcagcauguggugcacaguuuuuaaggccuccuauguuauucaaauuguuuucucaacuagagagaauuuguuuuccaagcagggaagccuacuguccauuaucuaccauuacuuuucacaaagauauuccaguucccauacuguuuuagguacaguaugugcaaauauacuauauccucugguuggauguauuguugcuuagacuauuccuuuauauacucuggcacuguuuucacagcuuguucuugggguuuauuccaaauaaaaucauuugcuuuccuuguaauacuauacaaggguugcaaaaugacuuguaaaugugguauauguuaucucugauauccaaauaauccuauaagauguuguauaucagcuucauuggcugguuuuaagcuguuguaauucacuuaugacugcaguagguauuuuuugacccuggaguggaccacccaagaacuuaaccuuuguaucugguccugauagcuuauuauuauggaugguccaacauuaucucucaaugcuuguaugguuuggucuacugguuugcuugggauuuuuuguauauauuuccuuuucauuuuauuaucaaaaagucaucaacauacaaauauaguuaggacugguaugacuuuauccagugaccaucugucuuagucaggguuucuauuccugcacaaacaucaugaccaagaaacaaguuggggaggaaaggguuuauucagcuuacaauuccauacugcuguuuaucaccaaggaaguaaggacuggaacucaaacaggucaggaagcaggaacugaugcagaggccauggagggauguucuuuacugguuugcuuccccuggcuugcucagccugcucucuuauagaacccaagacaaccagcccagagauggucccacccacaaggggccuuucccccuugaucacuaauugagaaaaugccuuacaguuggaucucauggaggcauuuccucaacugaaguuccuuucucugugauaacuccagcugugucaaguugacacaaaacuagccaauacaccaucuuagaacacuguggacaauuauuggguagucuuagaaauugguacugucuugcuugccaagugaaugugguguauucucugcuuugugggugccgugguaugcuaaaguacaugucugauaaaucuguaguugacagccaucuuggugcugcucucuuaauccucaagaaaauaucuucuauagcugguaaauguccuggcauuuuagagaacaauucauuaauucuccuauaaucuaccaucauucaccauuuacuauuugguaaacugaccaaaucggacucuucaaauugaagcuuugcguugguucaauuauuccuuccuuuaguaggguuuaaugguuucagauaucugcucauuccuccuuuaauugggcauugugacauaaaugaggguucaacuguugguagucuuauagguucuauuguuacuccuacuagauuaccuuuuacuuuuuaaaauuuagaaaaucacaaaaaaauuaaaaucuuuaagaagccuaaaauauuuucuggugcacugcaacaugcaaaauccaugggaauuauuuugucauauaccauuaauucuaacuuacagacagguauuauggauucuccuguaacuccuucuauagugucuggcaguccuguauauauguuaauaucacugccuuugucaauuagccaucuaacauuuaucuucuuauucuuaugggaaacauaauauaugguguuacuggugccugacuugauuccugaugaaagguauacguguuugccuugucacagugaagcacugauauguguuuaccuuauuauaaugaggugcugauauguguuuaccuuauuauaaugaggugcugauauguguuugccuuauuauaaugaagcacuaauauguguuugccuuguuauacugaggaacugauauguguuugccuuguuauagugagguaccaauauuugguaacaaugauccucauuauuguuaccaaauauugugaaucuuggaagaugucacugggagggauaauggcugucuugccuaggcccugcauuaggucauagugaggugcugauauguguuugccuugucauagugaggugcugauauuuccuuugugauggccuucugucccuaaaaaaggcuuagguuuguuccuucaaaaaaaucuuauuuuguguaccccucugugggguucuguuuacaaauagcauuccagguuuucugccaaaggucuaauguuuguaaauggucugaaaaaucugaguguucucuuugauuuaaauggauuucuauuuacauuuaaugauacuacuuuuucuuggucuaacucccucuaaccuuuaaauaagucaauuaccucagaaacauuucugcaauuuagaagugguccugccaaauuaauuuuguguggcgguacccccuuaauuaaaauucuuuugaauugugguauaaucagagcauccugugaugugucuacuucauuauguauaaaccacaguacuccuaguugccucaugagcugaauggccucuuggaaaguguuccauuuugcugcuuccucacguuguguaaggucuaaagauggaaaugcgcaucuccaggcugugguuauccaguccaggagaagguguacaucgccuggagcagugccuaggacucgcucuaaagcuucauacacugcuggguuucuacuauauucuuaauuuuccucaccucugacucugacagcgugaccgugucuauccuuuuccccugagcuuuaucauaaaggaugcauccuccauuccaucuggacguauucuuuucucgacugacuuaguucuugaggaguguauggucucauuucuauuuguugcucaaaaugcuccucaucauuguuaccaaauauugugaaucuuggaagaugucacugggagggauauggcugucuugcccaggcccuggguuaggacagcaucuuugaaaggauuguuugccacccccauuucuuaguuccucuacgguuuucaucaguauugcuugcacuucuuuacuagccgcaugcucuagaguggcucuacuauugguggacuuguuagaaggaccucaaucuucacuucuuuaaacccagcuuuccuuuuggccuuauucuuuguuccaaaccauuuccucucugugcgauccguggcaucuggacucacuuucauggcuuugaagccaguaaguaguuucuucauucuaguguuacauacauuagggaguauagaacuuaaauuuuuuauauaacacccaaaguuaguuuggggugaguuucuuauuacuuuuuccaauaauuuaucugcccuucucaccaggcuuguggccaaccaaucuuuccuggguggguuucccugcaccuucugcucuuccuacggcauaggcagcaguuggcaucagguguugguaacaguagugaugagucccucacuucuggcucuuccuaugucguaggcagcagcuggcuuuggagugauggucccuucuuucacuaucucccuuagagcucugccuaguucugcuccuggacugcaauuaauuuuguaugaccaaaggcuuguugccaauuugcugaaauuuagaauaauuaggacuauuaugguccuuagaggguucauuuuucuucucaggguuccaucuugaagguagaauccugucaacuaugccaacuaucaugagucauguccagcuuaaggcugggaaggacagacagagucuagaucucaagguuuauucacuacaauaagcaucaguucacaacauacacgugggguagcugacucagaagcagguggcagaggggccucacaggcaaggcuugcaaucugucuguugucugugugucucaggcagggacuccuuacucuggauccucuuaucucugugcagccaggguagcagucaguuguguuagucaguguucuacuccaccacuggcauggccaccggggaggugaaaugcagggagcuugacugcuuuuaucccaagcccagugcugggcuuuagagaagagccuagacaccacuccgacuccgggagugggagaauacagucugagaugugggaagccaaagcugguauuucccaaccccaagacaucuaaucgcugcuagagugccacacagaggagcgggaacccacgacgagggggaagggaugggaacuuuggcuuagcucauuggcaaagguagaagcaguugccuggaaaugcagagaagccgaggcucuacaggcaaaggcuuucuccacgcuccccaugguggaugaaagagacaguccucgguuccaaacuaguuauugguuguucauuguggaaaauggaugcguaccaccuucucaggggggaccagagauuaaauaccuucugcaaggaggaauauccaggaagggaagcuuauugacuaaacccucagggccucuagguaccucauuagcaaguagagcucuguucuggggcaaugugaccacagaucuguuuccuuaugugggaaguguggcacguuccaggccaggaaucuggcagggagcugccuacggacucagguguguaccccgaguuuccggagacucagacccacucuaccgaguuuccuagcaagguccacugucccacaaguuguuuucugguuagagggcaagacagcacaacacucuucacugucgagcaucaaggucucugccugucggcugccagccucugcuuucauuagcuacaagcuagcauuacaucauuacauagcacuucauucuuaucugcuacacacagagcugacaugagcugcagagcuggcgugagcuggcugcucauccaacuuuuaucuccuacacacagcugacaugagcuagcagcuccuugauauaacauccaacucaguccuguucuuauuucuuauuuacauucugucugcacacagggagucucagcuguggcuucggcuggcuaguuugauggcaacaagcuagucaucugagaggaagacaccucaacugauaaaaugccuccauugcgcuacaggcaagccuguagggcauuuucuuaauuaaucauugauagaggagggcggggcccaggccauuguggguggggccaucccugggcuggugguccuagguucuauaagaaagugggcugagcaagcaccagggaacaaaccagugagcagcacccuuccauggccuccucaucagcuccugccuccagguuccugcccugugugaguucuacccuuugaugaugaacugugauauggaacugucagugaaacaaacccuuuccuccccgcguagcuuguggucaugguguuucaucacagcacagguggguuacccugcggagggcacugccugcugcucuccaggccuugccuggucuacaucacacauuccgugcuuaccauucuguacaaaacaauuuuucaauucccuucgaauuuuucuuuaaauuucuaaauauuuaagauuuccuggauaucuuuuaagaaacugauaucuauuuugauucucauuuucuuuuuauuauguuguguguuaugguuuaauaaauguucugccuuggugaauguauauauauauaugcauuuaugcaguuacaagauguaauacuaaauaugacugucuuaguguagguuuuaggauuacucaaauccuaucuuugcugagauuugucugcccuucaaaccccuccccaucugggcugaagugcugacuggccugcccuuguuccauaauugcugugagcgugcaauggcguugcugaauuuucagccucaucauguuuuaagacaucuuaauuuuacuuuaauuauuuauuugauugacuaaggagaggaaugcuaucuuccucgaauaauagagccuauauuuuacuauauuuugcucagauacucccaaacuacagcuuguuuuuuaucugugguagaguaucuuuuuaaauuuuuaaauuguguguguguguguguguguguguguguguguguguguauuuguaagucuguguuuguagauguggaugucagaagucaauuguaggugucuuccucauucuuucuccaacuuauuauuuuucuggagggguugcuguuguuguuaguguuguuguuguuguuguuguuacagggucuugauguggagaccagucuggccuugaacucucagaggucuuccugcauuugccuccugauaauauugugugcgaccacacuuggacuccaccuuauauuuugagauaaaguucuuacuggcucaucuagaaagcuguccaucaagccccagggauauuccugucuuggccucccaacacuggggugacuggcaguuacugacagcccuggggugacugacaggugacugacaacacuggggugacuggcaguuacugacagcccuggggugacugacaggugacugacaacacuggggugacuggcaguuucugacaacacuggggugacaaucuuggccccauuuaccugagcccuggagauauacucccagguccucaugcuugcauagcaaaccuuuacuacaaaaaacaucuacccaggcacaauuauuuucugugaacaaaaugaauuuucaggacuaaagcacuugacguucuugcaaagggcccagguuuggaucccagcauccacauggcaguuugcaaccaucuauaacuccaauuucagaggaucuagccccuucuucugaccuccucaggcuucaggcaugcaugugguauacacaauacacacacacacacacacacacacacacacacacacacacacguauaccuaaaauaaaauaaacaaaccuacaaacaaugcuuucccaugauauuuuguaaagaauuaguuuaguuuuauuuuagcaaaucagaauuucucccaauaaaauuaauuuuuguacaagaaauaguaauauucucaauaaaagcacagcaauaaaaggaaguaaaagacauaaaaaccuuaaaagccaagaaacauccuggauauauuugaguuggugcauuuuaauauaguaugaauaauguauugggaaaauauccuuugccagaaaaagaaaagaacugaccuuagcaagcugagucaagucugaguuguuugguguguagacagcccugugauuuggaaagcagauuuccuacuuuguugucuaauaaaggcuuguagcucuuuaauucugcugauugaauuacaaacucucuggggcauagacugcauuuuuugucauguuaacagcuugcaugagcagagggguagcugcuuagcuucaugauuuacaguguaagaaaagcacgcacaguacacaucuuagcgaauuucugcagccuuggauuccaaagagcuguugagagggagaagugcauauuuuaugggucaagaagcugacagaaauaauagcuacaguaaaaccccucaagcucccauccuuccucguuaggguugaguccgguauuccaugccggcaccucugggacccaggcuuuguagguucccuagaguuggaacaugaacaaccuacacgcaggacuuccugccaccugcaugcuucccagagagaugacaagggaacuucagaugggaaaagcauuugaugugucucggguccuaaggaaacuccauuuccucacacuccuggcaauuagacaaaaggcagccuuccucaggaauguguggagccaagguccucucuaccaaggacccacuuccuuuuuuuuaacugaagggagaggagggaaagagagaaauggcugucugcagugccuauuagcauaccagaguacaugauggccuccagacccaagugucacaaguacccauuucacauuccaaagcacaugcugauauccuggcccucccuccuucagcucaugggcuuccuuccccccaguucccuuacucccuuauaauccugcuguuucagcuaugagcucuccuggucucucucuuuugcccuuucuugguucucucuccucucucucucucuuucucacucucucucucucucucucucucucucuuccucccucccuuccuccuuuccucucucccuccuucccuuccucccucucuccaucucucccuccaucccucccucucucccucccuaauggagggaccucuuacccauggccauaugcaaucuaccacuuucuaacucugcucuggacucuccuacaugccuauagcugugcucucccucgaaucuacaauaaaaacuuuccccuuagccauacuguggagccgccagcuuaugcacugugcaggacugccucaccuagaacccuagcacaggcccccugcacuguguguuccagguuccccccuauauugccagaugccuccuggagggaguacugaguuaguccugcaaugcugcuucugauaaauggccagacuuacagccacaggacacaagucuucacaaugcucuggggacauuuuguugcuuugcuuuuuguuguuuguguugagguuuucuuauaucauuccaggcuggccugaaauugagcaacaacagaaccuccaaaauuccuccaacuugcaauccuccugucucauccucccaaguaguaggauuacagcuauacaccaccgugcucaguugcuccauacauuuucuacauuuuugaucaaacaaccuucuuguaugcaaagauucucuguggccccugaggaaauguuuggaugugacuaaaaaaauauuuggaauccuuuugacacgguguggggugcaggaacagaagagaaauuccgggccaaccagccaaugucagcaguuuccuggaggagggaguggagaagaggaggacaaaaaccaugguuuugagcuauacuggcauggaagucagccacaugguagacagcauauacacgguguggaggggucaugacaaaaagaaugauggaacccaaccuaccagaaaaaaacauacuuaggugcuggccaucaaucaggaagcagacaaaaaaagagaaggaagaaguaauauauuucugagucaagucucagaaaggugggcaagcccaacagagcauuauagagggucuagccacuggggacaggaauguuggggaaagcacaguaguucauuaaggcgaucauuauuccacccguguagcugcacuuuggcuacuuggugcuuucuucuuucuuccacccuucucuacucuuuuuccaccuuucaacccccuaacaccagauagaaaagaaaaaaggauagaaggauagaggggaaggggugaugauauuguuagacuaugaccugauaguuagggaagccaaguuccuuggggcaaguuuaaccuucauucucaggauauauaauuucuucuuguuucuucuuugcacacaacuacuuaacaaacccugaccaacaacaaccgacagcaaacaacgcccucccccccccccaguaacccaucaccccucucagggccuagcacuuauagaccuucuaaaagguccccagaaucccaaacgucacacaaucacagaaacuaucugcagcuggcaaaaucacaccccugccagaacacaaggcaaaucacugcuguagacaaucugaagccgccccauaucccacaccuuagaaacauauauuauuucugguuuuuuaaauaaaccaaaauuccaaauugucacuacacaccugucucuuuaccauggcuuaaggugagacugcuuucuuaggagugauucuauuuuccugagcggugaucccuuggccaggugauugguccaacuagauugauuauguguaguuaggucuccgcccaggguuucauccuguuggccaguuuucccuuaaagggucuuuacugcugcuggguuauagugggcaaagauuagagaaaagaucuacaccaggcaaaagaaucauauccacauaacaacaacaagugugaaaugcucccagagucccugcuaaacagaguaagccauuucuaucacuguauugagcuucagaaaggcacuaugaaguuccucugcuaaaauccucccauugucuggguggggcuggagccauggcucagggcucaagaguacugcugcucuuccagaagaccugagaucauuuauucauuucccagcaaccaugguaggugguucacagccacuuaaacuccagcuccaggguacccccauacccucuuuuggcuuccucagaugcugacauauggaucacacacacuaaauauaaacaaacaaacaaauaaauaaguuccuuuguucccuucauugaauauacccugaagagccaugcagcccaauaggacucacguucccuggcuucauagacauaucugaccuuaucugccuacacugugucacaccagucaugcugucucacugucauggaacagaauaaacuuauucuuaccuugaauacuacaguugcugucccucccucagauacaacuuuuuuccucauuuggagucugaccaaccuccucuccuggagagcuuuuccuuucccaccaagccaaaccaagccuuccuucuauauucucuucuguggcucugcccuccauguuauagcauuuggugcugugcacuguaacagagcauguuuacagcacuugguggcaugcgguauaauacaggucuuuuuauuaugcugugaguuguuucucucugaugagaauucagugcaugaaguauucaaguauccauucuuuagcaaacuccuuggcagauagaagcuucauaaguaucuguugaauacaugugauuugagaaaugagaucagaguucaaggauaacaagggguagauuuauauucugaacuccuagucugaaauuuuuaaaaagagaugacagaguuagagaauacaaaauaagaauggaguaaggccuuuuccucugugucuggaagugcccaguagaacaauugucuuguccuccccuccccuccucuccucucuuccucuccccuccucugcccuccccuccccucuuucuccuucccuucuccccuccccuucccucuauugguuccuauugucuuaaaaguugugcaacaaccaaagagaauuguauaaaaggugucuaaggcacagauaccuggacaagguggaaagauguacaggaacuagauccaaaguccacuucucuuccugggcuuugcagccccugaaaagcucuuuggugaagcucuuuguagugacaaguuuugaggauuauagaauccuggcuucuuuaaaauacacacacacacacacacacacacacacacacacacacacacacacacacacacagagagagagagagagagagagagagagagagagagagagagagggagagagagagagagagagagagagagagagagagagauuauaagaauguguuuuuguuuuaaucccagggacuguccucaacaguugucaaugauuugccucauguucuaguaaggcaugguuuuuccagcugcagguaguuucugcaacugugugacauuuagaauucugugaacuuuucagaggguauauacaugcuagagcccugauuaggcaggguugggugguuguugguuguucagggauguugauguggucuguuaguaguugugcucaaaaaagagacaacucucccucccuccauuccuuccuccuucccucccucccuuccucccucccuuccucccucucucucccucuuucccucuccccucucuauccuuuucuccucucuagugauucaaggugaaaagguuuggguggggggaugugaaguaaagggugggaaaaagaauccagaaaguagcaaaggcaaugaagaacaagaagagagaaaugagauucauagcucucucucucucgcucucucucucuccuuucucuccuaacuauugauauggggugaaaacaggggcgggacaaaggauggggaaagaagaacccacaaaguagcuaaguccaccuacaaccuugcugucugaugccacaggaaaggacuucaugccacuagguguacccugcugucuucaaaaggcucugugguaagcauuuugaacaaguuagucccaggcuaguugaaaaauaacuaaagccucuagaguagccacaguugcaguccgccaauugaagcgugcuuugccccauugcuguagggucuuaccagagucucucuugagcucugccaggcacugcaugguuuauccuuuucuccucuguaccaugacucgcaaggaauguggcuagcuauaugcuggauguuuaaacaguuuucaaaguaaagauagaguuaugaaaaugccuucucuuuuuggcuaggaggaagcaagggcagucggcagagccgacccaccaucgauucggacacaaucaccugcuggaauuugcagagccgguuuaaauaugaucauaacguccagaagucuguuucuaaaauauagaaaggcaagaugacagcucuaaggaugccaauuuugaagaacuuggaaucuuuucguuuugcauuaaaccucgggcucaucuagcuggguuuccuggugugacaggagaaagaaacaguaauaaaauauggcuuccuugac

SEQ ID NO: 2365 - RNA, 2382 nt, Mus musculus
ugcuugggugguccauacuacuuggguggccaagaaccagagacuagauaguucagggaccuaggauaaaaucaaauaauacuagucaaaaaaaaaaaaagagagaaaagaaaucaguguaguaauaaaauacaaauaauauuuauuauucuaaaaauauccuguuguacucauaaauuagugccuuggucagccaucaucagagaagcuuucuccugaagcagauggaaacaaauauugggacccacagccaggcauuacaaugagagugagagaccuuggaacacucagcucuaaauaggaugucuccaacaaaucccuuccaucagagcucaggaaacucugcaaaacaggagguagaaagagcacagaaagagcgcaagagccagaggggauggaggacaccaaggaaacaaggaccacuaaaucaguaugagcaaagcucacaggaacucacagagacugacacagaaugcacaaggucugcaugggucugcaccagguccucuguauagacaguauggcuuuucaguuuagugcguugcuguuguuguuguuguuuaaauuccugucugugaacaagugggucucuuauucuugugucuucucaaggguuuucuuccuuuuguuagguugccugguccaaucucaaaguaaugggucuuguuuuauauuuuauuuuguuguauuuuuaaaaaagugaaugcaugaaaaccacuaggaugaagguaagaacuaaacugucauuuauacccgcugggagagggaaaaacaguuuuguuuaauggcgugacacugguguauaccaaucacuccagagaaggucucauuuucaggaauaguugacaaacauauaauagacuccagcuuuguguguguguguguguguguguguguguauguguguguguauguguguacacuugcaugcacaagcacgcaugcacuuuucuuuaauuacaacuugauguuuguuuuucuuuuggggugucauuuuauauauuuucuugguuuuguuacaguauuggauuuguuuguuugacaaacaacuuaaaaguugggugagggcuggugagauggcucaguggguaagagcacccgacugcucuucugaaggucaggaguucaaaucccagcaaccacaugguggcucacaaccauccgaaacaagaucugacucccucuucuggagugucugaggacagcuacaguguauuuacauauaauaaauaaauaaauauauuuaaaaaaaaaaaaaaaaaaguugggugagcagggacaggaagaucuggaaggaucugagggagaggaaaaauaugauuagaauauauuuaauuuaaaaguuaucuuaaauaaaacauguugaaagggggcaucauauauauaugacgucuaaaacuuccaaaaggauuuucucacugugcugugguccaccaacuugaugcucccaccaguguaucugguaaacgccuugauuaacuuucuucccccaccuccugcagauaaauauauuuaucuaaucucuuuuauaaagaaacauacuguccaggauauguucaaucccuuuuuaggccauugcugacccuaugcagcuuaaaauaauuuauuuaauuuucuuuuaagcaguuauuguuuuagaucaacagcggucuagaucauuuuacauaaaacuucugucuaguucuucauacaucuagguagaaaacugaggcuauguagaaaguucauuacuagaaauaacgacuucaguccuguguauuccuaaacagcaaaauaaaaaacucauuaugaacauguuucugugaguucuaggacugaguucuguauuccaguagaacugcccggggaaaccucaauaaaguuggcuggaacuaacaccugcucucuaguuuuuugguuuuuuugauuuuguuuuuuuccccagacaggguuucucucaguaguccaccacucucugccuccaccaccaccaucacccaccagaucuguuuuaaugagaaagacagccuacuaaacaggcaggcaugucacggagaggagaaaucgacaggacaaugguuuugcuuucugaaucucaaacaaguaacucuugugcuuauccuaaauaaccuuugccuugcaguaugcaauuuuccuguaauaguuacugagcgccuacaaugagccccagucugaaaaggcagugaagaacugacccuguucucagggagcuuacgccauagggagacgucuuaguuuguucuauuacacaauuauccaaaauagaucaucacgaaaucuaaaccugggaagucggccuuugguagaagaaaagcacacgcgagcuuggaucaggccgaaggguacccacuguugaggacgccgcaccgcgcgacgcagccg

SEQ ID NO: 2366 - RNA, 19292 nt, Mus musculus
uggucacagagccucugggcgcggggcgaugacgucacacuagccgggccucgguugcuggagccugggcccucgccggcgaccgcgagcagggucgagcugggacggcgcuaccaugaccauaugccaguuuuuccuucaaggccggugccgcuucggagaccgcugcuggaacgagcaucccggcgcccggggugcgggcggggcucggcagccgccaccgcagcagcagccacccucaggugacggucugggagccuugagccagggccacuugcugcggacgcacaccuccaccccgggccccugcccuggcaugcgacgucucacccccaguaguuugacaagucguuucugaucgucacacguggacaggcguuuggacuugggugcuccugucaaacacugcguuuuuaaauuagagauaucuucaucaaaaccuccuuuuuggugaauggcagugguagggagaauucacguggguucauucagaccccuuucucuacucuuuccccuuccuuguccgugaucacaagcucuuaaaaucugggcuuuaguuaguagcuuccgacacugggucaagaaccuuacaaguuuuguggaaaggguauucagggguuagacauuaaaccagcacaaaacaagguuuuagaagucagauaaauacguuuuguucucuuaauuuuggaaccuaguuuuuuguuuguuuugguuuuuagguuuucagagaucggcuuucucuguguaacagcccuagcuguccugaaaaacucuuuguagaccaggcuggccuugaacucacagagauccaccugccucugccuccugagugcugaaauuaaagucaugugcuaccacugcccaguggaaccuaguucgugacguugucagugggugcuucucuuuccccuucucuuuaaggcuccuccagccccuguguucaugcugguuucauauuuccagucuuuucguggaggagacagauuguaucaucuacaaugcuucuagugaaagacuccaaauuaggagucagguuccgauagauacugguauacucccagggacugcugagaggaauguuugccauuuggucucuggaaaccuacuuuaaauguaguaauuugcaaguaaauguucaguagauagauaauuaggggaaaaauacaaauaaaacuuuagaaugaaaagaaagaaaaagaaugcuuuguaauuuuaaggcccacauuugggccuuaaauaccucucucuuucccucugcucugcuccaucuuacguagcuuccuguuccuccuccugugagagcugggcauauccuauucugucaaauuuuucucugauuugucacuuugucuggcacucaauuagauaccacuuucaaacauagcugcuuccuucuacagacuaacuuuacuuucgaugucugagauuaaagcuguguacuaaaggcaugucuauuucagccagaggaguacucuaucagucuguuuuuaguauauauuaagugauauauuuucuaaauccuaagauaaauuaccuuuauccuagcauaaacuaggaagugauaagauuaaaaacaguaucaaaaccugaaacaaguccuauuggcuuauuauuauuauuuuaugaguuguuagaaaucuacgcuauacuuuaccuauuaguaagcucugcgaucucuauaugaaggauagguugugggcauuguguccacaaaguaaagacagaggcaaacacuuuuuaaauaccuauuuaaggacagaaaguaaaauuuaacccuuuuuauuauccaguuuauucauuguucucuuucauucauugucucuauggcccagugcagaagcauacacacacauccaaugauaggucaaaugagggccuugaccgagcugggcucaccgcaaagcuuuuagagauguuuagaguauuuuuuauuuauucccucauggucaauuuaauaggcuuaacacugaacucaccgauaugucuuuauauuucuaugaucacauugaucucacuuuguuguugcuuuuugucagcuuggguuuugggguuuuuauuugcuuuuugagaugaggccucacuauauaguucugacugaccuggaacuuagagaccugccugucucucccuccacagugcugugauuaaauucuuacaccaacacaccuggccuugaucucauuuuuuaauauaaagagaacauuaugugacuuguuauaacauauaacaaacuauaacucauaaagggauugucauuuaaaacuaguagaaaauagcacuguguauaaugucaagacauaauaacauaaaauguaauagagaucuucaagauuggaaaaauuuaccaauuuucugauuguuuguuuucuugauuauuuuagggaauaaccgucgaggguggaaugccagcagccagagguacuccaacgucauccagccuuccagcuuccccaaguccacaccaugggguggcagcagagaucaggacaaaccaccauucggcucuuuugauucuggggcuucuaccagcagaggcuuugggucaucucaaaacccuuuugcuucaccucucucugaugagcagaaagaugaaaagaaacuucugugaguuaaaaguguuguagaaaaucaauugcuuagcuuuuccagaagcaauuacaguguuuucaguaagcaaaacaagaaaaagaagucacccguggcccuguggcucagccagucuguucacacugugagcuucucagaccucaucacuuagugugcguucuuagguuugucugcucugguccacuuccugcuguacuagcauauuucaaaggucagucuugcuuaaacuaaagucggugugcucugugcucuuuacagaguaucggguaacucagaacaaucgcuauccucaaggguacugauaauaucacauauuuuucuuuguaaaaccuuuauuucaguuucccuauuugaaguuccauaaagagugaauuuuuagguuaguuugggguguauuuuuuuuaaggggacaagcaggcuuuguuuuauuugaaagcagggucucccuauguaguccaggcugguuuguaacucaggucucacugccucucugucuccagaguguugucacuucaccagccauuuguuucugaaaugcugaggacugugccuaaaucuucaagcaucaauuguguguguguguguguguguauguguguguguguguguguguguguguguguguguguguaacaaggcaaaguucuauugugauccuaaguguaauagcauccuuugugauaccuaucacuuuaguaguuaauggucacauucgauaugaaagaaacauuaauuuagagucaaauguauaacuuuguucagauuugcuguuaagugcacagaucugaaggcuggagagguggcuuagcaguuaagaacauuggcugucuuuccaggggaccugaguucaauuuccaguacccacacagcagcucacaacuuuugguaacuccaguuccaagggauucaacacccucacacagacauacaccaaggcacauaaagcuaaaaauaaauuauuuaaaaguauauguuuuaaguacauggaccuguuuccuauauuacaaaguagaaaauuuaaguaaaauauaucugaaguccuauaacccacucuuaaauuuuaaugauucucuauaacugguagugguacuuuuuauuguuuccaguuaaaaauacugugcauuguauuuaguucuuuaaaaaauauuauauuuaugauaauucuuaaguauauggauuaguuuuucuauuaauuaaaaagauagcacuauuaauuauucuuuauuauuuguaacuacaaaauacaagguguuuguuguuuuggaaacaguguacagcccagauugaccuuaaacucacuguguuaccugccuggccucaaaauucuccucaaucacccaggugcuaggacugcagcuguguuccaccaugcucagguugucauucauaguucugugaacuucugagguagaaaagagucuucagaaaagaagauggugguggcacacgccuuuaaucuggcacuucggaggcagaggcaggaggagcucugaauugaagccagccuggccuacagagugaguuccaggacagccagggcuacagaaagaaacccugucucaaaaaacaaaacaaaaacaaaaaaagaaaagaaaauuaaaaauauguaaacuuauguauuuacuagaauuuaaauuuuuagucacuuaacuucauaaguaacaaauuuuaaugagcaaguaaaauauccauuacucucauuuuucuuucuuuucuucuuuuuccagggaaggaauuguuaaggacguagaaguuugggagucgucgggacaguggauguuuucuguuuacucgccagugagaaagaaacccaauauuucagguaacugggaaacgugcuugacuuguuggcuguuuuuuggugaggauggaacccagaccagcauacaugcuaggcaagagcccugccacuaggcuauggaugcaacccuguacuuguauguguuuuuaaaauauaaaauuucuacugucuaaaacuaggccaugcuaaauaaauuuauuccaaacuuaggcacagcuagaauuugaucuuuuuuaaaguauucaaguaucccagcuaaaugauucagagacugaaagccauaauguaauucuuuuaguuuauauuauuuauucucaagaaagaauaauaaaaucaggaucuacacaguuuuaauucagucaacuaaggagaggcccugcuuuauggauucccucuguaaacccucaggaugcccucagugcuaccuuguggccaggagggucccacgcugcccuccauuggagcccuggcugcugccuugccuuuccuccucuuccccaccaagaauccugcuucuucauaaagccugucggaacucucaaggagccauagagauggcaucucuuuagaagacuccuuucuuuccauuugguuuuucccaugaucccuaugacugccaaguucuuccaagccucucauggagagccuaagucucuccuguugagacagcaggcguggcccagcccagcccagaagucagggucagauuccaggagcgcugcugggccucaccccucaccucuggcucaccaccaccacucucuuauucagguaaaaacucuuuacugacuuucauuuguccugcacccugaucugcauuugagggacacauaaaccaugagcgguugggguucuucccggaaccuuguauccuggaggaaagaaaacaagaaaccaugacaacagaccguuuaagauagugguaguuucuguaagcuuuguaagcccuagauauuuaaauuuaaauauuaguacuuaaguacuaccaaguauuaaaucuuaauuuacaaauggaccuaaagccuaaugucuuacaucucugguuuacauuucaaaauaugaaauauagagaguucuccauagggugaucauguaaaauauaggacaugcaguuaaauuuaaauuucagauaagaaaguaguauuuucaggcuggagagauggcucagcgguuaagagcaccaacugcucuuccagggguccugaguucaauucccagcaaccacaugguggcucacacccaucuguaaugagaucugaugcccuuuucuggugugucugaagagagcacugguguacucacauacauaaaauaaaucuuuuuuaaaaagaaaauauuuucaauauauguauccuauguaauaucugggacauccuuaaauuuguuuuauauuugaaauuuuaauuuauguaaacaucuggguuuuuuguuaguuaaaucuggcagccuaucccugagauaucuguaggaacuggauauauucauaaauguuuucauaauaauacuaagacacuaauggccauuuugauugaaauguguaguauugguauaaaaguauuguugaguaaaacugauggauuuagcauaaaccgaaacagcaacaagcugcucguagacuguaggaaucaugggaagaaggauuuggaauagcauucgaacucgaggagguaaaauuaucuccguucuuaaugaaauaacagucucugauuuuacacccucuuagccuuugacuaugcacuuuaccuaccucagacaaagcaggggugcauguacuccgugcuucugcccuguacccacgugugcugcucacgcgaagggauguuugccaccaccagaugguauuggaaagaauaacagcucuaugguuauucacacuuggcuuugguagauauuuucugaaugagaacagaacagugaaugagauaaaccugucaccugggcgauuguggcagagaaugacaggguuacugccaauaguaaaacugaaauucccugggaaaagguagagugauggaaacccuuucugucacaugaggacaacagcuucccagucuuuaaaaaucucuucuaguaaggcuagugguggugcugggcaugguggcagaggcaggcggauuucugaguuaaggccagccuggucaacagagugaguuccaggacagccagggcuacacagagaaacugugucucgaaaaaaaaaaaaaaagaaagaaaaagaaaaaaaaaacugugucucgaaaaaaagaaaaagaaagaaaaagaaaaagaaaaaagaaagagagagagagagagaaagacagacagacagacuagucauagcaugaauaugugucgacuucaggguuaguuuguguuuuuguuuuugcauucuagagggcccugugucauguauggaaguucucuagggcuuguucaagaccaaagugucuuguuacagaaucacgcuggcugaaauccauucuaaguccaagaugaacagacagaugaauuguaaucuaacuacucaaaaaguuaauuggcuuuuauaucugcuuuauaacuggccuuuaaaacccucccacuugucugggcauaguggcaugcaccuuuaauccuagcacucgggaggcagaggggggcugauuucuguaguuaaaggccuuccuggucuacagagugagacccugucuugaaaaaacaaacaaaauaaaaaccuuccacucucuagccacauuuaucugaaaaagccauugagacuuguuuuuccagugacaagucuuugggauguaguuuguauacaacagccaauagcaggauaaaagcagaagcacagagaagcacagacaggaacuggcagacagagcuggugagagccacucagcaacucagagcauguccugcuggugcaggguauguggguucagcuuccagucuucaugguggcugccucacaacuuccuguaacuaguuccaagggagccagcacugcauucugaccucuacagacaucaguacuccagaacacacacacacacacacacacacacacacacacacacacuuaaaacuaguauuuagaaaaaccaacuaagcuaucugagaagccaaacauuaacaagcucacuaauguauguggauacauuuucauuauaaagaccuaacuuuugugugauguuggagcacaacuagcacucuagcacucuagagguaaaggcagguggauuucuguugaguuccaggccagccuggccuauagacuuaguuccaggauagcuaggccuauacauagaaacccugucucaaaaaauaaaaaacaaacaaaaaaacaaacuucucuguagcuagaauauuucuuuuguaccauguccuaguuugcuuuucuguugcugugauaaacaccaugacccagaagcaacuuggcaaagaccggguuuauucagcuuacaggcuaauggccgaucauucagggaagcccaugcuggaaccaaaggcaagaagaguuugaagcagaacagagaaacacugcucgcuggccugcuuccccaggugugcucagcuaucuuucucacacagcccagguucagcugccuagggaugguuuuaaucgcggugagcugggcccccagcccucauacaucaauuagcaauugagagacaucccacagacaugcucacaaggccagucuaacaggcaguccccuccccugagguucucccccaagaagggagugccacugacagccaagauuagccauuacauacuauccuuuuaaauacuauccugagaaaauagcuauucaaauaauucuguauucuaacuucuguauucugugauucagauaagaaacuaguuggucacagcuugaaugaauagagauuggggugagaguuccaugacagagaguuguuacauucuuaggagacccuuuuaagaguuaagccuugaaugaagagaaagcaucugauauaagaagcuuggaggaaacacucccagcaaucugacagcuggugcagaggccuugaggugagagcacugagcuugaauaauagaagaaagaaaguaaugauacaggcaggguaaagccagagcagcagccaaggcucauaugaugcuggcucucauuacaucggauaugcagcuauugaagagcuucagcagaagcauguggucugacuagaaaaagcugacccagugaugcaggaagggggagaaugagcucugggagugagcacaagacaaggaggcagggagacaaguuaggaagugaugcugaugaccgaccuagagcuauuggcaguggacacagagucagucaaaguugaguucuguuuugaaccagcaggaugcuaauacuuuagauacagaaaaacaaacaaauccaguaugauuccugagugcuuuuugcaguggaguaaacuaaaugguacaaggguuccaaggacauuugugucaaaaauaagaacauugccuuuggagcuaaagggaucugcaacccuauagguggaacaacauuaugaacuaaccaguaccccggagcucuugacucuaggugcauauguaucaaaagauggccuagucggccaucacuggagaggcccauuggacacgcaaacuuuauaugccccaguacaggggaacgccagggccaaaaaaaugggaauggguggguagggaaguuggggggaggguaugggggacuuuugagauagcauuggaaauguaauugaggaaaauauguaauaaaaaauauuaaaaaaaaaaagaacauugccuuucuuaggguucucagugcuaaaaguagagucauugguuuagacaauaaaaucacuuggugguauagauaaacugaaacauuuuugguauuuccuuuaaaguauaugcauauuaagaacaccaacuguucuuccauaugaccuguaaucaauuuuagcuucuauauggcagcucauuaacuucaguuccaggguauugaucugacacuaggcacacauguggugcacaugcauucaugcaggcagaacauccaugcaccacauuauuuaugaauuuaugucuuuaucuauauaaaguggcuguguacuuuuguucugcaugcuugcuuuuuucaucagggccccagaccccaugcaugccaggcagacauucuccacagagcuacauuccuaagccccaguauucuacauuuaucaaugaacgcacucgaauaagcauccuuuugcauaacacaaguaucugaaguuaaauccuagaaauuuaggucagggcuggugagauggcucaguguguaagagcacccaacugcucuuccgaagguccgaaguucaaaucccagcaaccacaugguggcucauaaccacccauaaugagaucugaugcccucuucuggugcgucugaagacagcuacaguguacuuacauauaauaaauaaauaaauaaauaaauaaauaaauaaauaaauaaauaaauaaauaaaucuuuaaaaaaaagaaauauaggucagagucuaagcauuuagcacuugugcuuguuuauggacaguuugccccagaaaauuccuuaguguguucagaacagcauccaucaccacuccugaguggcagugaucaucuguucuuagugucugccagucugugaggagagcauuuuauuacuaaguugaauuuuuuuaaaguuuucuuuauuuacuugccuucugaaauuguagugagcuguuuguauuuucugucuuugccugucucuguacugacuuagaaacaauguuucuguauuaaaaauguuacucauguguaugcaguugugguuuuccugguuucuuguuugccuuuucaauuuguuuauugcagauguaacagcauugguuugaaugugucuaaucagcucuuguuuuccuuucacucuuuaucuuuacagaauucuucauucaaggaugaaauaacuauauuuucuuccaguuaauuuaaacauuaguguauauaggguuugauuuuuuuuuccuugaucuugaaauauuucugacaaccagcauuauagcauuuugucucaaacucuagcuuuacuaccagaaucacuuacuguuuaaauuccaacugauuccucacuucagguuucacagacauuucaccagaggaguugaggcuugaauaccauaacuucuuaaccagcaauaacuuacagagcuauguaaguuuguuuucuauuccucuaccucagcagcauuggcugccaguuacugcuuccuguguuuguaguggcuugcuuauguuuugguauguuuggugaaagugguggcuugaauaugcuugacccauagggcauggcuauuaggagguguggccuaguuggaggaaaagugucacagagagacugggcuuugaaagucuccugugcucaggcuccaccuaguauggaagaaagcuucuuccuagcugccugcaggaaggaguccucuccuggcugccuuuaaaucaagacauagaacucucagcuccuccuccagcaccguuucugccugucugcugccaugcuuccugccaugauaauggacugaaccucugaaacuuuaaacuagccccaauuaaauauuugucuuuauaagaauugccuuggccauggcaucucuucauagcaguagaaacucugaggcaggaguugguaucagggacuuggguauugcugugauaggccugaccauguuuuguuuggaggaaugugaauuuugguacuucaauuuggaaagcuagaaugcuuuaaguggggcuuaaugggccaccaaguaggacuaugggaaacauuggugcugggggugauuucaacucuggagagucuucugauguuuuggugaagaauguggcugcuuuuugcccuugucaaaagagucugccugaggcuaagguaaagagauuuauguucauugcauugacaaaggaagucucgaaaaagcucagcauagacuuuguccucugguuugcucucaugaagaguauuuucaucaagcauagccagcuuagaaaggaaaaauacaaaaugugugguucacagaguaaaggggcagcaggacgaggaguggagcugaaugcuguguucaggagaguaaauggaaugaagggaguggugaccuugagacaagaucccacccagcuacgcuugugcauuugcaguugcaugagagagaguuauauuauguuaggcauuacuaugaccugcuuguuuuuauuuggacauaaggagauacgauuuugugucacauugacaagggauggaucaugauggcuauucucaguuuucaaguugauuaagaucaguaaugaaaaacuuaggucuagaucaguaaugaaaaacuuaggucuaggcauggugguacaugccuuuaaccccaggagacagaggcaagcagaucccugaggucaggccaaguacaaagcaagcuccagguaaagaaaaacugaaggccaggcauggugguacucaccuuuaaucccagcauuaaggagacagcuaugcagacucuugacuucaaggucaaucuacagaaguuguuucaggacagccaaucuuagacacugaaggaguuggaaacaaaaguuggcugguaauauaagagaacaagggggccauaaucgagccccagcaagcagcagaacuuagcagcuucggccauguggcucuagcuuuaaaguaaagaauagaagggguuacuggaacaacugaugcuagguggcuggagcuaagacguuaauagugcuuaagaaaagaccagcaucacugaggugaaaccugggaaguguuuucugagagcacaaagaagcuguguuccagagauagccaaggauguaccuugugcuguagcuggacuugguaauguguaagagucacccaggugguacugguuuggaaggcaugaaggggucauggagagcagcuggagcuuggcacugugagaggucaggagaggccacuggugaagaugcagccucaguggcaguugaaggccuaggacuggaggggucaugcagagaaguugaggcuuggcaccuugaagagaaccuacgagaggccauugguuggugacacacuuccuccaacaaggccacaccuccuaauaguaucacucccucugggccuagcauauuuaaaccaccacaguaagaacuguuaauuuuuuuaaaaaggucaaugucuuuuuaaaauuguuucauugucuaaauuaauaaugaugugcuauugugauaagggauauuauuuuauaaguuauccaucaaccaguccuacaacucagaccuucugucaucugaaagacauuacugcuuccauuggugcuaguccaugauggagaccaggaaaacagaguucugccucacacauuaacacucacagagcagacauccggaagaaaccagagugagugggccagugaguaagcugggugccugaaggaaauaauuucuguugucuacagucaggacugugcauuccagcuacuacacauaauucccuccuguccagauaucaccaguucugcacuucuaggugaucagcagugagguacagggagugagagaacagagaggcaacuagaccuggaugaucucuggcaaacaggagcagggcuuaaacagucagucuugaguuaauuuuguuuucucucuccagcuaaacucuguucaacagcuuguaagucaguggaggaauaggauaaaugaacugaaaaaucuaacuaugucgaccaaaggagcucuggugaguacugaagaaguuucuucaaagaagugucuuaucuacccuguuuuguuuuguguugguuuuuaagacaagaguaaauagacuaggacguccugcaacuugucauguagcccaggcugcucuugaacucacaaccaccugucucggucuccuccaugucuagcuuccuguugcuuuuuguguguuucuugagacagggucucaucugaaaugguccugacuagccuggaacucagagaccccuguguccaccuugagugcugggauuaaaggugcacacuggcucuauugcuuuuauuuuuuaauuuccauuauuuuauguguguguuuugccugcauguauaucugugcaccaaguauguaccugauguagcagaagucagaagaggguguguaauccccuggaauuggaguuauaguuaagaauugccauguggugcagggaaucaaaaucagguccucuugaagagcaguguugauaaccugugagucaucuuucuagcuccuagugcuuuuugguagaggauguuucauuuauaacuugaagggcaaaguaaagucucuguaaaugauuauggcacacacccucacccugugcccacacacccucacccugugcccacacacccucacccugugcccacacacccucacccugugcccacacacccucacccugugcccacacacccucacccugugcccacacacccucacccugugcccacacacccucacuauguggucaucuagagcugaagcucuagaacuuauucuguuucucagaaaaguggggacaguugugcuuuuuuuguuuuuguuuuuguuuuguuuuguuuuuugguuuuucgacacaggguuucucuguguagcccuggcugucuguagaccaggcuagccucgaacucagaaauccgccugccucugccucccgagugcugggauuaaaggcuaguugugcuuuuuagaaccaguuuucaguuagccacgguagacuccuuuaguucuugcacuagggagacagagauagacagaucucucugaauuugcaacaacggaucuacauacuggaguccaagacagccaaggaaugcuuagaccuuguuuauaaauaaauaaauaaauaaauaaauaaauaaauaaauaaauaaauaaauaaauaaauaaauaaaauguaaaacuuuagcauaagguuuuaaacugggguaggacuaguuuugaaaguuggaaacuauuacaaauucaaggacuuaaagaugugcuuauuccaccuggcagcuguagagcucccuuggccgcaccauugcugagagcugggagcacaguaaugccuaagucuaaggagcuguagaccuuccgucugggaugagugcuuccaggucauugugaacguuguaaggucccuggaacaacccguccucaguggcuuagcacgucaucguuguuacucuuuuaucaugagcauagaugcacuuacauuuguuuauccauuuaccuauuggugacuauuacuccaguaaaaagaagcaaggaaaaaacaaaacaaaacaaaaacccuguauaauucugucguuaugaaacuauggaagggacagcaccugucuguaguggugagcuaaugaucaauugugugggaccagaaguggagaaagggcugucugcccaggaaggucauaggaagcucuuaagggcaauagaaauugguuugcggugauuauaaguguauuaggagucacugaaauaugucaaaacacaucaucucugcucaaccugagggugaugacccuuucacaggggucacauaugagacaucuauaugucagauauuuauguuacaguuauguaacaguagcaaaauuacaguuuugaaguagcaacuaaaauaauuuuauguuggggaggucacugcaacaugaggaaauuguauuaaagugucacagcauuaggaagguugagaaguagcucuaugugaacuagaugaaauugucuaagauacuucuaggaaagaaagcucagcuucaaugguuucaggcuuggugcagugguaugcaacuuuaaucacggcacuuagguagaggagagguggauaucugugagcucaagauagccuagucuauagagaaaaaaagaagaaagacaaaugucuuggagggaaggagucgggauugguggaagguuccuugaaaagggcauccaucagucagcagaguaggucaguccaauggguuuuaguaggaagcguuuuauagcacugugacugcaaguugaguugaagcauugaggagguagccugggcauacucugacaagagaccuccaagagaaagcucugaauggcuuugaaagcccuguuuuuauagugcugcagaucaggcugggcuuacccaggccaggcggauucuaccugacccauacuccucccuaacuauggcuucugagauugacuugaauacguuuauauauauauauagcuuucaguaauuugagggauuuuaaaguuuaacuuuucuaaacacccaguuaaaccuguaccuggagugacuaacaaauucggguguaauuuuauaaacacugacaugugugguuuucuagaaugcaauuuuauuuauucuugaagguuuuuuauauggauacaauguauauugauuaaaaaauguuuuucugauuauaauauguuguuuuuaacaaguugaauucuaacaauuuuaauuaacaaauugaauuuaacaacuugaacuuuaacaaguauaaaauuaaaguuguccccagccagagauaacugucguucauuucuagugcaguuuuauaucaaugugcauauuaguugauuuuauaguuuguggaguauuauauccuuuccuucucuugaucacauaauggacauuuuauauauuaaaagugcauauuuaaauaauacauuuuuaaaauguacuguauagcaacagucuaugauaacuacucaugaaguguuguauuuguguugguuuuucagcucucugacguaaaagauggggucagucaagcagugccugcguuuggauuuggaaguaagcaagcagggucguuugggucaccagguaagagaguguggcucagaaaagugggaugcuauagauugcaacuuuagaaagccugaaucaccauuuuaaauaauucucacaaauuccuccauaauggagccuugaagaacuuagcuccacaaaugcuuugggaagguaggcugguggagugggaguaagggggagugcuggggcucagcuuauagaaguacuuuugucucugagauaggcuauuacuguguagcccuggccuggaacucacuuugugaaccaggacuuuugauccuucugccucugccccugcaaugggaguacagaugggaaccaccaugcccagcucuagaagaacauuuuaggaaugucucucugccucauaggaaacugggcgugaugauuauauauauauauaauucuagccugcagaggcugcaguaaagaaucaaacaucuaaggcaagcuuggccuucauagcaaggcucucaggaauuugauaggagcacaccaguguggcaggagugucauugagaccuuugucagcacacagcagucacaaggcugcucugcugaaaagcauggcaagccgaagcgcacacccacucugacucgcauggacgcaugagucgugacagggcagugggacucagagggucgguuuaacuuuguuuucaugugucccuaaacucuucaauaucuacacaugucugaaauaagagaagggagcggcacggccacauuuucugacuguaaccuauguuuguaggcuucccagugaauaacagcagcagcaguacuguucagaacuuuaguuuuaaaacaagcccuggacuugccacuccuccuuccggaagcacuucaguauuuggaagucacccagccuuuggggcugggcccucugcgggcuccuccaucucuuccuccacuccagccuuuggacuugggaaaccugaagccacgucugcugcaucauuuucguucaagagcccugaagguuccaguuuugcaucaccuggguuuucgggauuuccagccuccauggcagcgagucccucuggcucuacaacagccccucccuugagaagcggcaguucuguggcugguuuuggcaguccuagcccacauucucaggcuguauuugcuaaaccuuccacugacguguuuggagguagcggcauaucuaccucuguccuagccuccggugccgcugauaacgcacuguucacacccagggaucagcugaugaaggaagaacuggagcaguuucaaucccagagauuuacccugggaaaaauuccacugaagccgccaccggucgagcuucugacuguauaaaggucagguuuaaauacagaaagaaugccuuagccaggcauguccugcaugccuacagucugggaagcugagcagcagaacaccacaaauucaggccaguguggacagcacagagugaacaagagaccuccaagagaaagcucugaauggcuuugaaagcccuguuuuuauagugcugcagaucaggcugggcucacccaggccaggcggauucuaccugacccauacuccucccuaacuauggcuucugagauugacuugaauacguuuauauauauauauagcuuucaguaauuugagggauuuuaaaguuuaacuuuucuaaacacccagcuaaauaaaggauagccaaaaaagucaauaagcaagggacucuuuuguacuguaauuacgaguggaacuaaacaguacaguguacugaauaaaguaauuuucucauucuacuccacuuucugucccuuuaaauagggaugugaacagugguuucuggagaucaaacccagguacagugucuccugcaugacaggaacuccgucucccaacucugacuugugccugcaugugugucugugcaccacguacaugccugguuccuuuagaggucagauucccugcagcugagguuacaguugugaggcaccauauaaaggugcuaggaacugaacucucguccucugaagcagcaguccuccuaaccucugaacuaucuaccucuccagucccaagcccucaccuuuuacaugggagaaaaucaaacguggaaggagccgcugaguggguggagcaguggcugcagagauaugcagaugugaggacccaagcugaugcccagcacuuaggcaugggagugcgugaaucugucuccccagcacucaagaggcagagacagguagaugcccagaacuugcugaccagccauuuccagaaacccugucaaaaggauggagaaaugauaggggaagacaccuaacaccaaccuuuggccaucacacacaccugcgcacaaacacacaugcguauaguagaccaaaaaacucaagcaaauggcuuaccuauugaaggaugggcacuccagguguucaugaacagugcggagcauucuuucccucgggauccauauucugacccuuuuaaagugugauucccaucuaacaucagaggcguugcucuucuauggaguccagcaaaugcagaucaacuacacaaugacaggcggaccaauacaugcgugucauuaacaaagaaucuuccaucacguguccuuucacgugcuugcuuuagcagagcauccucucuccugugucugcuucagcgaaacaugccgucacgagucugccuuagccuuucacaccuguguccacuuuaacaaaaacguuccuucauguuugccccagcaaaacaucauccaaacaauuuuccaaagaacccuuaaauuuccacuucauuauuuaaucuggaguccacccugagaaguggguaugguacgguaugcauccacuuuccacaaugaacauccaauaaacaauauagauaaacauggacugucuguuaucuaccaccaccauggggagcaugcaggucuuugcuacagagccgcugcagcuaaaucucagguagaaggccucuguacuuccagccuccuccacugagcuaaggacaaucaccccugagacaagcuggcacuucccuuccuccccaggcucucaccuagaugcuguccccagcccgugcacacacacacacacacacuccuccguucucagcucuucugugacuc

SEQ ID NO: 2367 - RNA, 20238 nt, Mus musculus
agcagucggcagaguugaggucagcuggcaugggcaacuugaagagugugggccaggagccugggccacccuguggccuagggcucgggcuggguuuagggcugugcggcaagcagggcccagccucuccagcaccggagccuagccaggcgccagcacccccguccccaacccgaccagcaccagaccacaggugaggggcacguggcuaugcgcagguaagaucuaugaguaaagggguuguauggaggacugaggccuggcucugggaagagccagaaggaccaggcuaccgaugccaaaagcuccuaaugugaacagaacagagcgagauggcauggcugaggagaggccgggagcgaggccaucagguauuggguaagaggagacaagaggcugcgacagaacugggccagaguuugaguguugguccaugucaagaacuggucaaccucagacaaguuacuuaaccucccugagccucuguguggauaaaagguggacuccgcagcacucaccucuuggggcuguaaguuuccaguuuaauggaagccucuacaaacaguaguaauagcuacuuaacuggagaagacaggggcaggggacgggcacacuaugugugggguuucaaagaacagcagagaucuggggccugagaugcaaacucuugggucggggggccaaggcaaagcugcuagguuccucuccugcuuaaggauucccuccuucugcccugagccgcagacagaccugcagcccuagcccucaaaaacaucccugaagagaagaaaaugaaaaauuccaguggguucaggccaaggggcuccugccaagccugaggguccagugcugcggcucagggccccaagucccucccuuccuccugcacaggcaggcgguucugggaggaagugauaaggcuucagggcuucccuucacacuagggcugcugucaagagggcugggagugggaguaaaaucagagcagaggaaucccugcagggggcuucccucagcucggcccuaaagcugggcagcggcuacuccauuuccaguugcccaaaucugauccuuaagauggaguagcaugaagaaugguggccuaggggccacuguggugaaguauaacuauaaucccagcaguugggagguggaggcaggaagauucuagccauccucagcuagacagaccuugagaccagccaggccuguuucaacaaccccccagcacacacccaagagguuauuucacucaugguccagaaacuggaacagcuaugagcauggcacaaccaccugcucugaugggucgucaugcaccaucucaggugaggcaagggcauuccgaggugagcacccagaccaagcaaggaggccaaagagcaagcucucgcuuuuuauuuuuuauuuauuuauuuauuuuuaaauaacaaagguacuccacuagaacccagucagucugccguaacaggaggaaucuaccaccucuccacucaaucgcagcuucucaacucuucucuaggauccaaacuuccaacuuaauaaagcuaggaaacacauucaaacuaaaagaacuucagguguaaaagacacaaaauagguucugcgcagggagugaggaccagucugggccagcacuccaagccuagaggguggccuggugguggugggaaacgagauaguggcucacagcacacaucaacucucuuguacucccuugcugggugcgucauuugaccacgccuugaagccuuuaagugggggcacagaagguacugcccaccuccuaaggcuguugugagagcugacagaaagugucaggaagaggagggugggcaacgacccuguaggguuacugaugccguacagugcugcccuugaacagugauggggaggccuaaaggagacaaacuucucacccaugacucuaugcauuccuggcccacaacagccccccgcuaacccggcccccagacggacccagguuuccucgaguaaagaauugggaagugggcagcaucaccuacgacacccucagugcccaggcucagcagguaaggacagguccugcccguguuucuaggccuggucccagaucaggacccaaaccaagaaacuccacuuuguucacauuuggcccuugucugcagagaguagugaaagccaggaaggaccagagggaucaaggggcauugcaagaacuucagcaagccuuuggcccugagccccaagcccuaagcaaccaaucucaucccauuuccauuaucagcccugcucugagcccuugcuuucccgagcccgccucccucugcccuugcuaacuaaccacagcucacucauccuguacuaugaccugauccuggccuuuguguccccuguucugguucaggaugggcccuguaccucaagacgcugcuugggaucccugguguuuccaaggaaguuacagagccggcccacccagggcccuucacccacugagcagcuauugggucaagcccgggacuucaucaaucaguacuauaacuccaucaaaagguggguccccuuacaccccaacacccugacacuugaguggagaagccuccagaucaccacucacaccucauuccccagccggauucaccggccugagaccaaggaucguucccccucuccccccuucuccccaggaguggcucccaggcucaugagcagcggcuucaggaaguggaggcugagguggcagccacaggcaccuaccagcuccgggagagcgagcugguguuuggggccaagcaggccuggcgcaaugcuccccgcugugugggccggauccaguggggaaagcugcagguauaaccagcuggcacgauagauaccaggggccugaacagauccaggaagcuccugaggccucccugagggacggaugugaggcaguggaaggguccuugucccacacugccuuuagagacaccugcuaaggagaccagauuaucccuccuugacacugcuggauaauccucagccuauuggcugacgagugguaaucaaggcccacagcccuugacugaagcaaucagauccuugaggcucucugaguacgugagaacagcugacagaggaggaaaaaugguaucuggcgauacuaacuaaaggucuauggucuccugccaugccuucaccucauacccacuuccccugaggucccuguggccccagucccacaccuccuucacacuaguauacacuacagaaccagccuggguuacuggaacagccucagcacuaacaggagccagggaucuacaggggaacugaacccgugaccuuggccgccuaggcuguacgcggcugcuaaagacaauggaaaaaagccacuugcucagugaugccaaagacacuccaacaaaauaagagcacucuacccgccagugcccgacccuuuaagugacccaucaagcuuccauaauaggcuccacucaccgcuguguccuucccuuggccacuggccaccacugccaccccuuauccugucacaaaucaccuucucccucaggugggauaggaugucccagccuucucaaaucagaaugccucuggcauggucccuagagcucuguagugcacccaccuccuccccucccucuucccaucacugcucuggcuggagggagcuggaugcuuaccagccuuggaugagcucucaguaccaaucacccaucaacuaggaauccccaccccaccccaccccacccccgcaggugcuccucugugcugguuuucaagucugcccuggggggaacagggagaugagaccuggaaaaaucaggcugugcugggcaaacaaggcuguuagaggagggucaguagggcuugaauguugaaagcacuggucacauggacaguggguagcuccuccagacccugccucccucccagcaagccccaugccagcaccccucuagagcugacagucaaaaccucaucucuuuccuacauccuuggacuguccuccuugggcccagguauuugaugcucgggacugcaggacugcacaggaaauguucaccuacaucuguaaccacauuaaauacgcaacaaauagaggcaaucuucggugagugacccugcccugggcccaagcccaccccaggcaacaguaaagcggcucuaaccaguuucauuccccgugucaguucagccaucacaguguucccccagcgcugcccuggccggggagacuuccggaucuggaacagccagcugauacgcuaugcgggcuauaggcagcaggauggcuccgugcgaggggaccccgccaacguggagaucacugaggugguauaccacuuugcuuucuagugcugugauaaaacacugaccaaaaguaauuuggggaggaaaggguuucuuuccucuaucaacucauagguuccuccauuccugaaggaagucagggcaggaacucacaacagaaaccuggaggcaggagccuggaggaacaugagggauacugguuacuggccuacucagcuaucuacaguauacauagcucaggggcagcacugccacaguggacuggggcccccuacaucaaucaguaaucaauaaaaucuuccauagacauggccacaggccaaucuagugaugucuucuccugugugucaaguugacaaucaagagcagucaucaucagugguucccacaaggcuugcaaggauagacagggaagccagggaacacuucaugggaaggccaagaggucagugagcagaaaggggggccuuccuugagaugaaagucaggcaugguagugcacuccuauggucauagaugugagaggucaggaguucaaagcaggccuugaugacaagagcagugggcauagagacccagccccugaggagccccugagguaaagagugggggaauggcuaauggggaagauuccuaguaaggucaugggucacaacccuugaccccaccucugccugcuucccauagcucuguauccaacauggcuggaccccaggaaauggccgcuuugaugugcugccccuguuacuccaggcuccugaugagcccccagaacucuucacucugcccccagagaugguccucgaggugccucuggagcaccccacgugagcaugaaaggccgagggugggacuguccgggggcaccuggcaacucuacauagaagcuaaucccaaacccuaccccuaggcucgagugguuugcugcccuuggccugcgcugguaugcccucccagcuguguccaacaugcugcuagaaaucgggggccuggaguuuccugcugccccuuucagcggcugguacaugaguucagagauuggcaugagggaccugugugacccucaccgcuacaacauacuugaggugagggaaugcugaggaaaggggacaugaagcuguaugcagcccccacucccacccagagugcuggccgugggaaagugugcgucaaggcagguccaaggauguacaugagcucuggagccacaaaggugggggaggggggaggcuaagugaggagcuugugaaggauagguuucaucagauucucaaaggagugugugugugugugugugugugugugugugugugugugugugugugaguguguguauguauguguguguguguguaugaaugugugugugugaaugugugugugugcguguguguguguguguguguucccaggcuggcccugaacaugguaaucuuccugccuuggcaugccaagugcuagaauucuagcuuugaaccaccaugccuggcuaaaggggaccuuaucucagcaaagguuuacacucugcuucagagaugacaaacaaaagccagggcugaggagagacuugcugccucuguuccacaguaccuuucuggacaaagcacugacccaacccaguauuccucucacccccuccucaccacucuuuugcugcuucucuucaacuugacccaggauguggcugugugcauggaucuggacaccaggacaaccucaucccuguggaaagacaaggcagcgguggaaauuaauguggccguguugcacaguuaccagguacgcaggcccagcggugggguuagggaacacagacccugagcacaguggauacauauuguagcccugugucauggcgcaugcugugucugcaacucuggauacacaggcacugcucugggcgcuauaguaugcuaccuaaguuccugccagaaaucuugcucaguaacugguuccaggguauacugugggacccaauggaaucuggacugucuaaugcugaguagaaaacaugcuggguacagaagugucauaauauaaugugugugugugugugugugugugugugugugugugugugugugugugugugugugugguaggugugguuugaggaagccagugucuagugaauaccuccauggagucuaaaaggguuaagaaaggacuugagaguguggcucagugguaaaugugaagccccagguucuaucucagcacccagcacugguggcaaggcacacagacacugcaagucugagcugcucuuacccauucgacucagagaaugacuauggaaucugcuggagauuugagaggacacagaauaugucauuugcagugacccaaggcacagaauagacuggguuugcagugauaaaggugggcucuauagagcauucugacccaaggcacagaauaggcuggguuugcaaugauaaaggugggaucuauagagcacuucugaggccaggcucuucuacccccaccacagcuggccaaagugaccauaguggaccaccacgccgccacagccuccuucaugaagcaccuggaaaaugagcagaaggccagagggggcugcccugccgauugggccuggauugugccccccaucucaggcagccuaacuccugucuuccaucaagagauggucaacuauuuccuguccccugccuuccgcuaccagguacccaacccaucuggcuccacuuagugcaggucugggcagcccacaggagcugcuuucuuccaugcuccuccccuuccccacuccauugcucuuuugcagccagaccccuggaagggaagugcagcaaagggggcaggcaucaccaggaagaagaccuuuaaggaaguagccaaguggguauccugagacugcaucccuuccccauacuauaggggaacaagcccaguaguaguaucacaagacuacagcgaugagguccaggccccuaccuaggaggucuggcuucugugcaccuagaugcccuaaucccacccuugccugcagugcagugaagaucucugccucacucaugggcacggugauggcgaagcgugugaaggcaaccauucuguauggcucugagacuggccgggcccagagcuacgcacagcagcugggaagacucuuccggaaggcguuugauccccggguaggacugaagccugagaggcagcgggcuaaaaaggauagagucuguccaccucuucagaggugccuaggggacaagagggguacaaguaaggguucauuucaaguccaacaugguggcacaucccuguaaucccaacaccugggcgacagagucaagaggaucaagggucauccuucauuauauaauaaguucaaggcucaccuggucuucauaagacccugucucaaaaaaguaaaagucaggguucacaaagaaagcuacagucuacaaggauucagcgugcaaucaggccuugucuugccuaagugaggacagagacaggaggaagacaagcgucaacacccaucuucucaccgcagguccugugcauggaugaguaugauguggugucccuagagcacgaggcacugguguugguggugaccagcacauuuggcaauggggauccuccggagaauggagagguaaggcuuucaggagaaaagauucaaaacagggccagcuagacagguggaugcaaacacacacacacacacucacacacacacucacauauacacagcagcauggaaaguuaauaugcuaaguagccccacuuccugauggggaugugaagugcugggaaccuugauuccuguauccccagccaucuccauuaucugugcaacucuuuugauauggggacggcacuucuuggcugaccagaguacucccaggucuugccaacugagaaaaauaaggauucccugcucacuucaguauuuuaacuuucucguuucuuguuuugaaaaaaaaaaaagcaugcacacucucuggaugcuagaauagcuucacuuguucaacaugucuuaaaagaaacuauagcugaggccaucaaaugccuuauggcuacccauccucuucccaugguacaccuccguaccccauguuugauucauuucuaccugcuuugggugucaggucccuuacaagugcugagucccuccucuagaauccaaaguuaaauguauacagcaagcuugaauucugacagaagccccuucccuaauucucaucugcuuuaaaaacaaaucaacaacaacaacaacaacaaaacccacuuaagucaggcgugguauccuguauaauccaagcacuugaaaggcacaggcaggaggaucaagaguuccaggcuaucuacagcuguauugugaguuuaaggccaguguuggcuucgggaggcccaaaacaagaaugucguuagucccaggacuagggagaccagcagguggaucucaggcuaacuuaucuacauaaugaggcccugucucaacaaaacaaaacaaaacaacaacuaagccagaugagauaagauggcuccccaggaaaaggcacuugccuccaggccugagacccuuggaucugucuucaggaccuagguaauagaaagacagagccaacuccugcaaauuguccucugaccucuacacacacacacacacacacacagagagagagagagagagagagagagagagagagagagagagagagagagaaacuaaguuaaaaauaaaagcaauaaaaaauuaaaaucaaaccaaagaagccaaacaccugucuccacaucugcucaguaccugauggggccucccugugcgucaggacagguagagggcagcaagacaguaggagugcuccagugagugcggccuuuauaccagggcuucccgauccagccccauuaauccguuaauccguggguggauuaaaccacucaugaacacagagcccucucaacccaaugaucuccaaaggucuggccuccaaaugucaucuuaacacaagaugggagggacaaacaccacaaguggcaauaugauuauuuuaaccaugauuuagcuuuggggcauaaguggagugugugacccacaguccuaacaagacagagccuuucagcagccuugaaagcccaucaguuucuccaggucagucccugucucagcagauggguuucaacugcucaagaaggucacaugaguggaagcacagguacccuguccucggccaccacgcagccacuuucgaggcucgucccuguccauuagucaguacuuucuuucccugcucaguggcguucgcugugugaacagccucagcuugcuuauucauucuucuguugacagacacuuggacugcuuccaguuuggaguuauuaggaacaaaacuguuaagaauauccuuguagcaggcuuuugugggcuuauguuuucauuuaucuuggauaaauacccaggaguguauaaggacaauguaaguuuaacuuuuuuaaaaaaaaaaaaaacaaacugucagauggucagauugaacuauacuuuugagaugugagcauuucaauuuuauacccccaauuuuuuaaagggagaaaugcaggaauauauccaacagaaaacagaguauacacaaagauaugaacaagaauauuuauagcaacauugcucauaacacccacacuggaaacaauucaagugucaaucaacaauaaauuggauaaacagugauaaauucacaugcgauucagcagugugaacgagucacacaacacaguacaaaugagaagggaaagcaggccgugaaaauacaugugauacaauccacguggucugaaguucaaaaccaggccauuguaagccaaggguuagcucacucuggagaacaguguaagauacaaaggugacuucaggaugcuccccauauuuccuaggggcugcuggucacacaucugguguguagaaaccuacaugacuguacaguuacucugagauguucacagacugaguucagggggauaggaagucggugcuuggcgagcaugcucaaggccauggcuuugaacccuggcauggaauugaucagcuguggugguacaucuguaaucucggcacucacaaguuggaggcaagaggguuagaaguucaaaaucauauuuuuagcaauauagcacauuagaauccagccuuagcuacaagaaauucucucucucucucucucucucucucucucucucucucucucucucucucucucucucugucucucuuucucucguacugaguacagacaucccacccagcugaccuauaguuuguauuuagaggcuguguuuugugucauuuuuaauuuguuuccauuaguaccaaaacgugaaacagccuucugggugaccacuugaguaaucccccuggagaggacacugccaucaggcccuaaagcacuaucugcucccuaaguagcuaaggugcugggcugcucaugucuagggaucacauagacaagcaugagcugccuuccaucugccacucaaggagggcuugcccaccccaccaaguucugacugacucuguguguguguguguguguguguguguguguguguguguguguguguguguguuacacuagcuauggaggucagaggaccuuuguagaguugguucucucuuuccacuuuuacacagcucaggguugaaacucgaguccccacccucuuauugaaagcaccucuaccugcugugcccucuccucagccaccacccauucguuuuguuuuguuugagauagggucucacuguguagucacuguguagaccaggcuagccucaaauucacacaguucuucccgcugcgauuagaagcauaucacacuacaccugacauaagcccuucaugcagcuaccucaccaccugaaugagccacacaacgaugaguggcuugugagugcggaugcuggagagcuacucacagacuauccagugcccuucugucacagggaagucauacaccaccaugcaguaaguaucggacuaggaugcagccaaccuaaagaaugaggucgagggccuagagagaugucuuagcagugagacugcucuugcagcagacucuaguuugauccucggcaccuauguggaggcucacaaccauccguaacuccaccuccaggggaucugacacccucuucuugccuccaugguuaccaggcaugcacgagaugcacagacauacaugcaggcaaagcauucauaugcacaaaauaaauacagcucaaaaaaaaaaaaagagaaggauguccacauaggucauugauaaaaagcaagcaagaauuacaggacucuguuacaaaacaaaacaaaacaaaaaacuauaugcaccuauuuaaguaccaacagcccccaauuuaguguguguuuuuauuucaauuguaacuuuuuguuuguuuguuuguuuuuuauuuuuuguuuuuuguuuuucaagacaagguuucucuguauagcccuggcuguccuggaacucacuuuguagaccaggcuggccucgaacucagaaaucugccugccucuaccucccgagugcugggauaaaaggcgugcgccacuacgcauggcaauuguaacuuuuuacuuugugauaaugggaaagcaauaugaguccauuagaaacuguauugcaaaucuuaaacuuagaucuguguccaaaccagaaucaagcuccuguguuugaguuguugagaaguucccaguuagccagacauuuguaggggaaagaaccaaggaaacuccuugaugagauuagaugugagagaguagggugcugacacucgguuaaaacguuuccagcguacaguggguguguugggauguaaccccacugugagucaaagcgugugcucauggauacaggguuaggaaguuuucaccugucaguaaguaguacacacacacacacauacacaaacacacacauacacacacaaacacacauacacgguuaagugccaagaaagaauaaaguuaggcuuucucuuuuacuuuauacaccucuguaauguggcuuuucaaaaggcaagcuuuugaauuuucaaaacaggaguuacuaaugaagacuaauaagagccaggcagccugguuuuaaguuccuguacaguguaaaauaaaacuaaccaucacgccgacucuucccugcacagagcuuugcagcagcgcucauggaaaugucaggcccguacaacagcuccccuaggccugagcagcacaagugaguaggaagaggggacaaggggcaucuggagacacugaagcaguggucucggggaccuuacccuccucucuucgggcuuuccuaacaagcuggaaaacagagagagagcaugaggcgucuaccaccacagcccuuccuucucaccccaggaguagaaaacccaaaacuauucccuggcugggccagggccaguuucccagucaguuccuugugacacccugucuuuauccucucuugccaggagcuacaaaauccgauucaacagugucuccugcucagacccacugguauccucuuggcggcgcaagaggaaggagucuagcaacacagacagugcaggagcccugggcacccucagguuggggguccucacuaaggagggugaaugggagagacaaacuuuaccuggguaaacuugggcuggcauggggacuccagcaccggcucccuggaccacagguucuguguguuugggcugggcucccgagcauacccccacuucugugccuuugcucgagcgguggacacaaggcuggaggagcugggcggggagcgacuacugcagcugggccaaggugaugagcucuguggccaggaggaggcuuuccgaggcugggcccaggccgccuuccaggugagcuccccgguacccuguaucugacuggaucagcaccauggucugacuccgacccaccugagaugccuccuccuggcuuuuguaguugaaagcugaaaugcugaggcuggagacucacuuccuaaucugcuucucuggccauucauucccuguuccuuuccaacugugcccucauuugcuacucuuccagaaucagccccaaguaguggacaacagggccuaccaacggaaaugcuacacaaagccagaaacacagaaaacaguggaggaagggccuacagucauaagcuggugcuaagagcaggagcacaaagggaaaaggucagggcaucagggccccuucccaaggcagccaauaaggaagaagaaagagggcacccagaggaucggaggucagggcugaagcugagccuggagaccagcccaggugccuggccuagaggacuaguucuggacacagaaguaucccagggaacuuccucagggaaucgucauguugacgcuucucacuuggcgcagggauucccccacauccgucuguccguccaucugggguucaguuuuagccaauugggaugcaaggcaagaaggggggcuucuuuagaguugggagagccagaggguuugcuuaaaggagaaggcugagauugagaaacgaaaauaggaaaucagagccagagaauauaggcaaauggagaugcuggggguuucugagccgggugagaccacagcaugaaguuucagggaggugauacagauggauggaaacaucugagacgcaggaagaugggcucacugugaccauagcaguggggaaucugaaggaagggagagggccaaggaaggaaggaagagauauaaggcuguacacccuagaaaagaaacaguaacagccuggagauaggucccagcccaucacagagcccuggaucucaaggcugagagagcaaacugcuagucagcuguucccugaccaaaagcagacaaagcaggcuuccuauaccucucauaggaagauagcacuggcccucugcauacugugcuaagagcuuugcacaaagugccucaaauagggcugggguguagcucaaguggugguugcccagcaugcacuagcccuggguuccacccuugguauuaaaaguguagugguacauuugcguaaggccagcacuuggaagguagaggcaggaggauuagaaguucaaggccaucuuuuccacauaguaaguuggaggccagccuggucuacaaaagacccugccucuaaaaaugaaaguaucuuauuuaaucuuuucuggaaccucaugagggaucaagaugagagacugagacacauaagauguuaagaacggaaagauccaaugcaggucggaguucauagcugccuuuacugucuaacugcgcucccagggacagacggggucagaacucagacaaguauggcaagucagggccccuaugauagcagccaaaugagcuagaaaauaaggagccaucauguacagcagccucagccccagguucuuacaacuucauccuccaucuugccaguuagggugccaaccccacagcuagggaucaggcugcccugcuugcaauggaaagagauuguuggaagcuggaagguuaagcccuugaaacaccccucccccacuucucacugaggcugccugauggcuggcaagcagccuuagaccaucaccuacucauccuucaggcugccugugaaaccuucugugugggagaagaugccaaagcugcugcccgagauaucuucagccccaaacgcagcuggaagcgccagagguaccggcugaguacccaggcugagagccugcaauuacuaccagguacaacccugaccucaaucugaccuugcugagugaggggccuaggauucuccucacaggccaggacccacucaguugcucaagccccuuuaccaucggcuucccagggcugacucacgugcacaggcggaagauguuccaggcuacaauccucucuguggaaaaccuacagagcagcaaauccacguaaggaacauggcuccuggcuccccccacccuccucccuguuaggaucccucuucauucagaauauagccccuuccuucucccccauuccuccuuccuccuugauggccucugaccccaauaacugccuccuccacaccccuagccgagccacgauccuggugcgucuggacaccggaggccaggagggacugcaguaccagccaggggaccacauaggugugugcccacccaaccguccuggccuaguggaggcacugcugagccgaguggaggacccuccgccauccacagaaccuguggcuguggaacaacuggagaaaggcagcccuggugaggaucauuggcugggguaggagaguaagagccugccgcauacuggugcaggacugccaugcugcucagcacuaacagggcugcugcccugcuuuccaccugggcgcuaccuggcccuagcugccacuuuagccacuuuagccuggccuuguugcauaugguauuucccagaacccaccaggcacccuaaaagccuucucccacagccuccgccuccccacagucuaauuucucuacaguuggucuaucuuuuuccaaaauaaugccuggaauuaagauaacuuggugggguuaaggguggaggagaucggauuaaccuagcccagccaggguuccucaaagauaccaaggcugcacagacaaucccaugccaccauucaaggacagauuuuccaauaagacacaguaacuugugguuagcccugcccccccaagagucaacaucagcucagaccauccagcuccagugggcccugcccucagagcucccugugcaccaccccuagguggcccuccccccggcuggguacgggacccccggcuacccccauguacgcugcggcaggcucucaccuacuuccuggacaucacuuccccgccuaguccucgccuccuucgacugcucagcacccuggcagaagaguccagcgaacagcaggagcuagaggcucucagccaggugggaaccauaguucaggaagccccuggggcuggacuagaggaggauaaguagggggacaucgcauggcaggaaauccccugcacaugccaggucuucuggacuugccucuccuagccaacaugcccaguacuuuaagaccuguuuccaggccaaccugauucaugucugggugcugagagucuucaaguagaguguguuggccugaacugagcauggaugaaugcuaaggacacucagcuagguagagggcacucugggaggguaaguuacucugaggacuguggggcucucagcucagcacaucugccccccccccaggacccccggcgcuacgaagaauggaagugguucagcugccccacacugcuagaggugcuggagcaauuuccuucaguggcacugccugccccgcugauccucacccagcugcccuugcuccagccccgguacuacucugucaguucagcacccagcgcccacccaggagagauccaccucaccauagcugugcuggcuuacagaacccagggugaggcugggagcaggaagagccuaaucuuggccaggcuaggacaggacucugaaugacuucuccuucuaaccccuagaugggcugggcccucugcacuacggugucugcuccacguggaugagccagcucaaggcgggagauccagugcccugcuucaucagggggugaggggcccucuuggguagggaagggcaacuacaagagguugucuguguccagacaggggugagaaagugcuaucuauauacacggcagggauacaugagaaaugugugugugugugugugugugugugugugugugugugugugugugugugugugcaugagggcagggguaacacaauaucggcugguaauuacugaaacccuauuauuacaucaagaaugguggcucucugggucacuucccaacuacaguugagcuuugagucucaaagcuuuggugcagggaccugacccugaagccacaauuacagcaacaacauagauuagacaguagcccugcugauuggugaaagaguggccccagcacgauucucuauguccuuggcuacuacccguguuaaaaggcuuggcuucugucaggcauggugggagagggggagagagagagagagagagagagagagagagagagagaaagacucagccaggcagugguaucagaugauauugcaugccuuuaaacccaacauuuggaggcagaggcaggcagaucugaguuuaaggccagccuggucuacauagugaguuccaggauagcuaaagcuacccaagaaacccugucuggaaaaaacaaaaacaaucaauccaucaaucaaacaaacaaacaaaagagacucauuugucauugguccuugggcuuuccugucuguacagccauagcuuuguugauaugucaugggugacgauguaaaggggucuuaauggacucucucugguuagggcucccuccuuccggcugccaccugauccuaacuugcccugcauccuggugggcccagggacuggcauugcacccuuccggggauucuggcaagacagacuacacgacauugagaucaaaggugaggcugggcuaagggugaccugcaagucagaaggaagccaagcagaaaaucaauggcuuggaagaaacgaccauaaaagaaacuaggcccaaaggugaaaagaaacauauuuaaugggaaagggaggagagucgagucuggguccugauugucagccuuccugguggucccucagcauauaguagguuuuaaaauggauuaaggauagagaagggagggacagagcaggaauucgaacagaaaacgacuccagguugauuccuuuugaagucagaacgccucuggggugauccuaucuauuaacugacaggcacagagaugucaaucaaagugguugugugcgauaggacuggagugaggaaaaagaccugggauuucacacaaggcaauguguacagaauugaguccaguagagcaguuuccuucuauaaaucaaaggugugcaagggucugggcagaaagcauccuauuuugccccuagaggcugaacagacaagauagugguugcuccaagccaaaagucuggcuggcacccugaguggccuggaggugggguuaccaggacuguuccagaggaaggggcccucccaaaccuccauguugcucacagggcuacaaccugcccccaugacuuugguguuuggcugccgaugcucccaacuggaccaucucuaccgggacgagguacuggacgcccagcagcgugggguguuuggacaaguccucaccgccuuuuccagggauccuggcagccccaagguaccaggggcggguguagagauagcgugacaaggccguucccaagccccgccccucccaaacccaucuuacccgggcacgccccuggccugggcguucucacagcaaggcccgucccuagaccuacgugcaagaccuccugaggacagagcuagccgcggagguucaccgugugcugugccuugagcaaggacauauguuugucugcggcgaugucacuauggcaaccagcguccugcaaaccgugcagagaauucuggcaacagagggcggcauggagcuggaugaagccggugacgucaucggcgugcugcgggugcgaaagggcagaccuggccgggcuaggguagaucuaugcugacagcuccuguucggguucuaauccauugaguucuuuuccuccccucaggaucagcaacgcuaccacgaggacauuuucggacucacauugcgcacccaggaggugacaagccgcauacgcacccagagcuuuucuuugcaggagcgacagcugaggggcgcagugcccugguccuuugacccgccuggcccagaaauaccugguuccugacagucuuccuccccuccaguucccggaaagagggauugugucacuucguucgguugaccaaggcuagccacccucucugaagaaugccuacagcauugguugcaaggcugccaauuuaagaucuuucuucucucuccaguuuaccuaggcuggggggggggggucggccuaaaucuugaagguuccuccggcugugguaguuagggcauccugcugcccucuucauaugcuuugauggacuguagacucccuuuaacucucucucuggaguaucuuacguuuaaagucuaagucaucccgguauuuauugaaaaauuaucauaaaagaccaugccagaugcccaacccaaaccuugugaguuacaaugauugaaaaugagacuuguucaaugcuuuaauguguaaagauguugggauaauaauucuuugacagugagucccagacaccucucuguaacccaguacucugcaaaaaaaaaaaaguuucuaaccagggacagacaguuuugcgcuugagugaacaggugcaguccucagcuuccaagaguggggcgugccagacauucccauggcaaagaugugcagcucaaccaugagcaauuucugcugcuuguuucguacaggaugaggagucccacccacuuccuccugcuaucacagcagugcugacguccaaaaccagcagcccucucugguuuuuccacucacccgucuccauauuccccaccccuagucccacaggaacucaaaggggaggucgacaggaacaacuucccuaacacugaguugaaccaugccugggcccuggccccaccuugaggccacugggguccuucccaggcaacugcuccacaaccagccaggcuaguguucucuuauccucacuuguggggcccaucuguaggcuaccucagcucacaaucaucuccuacuuuuucacuguucuccgggcaagccccucuuugacucccagauauggccaacuaaaauauccugggccugucaucggaaauaggaauggagcucagaagauggcuucaaguguccuuccaugccacccaucaaau

SEQ ID NO: 2368 - RNA, 16392 nt, Mus musculus
gugacucaagccucuaaucccaacacugggaaggaaggauggugaguucaagacaagccugggcuauaaagagagucucaggcuagucagagcuauguagcaggucuuggggguacuuugggagacaauuauagcaagaauaagcuuagcccaacugcugcaagagcuauucacuuuugagcuggaaccuuaggccagugauucagacccaaaugaagaaggaaccuaaagguuagcucuuagguugcacuuugauuaacuucaugaccuacauacuaauaauucacgauaacugugaguagcaggaucacauagggagauuagagacucaagugguggcacguuacgugcauguauguuuuuguuugguuuggguugaggggugugugugugugugugugugugugugugucuguguguaguuuuuuuuuuuaacucucaggucuguuuucacauauuccuucucacgaaaccaccacuuccugugaugccagggagcauagagauugucuggaacaacucuagagaaagggcucaaggucagaagcgccaggacguccucuaaugugagaaugaacgucgcacaaccucugacccgcaccugacuucaggccacugagcaaauagcuagagcugcuucugcucggucccgccuacagccaacauuuuauccaaucacagcuugcagcaagacugaugugucuuuucuccaaucaucgcugagaaugggaagggguugucgggauggggccauagcgaacauggaacccucgguaggauaagugugagauugccguugcuggcugccccuaucuuauugccucaacauguuggugcacuuauuucgguucggaauccgggguggcccaguuccaggauggucgcuacaaucccugcgcuuccagacguucucugccgccagguaaaaacacaagagcaacuuggagugugggccauugaccaccguccgacaucgcgcggggcccgccgggauauguaguuccgggcucgcgcggggcuugcugggagauguaggcugucucggaggguguggaaugucacuguccagggaauuggccucaauuauucaugaugcuguguggugccagcaggaggcuccgcaggucuguauccacuugcggucaggacucagccacacccagucaccacugcccacuaaggggcgccacucacagcucgcauucgcucucugguaauccaccuggagaucuguaauugguguccauagacauuuacuauugauagugcuucaggauuagcugaaauaguucuaaauaaucaaaagcgauaccugagcuggcgagaugauuuagcaguuaaaggcacuugcuaccaagccugaagacguggauucuacuugaaaacucaugguaggagguaugcaguuucggcaaauuauaauuauccucuuacuuccacuaucccaaacccacuaaauagauaaacacauacgugcauuuaaaaaaaaauuuuaaaguagguccuagcuagaaucuacugugaauucaaggccaggcuggucuauagagagcuccaggucagcccaacuauacagugaaaucucaacagcauccacguuaagcccgagaguugcuaggaauuugaagccagcacggacuacauagugaguucugagugaacaaaacaaauaggaauuugauucuuagagcuagauguaucgucaggaaccgagccuaguacccuuuacucaagaaggugagucuaaauccaguauacagccgaauguauucuauacauucuaaguucaaggcccaccuggaaaacuuuguaagauccugugucaaauauaaagaguaaaagggucauucauaugacucaguggguaaagaagugccaccaacgugauccccugaguuuguaaucccugggacccacguguggaaggagagaaccaguucuuguaaacuguccuuugaucucaacucacuguggagugcucaggcauggguguguuucucgcacccccccccacacacacacacaaauaaauaaauaaaauuacuauauuuuaaaaauaaagaguagaaggagagcuggagacauggcucagugguaggcuuuuuguuuguuuguguuuguuuguuugacaaacaugaaccauagauucaauuccuaguacccugggugggaaaaaaaacugauccauucuugguaaaauuaaaaaagcaaaaacaaaaacagaaaaacguaccccacauugauccagagagaauaaugaguugaaagcauagaagagaccaaagucuaauuuuucucuuuuucuccuaguaauuuauuuuuuauguacagugguguuuugccugcacguaugucugugugaggaugucagauacccuggaacuggaguuacagacaguugugaacugccauguggaugcugggaauugaacccuggugcucuggaagagcaggcagugcucuuaaccacugagccaucucuccagcucauuguuuuuaguuuuguuuuuguuuuuguuuauuuuuuuaagauuuauuuauuuaauauaugugaguacauuguagcugucuucagacacaccagaagagggcaucaggucuuauuacagauagucgugagccaccacgggguugcugggaauugaacucaggacuucuagaaaagcaguuagagcucuuagcucuuaacugcugaaccaucuucccagcccuguuuuuagcuuuuuuuuuuuuuuuauaaagauuuauuuauuauuauauguaaguacacuguagcuguccucagacacuccagaagagggcgccagaucuuguuacggaugguuaugagccaccaugugguugcuggaauuugaacucuggaccuucggaagagcagucgggugcucuuacccacugagccaucucaccagcccuguuuuuagcuuuuuaaacagaguuucacuauguaguucuggcuggccuggagcucucuauguagaccagucuaaccuugaacucacagagauccaccugccucugccuccugagugcugugauuauaggagugcccucuacccagaaccuagaauuuaacuguaaauauucuacaagaagcaacuguuucccugacagguccaggggaaggcuaccaaggguagguaacuaugaggggaagguugccaaagguagguaacuaugaggcaagcccaccugccugauggagggaggagggcaagcaugggaacuggugcugggaagccuuccaccaguuguugacaauccccauagcuucuugguuuggaggagcugagagaagcuagaaaguagccaugauaaauuauuaaugucugaaaacagucuuuagaaagagugaggguguugguaauauuuggaccauaaagagacacaaggugagaccagauaaaugacuguguucauuucaguucaugaaacaaauuuagcagaucagggucauuuugaaaggucaucagaaacuaucagaauauccauuucagaauuaagggacauaucuuaugaaaccuuuuaacuuuggcauucacacacgcacaugguucuggguuguacuaagugcaguguaccgucucagugacaguaaaucuguauguuugcaaaaauugcaguggucagccuuacugcauaucuaacaagggcauacacagcuuaacaaacaucugcucaauagauaucucauaucccagaguuuccuaaguucuagaguauaaaauaugccucugcccccucaguaagacuacuggaaaauuugggggcuggugagauggcucaguggguaagagcacccgacugcucuuccgaagguccagaguucaaaucccagcaaccacaugguggcucauaaccauccguaacaagaucuggcgcccucuucuggagugucugaagacagcuacaguguacuuacauauaauaauaaauaaaucuuuaaaaaaaaaaaaaaagaaaauuuggacaguaguacaggaagaaaaaagagugaguuuuaucuuaaacugaggcuagauagacauaaggcauaguggggggcgggggcgggggaggaacacuaggcaucuguuaaugauguauaugugggugaguacaugagugcaggugucagaggacaccagagggguuggauccccugaagcuguagucacaggcuguguauucacaguugugaauuuccugacaaauaugcuggagucaaucucaggucgucuacaagagcagugccuuugacugcucagccagcucuccagccccuauuuuauuuuagucuguaaugaggucucacuuuguauuauaggcuggcuuugaacuugaaaucuuccagugucagccucccaagugcugggauuucaggaaugcaccacccccacgcccccaccuccacuuacagucuuucuuuucuucuaagucuuuccucaucuauucgucuauuuugaacauucgucuguguacuuuuagccagauaacuucugcuccaaacuguccuguccuuccccucuggcucuuucguauuaugaccucuaaaaugcaaaucugacuuuauuacaccuuauccuaaaaacugcagauaucccuaaaaaccccuccugagaagguggccuucuugcauccaggagcuuuguggaggcucggaugcuauccuuccaaggcagcuguuuccucugccucccaugcacccuggcaaagccaccuuguugcugaaggucuucucucacugccccaccugcccacaaucuccagugugaacuuuucugaugcugaggucaaacccagcagcacauacucugagcucugugcuuccccacccagcauggccguaggggaaggagguuacucugucugauuugcucaguccauagucugugacacaguggguuuacagguguuguaagcagcugaauccucuugcucucuuguuucucucuuucccucuugggcucuucuuccccacccccuucccuucugccucucuccacguggucauggccauggcuggccucuauuucucuacucucucccucucucugccuuucucuaccgcuacccucuugccuccccuccccaugaccugaauaaacucuacucuauacuuuaaaaaaacaaaaaagcagcugaaucuaccuuuccauuuuauacauaugggauguuuccauuuuauacauaugggaccugaaggaugacagaaaucaguccuuugugguuuuguuucuguuuccucugucucauugcugaaugagagaggaacauacagcccucuugcccaccucauuccugggaacaaauuauaccaucucucacucaguucuucuccuuaccaagugagaauaagggcaucccucagggucaagagcuauggaccauuuacucuauugccaggucacguugaugaccuugcacauaugcagggguaggcacagagaagaaagcucaccccccaagauucucucugagccuuccucuagaaagccuucuugauccgucccuguaaaggaggccugcccacccaccccccaccccacccucggucugccgcuccagguguccugucuggcaggcuggagaccugcauugacuggguggcuggaggcuacauaggggccuggguggcugaugcggccuggacaaaagugcuagaggcaaaggcucuuaggcuuguacucugauagcagaacauuccccaggugcuccacaugugagcaggggucuuacagaucagcauugcuuaagaaugcuaagguggggcuggagagauggcucagaaguuaagagcacugacugcucuucccgagguccugaguucagaucccagcaaccacaugguggcucauaaccaucuguaaugagaucugauuccuuuuucugaugugucugaagucagcuaagguauacucauauauaauaaauaaauaaaucuuuaaaaaaaaaaaaaaagaaugugcuaagguguucauuuugggugagguagcacauaccugaagucauagcuacucaggaggcugagccaggaggaucacuugagagcaaaaguugaaggccagacuggggaauauuuuaucucaaaagaaaagaaaagaaaagcauccguggagaggcugcagauaaaaugcuguuccagaaaacucauccagagcccaugguuggggggaggaggcggcggagggcggggcugaguaugugggcaaguguuaguaauuugaaggacagccaggcccacagcugucaaugccuuuuucuaccugcagguccucagaugaccggcucagcucacaccuccugcggacuguagcccagcuccguguacagcuccgggcucaccucccucgagccccaccagcuucccacuggagccccucugccugguguuggguuggggggaccuugguggucccugcaguccuguggcagcauccacgccucugccuuauagcacuaugugaggccaaagaguccccuccugcccagcccacacgugccccagagcugcgcuuuaauuggaagcucuucuggcauuuccuucacccccaccugcuggccuugggggcagccauuguggugaggcuuucccugcuccuccgugcucaggccaggaagggccuaggauagcauuccugccuuacggcaaugacccuggggcaucgggauaaccugugcaaggggcugagucuguaggcuaugaggacucaggggcuggaggucuggacuuaagcucucaaagagacacuuuugugacauggauggccaugguguggacaaggcaaggcugaguagggggagaggaagagccagagccagagcgggggaggggauggauacagccuccucuccaggucucucuucccucuguccuguuccagcuggccuuaggugcggcacuagugaaugugcagauccccuugcuccugggccagcugguggagauugucgccaaguacacgagggaccacauggggaguuucgugucugagucccguaagcucagcguccagcugcuccuacuguacgguguucagguauagccggguagcagggcucggggcucacagcagccuucuuauggugucgcuaaaugccaggccucucuuccagggacugcugaccuuuggauaccuagugcugcugucccacauuggugagcgcauggccauggacaugcggaaagcccuuuucagcucccugcuccgguacuagcagcuguagugggugggaccaggguagaccgggguaaaccaggaggucuagguggggcaaauccugaagugccaucuccucuuccuucaccugcuaccaucaugucuuccugccaggcaagacauugcuuucuuugaugccaaaaagacagggcagcuagugagucgcuugacuacugaugugcaagaauucaagucauccuucaagcuugucaucucccaggucagugggucaggccccugugcagacucagcaggccagaauugccugccccagcccugacauucuaacauugccuugaaacaaggcaaugccccugcccagcucuuacuguagacugucugaggaaagcaugagagagaaggaacuaaagagucaggacaggcugcugucccaugcucugaaaccuugccuccccagaaagccauugugaggcaguuauccucacagugagugauccuggcagaagcaagcucaucugacccagcaugaccccuucgugcccauacccagcuggcaucaaacucaugcgugacucuacuccauacugauagucuguccugugcgccccuccuucaccugguccggugggcaggacacuggcccaugguagucaguguauuccugugcaguccagcauguugaaacagaaacaguggauuuguuuaaauaaaaaggguauggccuauggacauucucacccaucccuuuugaaacugauaauuagguccuggcuggccaagaaagggguucauuugguaacccauaacugccccuugaccuucagggcucgcacugcuggccuaggccucauaagugcagagcuguggccagccuacccucagcagaacacucaccaucuggugccgaugcucuaacauccugcccuccuuucacuacucagggacugcgcagcugcacccaggugauugguagccuggugucccugucuaugcuguccccucgccuuacccugaugcuggcugucgucacacccgcccucaugggagugggcacccugaugggcucaggccuccgaaagcugucucgccagugucaggagcagguacugggauucuugacuugucucccuugguucuuccuagcaucucuggcccauucuccuugcccuuccuccugccucuuccugucuacaacuacuuccuauuucccugucuccaugcagauugccagggcaacagguguagcagaugaggcccuuggcaauguucggacugugcgggccuucgcgauggagaagagggaggaggaguaagucccgggaaagcagagcauagagugggcccauccaucucaccccuccccugcccuggcccacagcccagcugccucccgagugcccagcccagccucucuucccagacgcuaucaagcagaacuggagucaugcugcuguaaagcagaagaacugggcaggggcaucgccuuguuccaagggcucuccaacaucgcuuucaacugugagugagcaaggccugucugggaggggacgugggcaugggcugggugggagcaaagagaggcaacagacagccuucacuugcccaggugcuccugacauugagggccugcauuugugagaugccgcagcuucugacuccugugggauauuaagugaugucaucccuuagcucguggagagugcugcaaggcacccuuaaggagugugcuguaaggcacccuuaaggagugugcugugcaccucaauguuaggaaacccuucuguuucuccagcccuuuacguuuucauuuaugugugcauguggauguggguauguggaugugagugcagguaccuaaagaggccccagagugggaauuacagacaguugugagcugccagauguggcugcugggaacugaacucagguccucagcgugagcagugugugcucuuaaccgcugagccgucgucccgguccuuugauuuuuagauagagccucacuaaguuaccuagauugacgucagacuuuuucuguaucccaggcugccuugaacuugugguucucuugccucagccucuuaaguaacuguuacaggccuacaucacuauaccuggccugcccaucuuguuucacaaauguggaguugagggcugagagucaacugguggcaguacagggguaaggcucaggacucagucuucaucccuugcuacuuccugccucacugccuggccccuuuccauguagguauggucuugggcacccuguucauugggggcucccuuguggcuggacagcagcugaaagggggagaccucauguccuuccugguggcuucccagacaguacagagguaaguggggaccacugucaucucucaggagaguucccccuacccccaccccacccugccguccuuccagaacccugcuuccuagaacagggaugccaguguacuugggggaggagaugcugccuagcacuaacccuggucccccagggggacacaacagggggagccucuaacacuuccacaagagccuucuaaggcuccacugcgccuccacucagggaugcaguaagcaccauuagcuuccaggcagcucucaagugucccugagaagcuuucaaaaaaaaaaaagaauuaauuguggugaaauagacaguggaaauguuauugccugggccguucuuaagugcacacuuugguaguguuacacacagcucaguguucucagccaccacguuguguggcgugcguguaucagcgcuugaauacccuauggacaccuuccugaacaggcuuuuucagggcugcccuggccucagagcuuuccaaggaugagaugaagagcacugccccccgaugcugcuugugugacuuuccucucccugucuagcugagccccaucuaccccaugcagcaaccuggagcucaucugucaccuuggccauaaggcagccucagugggcugucucagcgggcugccccggcaggccucagugaaacccaagcacuuccuacuguuguuucuaccuugcuuucccuagacauagcaaacuuaaaaaaaaaaaaaaaacauaaauauauguuaugauaaacaacuaaagagugaauaugcuauaauaaauaaagggcaaagacuuauuaguaccaaccacgucaggagugcucucccccuucucaaauugguccuucccuacaaaggugacacuccuccucauaguggugcacugucccugcccagaguccuaucuugccauugcugugacuccacaguucuuagagaaagaccuaguaucuuguugcuauugucuagugugacauaaggccaaccuggagauuguagaacagucuugucugcacgauagccagaggacuacagagcagagcucaccgguucccagcuacaugggcacugccuuugcuuccauuucugcuccacaucaaagaccgucagauccucuggucuccgaagccuuaucuguccucuggcccagcagcuguuccucccugccuuugcuaucuaggugcucugauugcaaaagagguaggggcuaccaugucccuucugcuaccuugcauuccuugugcugaccuaauucccaggucagcguggacuccaguccugaggacucggaugagcaacuuggcucuacucccuggggacaugccucccaucuucauguucuucccugccuacugcauuguucagcccuaacgaguacuaugccuagacugcagggcagcccagagaguagccuucgcugucucaggccccuggccaggucaccaucaccagccaacuggaggauuuggccuccuugggaagcugcuguguuucucucugccucuugcuguguauccaagggcccaugugucaaggcugagguccaaugggagggaugagcagggcaucacagcucaagcuaaguguuccuuuuguugagaauggaugguccccagucgggcaucugcccaagccagcuuacuucaucccagugcauggcuggcccauuguaccagcucucagggcaaggucagagcacucccgugagucgugugugcuuuggauuucaguugugguugccccuuugccaggcucuaauggauuccugguuuccugugagcuggucacacccacagauaacucacccacucagcuccucccuccacagccaaccuacuccuggcaagugccuauugcccaaagccugccauaacuguuuccuugagggcuuuggggugcuuacccagcaccagaagggugaacuuaguccauagcuugugggauggcagucuuuccucuucuccgaaagggcccauugcacucagaggcauauacccguagguuggcuaacccacuggggaccaugacuaaggcuguugacucaucuucuuucuuagcucucagcaggcgaccagccccagcccugccaagacaagggaggugacccacugucuagacagauaaacacauagcaucaccuacacaugcccacuuuuagggcaagcccacauagaaucuuugucaggaaauuuacuuugggggcuccccagggcuuccccuuuuaguccccugucucuguuuuucuucugaaagggcuuaacuuguuuuccaucugaauuuaaguccuugcuucuccagagucuaguguuaggucugaccucccacugugaacccauccuuaucccuguuuaguuaaagcccucuggugggccaucuucacccuguuuccugaaggcccgggaagcauguggacauaccacugaguccuaaucacuuacccaucagccacugcugccuggggccucuccagauccuggcucuggcagcaggcagcuguuaacugaagggggaacagaagcucagugaucuggugucacagucccagggccauacaugugagcccugccgcugccuccccaacauagccuucccuucucucugacucuuguuaauacgucuucucacucuccucuggcaggucuauggccagccucucuguccuguuuggucagguaagugagauugucccaagucuggguuagaguccccaucuaucacuagagaggugugagguagggguguggcuguggcugcugugaauacugccuuugauugggggugggcagagguagaacaaagaacaagguuugaaccccaagaccauagucugacuccacccuaugaagggucuggacacacuacagcccugccugguagcagaagcccccuucccuggaagcccugguuuuuaucucaaccacaaacuagauuccuucugcaggugguacgugggcugagugcgggagcccgagucuucgaauacauggcccugagcccugucaucccauugaccgggggcuacugcauccccaacaaggacauucgugguuccaucaccuuccaaaaugucaccuucaggucagcauuggugguuaugcugagaaugaggggaaaucagcuggcauuuaacugaaagcuuccugugagcaaggcccugugagggaccuuagggcaguaaaggcuaggaagcuggucugacuggggcucucuuggccacccccagcuaccccugcagaccuggcuucaaugugcucaaggacuucacccugaagcugcccucuggcaagauuguggcucuugugggccagucugggggagguaagaggaagcgcacgacuuucauccucugguucguauuguuugguaaccacuuggagcagggcugguggcaagcccuccgugguuccugcuccuaccugggauggguacccuccaguacgacaagggucugucuuugcuaggagguucuccccaacucccccucccuccaggaaagaccacaguugccuccuugcuggaacgcuucuaugacccugaagcuggcucggugacguuggaugggcaugaccugcgaacucucaaccccuccuggcuccggggccaggucauagguuucaucagccaggugaagggcagagcugaacagggucucaacagcaagacuggggccccuuucucucuuucccgcucaucucccuguuucucugaggacaucugugcucuucaugguucuuaggcauccucuggauccaguacgucccucucccucugcagcuuuguccuuguacuccagagcauagacacugcuccuaugggcagcagucuuaagaucccagagcugugguucuaaggcugccaauagccacaagcaggaaaggccaaaacucacaugaccuccuauuacuauagggccuguccaucaucaccuuuggggugcucuguuucccauuaaugagccacccugcccucacaugauuagcauuuggcuuugaacuugagaccugcccuacaaucaugguccuguaaaauaagacccuccuggugcacauggcaguccccaaguuuugaggcuagcuuagaguauaaccuguagauaucaucucuguguccccgugccacucaaccuugcaggagccaguccuguuugcaacaaccaucauggagaauauccgauuugggaagcuggaugcuuccgaugaagagguguacacagcugcacgagaagccaaugcccacgaguucaucagcagcuuccccgauggcuacagcacugugguuggugggucccuugaugggaaggugcugggucagcagggcaguguugacacucaggagccaugguucuguugacauggagcaccucagcgugacucaggagggacagcuaggagacggucaagccaggaaagccagaccaugguugaggggacaaagauggcuuuauggagacagaagaaccugagacauguggcucaggccucacagacuagacagggcucugagaggagauggagauuauaauaacaaauggaaaugggagacccaggccacaggcacaaagggcuugugcacucaaaccuaccacagcccaggacaagaaauaggaccccucucagaauuuucuguguucuucugguuuccuugcccuucaguggcaucgccucagcacaacagcugggguugugugcaggccuuuucugucuucagggugcuggaccauacagugucacacuagcucaugccuggaacaaccuaagccuuagauguucaucaccacagcucuucugucaucucuggggcuacucugcugacugacguggaccuuucaggcagugcccaucucuagcaaucccuccagguccuaacacagcuguguucacaugcucaggguucugugcuguucugaugggagacccuugucaucucuauucggcccuuccuugcuccuucaauucuggcgugccccuuguuauuggggcuucccaagacugcuccccuuauugagcugugacccugccaucacuuggcagucccucccaggguuguccucugugguuagcaucugugugcugugcagcccaugcuuggguuccaaguggucuuacugcagccaaggccagaauccaaaagaugcuuguugcaguaggcaucuggugggagcucaucucaagagaugcaccuaggaagggaggcauaugcaagacauuaguguuuuggguacacuuucaugcuggagcauucagacugacaaauauaaacacagcacugugaacgugggauccugacaggagcuugauggaaguucccaaguacccaguauccguugcccacugccuccaguguagggcuaaggaccacuuuagaccccuguccuguccucucuuucccuaggugagcggggcacaaccuugucugguggccagaagcagcgccuagccaucgcacgugcccucaucaagcagcccacagugcugauccuggacgaggccaccagugcgcuagaugcagaauccgagagggugguacaggaggcccuggaccgggccagugcuggccgcaccguguuggucauugcccaccggcuuaguacuguccgugcagcccacuccaucauugucauggccaauggccaagucugugaggucagucgggcuaggaacgggcaguggcucggguggcacagcuaagcugugugagcaccuggccugcuuccaggugcuugaggucauguucugggaacaaaaccccaacagaccaaggucuuccuauccuuggauaaacccaggccacuacccucugggaaagcugaacuacaggcucccggaccaggggauguguauguugguaaagagacugaggcacagauggcgacccagaggcuaagaugcagagaggcugucucagacuugugggagagaucaggcagaaucagagcacacaaguguaucccacagccacagccgaacgagagacaaaaguaaucaggccucucaaugucaagggaacagaagguagcauuggcugguaaagcuguccccaagguagucccuuuacagugagcagaguugucaagugucccuaggucaugagcuuaagugguugugagccucacaauugauggaagucaauagggacuccgaguuagcucuguugaaaugacccuccuucugucuccaggcugggacccacgaagaacuccuuaaaaaaggcgggcucuauucagagcuuauccggagacaaacccuggacgccucacugaccucaaccccuccugcagagaagccugaagaccccaaaagcugccaguccaaagccugagaggcccccuggggucaggucacugcaagacaucagucugaggcuggagcucugcuggggacagagcccuuggaaggccagugugcuggaguguggccugcacuacugcccccuuaaaggagcugggcucaacagcuggggugggaaauggcucuccgcccaccugcucugaccauccugacucagcucuguggucacgggauguacacagugagacagagucccuggacaccucugcuugacccucucaggcuggccugguucugcccaacacucaguuguuugggcccucacuccaggagacuggccaggccugguagaauggguuguaaucccagcacuugggagacagaagugggagggucaagaguucaaggccauccugggcuaaauagugagacccucucucaacaaaaagaaaaaccuaaauaaagaggaaaaauuuucaaagaggccgaggcuguagcuuaguagcagagugcgugccugcccuaugugaggggccuagacauaauccuuaguacugcaaauaagaaauaaaacccaggguuggagugua

SEQ ID NO: 2369 - RNA, 4446 nt, Mus musculus
caguccuguucugcagccccugccugccacuaccuccugcgcccuacuuggucuuuacugcagagacccagccccacggagucaacgccuguucuggggaaggcagagcugaccgaaguucaacucauccaguccuaucaggccaguacuuucaccugucuuggcuccucccgucucuaccuucuccuucucucuccguauuccuugcugagcuacuugagucccauuucaauccccaccacuauccugcuagcccuacaaaacagcuuccgugcuccuuagaaaucccauccccagucaggaaaccucccugcuccagccaugaaaccucccucaggacuggaggaggcccagcggcgacaggccucagacauccggguguucgccaacagcugcacgaugcaugguuugggccacaucuuuggcccuggaggccugacccugcgccgugggcugugggccacagcuguacuccugucgcuggcggccuuccucuaccagguggcugagcggguucgcuacuauggggaguuccaccauaagaccacccuggaugagcgugagagccaccagcuuaccuucccagcugucacuuuguguaacaucaauccccugcgccgcucacgccucacacccaaugacuugcacugggccggaacggcacugcugggucuggacccugcugaacaugcugccuaccuucgugcccugggccagcccccugcaccaccuggcuucaugcccaguccgacuuuugacauggcacaacucuacgccagagccggccacucccuugaggacauguugcuggacugccgauaccguggccagcccuguggaccugagaacuucacaguggugagccaguugcccgaagacccuauuuagugacuacaauuuucagccuugucaguaaggaaaccuuaccaccccugccuggcuaucccuuccuuccugcuggccacaggccuuccaucggagacauucguucugucuauccgggaagcugccuugggaggcuaucucuguccaucucaguuagacaucugugcaccuggcuaugccucucagugaggacagcaauccaagcaagcugcaggaccaagggcuaaucaguagagacacuugcuccuagaguagacugcaguacccugagacuauucuggggcaggagagaacugauguuccucugccuccucugaauuauuccaccccaaaagagggcaagaauacauccaguuaccccuguagggauacugcugucagggcuuuggcgagaggcagagaaguuacacugaggcaggaggcuucuccauuccacauaccuacaugugagacuaaggacauugagguauggccuaucaaguuccuucaaggagggugggagaagugguuucuucguaugagauccagucucaaaaaaguccaaagcauaaaacaagcaugggggugcacaucuuuuaucccagaaccuggaaaacagaggcaggaggaucccuggggauuugaggccagccucaucuacaauauauaaauucuaggacuacauagagagauucugucucaaaaaaaaaaaaaaaccuuaagaaaaugaggacaugguggaaaaucagcuagaucuccuagacuucaucacuuaggcucccccuagguacguaagacagcacaugcagggggagagcaucuacccaagaccuacugagcuugcacaucugccuccagaacuggaaggauuugucacugccaugguggcuuuuccuguggucccaggacuugguauuuggaaccaggaggaucaggaauuugaggccagcucaguuacaucgaaagcaccagacaaggccaggcuacauaagaucuuacucccugucccucccuccaaaacccuaaaggacaaaacaaagagaacgggcucaaggggugguauggucccauucccaagggcuuguuugagagagggacuguuccuuucuguuccccccaaccuccccccccccagauuuucacucgaauggggcaaugcuacaccuucaacucuggugcccagggggcagagcugcucaccacuccuaagggcggugcuggcaauggacuggagauuaugcuggauguacagcaggaggaguaucugcccaucuggaaggacaugggugagggccacagggucauugccugugaggagggauaaggguggaugcaugccugaggcugggaaaucacaagaccaugggagggagggggagagggagggggagaggagggggagggagaggcgguagguguguagggagaagucccaaagcauguaauuuugugagaagagacagggcugucucuucuaaauccugaggagagggacugccaagagagucucuccugggaauggagugucuggggccuuaaaggccccucccugcagaagagaccccauuugagguggggauccgagugcagauccacggccaggaggaacccccugccauugaccagcugggcuucggugcugccccaggccaccagacuuuuguguccugccagcaacagcaaguauguuggcucaacugccugcaccucccacccuccccaagcuccuaccaucccuagaaggcccuaagaccccaagccacagugucucagccugacugugggggccacacacacacacaccucuauuacuaaacagccuauuuaaucuugucccucugacagcugaguuuccugccaccacccuggggugacugcaauaccgcaucuguggaucccgacuuugauccagagcccucugauccccuggguuccccuagcuccagcccuccuuauagcuuaauagggugucgccuggccugugagucacgcuauguggcucggaagugcggaugucgaaugaugcauaugccugguaagggacugggcucuguugagaguagggaaugaagauacccuagggggcgcucucaagcucucagaccggucucuucuuccuauucuaggaaacuccccagugugcagcccccagcaguacaaggacugugccagcccagcucuggguaaggcacaucucuucagccucccuguccccauccauucagacauugaucacaacccucuuggccaagugcuccuguuccuugcuuugcggccugcagacgcuaugcugcgaaaggacacuugugucugucccaacccgugcgccacuacacgcuaugccaaggagcucuccauggugcggauucccagccgcgcuucagcucgcuaccuggcccggaaauacaaccguagcgagacuuacaucacgugagcaagggacaugguagcaaggcuggaggcacuguaccugagucaaggggcuccuagcagggaacuggacuggaacccuuucgcacacagcccaggcuagagucaucucuacauaacagguucugggacuugggcaaacugcuuaaacuuucugacuugggggaugggaacaacccaagguucuugaaaggggccagaaugcucacacccacuuccagcuggccccgggugguguccagcaaguaguucgcgcuucuuuuccuucagggagaauguacugguucuggauaucuucuuugaagcccucaacuaugaggccguggaacaaaaggcagcuuaugaagugucggaguugcuggguguguacugagugccugggucugcagaggugcagaagguaggugaucgugaacugacagcacucugccuccacaggagacauugggggacagaugggacuguuuaucggagccagccugcuuaccauccucgagauccucgacuaccucugugaggugggacagaaccccagacaccauggggaagaaucaggccaccagugucuaagaauauagauguuggccaccuaacuccugccacuuguccccagguuuuucaagacagaguccugggguacuucuggaacagaaggagcucucaaaggcgcucuggcaacacucugguaacacuccuuugccaucccccaucccuaacauuguaggccucaccccaaaccuuaaacauuuggcccaggagcuauaaguacaacaauauuggcuggucuccaccugaccccucuucccacagcuccaggaagaguugaaugggcaucgaacacauguuccccaucucagccuaggccccagguaauaugaaauauuccccauaauggggacaggacagguucagaggaagaaguucagguccaggacagaagagguggagggggcccugcccagugcuguggcuugucccaccaggccuccuaccgcucccagugcugucaccaagacacucgcugccucccaccguaccuguuaccucgugacaaggcucuagaccugcuuggcugcgccgugacaucuuggacaugcccaggcuguacaucuuugccuucuuuacccuaauaaagcucuaguacacgugccu

SEQ ID NO: 2370 - RNA, 1486 nt, Mus musculus
cuuuauuuauuuuguguaaaguuuguauauauggaacuauuuugucuuugucugucuguaucccaaaaggggacugggaaauuguuucuuugaacguuacccacuuuguccagcccuacugcuuugcugcuuuagcacaaggacaugcaagggcaugaaauggaacugucauggccaauaugggggucuucagcagcucccucgucacuccaguguauucccacaccuucuguucccauugggcuacuguauccccacuuccugugaacaaacccaucugcuucugaugucuucucuuugggagaagcagcacacuucaggaagagacauacuucaguuugcacugaagggagacccccccaguuuagcuuggagaacguucaaguuaucuacauagaagaugcuguccggucagugauuaaggcagggcaggaagcguacuccaccaccugagcugaacagagaggggauuccuuuacaggggcacacagccucauuucugucuuccucucuuuuauaugccagagccuggggcagaggcccacugccugucuguucuugcaacuuuagcuguguuuucuccugcccauuccauugugaaguuggguucccaccagccucuuccauuacagaaagauaggcuaaaagcagccacugucagauggauaggacaagggugaguccaggaggguggaggcagagauugugggcagaugagguaaaccccacaaccgggcucuagguaucugcagagaccuuagggagcgaagauuguuacagaacccuacuuguggcuacuguccugguuaacuagcuuuugggggacaaacagggucuguggauuagggggaaaggaauaaagacgaagaagcuauggauaaagcaagcugcuuuauccauaaaguugcuggcaagggaggggagcaagcacacacacucacauuccugaccugccuuccaggccacccucagcacuggcgagcuauggggcgaacuagucaaccuagcauucagucagcauuugacugacugcaucaugugcgacuaagguggucucuguccuugguacuucauuucucccaagcaacucucuagugaggcuacagaucggaguaggccgucucucuggucaggcuuggcccagcucauucccagccaggguuaccucagagucaacucucugcucuacacaggaguuggagguuaaauguuaccucuucagcagaguugcuguccagguccagagaaacaggaggcaagccgcaaggcagaaacccugggggaguggccagagcccagguuuuuggcuugccacacagcugcaacagugcuaagcagagggagccagcccaagcaacuugguuuuggagagucuggggacuagucuguccuguaccuacacgguacugcccagauucugcccucuguaaggaucuuaauaacuugaaaaggggacuguggauaaaauaaaaaaaucaaaucaaau

SEQ ID NO: 2371 - RNA, 13018 nt, Mus musculus
cuagauaguaaaggaauuuauugaugacuuaacagucagcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcagaagguguagcccagauuaaagguguguuccaccacaccuuuaaucccagaugaaagguguagcccagauuaaagguguguuccucaaacucaaaauucuggaauccauagccacaauggcucaagaucuccauaccaagauccagauaaggaucuccaagccuccagauaagggucacuggugagccuuccaauucuggauuguaguucauuccaaauauugucaaguugacaaccaggaauagcuacuacagcuagcagagcuaauaaaagggcauguauagaaaagauaauagaaucccauguuaggcaucucucccacuccaccaaaugcagcugacaggucuagcucaaguaccugcauuuuuaacaaguguccuauguggugugcagguggcagcaguacaucacacugcaaaguauggcccgggaccucuagcucaacauuuacacaaggaagccuccuaggaaucaguuccuaccuguucccaggacuuguacaaagcuggcaagggaugccucuuaucugacaacccuccacacccaaauuccaugaacucuucucaaacacuggccuaaggaaaugcuugauccagaaaggggguggagauaaauccucccgacuccugccucaugaggcccauggcuugcugaggaagugaaugccgacugcaggaggaaaaaaaggcucagagacccaggaaggagggggucuguagcuuccucuuuuauuggacacuugguagaugacacauagaucuacacuguuaaauaauuauuaaaauacugaccaggacuaggcccuggcccagagcuccaaaccagaagcaauaaggaacgggguugaugggcuggcaguauuucuccaacaucaccgaaacccauaaaaugaggcucuugaauccuuccagggccagaccagggcuugggcccuuggguuaacccagguaccccuggcugcaucuuucagggcaagguaaccagcaagggucuggagagaacagccagccgaguccagacagacagacccaaauggaaggagggugggaaaacggacaggugcuguccagcuggagauaugaugcagcgaaggcaggcugaggggagaggcugagggcaguauugcagcagugcaggagugcagccccaggguccuguccugaguggcuggucaggugucagcuggcagucuccagguggcauuccugacccaagccuggcugagggcucacacauuguggguccucuuggugagcuggggcuccucaucuaccagcuuggacuugaggugcuccuuguaggccaggaugucuccaggccacuuggugauugucuguuucucacagacccaaaucuccugugcaaccuggaagcagaggcuggacuugaucuggccagucgguggcacccuccccacuaccacuaccgggcuucccaaaaguagcggcuucuccugaggccucaccaaaacuacauccagcucacucucacuacuaaacaggcucuggcucuuuggagccuucuggaaucuucuaagguagacccugcugugccacccuguacugucaggcucccaguuacaggcuccugaucauucagaggccucaugaccuguagccaagcuuccuccucuuaauccaaguccuuacuacaauacuuacuuggccgaagaaucucgaaagaguagcaagagcgccuuccucauuuggguccucucuaccaaguuaacuacuauccugaaucaucagaucuggccacguggaccugagccccuucucugaauuuagcagaugucguuagacccucuauguaccacagcugugccucaggccacaccucaccugcuggaugagucugaagucauggcugacuagcaucauuccacccucaaacucauugauggcaucugccagagcaucaauggucucgauguccaggugauugguaggcucguccagaaagagcaugugaggguucugccaggccagccaggccaggcacacucggcacuucugcccauccgacagguuccggauugggcucaccuagaggaaccaugacacaaggacuuggugcuggcauacaagggcucugcagcaggggacuucucuccuuuuucuggcucuuuguaaccauuauugccuuuuuuguuguuguuuuugcaagucaugagcuuaggaugacccaagaucauacagcaagacaguggccaggccauuaguccugaggccugacaaggacaccuggaagcaugaccaugugccucucacucuaagaucagaaguccuuaugcaaugacauaaucuggcaacugugcaauuucaugucugucuucuaggcugcaacuucuguugcucccucaagcacucuggcucaagagccgcucagagucccauucacugaucuuucuuacaaccccauugugcaugacacuacagaggaaaggaguggaggagacucuggaucacaugugaagacagcguccgaucaccaucuggcaguagccucugagccaccuuggguccuucccagggcuccucucucaccugcuguuucccagugaggccguaucucccaaugaucuuccucaucuccuccuucuccuugaucucuggauagcacuucaucauguauuccaauggugaaaggucaagguccagcugcuccuguaagugcugcagagaaagcaagaccacauuugagggaacaccuccaaaaggaugccacuuggugugacaggggccuacccagacacuugcucaggauacaagaugcagggugggguuauguucccagaggagggguuggacagauguguucccuucuuucacccuggcccccaaccuugaccccagguuuguaccugaugguaacgcccuaucuugacaugagaaugcuuccggaucauuccaucuguaggcagaagcuaaggaagaguauuaaguagaaucagugguggguggaggggaaucccagacacauguauaaugaacagggcucaaaccacccccuaguugaucuacugugcuagcuaacacaagaccacugucuaggcacuuuugaguguuaggaggggcugugaagaucucaauggauaaagguacuggcuugacaaccugaguugaucugguacccacauaguggaagguaaaaucucucacaugaaugugcacacaauaaaacaaacauaaaaguauagacuuaggaagacucacuaacagacucuuaaggaaaugaaggcgcacagcaccuuacuagguggacaggaaaggcucauuguacaaaacauugguaaagcacaacacacauuuucucaaaagaaacuccacugaauggcuugucuguauggccuggcuuaaacacuguugcaugcacucacaugaaaucucagugauacagauucuuccccauccacccugccacaggggagacaucccugggcuccacacuggcccagccccuccaggugcucacucaacuaagaaggcacucacucacucacucacacgccuucuuccuuagugaagguaccaguagcagcugugacaugccaccuuagcaccauaccucuccgguuagcagcuucagcagaguggacuucccugcuccauuggguccuaccagagccacucgugugucaagaucaauaccaaauucuagauuauuguagaugcaaggcugauguggauaaagaaagagggacaaaggcuagaaauuggauguacugcccagcgugccaaucccccaggugcgaagaauggagacagcauuacuguaaagcugacccaacccacuguuuccaucugcuaaaucugacggccgucuccucccuggcaagucagcaggaacaggagagguucccacugcucaaacugcccacgcacagugcagugcaccuggccuggcuacacagaggauacuguacucaccccgucuuucguauauuugaagcucacguucugcaccauaaugacagguggugggaucuuaccgcacggugggaaauaaaaugacagcgucuagaaaaggaggcacuuucaggucagggcuuuuucuuaaagucaugcuccagucaccuaaccacaucugucacaccucaccuugucacucacaacccuuucugucaguccggaugccaucauuuucuguaguguuuucucuuugcuuugggccugccgggccagcuuggcacugccauggccaaaccuggcaauguaguucugcaagacaccaggaggaggauuggaaugggugcgagagacaggauggggcuucaaguguuugcaggagaccaggaagggacuugaggugugcacaggaaacaaacagcagcaagugaacccuggaguaaggagcggcccacgucuucccaggcuccucuagcccccugcgagucccaauccagguggagaagagcagugugauuucccuaccuucaugugugcgaucugguccugcucccagugaaaccucuucaucugguucucuuccaacuccagccgugucuucacauacugaucauaauuacccuguggggaaaugccccaggcaagguggcagcuuuacccagggcucaguccuggguucucacucaggcuagaggauggaagcaucacucccuggcugcuguucugaggcugagcaguaaacagaagaacuguaucacagcagcucuugcuaauagaaccugcuauuuauuucugcagugcugaggguggaaccuaggacauggcuugcauggcucacacggcucauaguaggcaagggugcagcacuaagccacacugcaguccaaccaggaauguaugggucuauguuuucaauccaugccuauugcucagucaggccaagguuccauggcaaauccuaagguuaaccagaagaacccagggucggcagaagcccugaucacagacaugcagacaccaugaagcccaggcccucaaccaucucuaacugcucacgucagacgcugaagccacauauggauaaggguuguccccgacaagaaaaauaaaccaacuggacgcagaucaugccuugaauugcuguggcuucuaucugagccagacaaagcccaagacucaagcuagccauccacuaaaaagaccgaacgagggcugcagagauggcucagugcuuaagagcacugacugcucuuccagugguccugaguucaauuccuagcaaccacaugauggcucacaaccaucuguaaagguauccgacgcccccuucuagugugucagacacuccagcaacaguguacucauuaaaaaaaaaaaaaaaagaccuaaccagucucaggacauccacacaaugaucaugcuauguaggcauacuaaacagaaagacucaucuagaaaggcaguuaaucauuguaaaaguaaccugaagaauagaaugaucauuaaggauuguagaagaggggcuggagaugggucaguggauaagagcacugacugcucuuccaaauucucagcacccacaugguagcccacaaccuauaagucaguccagggaaccugacacccucuucuggccuucacgggcacuauaugcaugaguugcacaaauacucauauaugcaaugaauacauaaaauauacauuaggaaauccaaacaaaccgauucuagaugauaaagguaaaggacacauccauaugacauuuuguauaaaugacugcaaauacagaguuuuggaaggcaacguaaaaaacuaguaauguuccccagugacugugccuagaagggucuauguuucccuuuccccauuagagacugaugcucacuguggaauccugcuugguaugacccguauacuucagccaucauagugcugggucauguagacgcugccacaccuaacuauuuuucaugaaaacacuuuuauuacaauuucucuuauuuaguaauguucauuugcuucucagcauccacagcaggugcucagaacugccucuaacuccagcuccagaugaucaaacccuggccuggccuggccucagcaggcaucugcacucaccugcacaaacccacacacagguacacauuaucaaaccaacuauuuuuuaagauaaaaaaagacaaggcacaacagggagacugcuaagauacuaacuuauuuucuugugcacaaagcugucacaacagugaaggcagcaaaacaaacaaauacacacacacacacacacacacacacacacacacacacacagagcagcugccagcuguggccuaugggcagaagcaaaggccuuugggauuaaaauaaaauggggcagaguucuuuaaauuuuuuuuuccuucgagacaggguuucucuguauagcccuggauguccuggaacuuacuguguagaccaggauggccucgaacucagaaauccuccugccucugccuccugaguucugggauuaaaggcgugcguuaccacaccuggcuauuuuaauuuuuaaugacaaacccaaagaaccaguaagcacgagaggcaaggcucacuuaccguguaauacuugaguuucuuguugugcauauggaugauauugguacagaccccauucaggaaguccugggaaugggacaccaggaccaggaugcgcuugaaacugugaauccaaagaacaaucaggaaggucucaagucagagacuuucaaagaaggcuacauggugagacccaggaagccuucaccggugcucucacacccuuagugaacccaagugcccuuaaagcucccgcaaccaacagggaagcaagcacucuguaacagggggcuccuggagccuugcagugguaacagcccaaggccccaaguguucuguucugucaacagaaugaaguacggaugggugaaguccugcuaucaacagucuguacacacacaaguaucuaaauaaaagguauccagaggcguggauggggucaacccagacucaauaagagaaacagaaguccuuucuuuuugaagacagcacuaaggcagcuccuguuuacuuuuaacguugagacaauagauuuacuauuauuuuucuguaucaccaccacaccaugaauuuaagcauuagacucacuguacaugauuuauguacacaugugugcacaugcacacauacaauuaaacauuuucuuuagugaagaugcuguauuuuggacauaggaaaaacaagacucauguauuucagacuuaaaaacccaccccaaugaaacagaaagagccggucugacuucacuggcacuggcugcaucuggccugucucuggccuuccuucaccugcacucaucagggcaguuucugagcaccuaaucccuuuguacucugcuccugaccucccugggacugcagcucccagccccaucucuuacgucuuaaguuccucuuccagccacacacaagcaucgagguccaggugguugguaggcucguccagaagcagcaugaagggccgaauaaagagggcucugauggaugccaaagaaacagaaacaucuuaaaugcuaaaugaaaggugcagcuuuccugucacgacguuggucaggucuggacugaauccuuaagccaaucugcuuacuaccucagaggaaggaaagguagaaagugaguuacaggaauugggacugcagggaaaccggagaucuucugcaccugaagguagugauggagcuggugcgcaucagaggacaaggggaaacaagcuacuaaggcaacaagcauuaaggugagauuacuugacggggcugacagacuccagcaaguugccaaacaauguccuuuucuuacacuguaaaacaagggacaggcugaaggccuggcuuccggacugcaauaagcagucuuggggaacucaguaagagcgcgucugaucaucacacuccagccugcacugagcgagcuccugaaccagccagagaaacuuccagccagcaaguggagucuacacucaugcucuaagacacgaaaccaacucucggaggccaugaggcagccucaacaacuugcuucccaggagcaggcuugaaugcaguguggacuccccacagagaggaagugagaaguaaaugccuuugaauguuggugcuuagguaaggaaggccucagugaggugaguagggugaggcagucaucaggauagagcccaaggaggacacaugcauagcuuuauaaggagagacgacgacagacauucaaauuuccuuuucucucaucaaacgaagccuacacuacacuacacuacacuacacgacacgacacuccaggaccuacuacagcagcugagcucccugaccuugugccucuagagucaugaacaaagaugcaccuauuuuguucacagugugcagccugagaugcuccauaauuuuauaauuuuaagagaaagcacacacaucucagcaugcuggggagggugcugguguagugcuggacuacaaacucacuuuaaccucaggcuuacgggguaagaaggacagguagcaucaauguguccaguaucauacugccauaaaaacuagcaggacagcagcacaaaaggcaggaagggggucaaggugaaaaccgacacuuaacuaccauuuuacuugggucugcucagagcacuacuggaacuggcuccgagcauggagguggucuugaguacuucagccagggcagucagucagguccacacacugacccacauuacaucacuaauggcuaucucauccgacacauaauacuccuaccagagugaacacuccccuuugagagacaggggcuccaaggaugguggaaaggggagaacucaccuagcaagagcaacucucauccgccagccaccacugaagucuuucagcuucuugcgcugcauagcaggugugaagcccaauccauguaagauccuugaggcccucaucucagcuuugucagcauccagcucuuccagccguucauagagcuccaugagcuuuucacacuccgcauccucaugugcuaaccgcucagccucucucuccagcauggcccgcucuguguccaccuccaucacacacugcaaggguguuuuuucgcuaggaggcaucucacgagucagaugguagaugucgaugugcucugggaugggcacuucacguuucccaauagccgagagcagcauggacuuuccuaagagggugacaggcgacacuaagccccuucaccgccacucuuuggcaccuguuccuaacaggcagucacuggcucacucucaggcucuccuucccagcuucccuucaagucuaaucuuacugugccugugaaauccuguucauuuacaaaggcuucuucacaccaccacuccucacccucacucccccaccaaccucucuauagcaccuucugucaaaaacucccaugguaccugcuacacacagcugugucauaagccccaugucuccagcaugucuggucccccacucaugggauaaaguucuugcuuuguuagugcuaaacacauagugaguaacaggcaaaccaagaaagaaaccuccuccaccugacccccaagggccucaccaauuccauuuaagccaaugaggccauagcgccggccugaguuuaauuccaguuuggugucgcugagcagcucuugaccaugaaagguaagggagagguugauaauguggacaucaguacuguuggggugagaagccaggacaccggugacagcucgagcagcagcuuucuucaucucaaaguccuccagcuccuuggucagcaaaucuacuucuggggcaaaaguggaauuugggaagggucagucagacagacucagaucugggaccaauaggcaaacuccacaggaccugagcucaggucaugcgaagcagauucagaguucggagggcuuuacacagugccaugacacagacuagccugacacccugcuuucacagacaggcuuuucucagcagcccuuuugagucuaugcucucuccuaccacuucacuuuccuccacuguuucccccuucaccaucuuccauagcucuggccauggauaaagcuuccccauggccuaacuugaucacacuagcugccuucuagaaucuuauuuuggggacaauuccuaccacuugacauuucuucaucuguuuagugcaucuauggugacucucucucucuuucccucccuuucucucucucucucucucucucucucucucacacacacacacacacacacacacacacacaccucaaaacacagucccucaaauaagaaucaacagcugcaaugacuaaaguagacauaaguaacacugcaaaaugacaugggauagcaaaugggaacacaaucauguguguaaaccucaaguuugcacaagaacuuaacguguaaaaggacaauaccaugugugguaagauucaaagggcagugagcagucuacaugcagcagaaggacugugcagcuuuccugggcagugaagacaggguuagacugggaugguuguuaucauacacugcaauguuugcccaugucacaguuaacuuagcugucaacuucacauaaaccuggcaagaggaaccucaacagaagaacugccucaucaggcuggccaaugaccaugucuagggcauuuucuuaauuucuaaugaaugcagaggguccaguguaggcagugaagucuuuagcugagugggucugugcuacauaagcaagcuaguugaugccugguguaguggcccaugccuuuaauuccagcacuccagaggaagaagcaggagaauuucugaguucaaggccagcuggucuacaaagcaaguuccaggacagccagggugguuacagagaaacugucuugaaaaacaaaacaaaaguccuugccugacuucccucaaaaauggaccugggaagcuggguaguggugguggcgcacgccuuuaaucccagcacucgggaggcagaggcagguggauuucugaguuugaggccauccuggucuacaaagugaguuccaggacagccagggcugucucgaaaaaaaaaaacaaaaacaacaaaaaaaggaccugggaauauaagaagaaaugaacuuuuuccucucaaguuaauuuuagucagaguguucugucagagcaagagagaaagaaauaauaaaauaaauuuucugagagcaaacuauguuuacagugugagugaguagcuuauuuaauauggaaaaaugcuacaauaaauccccuaaaccuaaguaacaaaaccauaaauauauuaucagaaaaauuacaugaagauauauaacaauauguuacacauuacucauugguauaaucacuaucccugugacauuaagaguaccauaugagccagggaugguggcucacaccuuuaaucccggcagcuaggaggcaggggcagguggaucucucuaugauuucaagcaagucuagucuacagaguuccaggacagccaggguuacacagagaaacccuucuaucuccaaacaucugccuccccccccagaaaagacagcaccauaugguagagccuguauacucaccaccauagguaggaagaaaaacaggaaauaguacaaguugccuucccuuuuauugucuacugcagcaccaaccaagguagaucaaaaacucccaucuguguuugccacuugaauucaguuuccuucaucaguaacaaguuuuaacucuaugggugugggugucaccaaaaaguuucauggcauauaaagacaugugucugugggugcuuuacucuguuuaaaaagauggggaugugaggacagccuggccucaaaccuucaucuuuuuaccuuagccucccaaaugcuggaauuaaaggccuaugcaucugcauccagauucugaucuuggcuucgaaaaccagcucaggaaacucacccaaccuaccuccaucuccuguggucucucugccauuggccuccucgauuuucucuucugccaccugagguucugugacagcaucuccauuuucuucaugucccuuucugggucgcugucgggcuuuggcagccuccuucuuuuuggcugccuucuucuuggccaggucggaaggcauggugaugagccacagggguaguuacaguccuuucaggagucugaagaaaagcaaacagauacuccaaaauucuaaacuuacagguaagaaugucugagugcuaucccaucccuccuuggaauuuuccuaucaagccuguggugcccaacucuuguccccgccaacuuuguccgggcuucucacacucucucgaccgcuccuccagccucaucuccucccuugggguucgcgcgccaauccccaccgccggcuucacucggaugcgcucuucccccagggccuuagugagggaccgcucugccccucgucuccaguuuccgaacuuggcgcucgcgcaccucugccagccgccuccuuuucgguucuucgccaggaguucgucccggaccucccuuccgucccucucauccaccccaccgacugcggcgcgguuucucucccggaaccacgaguccuccccagcgggucccuaagggucucugcgcucgcugccccuaaccucccccacaccccgcucgccggcgucucugccugggccaguucuuuucccuuucggcccuuuccauuccgacccugagcucccuuccgcuucuccucccgcuuccugcucacggguccacacucuccuccccuccggcgccccuucccccucaacucacggggccucgccgcucggccucugucgcaacagagcugcuccuugagcuccuccgcgugcggccggcuccccaaccaaucacggccccgggcggcccuuggcgcgcugccgcgagggcuucug

SEQ ID NO: 2372 - RNA, 13018 nt, Mus musculus
cagaagcccucgcggcagcgcgccaagggccgcccggggccgugauugguuggggagccggccgcacgcggaggagcucaaggagcagcucuguugcgacagaggccgagcggcgaggccccgugaguugagggggaaggggcgccggaggggaggagaguguggacccgugagcaggaagcgggaggagaagcggaagggagcucagggucggaauggaaagggccgaaagggaaaagaacuggcccaggcagagacgccggcgagcggggugugggggagguuaggggcagcgagcgcagagacccuuagggacccgcuggggaggacucgugguuccgggagagaaaccgcgccgcagucggugggguggaugagagggacggaagggagguccgggacgaacuccuggcgaagaaccgaaaaggaggcggcuggcagaggugcgcgagcgccaaguucggaaacuggagacgaggggcagagcggucccucacuaaggcccugggggaagagcgcauccgagugaagccggcgguggggauuggcgcgcgaaccccaagggaggagaugaggcuggaggagcggucgagagagugugagaagcccggacaaaguuggcggggacaagaguugggcaccacaggcuugauaggaaaauuccaaggagggaugggauagcacucagacauucuuaccuguaaguuuagaauuuuggaguaucuguuugcuuuucuucagacuccugaaaggacuguaacuaccccuguggcucaucaccaugccuuccgaccuggccaagaagaaggcagccaaaaagaaggaggcugccaaagcccgacagcgacccagaaagggacaugaagaaaauggagaugcugucacagaaccucagguggcagaagagaaaaucgaggaggccaauggcagagagaccacaggagauggagguagguugggugaguuuccugagcugguuuucgaagccaagaucagaaucuggaugcagaugcauaggccuuuaauuccagcauuugggaggcuaagguaaaaagaugaagguuugaggccaggcuguccucacauccccaucuuuuuaaacagaguaaagcacccacagacacaugucuuuauaugccaugaaacuuuuuggugacacccacacccauagaguuaaaacuuguuacugaugaaggaaacugaauucaaguggcaaacacagaugggaguuuuugaucuaccuugguuggugcugcaguagacaauaaaagggaaggcaacuuguacuauuuccuguuuuucuuccuaccuaugguggugaguauacaggcucuaccauauggugcugucuuuucuggggggggaggcagauguuuggagauagaaggguuucucuguguaacccuggcuguccuggaacucuguagacuagacuugcuugaaaucauagagagauccaccugccccugccuccuagcugccgggauuaaaggugugagccaccaucccuggcucauaugguacucuuaaugucacagggauagugauuauaccaaugaguaauguguaacauauuguuauauaucuucauguaauuuuucugauaauauauuuaugguuuuguuacuuagguuuaggggauuuauuguagcauuuuuccauauuaaauaagcuacucacucacacuguaaacauaguuugcucucagaaaauuuauuuuauuauuucuuucucucuugcucugacagaacacucugacuaaaauuaacuugagaggaaaaaguucauuucuucuuauauucccagguccuuuuuuuguuguuuuuguuuuuuuuuuucgagacagcccuggcuguccuggaacucacuuuguagaccaggauggccucaaacucagaaauccaccugccucugccucccgagugcugggauuaaaggcgugcgccaccaccacuacccagcuucccagguccauuuuugagggaagucaggcaaggacuuuuguuuuguuuuucaagacaguuucucuguaaccacccuggcuguccuggaacuugcuuuguagaccagcuggccuugaacucagaaauucuccugcuucuuccucuggagugcuggaauuaaaggcaugggccacuacaccaggcaucaacuagcuugcuuauguagcacagacccacucagcuaaagacuucacugccuacacuggacccucugcauucauuagaaauuaagaaaaugcccuagacauggucauuggccagccugaugaggcaguucuucuguugagguuccucuugccagguuuaugugaaguugacagcuaaguuaacugugacaugggcaaacauugcaguguaugauaacaaccaucccagucuaacccugucuucacugcccaggaaagcugcacaguccuucugcugcauguagacugcucacugcccuuugaaucuuaccacacaugguauuguccuuuuacacguuaaguucuugugcaaacuugagguuuacacacaugauuguguucccauuugcuaucccaugucauuuugcaguguuacuuaugucuacuuuagucauugcagcuguugauucuuauuugagggacuguguuuugaggugugugugugugugugugugugugugugugugagagagagagagagagagagagagagagaaagggagggaaagagagagagagucaccauagaugcacuaaacagaugaagaaaugucaagugguaggaauuguccccaaaauaagauucuagaaggcagcuagugugaucaaguuaggccauggggaagcuuuauccauggccagagcuauggaagauggugaagggggaaacaguggaggaaagugaagugguaggagagagcauagacucaaaagggcugcugagaaaagccugucugugaaagcagggugucaggcuagucugugucauggcacuguguaaagcccuccgaacucugaaucugcuucgcaugaccugagcucagguccuguggaguuugccuauuggucccagaucugagucugucugacugacccuucccaaauuccacuuuugccccagaaguagauuugcugaccaaggagcuggaggacuuugagaugaagaaagcugcugcucgagcugucaccgguguccuggcuucucaccccaacaguacugauguccacauuaucaaccucucccuuaccuuucauggucaagagcugcucagcgacaccaaacuggaauuaaacucaggccggcgcuauggccucauuggcuuaaauggaauuggugaggcccuugggggucagguggaggagguuucuuucuugguuugccuguuacucacuauguguuuagcacuaacaaagcaagaacuuuaucccaugagugggggaccagacaugcuggagacauggggcuuaugacacagcuguguguagcagguaccaugggaguuuuugacagaaggugcuauagagagguuggugggggagugagggugaggagugguggugugaagaagccuuuguaaaugaacaggauuucacaggcacaguaagauuagacuugaagggaagcugggaaggagagccugagagugagccagugacugccuguuaggaacaggugccaaagaguggcggugaaggggcuuagugucgccugucacccucuuaggaaaguccaugcugcucucggcuauugggaaacgugaagugcccaucccagagcacaucgacaucuaccaucugacucgugagaugccuccuagcgaaaaaacacccuugcagugugugauggagguggacacagagcgggccaugcuggagagagaggcugagcgguuagcacaugaggaugcggagugugaaaagcucauggagcucuaugaacggcuggaagagcuggaugcugacaaagcugagaugagggccucaaggaucuuacauggauugggcuucacaccugcuaugcagcgcaagaagcugaaagacuucagugguggcuggcggaugagaguugcucuugcuaggugaguucuccccuuuccaccauccuuggagccccugucucucaaaggggaguguucacucugguaggaguauuaugugucggaugagauagccauuagugauguaaugugggucaguguguggaccugacugacugcccuggcugaaguacucaagaccaccuccaugcucggagccaguuccaguagugcucugagcagacccaaguaaaaugguaguuaagugucgguuuucaccuugacccccuuccugccuuuugugcugcuguccugcuaguuuuuauggcaguaugauacuggacacauugaugcuaccuguccuucuuaccccguaagccugagguuaaagugaguuuguaguccagcacuacaccagcacccuccccagcaugcugagaugugugugcuuucucuuaaaauuauaaaauuauggagcaucucaggcugcacacugugaacaaaauaggugcaucuuuguucaugacucuagaggcacaaggucagggagcucagcugcuguaguagguccuggagugucgugucguguaguguaguguaguguaguguaggcuucguuugaugagagaaaaggaaauuugaaugucugucgucgucucuccuuauaaagcuaugcauguguccuccuugggcucuauccugaugacugccucacccuacucaccucacugaggccuuccuuaccuaagcaccaacauucaaaggcauuuacuucucacuuccucucuguggggaguccacacugcauucaagccugcuccugggaagcaaguuguugaggcugccucauggccuccgagaguugguuucgugucuuagagcaugaguguagacuccacuugcuggcuggaaguuucucuggcugguucaggagcucgcucagugcaggcuggagugugaugaucagacgcgcucuuacugaguuccccaagacugcuuauugcaguccggaagccaggccuucagccugucccuuguuuuacaguguaagaaaaggacauuguuuggcaacuugcuggagucugucagccccgucaaguaaucucaccuuaaugcuuguugccuuaguagcuuguuuccccuuguccucugaugcgcaccagcuccaucacuaccuucaggugcagaagaucuccgguuucccugcagucccaauuccuguaacucacuuucuaccuuuccuuccucugagguaguaagcagauuggcuuaaggauucaguccagaccugaccaacgucgugacaggaaagcugcaccuuucauuuagcauuuaagauguuucuguuucuuuggcauccaucagagcccucuuuauucggcccuucaugcugcuucuggacgagccuaccaaccaccuggaccucgaugcuuguguguggcuggaagaggaacuuaagacguaagagauggggcugggagcugcagucccagggaggucaggagcagaguacaaagggauuaggugcucagaaacugcccugaugagugcaggugaaggaaggccagagacaggccagaugcagccagugccagugaagucagaccggcucuuucuguuucauugggguggguuuuuaagucugaaauacaugagucuuguuuuuccuauguccaaaauacagcaucuucacuaaagaaaauguuuaauuguaugugugcaugugcacacauguguacauaaaucauguacagugagucuaaugcuuaaauucauggugugguggugauacagaaaaauaauaguaaaucuauugucucaacguuaaaaguaaacaggagcugccuuagugcugucuucaaaaagaaaggacuucuguuucucuuauugagucuggguugaccccauccacgccucuggauaccuuuuauuuagauacuuguguguguacagacuguugauagcaggacuucacccauccguacuucauucuguugacagaacagaacacuuggggccuugggcuguuaccacugcaaggcuccaggagcccccuguuacagagugcuugcuucccuguugguugcgggagcuuuaagggcacuuggguucacuaagggugugagagcaccggugaaggcuuccugggucucaccauguagccuucuuugaaagucucugacuugagaccuuccugauuguucuuuggauucacaguuucaagcgcauccugguccuggugucccauucccaggacuuccugaauggggucuguaccaauaucauccauaugcacaacaagaaacucaaguauuacacgguaagugagccuugccucucgugcuuacugguucuuuggguuugucauuaaaaauuaaaauagccaggugugguaacgcacgccuuuaaucccagaacucaggaggcagaggcaggaggauuucugaguucgaggccauccuggucuacacaguaaguuccaggacauccagggcuauacagagaaacccugucucgaaggaaaaaaaaauuuaaagaacucugccccauuuuauuuuaaucccaaaggccuuugcuucugcccauaggccacagcuggcagcugcucuguguguguguguguguguguguguguguguguguguguguauuuguuuguuuugcugccuucacuguugugacagcuuugugcacaagaaaauaaguuaguaucuuagcagucucccuguugugccuugucuuuuuuuaucuuaaaaaauaguugguuugauaauguguaccuguguguggguuugugcaggugagugcagaugccugcugaggccaggccaggccaggguuugaucaucuggagcuggaguuagaggcaguucugagcaccugcuguggaugcugagaagcaaaugaacauuacuaaauaagagaaauuguaauaaaaguguuuucaugaaaaauaguuagguguggcagcgucuacaugacccagcacuaugauggcugaaguauacgggucauaccaagcaggauuccacagugagcaucagucucuaauggggaaagggaaacauagacccuucuaggcacagucacuggggaacauuacuaguuuuuuacguugccuuccaaaacucuguauuugcagucauuuauacaaaaugucauauggauguguccuuuaccuuuaucaucuagaaucgguuuguuuggauuuccuaauguauauuuuauguauucauugcauauaugaguauuugugcaacucaugcauauagugcccgugaaggccagaagagggugucagguucccuggacugacuuauagguugugggcuaccaugugggugcugagaauuuggaagagcagucagugcucuuauccacugacccaucuccagccccucuucuacaauccuuaaugaucauucuauucuucagguuacuuuuacaaugauuaacugccuuucuagaugagucuuucuguuuaguaugccuacauagcaugaucauuguguggauguccugagacugguuaggucuuuuuuuuuuuuuuuuaaugaguacacuguugcuggagugucugacacacuagaagggggcgucggauaccuuuacagaugguugugagccaucaugugguugcuaggaauugaacucaggaccacuggaagagcagucagugcucuuaagcacugagccaucucugcagcccucguucggucuuuuuaguggauggcuagcuugagucuugggcuuugucuggcucagauagaagccacagcaauucaaggcaugaucugcguccaguugguuuauuuuucuugucggggacaacccuuauccauauguggcuucagcgucugacgugagcaguuagagaugguugagggccugggcuucauggugucugcaugucugugaucagggcuucugccgacccuggguucuucugguuaaccuuaggauuugccauggaaccuuggccugacugagcaauaggcauggauugaaaacauagacccauacauuccugguuggacugcaguguggcuuagugcugcacccuugccuacuaugagccgugugagccaugcaagccauguccuagguuccacccucagcacugcagaaauaaauagcagguucuauuagcaagagcugcugugauacaguucuucuguuuacugcucagccucagaacagcagccagggagugaugcuuccauccucuagccugagugagaacccaggacugagcccuggguaaagcugccaccuugccuggggcauuuccccacaggguaauuaugaucaguaugugaagacacggcuggaguuggaagagaaccagaugaagagguuucacugggagcaggaccagaucgcacacaugaagguagggaaaucacacugcucuucuccaccuggauugggacucgcagggggcuagaggagccugggaagacgugggccgcuccuuacuccaggguucacuugcugcuguuuguuuccugugcacaccucaagucccuuccuggucuccugcaaacacuugaagccccauccugucucucgcacccauuccaauccuccuccuggugucuugcagaacuacauugccagguuuggccauggcagugccaagcuggcccggcaggcccaaagcaaagagaaaacacuacagaaaaugauggcauccggacugacagaaaggguugugagugacaaggugaggugugacagaugugguuaggugacuggagcaugacuuuaagaaaaagcccugaccugaaagugccuccuuuucuagacgcugucauuuuauuucccaccgugcgguaagaucccaccaccugucauuauggugcagaacgugagcuucaaauauacgaaagacggggugaguacaguauccucuguguagccaggccaggugcacugcacugugcgugggcaguuugagcagugggaaccucuccuguuccugcugacuugccagggaggagacggccgucagauuuagcagauggaaacaguggguugggucagcuuuacaguaaugcugucuccauucuucgcaccugggggauuggcacgcugggcaguacauccaauuucuagccuuugucccucuuucuuuauccacaucagccuugcaucuacaauaaucuagaauuugguauugaucuugacacacgaguggcucugguaggacccaauggagcagggaaguccacucugcugaagcugcuaaccggagagguauggugcuaagguggcaugucacagcugcuacugguaccuucacuaaggaagaaggcgugugagugagugagugagugccuucuuaguugagugagcaccuggaggggcugggccaguguggagcccagggaugucuccccuguggcaggguggauggggaagaaucuguaucacugagauuucaugugagugcaugcaacaguguuuaagccaggccauacagacaagccauucaguggaguuucuuuugagaaaauguguguugugcuuuaccaauguuuuguacaaugagccuuuccuguccaccuaguaaggugcugugcgccuucauuuccuuaagagucuguuagugagucuuccuaagucuauacuuuuauguuuguuuuauugugugcacauucaugugagagauuuuaccuuccacuauguggguaccagaucaacucagguugucaagccaguaccuuuauccauugagaucuucacagccccuccuaacacucaaaagugccuagacaguggucuuguguuagcuagcacaguagaucaacuagggggugguuugagcccuguucauuauacaugugucugggauuccccuccacccaccacugauucuacuuaauacucuuccuuagcuucugccuacagauggaaugauccggaagcauucucaugucaagauagggcguuaccaucagguacaaaccuggggucaagguugggggccagggugaaagaagggaacacaucuguccaaccccuccucugggaacauaaccccacccugcaucuuguauccugagcaagugucuggguaggccccugucacaccaaguggcauccuuuuggagguguucccucaaauguggucuugcuuucucugcagcacuuacaggagcagcuggaccuugaccuuucaccauuggaauacaugaugaagugcuauccagagaucaaggagaaggaggagaugaggaagaucauugggagauacggccucacugggaaacagcaggugagagaggagcccugggaaggacccaagguggcucagaggcuacugccagauggugaucggacgcugucuucacaugugauccagagucuccuccacuccuuuccucuguagugucaugcacaaugggguuguaagaaagaucagugaaugggacucugagcggcucuugagccagagugcuugagggagcaacagaaguugcagccuagaagacagacaugaaauugcacaguugccagauuaugucauugcauaaggacuucugaucuuagagugagaggcacauggucaugcuuccagguguccuugucaggccucaggacuaauggccuggccacugucuugcuguaugaucuugggucauccuaagcucaugacuugcaaaaacaacaacaaaaaaggcaauaaugguuacaaagagccagaaaaaggagagaaguccccugcugcagagcccuuguaugccagcaccaaguccuugugucaugguuccucuaggugagcccaauccggaaccugucggaugggcagaagugccgagugugccuggccuggcuggccuggcagaacccucacaugcucuuucuggacgagccuaccaaucaccuggacaucgagaccauugaugcucuggcagaugccaucaaugaguuugaggguggaaugaugcuagucagccaugacuucagacucauccagcaggugagguguggccugaggcacagcugugguacauagagggucuaacgacaucugcuaaauucagagaaggggcucagguccacguggccagaucugaugauucaggauaguaguuaacuugguagagaggacccaaaugaggaaggcgcucuugcuacucuuucgagauucuucggccaaguaaguauuguaguaaggacuuggauuaagaggaggaagcuuggcuacaggucaugaggccucugaaugaucaggagccuguaacugggagccugacaguacaggguggcacagcagggucuaccuuagaagauuccagaaggcuccaaagagccagagccuguuuaguagugagagugagcuggauguaguuuuggugaggccucaggagaagccgcuacuuuugggaagcccgguagugguaguggggagggugccaccgacuggccagaucaaguccagccucugcuuccagguugcacaggagauuugggucugugagaaacagacaaucaccaaguggccuggagacauccuggccuacaaggagcaccucaaguccaagcugguagaugaggagccccagcucaccaagaggacccacaaugugugagcccucagccaggcuugggucaggaaugccaccuggagacugccagcugacaccugaccagccacucaggacaggacccuggggcugcacuccugcacugcugcaauacugcccucagccucuccccucagccugccuucgcugcaucauaucuccagcuggacagcaccuguccguuuucccacccuccuuccauuugggucugucugucuggacucggcuggcuguucucuccagacccuugcugguuaccuugcccugaaagaugcagccagggguaccuggguuaacccaagggcccaagcccuggucuggcccuggaaggauucaagagccucauuuuauggguuucggugauguuggagaaauacugccagcccaucaaccccguuccuuauugcuucugguuuggagcucugggccagggccuaguccuggucaguauuuuaauaauuauuuaacaguguagaucuaugugucaucuaccaaguguccaauaaaagaggaagcuacagacccccuccuuccugggucucugagccuuuuuuuccuccugcagucggcauucacuuccucagcaagccaugggccucaugaggcaggagucgggaggauuuaucuccacccccuuucuggaucaagcauuuccuuaggccaguguuugagaagaguucauggaauuuggguguggaggguugucagauaagaggcaucccuugccagcuuuguacaaguccugggaacagguaggaacugauuccuaggaggcuuccuuguguaaauguugagcuagaggucccgggccauacuuugcagugugauguacugcugccaccugcacaccacauaggacacuuguuaaaaaugcagguacuugagcuagaccugucagcugcauuugguggagugggagagaugccuaacaugggauucuauuaucuuuucuauacaugcccuuuuauuagcucugcuagcuguaguagcuauuccugguugucaacuugacaauauuuggaaugaacuacaauccagaauuggaaggcucaccagugacccuuaucuggaggcuuggagauccuuaucuggaucuugguauggagaucuugagccauuguggcuauggauuccagaauuuugaguuugaggaacacaccuuuaaucugggcuacaccuuucaucugggauuaaaggugugguggaacacaccuuuaaucugggcuacaccuucugcuggagacaauauaaggacauuggaagaagggagucuagcucuugcucuugcuccuucgccugcuugcugcgugagacugaguaacugcuagauccuuggacuuccauucacagcugcgacugaaccauuguugggaauugggcugcugacuguuaagucaucaauaaauuccuuuacuaucuag

SEQ ID NO: 2373 - RNA, 527 nt, Mus musculus
caaauauggauucagccggugguucggggagacguaccuuccaccuuagaccauggccaaguucauccguaacuucgcggagaaggcaccgucgaugguagccgcugccgugacuuacucgaagccucgauuggccacauuuuggcacuacgccaagguugagcugguucccccaaccccugcugaaaucccuacagcuauucagagugugaaaaaaaucauucaaagugcuaaaacugguagcuucaaacaccuuacaguuaaggaagcugugcugaaugguuugguggccacugagguguggaugugguuuuauaucggagagaucauaggcaaacguggcauuguuggcuaugauguuugaagaccaaucuuuaacuucugauuugaguucuuauuugaauguucuuggaccauguguaacaggacugcuaucugaauaaaauacuagguguugaaaacaaaaaaaacaaaacaaaacaaaacaaaaaaaacaaaaaaaaaaagaaagaaagaaagacaaauau

SEQ ID NO: 2374 - RNA, 9155 nt, Mus musculus
uacuacacuuuauuuccacagcaaaagcgaaagcugcgccuuuauaucuccaauacuuuuaacccugcgaagccugaugcggaagacucugauggcagcauugccuccugggagcugcggguggaggggaagcucuuggaugauguauguccugguccaagccucuccagguguccugguguggguaugggcugagucaggguuaggacuaaaugucugcacugggaauugggagucagcccaggcuggggcgggugggccuggggacagucuggggacagagggcugccucugaguauacuacuugccugcugccaacuuggcccauucuguguccauggucccuguucugcccccacagucccugucacuuucccacagccuaguaagcagaagaggaaguuuucuuccuucuucaagaguuuggucauugaguuggacaaagaccuuuauggcccagacaaccaccuuguugagguaagacagauugcguccgcccuugaaccacaaccucccugucagcccugaagcagcugcagauucggauugaggaccauccgaaagcccuaggcucuaccaauccagaugggucuguguguaacuuagcucuucccccggacaguggcaccggacacccacaacccaggaaacagauggguuccaagugaagagaccaggggacuugagugugcgcugcacccugcuccugaugcuggacuaucagguugguuuuaccccgugccugcaugccacccacaccacagaccccacugucuuccuacucaccuucucuaggagcauacugcuaaggacccuaaccuccgugccccugagcccuacuucaaucucacuuuccugguaacuuuucccuagccuccccaguucaaauuggacccccgcuuagcccggcugcugggguuacacacacagagccgcucagccauuguccaggcacuguggcaguaugugaagaccaacaggcuacaggacucccaugacaaggaguacaucaauggcgacaaguauuuccagcagguaacggauguccuuagccccgggaccugaggagcagaagcaccuccaaagguagcugucuccucuuucugaguuccuggauaccaggaauguucagggcuaugguccuggagccgagagcagagucuuguccggacucuuccacagucuauuuagcugcuccccaagggaggugaaucugggccccuacugguacggagggcaucuggugauggaaucuccuugguaccuggaguugggagcccugaggugccaccagucuuggucuagacuuggggucacuuacuuugcuauucuuucugccucucgucugucuuugaagugaggagugguggaugcugugcggucacaugucuggcagcuaggaaaaaugaaauugaugaaaaaaugaccugaccuacuaauguauuuuaaaauaaacacaguagauagauauaaggaaaaagaguaguugguauuuauugagcauuuaccauauaccuucagacacuuguuguacacggauucaccuaauucccaugacaacccgugaaauggggcuguugauacccccauucuagaggugaagggacuaagacccaaggugcuaaguagcuugcucacagaauguggcagacguaaggccccugcacuggccucgcgauuagccaugccuguuucucuaccuccagccuggcucgcugccaucagcacccaggauucugacuugcccucagcuucuuguggucuuuccagaacgaaaggaucguuacuagcuacugugucuucaaacacacacaccagugaccucccucucaauuauccugcuucagauuuuugacugcccccgccuaaaguucucugagauuccccagcgccucacagcccugcugcugcccccugaccccauugugaucaaccacgucaucaggugagguggcccagccuuccccgcagacagggaguuuagcucccugguccccucccugcuuucuccacccuccucauguacccuccccagcccuagcccugggcuuccgugguguaccauggacaucagaggcuggacuucucuggcagcguggacccaucagaccagaagaagacagcgugcuaugacauagauguggagguggaggaaccgcugaaagggcagaugaguagcuuccuccuguccacggccaaccagcaggagaucagugcucuggacaguaaggugcggccugagcccagagcuggaguggggcguuaaaccaagagagaggacaaagcacucagaccacagcaugggccuaggccagggggcacacgcagccccucccuagugugagaagcugacuucauuccaaggucagcucugcccaccccgcuccccucacggaacucagaggaagcaagggcucuggggaacucuccuucacaagagaagcaacccccgcacccugcccccuucucccucucccgcagcacagggcagguggaaaucauugucuuucuaccuguagauccaugagacgauugaguccauaaaccagcucaagauccagagggacuucaugcuaaguuucuccagagaccccaaaggcuacguccaagaccugcuccgcucccagagccgugaucucaaggugaaguggggcuccgggagcacugaugcgaagacaagcacacgggcuggggcaggugggcaugcaccucaggggaacucaccacaggccccgugcucccucccaggugaugacagauguggcagggaaccccgaggaagaacgcagggcugaguucuaccaccagcccuggucccaggaagccguuagccgcuacuucuacuguaagguaauggaggcccaggaacccgaggcucccucuccuucaguccuggcagccuugccucucaccuggccacaguuaccuguccaccacccuacacccccaugcaguagucuccugguucccagacucuuccaggggaggggugccaggaugggguaccccuggucacucaccaggaucacuguaacccugccccgcucacacuuccucuaaagauccagcagcgcaggcaggagcuggagcagucgcuggucgugcgcaacaccuaggagcccgugaacaagcgucaggguggaccagccacuccgcccagcacaggcccugggcucuggacucccccucucgcgcugugcggaagguggggagggcuggauggauuaaaggucacguaacagacagcagccuuguggucauuguggacggggaugggaaggaggaagagaaggggaaggcaguggaagccggcagacaaauucuccacaacccuaccacagauucuucuucuuaccccucucccuagaccuaaaaacaguuuggcagaagauacguuuaauaacauuucuuauuuuuaaaaaaauacaguggcaagcccuccaucuguccgucaccuugccuugcccuucccggggcuauggcagauacagggguggagaggcuaagugcuguuggccuguuccuguucaaacagagccauggcuagcuggguacgggcccccagccccuccagauugcugaggcgacaacggugguacaguuccucgcugagccgggggcuacagucccgcagagagaacuucugcaccagcccuggcucuacggcucgaaagagguggagcccugagaaccggaggaaaacauccaucaccuccagccccuccagggcuuccuccucuuccuggccugccaguucgccagccagccgggcgcgggcugccagguagucagcauuguagaagcagcccucugcugaagccugccggucaaaucugcccccgaccggagccccccuagaaggguccacaccaggggaggggggaucagccccagggacaccugggggagaucucuguggugacagagcaggguugaacuccugaaaguggaccggaaagaaggccugccagcccgagauugcauucauacggcagcgguugaggacuuccgacccaggucuuguccacacggugguaaggaagaagaguguguccacaggguguuucuuggagaugacauccaugagucgcaccugcgaaggggccucugcucgcacagcgagccaggccagccucgccccuggguaccgucguucuaacucagcugcugcagccuucacuccgagaaaugggucagggcccccucggccuucccggggcccauagaccaacaacagggugagcaaugcauguucucgaggcuccagaacacuggcagcaaaggccucaagaaaagccaaggcggccggagcuucagccaccaggaguggcagcaccaguugcacccggguagccucggugacauagggcauaggcaggauuuccacucugcucaguggccucagcaggcucacucugcgggccagggagcgucugugcccucgcugagucacagcuuccagcagcaagucgaggguguauuccaugccccuugcagggucaaagcgccgguagccauugagaagccgcugcuuccggaagcgcaggcggggcugauagcgccgauugagcugcuccagagcuguguccacagcguccccuacaucugcccugcuagcccccugcaggggacacuugggagccccgucugcacaggcgaagguguguugcuccgugaaguagucccagcccagcaccucgaagcgagaguguggagugaaaggggccgggagcccaacaggccagcuuagcccugccucccccucaggggucagcaccgucagguuccggaucugggccuaaguuggagggaaugcaaccaacauuagugcugguucugagauuccacccggcuccagaugcccaggcucuggggguccaucagcagggccuggcuaaccaccgagucccuugcccauaacugucauaaucuaaaauacagaagggaggcgaggaaugcccaccuucacaacugccgccaggaccaucugcuuggcagaaggaagcagaucucaaaauacacaguucaauacacuuucaaucccgcgcucacaggaccaacauccucuucaugauccucugaccuaucuaucaaaucuauaccccacuucugaugacccccacacuacagaauuccccucuucuaucuuuugggccuuuagcacaauucuagacgccuagaaugcugcugccugucucucugggcagagcacuaauguaguuuaaguaaguuucugggaguuuaccuacaaauuugacaagccagagcuuacuguagcuggaccccaggcugucuccacccuagcccuggacuccccaggaccccucuaagcucccagccauggccuucaggcacagcucacugcaguggcucaccugcaguuguucuauuucgcuguaagcccgcuccaacuccagagcacugaagcguuuguggagccgguacaugagggugcccucggggaccgggugaacggcgaaggcacucaggaaagcagggcucuccuccuucucagggucccuauucuuggccaguucgaaggagcgauacuguugccccuagagggaccaaucagacaaucaaugcugcacacauaagcugugguuccccaaagccuuggucuccuuagcacucacaccugucaccaccaccgcucuagaagggacugagaagcaguggaccccuaaccuccauuccugcuucuaaugcucacauuuuggaaauaaggcaaaugggcaacuaagggccuccucuuuccccaagaaccccacugcucaaugagaauacagcuguaggacaucccagcaggcagguguggaagaugucuugccccugggauaucagccuucuaugauagagcuuuccaccuuggggguggggguggggguagggcuaggguggugaacucuagaacauuuucaccuuguccuuaauugugaugugcacuggguguggaaaaggggguggggaggauggcagacaggaagguugaugacuucaggcaccucuuccuguuuuguucaggggucccuaaaauuucacacuuuugauggccccagggcuguaaggugagcaagggagagcggaaggggcuagcuggccucugggaaggacaaaaggaugucuggagaauucaguuuggacagcaaucauucagucacugccaaccuuugggggacugggacugccuugaaggggcugucaccuggugcugugagacacagccgaugcccagagugucgaugaggcagcggccaagccauucaucaggccgggcacugagaauguccccucggcagccauccagauguggccgcaagcgcaauaggagacuccgugacaacagguagccaaagcccccauggcaguaccgggccugcucuccuguaccaaugaauuccucugcauggccuaaguacaggucuugguugaugcuaaggugaccagcaagagcugccaaucugggggccugcacauaugugucguccugcaugaugaagaaccagucauagucugccccaaagugugugugaagguggcgcagggucucugacaugagccaggcaggccgcucaucuccaugagacaccaccugcaucccugcaggagcccgggccccucgcugcccugugaaguagaguaaccgagggaagugaugugcuacuguacgguuaaccgcgacggccaggguggacaguguggcucgagaagucaggacagccaccagcaggcgcucacgagagcccagcucugucuguauauaccgaguccuacggagagaccagaagauaaggggucagcuccugagucauuaagggagcguguaccagccuagcacauacauuccuaggaauaaaggagugcauugggagaggggagagaccccccucccucaucacuaauaacuagcuaccggggugagugcccacugaguggacgaggcuggacuuggcuauguggagacaggcucuacucagaucuauuuaguagguuggugcagguacagcucuguucaagaacagugaacauuaacaccaauggguaagacacucucagacuuggggaaggauaaaauaggagcaaacuaagauaggaaauaagacaagugcuuccaggaaacuaacacugaguagcaacauaaacacagcagcaaacagcucuagagugagggcuggugcugaggacuaugcacaaucacccucaacugagugucaguacuggaggacuaugcacagucaccuucaccugagcgucagugcugaggacuaugcacagucacccucaccugagcaucaguacuggaggacuauggacagucacccucaacugagcgucagugcuaaggacuaugcagucacccucaacugagcgucaguacuggaggacuaugcacagucacccucaccugagcaucagugcugaggacuaugcagucacccucaccugagcgucagugcuggaggacuaugcacagucacccucaccugagcaucagugcuggaggacuaugcacagucacccucaccugagcgucagugcuggaggacuaugcacagucacccucaccugagcaccuucuuguagggcuuguuaggaucccuguaguaaggcacaauccugggucugaagucuucaucgccuugguccagcccauuuuuugagucuggauucuguggcccuccuggcuuccccacagccucuacacagggaucuucucccucacccuggauccaggaaacccgcaggaggcucaggcugcaucccagagacaguccuaggaugagggggagcacuggccgcagcagagccagcagggagcucagucgcaugguggcaggcccugacacagggcgccccaggggcacagucucaaggaugaguagguugaugggccacaggccagcaguagcccacgguuuuacccagagaacccggagucaacgaggucagcaacagaaaaaggagcccagcauccccaccaagucuucccaacccuaugucuggucuucaguggccauggugcugauacccucaguaaaauacuaaugucuaugugagcaaugccacucccuacggggauugcagucuguaguccaggaaaaagaaaaaagaaagugcaguccugccaaaccuaaccccagaaggucuacagccauuugaaacaugggccuaauucaagucagcagcacccagugacacagagcuuagggcaaagugcaugcgccauuccaacaacagucugaccaaaagggccugccucagacacccugugccaugcugaagcuauccuggcccacuaugucuccucaggccccagaggaacugcugaucugccgcugcugcaggcaagcacuagagaaggggucagcaccuccuuccaccccgcuccugagugucaaagagagccacagacucuagaaauccccuccuugucagauaagaucaccagcuaugaauggugcccacccaccuacccacccaaaugaggugagcagucacagugacucagcacagcuggccucucauaggagcgcaauggcugauggagccauuuugcuagccauccuacucguccugcaaagcuaugcugcccacauaucuaagaacagcaggagacaaauuacagacacucuugcuguggcuagagguuaucaaacaaagccaaauaaagcaaaagcaagccgggagacagcagcaguuagagaaacgcgggggucugggaaggccagcagaggcucaccaccuuccaacagggcaccuuccaauagggcgccagucagugcccuauuauucccuuggcgaccacagcaccgugccagcccccagaagaagggacagagcgaguccuagccggccgucuggagacagaaauuaaucgccuacgucccacgacugcagaaaaggccuugcguccagcugguuugcucugcgaacuugggcgguggaggggagcucgcggcggacagcaggaccgagcggguucucagguccugccgggcaggggaacaggaacacccaagccccacggcagacggagccgccucgcgggugagcccacccuguggcgggccgaggagcuccgcuuugcugccgcugccaccucacaagccagcccucggcuuccucuuccgcugccugucagucucccgucucua

SEQ ID NO: 2375 - RNA, 7793 nt, Mus musculus
ggaaugcuguccgggaggcucacuuccuagggcacucaacuacaagguacagagccagcuucuccugaccugucccugacuucugcuuccaggaccagggaccaugacuggaacaucgaggcugacuguggugaagggagacguuugcacagcccugcuggcaggucaggacauaaccaacccauagcugcacuccuacaauggcuuccuacuccacugugguccacagacugcuauacugcagggaaaccacaccaccaacucucuacaucagguucuucauuguacaacugggcagguaugacaaggucccuuucuuuucacuuuagaauucuaaaacuuuuuuuuuuauguguacuuguaaagacugcagcuuuuuaaaaccuuguuuuuaugaucugacauguuuccaggcaagaagguaauccuaaauuaucaugguagccucacggcugccuuuuuuuuuuuuuaaagauuuauuaauuuaucauauguaaguacacugcagcugucuucagacacuacagaagaaggagucagaucuccuuacagaugguugugaacuaccaugugguugcugggacuugaacucaggaccuucagaagagcagucgggagcucuuacccgcugagccaucucaccaacccacagcuaccuuugaaauaacucccagaaacacaguaugguguugagcaagauccugagaggagacugaaggccaccaugacaggaagcugccccggcucuacuucaagcuggcgugauucugguaggugcagcccugucguggacaucugcuaacacuggugaagccccagguuucucuccuccccagcacuacagaaaaccaggcacgaugaauacucguagguaucggcaaggaggaucagcagagcaagguuauacauggcuuuagagcaaguuugaggcuaaccuggacuacgggagccugucucaaaaaaagguaagacaaugcauugguccagcccuccaugccucuucuggccuccugccuggucuuuuccuacccaguucagaaauaaagucacaaaugucuuuguuucuuaaccucaaagggucggagccuccugggugcugcagagagaauggaaaacucaccucucugcgguuggaaaugugaguggcugcaugguccacguuuccaucgcaggcccguaggcccagccgugcuuccugggcagugaaucccaacuguaacaaguugugaacuuuugauggaucgauguaaagcuccuuaaagagcugccgugccuacaaacaggaagaagcagaacgcucaccucacagcaguaacaauaaggcuuagcaaagcuaaagcccaggagugaggcuaccaaaugugaacuacuguguguaagauucagacauacugagcuugucuaaccugccaccauaaggaaugaagcgaacacuaucucugccugcauaacauauccauaacuuagcaacaauaggcaggcugaaugcugcaggcaugccagagugacucuuucuuucuuucauucccagcuuagcuggcagugguggugccuccagcaaucaggaggcaaaggacaucugggcuauacagcaaaacaggcugcaaauagcaucuaucucucucccuuguaggugggcuggcugggugguugcuagguaacugcagguggucucucuuuauuuuguuuuaagauuuauuguuuauauaugaauacauggucgcugucuucaaacacaccagaagagggcauuggaucccacuauagcugguuguuagccagcauguaguuacugaaaauugaacucaggaccuuuggaaaugcagucagagcucuuaauuguugagccaucucuccagcccuggcagucucuuucugaggcacagguaggucuguucugacucucuaguccucucugcuugugccacacaaaccagcaggaacaauggaagccaaggccugcagagcucuacccuggcguacucaugcuagaggcagggcagaaacuauuucaagccacugccauuuuaaagagucuucauuacaacccccugccagagccucacagacacaaguguucaugcugcaugugagagaggggaccggacggaggugcagggcucugacacauccgugagcgugacucaaagaauacuccacugccaaggcagaggcagagguggggcagaggcagcagucguccucaccuuguugagauauucccgagcuuccucuccauuuccacugugauaguuuuggauucccugaagcaaguagagucuuaaaaacaacaccuucucuuucccacaauuucccugaaguuauugggagaaaaagaauaaguggucuuauuucuaauuaaagagucacauggucacugcuguaacugagccaugucuccacagcaauaagaugacaagauagcccagggcaccacagcugucacugggacaacuucuaagcaguaucucuuccacauggugggaucagucaagacacugaggcuaggcaccagaggccaugacuaagucacuggcucuuuccuggucagacugagaguagcgcucuacaauuaguaaacucuuuaagaaccaccacacaccaggccugauggcgcacgccuguaaucccagcacucgggaggcagaggcaggcggauuucuguguuuguggccagccuggucuacaaaaugaguuccaggacagccagggcuacacagagaaacccugucucgaaaaacaaacaaaaacaacaacaaaaaaaccaccacagaagcagcaagacuaaauugagcauggugaugcaugcuguaaccccagcacuccagaagcuaaagcaagaagauuaauaauacagcaacagucugggcuauaugagacugucucaaacaaaaccaaaaaucaaacaaacaaaaaaaccaaaaacacaacaacaaaacagaacacaacaaaaacccagccagauucauuaaacucucaaaaccugcuaaagcucuggcuaauauaaaggauauauaugcugcugcuaacacucuggcuaguaaagaggguacuguauuguaugcugcugcccagcucaaucaccucuggcagcagcucccacaucuaggcagaugugccccacaagcaggcugagacaaccaaucacagugacguacuuuuauguggaccagucucuggugauucucuccguaacaguuuuuaaagcauuucugggccaaguucagcuuuuucucugcaucaucaaggcauuccagcuguuccaggcggaaguaacaccacacaauguccagcuggaggacugcauaguuguccacaguguccagcagcucuuugcacucacuacaagagaaggaagcugucauggcagggcccuucauggguccccagaaagccuuuuagcucuugguguguuucuaggauuaacuaaugggguauuuacaauagggauccucugaauggauacagaggaauuaggguucuugauagcaacaugguggcaucuggcccaggacacaguagcuucuagcccuggcuaugaacuacaaucacccagacacaggaguccuucucuggggauacugaugcugagaccuaauuagggcgacaguagcaaagcucuccaugacagaagcuggcugucccacugcuaaaaucuccccaggagauucuaacaugcguaaagguugacacguggcuuuaaagacacccugaaaccugcaacucccuaaaaaugcuccagcugauggcaguucugacaagacauucagugcgcagggacuuucucacugggggaacagucuggaaaacaccaggcuaaaugccuagcugacuccugagggcccaugaacaggcugagccagacacaaggaaaacaaugaagacacuauucaugaauuauuuauuuguacuuuguuaugauacugcucaaugcauaaugcagaccuagcccucagaucaaaaaguaucugcgaccacagauaccuccaaagcuuuguccaucuacuuucaaugggaugcuguuaaauagcuuuuuuuuaaaccuugccuaccuagacauggucaucccaaagucuaaugaaauagauuuguuaucacccacgaggcugcacacaguccaaugggggcaagaacacagagaacaauguuuuugcaugcuuucaucccuaccucuucuagcauuccuauuuagucaugaauaucugacaacauacaugccauguggcuacacacacacauacagagagagagagacagagacagacagacagacagacacaagaugaggguugggggugggguaggcccagggaaagaacaucuucaacacagccugaaaacuugacuugagaagaggcagagaggcuguagguagaaaugugcucucauaucaagggagacucccucaucugcaacuuguugacggguucaccuucugagaaaggcuuaaccauucauaaagugcaaugggcacucugcccugcauuaacuuccaaggccuaugaaaagcucuuccaauaccugcuggacaagcaacaaggacagaaaugacccagaacugaacuguguguggccagaacacaaaaugaaaauuauaucaaaauccaggucucauauuaaagggguacauuuuacucuuacuuucaaaacaaaaacaaaaacaaaaaccaaacaucaggccgggcauggugguacacaccuuuaaucucaggacuaaggagacagagguaggcagaucucugaguuugagaccaaccugguuugccuagaguuucagaauaacuauaacuaccagccaggacucugucucaaaaaaagaaagaagagaagagaaaggaggagaggagaaaagaaagagaaaagaaaccaacaccugcacacuguaguuuugaagcugauagguuuaaauuuaaaccugagcaugccaacugggaaggaaaaguuaaaacaaaaacaaaauaucaaaacaaacaaaaacccagcauaaaacuguuuuaaagaacagccagggcuacacagcaaaaccauuucaaaaaaccaaaagaaaaaaaaaaguguauuucuauguaauaaugacuuuguuugcaauuuuaaaagcuuugcuauucaacaaauuuucauguugaaacaguuuuaaaacgaaagcacuaaaauuacuucgucuuaacacugcuuaccagaauuuuucauuuauuuguguauguguguguuuguguuuuguguaugugcccaugcaguagcuauggagaccagaagagaguguuuguugggggguguuucugugcgcuauguauuuaucugaauguuacuucuguacuuggagauagauacgguugcagcccagacuuugguacugcgcuuaugaugaagcauuccucacucaguauuuuguaaaacauuguucuccguuaucucauuggucaacagggucaaccagccuguggcugggcaggagagggaaaaguggaacuucuguccccagagagagagagggauucaggugggcauggggaguugccaugaaugaagcagauggcagguaaugugauggggcuucgaaguauccaggccagcauagcuggguagaauggaucaaaauuugcucagcuguagugccuggggcauuguccgcaccgauaccauuccuaagguaggaagcagugugacaacagauccgguggcagcacccugcgggugccaagccuacagacuagguggaaaugaguggguguccuucugcacaggcaagggggcugguuagaaauacaaaggaggaagccaccacauucuggugggugccuuaacuccuggcucccagaguuaaccacucugggguagaaaucaguugaagucagguaggaaggugcuggggagccuccccuuacacuaguaucugcugaaugaaugcaaaagcaccuaccagaaguaucugucagcguccaggaggcagggcagggcuauuccauacucuuuucuuuucaggaaagcucugcccuucucgugauaucccauagcuaacauaagggccuaggaaagaggguaaauuuuuaaaaauaguacuuucaaacaaguuaguacugcauauaauaaaacaaauuaaaguguauuagcucuauggaaaagcaaggcaaaaaaaaccaaacacaacucaaucuaaaacccaauuagcuaagcuccaugagagccuuagcuaacugaagcccugcagccuucaagccacgccgcagucugaguggcgccagccccugcguucuucaggcucuccuuccaccugcugagccacaucuguuucaguuuucaagacgagacaggugagcaggcaggaguucuuuuggccuuccugagagcacugcaggugugaugcugugggcugugcucacauuugggacaccgaggagggaggacaggauggaggccagccugcccuaagcagcaagacuguccaagucagaauguuaaguuccucagugcuguuugugguuuuccuuucaacuuggagucccuuacuuaucucagucucccguccuccaauuucacaagcaguaucaccacacuuccaaauuauuugacaaugccagcauuuccuagacaacuuuuuaagacauuuauuuguguguauguggguaagcgugugcauuugugccauagcacauauguagaggucaccggacaacuuucaggguucuuuuucuaccauguagguuccugaaauagaacuuggguugcuugauagcaagcgccuugaccugcucaaccaucuugcuggccggcccuccaaagccacuuuuaaaaggcugcagugguuuagacuguguauuaaaugagggcuugguccccagucuccccggguguaccaccauguccagcuuacaagcuaacuccauacaguuuaauuauugugugugugcaugucuguggaucuggguacagcuugccacagagugcauguggcuguaggagugcgccagcgcucugcucugcucccaccguguagguucugaggaugaaagcaggucagcaggcugacagcaagaaccuuuaccgcugcucucccuccaggccuucauuuuaaacagaauucauguagugaggcuuaccccaaacugucauuuaaaggccaaauagauuacagaaugaaacaaaaacccuaaaaugaacuagauuccaagugagucagagcucuucauucuaagaaacaagcacaacccacccaccccagcacccccagagaggcgauccccagggcaagccucccaaaccugacuuacuuuucuuucugcagggggaauucugagugaccugccugucugguucgcaaugucuaaguaaggcaucguuuccggaucaaccaccaucucagcugcaacaaagccacaggagccucguuaauuaaggaccaaacggcacuugagaugccagacugcggaggacuccacagcaggcacacuacuuaucugugugcugccugaugcaucuagggaggugacaaaccaaaaugguguaccucucuccgccaggaucuccaguccccguuugguccucugaaugcgucucuccuucagcucggccucguucuguuccucuuccucuagcuguaaguuuuuccucacauccucuucagacuguuucagcuccaguaccaucgccuucacauugugagugacuccuuguucuucaaggcuuuucccugggaacagcagaauugccugucacauaaacuuccugggcaacaguccauuuccugugguaaauggaguucuuuuuuuaauuaaauaauuuauuuauuuuggaau

SEQ ID NO: 2376 - RNA, 44386 nt, Mus musculus
cgugcggugacgcgugccgugacgcgagggcuccgcaaggcugcgugucgugggccgcgucgcgcgccgcggcucgugcggcucggcccgggcuguggcgggagcggagaugccgcagcccgugcccuggagcgccgcuaucccggccugcgggugucgcggugaguagccggcccgcggcgcuugaccccgcgcggccuacgucggcgccugagcgugggcugcggccugaagggacgcggcugcuggagcaggcuugguggccugggaggccagagcugcuuccggauucaacagcagugauggguacugcgcauggccguucucucgguggccguaaccuccagccaguguugugauuuacuagaaaaaaauaccgauuuuaucuuuauugcuguuauuacggucaggauuuagaccgcgucgguacaggaggcuggaagacagaaaggaugcauguuucuuugcaguaugcuuguuaaaaaaauuaccuuuuaugguuuucguacaccccaaacuagugcuuuaaauauaaauauaggaagacccgccaccugucugucagaucuuguccuuuuacuuugagagccaucauguugguugguugcuuaucuucaaacaaaaaaugagacccuggagacgcuuucuaguccgugggcccaacaaaacaguuacuucaaacuuauuucuucuuuuauuugaaauaaugcuuuaagaaaaacaggaaguaagccuuucuuacccucagcaugugccugccacggagcucugcaacugaaaugucaccauaccguagucuauaguuuucauuugauggcccuggaaucaaaucucuaacauuucugugcuguuucuugccagguuucuuaacaauuuuauauuacuauuuuucuugugaaguauaauuaacaugaaguuuauugauuauuuuacuaguauaguugaauggcaucggguacauucacaguguugucuuaacaggcagugccauauauuuccaaaaucaaucacucaggacagacauuauaacauagggcagggacuccugcucuucuucagucucucaguuuaccugguuuagauacuucauuugaauuggaauccauggucuuuccuuuaucuguaucuguuugaggcuauucuugguugucaacuugacaaccaaaaauggcuagacacaacugugagagauuuuugcugaauuaaaucauuugaaguggggagagcauuucuaaucuguaucuuugaggugggaagauccaccuuuaaucuaaggccacaccuucugcuggcagccuuuacaaaggcuauggaauaaggaagcccccucuuugccugcuugcucucacccauacuugaaaguccauauuccuucacuggcauuagagccuguuuguaugcuggauuccaguguaugcugaagaacagccgagacuuccagcuuuguggaugagcaacuagauucuuggacuugacaucaguagacggccauuguuggacuugcgggaguacucuaauaaauccccccucucucuauauggagaaauccauucuauaauuucuguuacucuagagaauccuggcaaauaguuucucugcuuucugucuuuggaaugucuauggaagguuugaauugcuuaguucguguuugaaaagcacugacugcugagucugauggcuccacuugucuggcuuggucuccagugaccuuuauggccuuucauauugcuugucagcacaucuucuggauguaccuuggaacccuucuucuuuuuuuuuuuuuaauuuuuuacuagguauuuagcucauuuacauuuccaaugcuaucccaaaagucccccauacccacccacucccccuuuuuggcccuggcauuccccucuacuggggcauauaaaguuugcaaguccaacgggccucuuuuuccagugauggccgcuuaggucaucuuuugauacauaugcagcuaaagacaagagcuccaggguacugguuaguucauaauguuguuccaccuauaggguugcagaucucuuuagcuccuuggguaauuucucuagcuccuccauugggggcccuguguuccauccuuggaacccuucggaagucuuuuccuagguucuucuccaaaguucccagugucccagaggaucuguucaguaucuguucucugcaccugcucuuccuuuguuacguaaaccugcucugcauugguuucucuguagcuucagcuacaguucccgugugucuuaaguuucugugugaagccuggguuccaaugugaaggcauugcccuaucuucaauguaccagcucaccucugacccuuguucugggucaucaagacuugaaagcuuggugcuauagccucuucuuccuuaggugacgccauucaugcugaccaguauagguaguuaguuggucuuuguuuuaccuuccccacucaguuucacagcccaaggucaagccaagauggcuucuccuugugauuguugucauuaacuccuugauucuaaacauuuucucccucuauccuaaaccguuuuguacacagcugucaggacuucuucccuaagcuggguaguagaauugcauaaagacacuagcuagcgauuuucaucccacuucccaauagggucucacucuguagcccaggcuggcccgaacuguugucacauucuuccugcuacagcuucccaagugcugggguuguaaaugugaacuaccaaguccaguucauuccugacacguuuauucuuaguggcagagcuccagucuguuuuccuacaauuaaacuuccacuagcuuuaaagcccuuacaauucacugaccuguaagucuuucaggugaggcuaggaauauggcucagugguuaagaggaagugguguucuugcagagaaaccuaguucaauucccaguacccauguuggugacuugacacugcuugugggucagacaccucuggacucugcagaccguguguguguguguguguguguguguguguguguguauguguauaauuaaaaauaaaaguaaaucuaaaauaaaaauguuuggguaaucugcuucauuuuaccaaaucccugaaccuacucaugauauuuuaaaaggcugcuguguuauucagaggucuucagagagguggagccaggggaaugugccccuauguacacacaugugcauacacacaguuauguucaagaauucuuagggcaaugcaaaauucauuagcaguuccuuacugagaagguaggugggacuuuuuuaaugcuagcauuuuaggaaguaaauguucaugcaacuuuuuuuuuuuaauuaaggauuuuguuuuguaguaauuguagacucacgugcaauuacaagaaauaugagagggacuauauaugcuuuacuguguuugaaagaccccgagaggagccccucgcucaggccucgggauaauagcggacccccaagaacucacaagagaccaagcuugaugcaaaccacaugaggcuuuauuuggggaaagccagagcuuuggggacgacucauaucccacgcagggguagaggagucgaccucgaggggaaggggucccaguuuuuauaagcccucaggggggaaaggagaaggggggaguaggggauuuccagaucuaaacaaugucuauucucaagaaauggguaugggagggguacaaggaaagagucuggugcagguguagcaacucaggauuggcccggcugugguugcuggggagauuuucugacucugucuuagcaaccaauaucacaaacaccuggcagugaggugcagcagugggcacacacauggguucaaggaaccgucagaacauuggcaggcacacggguucaaggaguggccagagcauugugcaccucuauuuuucuaaaucagugaagcuacuucuacuaacaaugaaaucuauuuugccaauuucaggguuucugugaccuuuuacauucugucaggaucuuucauguucugcucaguauuauuauguaaaacuguagcauaacauagcuacaguauugguguugguauaguuaguggucuguugcuaccgugauuccauacucacuuggccucuuuaagaauucucugaucccuguaucccuaaccucuggcagucacuaaucuuucuuucaucugcacaguuucaucauaucaagaguguuauauaagguaaucaucaaguguauaaucuugagggauuggacuugcucauucagccagucaguccaaucuuuuaguuggaaaaaugccaguguagaguuuuagcaucaccaacuagaaaaggaaaacuuguugaggacugacuugugccuuauagggcuacauaguaucccuggucauugccaacuguaaugugacaaccaaaaacgguucccagguauugcaaaagucccugggaguggcacauugcuuuuccagaugcuguguguuucccuagcccuuugcuggaggaucacuggaguuacagaaugaagaguagaccuggagcuuaggagacaggucauggcagcacaguucucucuccugcacugugcacacucuuccacacucagcugaguauucugcuguucaaguccacacucgcaaagguacaaugaaaccugcauggcuuuccguggaaaaguuaguaaggaagacacaguugauacauucagacauaaaauggacuagaaucuguggucucuuacucuguggacaagaguuagcuaaaggccagauuguauauacguuguauauaccuacccucugagucaaagaguugagcugugcagacuugagaacagucauuccaucaggacuuacugauuauuacgucccuucucgcagggguagaacagccaggagaccgccaccugaguuucugguugcuguagacuauuguaagggaagggacuccauuucugcagcagugggaaagccaucacacuucguaacccucauuugugcucuguaaggaacccuaacagauucacuggcucccaagagugaaugcugguggaaucgugccucaguuugucuuugggaccuuaguagggagggagaaaaauuauuggcucauauuuucuuuuuaaaaagcauuuuauuaugaaaaguucuagacacuaaaaaucaacauuugaaaucuuuaaugguucuuuucaucucuaggcauucauuuuuuaucuuguggauuaauugaguaauuucagauagcauaugauuuuagcaggauaaaaucaccucuacuuuaaugacccccuucuuaagcuauuauuuaauguuggaguagcuuuagauuuacagaaauugugauaauaugaagcauuccugugugcuguaauaguuccagugaaauguguauugcucccaggcagcuguagacgcucuacugccguuuguucucaggcugcugcaccugcuuacuguccugccugucuguguggcugaggacugcuguugcugagugaagagccauugucagaggaugcacuagcagugaccagcacugccuggccuggcucacuaaccugccagcuccuaagccucguacuuuaagcuauuuugcugacguguaucccugguuuccugauuuguuguuuuuuuuuuuuuaauuacuuuuuucuuguuuugcuuuauuuuugguguaaguuuguuuuccucuuagcagcauuacuuaguauguuucuucugcaucugagcuauguuaguauuguaguacuuguauccuuuuuggcuuaaagaauguuuuuaauaagcugagcagcuuugaacucuguguucuacugcuaugauggcuauuccugguugucagcuggacuacaucuggaguguauuacaauccagaaauggaggacacaccugugaaacugaucuugaggcuggaagacacaggcuucugaccuggaucuugacauggagauauugaggcauagcggccaugaaaaguugaggcccaggcaagguaguacauacccuuaaucccaggagauugaggcaagaagaucucugaguucaaggucagccugagacaaagcaacuuccagguguggugaugcacaccuuuaaucugggccacaccuucugcuggaggccuccguaaggacaauggaagaaggaagcucuuuaacuccuugcacuuacuugccagcacaucuguuggaaucuacuucuuuaggaguccagcucauauagaagaccagcugaaacaaauagccuuuugggacggagcaacuacuagauucuugggcuacccauuguuggguuaguugggcucuaagucauuaccauaaauucucuuaguauaguauauggagauucauaaguucuaugacucuagagaacccuaaaacaacugccuuagacuucugaaugcugggacugucagcagaggcagggaccgaggaguccuugagagaguuuuguugaggugaugcugaaguauuugacauugaagaagagaauuuugggacaaccgagcaugaagcauaggugggauuuauucagauuuauuaucauuuguucucuuucuuucuaaaacagguuggucuuagaaaguucgauagccuagguuggucucaaaccugcuguguagccaaagaugaccuuuaaccucugauucucucgucuccaccucccaagugauagagugauaggcaugcaccucuaucucugauaagaaggacuuaacguugaugcacgggccuuacggaaaacaggaugcuuccuauguggaugugggugucuuaugggagagccccaugugagcgucuugggcauagcugugauuugggugccuucugaagaagacucccugcagcccaggcugccugugcucaugugcaguccaugugucucauccuucccacagcacacugguccucuucucuuucaguaaaugagauccuggagugagacagccauuucugaggugugccugacuguauguuaaggugauaagauuaaaagcauaggucaaaggcguguaggucacagaauucagaguugaagguuugcaaucuuugugugagaaucucagaaaauagaguuuuauagcugagacagaaagaaaguuuaacucgacagucauacauguuuugauuguaaacaugaucucuuguuauuauaacacuuuuaaaaauaaacuucuuauuuguuugguaaaauuaguugaauuuuuacuuuuuuaaaaaaaagauuuuuuuaauuacuauuauucgguguaucuccaugugaaugugugagugcaggugcugaggagacaaguuagaucuguuagaacugucugacauugguccugggacucaaacuugaguccucuagaagaacagcaaauguucuuuuaacugcuagcuucaccuuagcccuuagcauucuuuucuuccuucuuucugauuuaucuuucuuuuauguguaugaguauuuugccuguauguaugcuggcauaccacaugugugcagugcccauaaagacuaaaagguguugaauccccuguaacagggcuuagaaaugguuguuagccacuauauggaugcugggaacuaaacccaguuucucugcaagagcagcaaguugcucuugauggcugcuccauuucuccaaccuccauuuugacauucuuauuuggaauaccucauuaaaaaggauuacugccucaguauaugaagccuucacagcugugucaaagguuuugccucuucguagauaaaaggcuucaguuagaugggaagugagggcugcucuccccucaugucuccaucuuuaucuugccucaggaucauaauuugccaucaugcccugcuuguuuucugugaagagauucacgaauacugaaagaccccaccauaaggcuuagcaagcuagcugcaguaacgccauuuugcaaggcaugaaaaaguaccagagcuggguucucaaaaguuacaaggaaguucaguuauagauuaacaguuaaagaucaaggcugaauagcacugggacaggggccgaacaggauaucgguggucaagcaccugggccccggcucagggccaagaacagaugguucucagauaaagcggaaccagcaacagacacagaagccccgauagacgucaguguuagcagaacuagcuucacugauuuagaaaaauagaggugcacagugcucuggucacuccuugaaccugugugucugccaauguucugaccagauaugugcccauugcugaaccuucauuagacucuuuccuuguaccccuccccuacccauuucuugaaaauagacauuguuuagaucuaaaaagucccaccucaguuuccccaaaugaccgggaaguaccccaaaccuuauucgaacuaaccaaccagcucgcuucucgcuucuguaaccgcgcuuuuugcuccccagcccuagcccuauaaaaaggguaaaaacuccacacucggcgcgccaguccuccgauagacugagucgcccggguacccguguucccaauaaagccucuugcuguuuacauccgaaucguggacucgcugauccuugggagggucuccucagauugauugacugcccaccuggggggucuuucauuuggaggucccaccgagaucaggagaccccugcccagggaccaccgacccccgccgggagguaagcuggccagcggucguuucgugucugucucugucuccgugcguguuugugccggcaucuaauguuugcgccugcgucuguacuaguuggcuaacuagaucuguaucuggcgguuccgcggaagaacugacgaguucguauucccggccgcagccccugggagacgucccagcggccucgggggcccguuuuguggcccauucuguaucaguuaaccuacccgagucggacuuuuuggagcuccgccacuguacguggcuuuguugggggacgagagacagagacacuucccgcccccgucuggauuuuugcuuucgguuuuacgccgaaaccgcgcugcgcgucugauuuguuuuauugcucuuuuguucuucguuaguuuuuucugucuuuaaguguuuucaagaucaugggacagaccguaacuaccccucugagucuaaccuugcagcacuggggagauguccagcgcauugcauccaaccagucuguggaugucaggaagaggcgcuggauuaccuucuguuccgccgaauggccaacuuucaauguaggauggccucaggaugguacuuucaauuuaaguauuaucucucagguuaagucuagaguguuuuguccugguccccacggacacccggaucaggucccauauaucguuaccugggaggcacuugccuaugaccccccuccgugggucaaaccguuuguuucuccuaaaccuccucccuugccgacagcucccguccucccgcccgguccuucugcgcaaccuccgucccgaucugcccuuuacccugcccuuacccccucuauaaaguccaaaccuccuaagccccagguucucccugauagcggcggaccucucauugaccuucucacagaggaccccccgccguacggagcacaaccuuccuccucugccagagagaacgaugaagaagaggcggccaccaccuccgagguuucccccccuucucccauggcgucucgacugcggggaaggagagacccucccgcagcggacuccaccuccucccaggcauucccacuccguauggggggagauggccagcuucaguacuggccguuuuccuccucugacuuauauaauuggaaaaauaauaacccuuccuuuucugaagauccagguaaauugacggccuugauugaguccguccucaucacccaccagcccaccugggacgacugucagcaguuguuggggacccugcugaccggagaagaaaagcagcgggugcuccuagaggcuagaaaggcaguccggggcaaugauggacgccccacucaguugccuaaugaaaucaaugcugccuuuccccuugagcgcccugauugggauuacaccacuacagaagguaggaaccaccuaguccucuaucgccaguugcucuuagcgggucuccaaaacgcgggcagaagccccaccaauuuggccaagguaaaagggauaacccagggaccuaaugagucucccucagccuuuuuagagagacucaaggaggccuaucgcagguacacuccuuaugacccugaggacccagggcaagaaaccaaugugucuaugucauucaucuggcagucugccccggauaucgggcgaaaguuagagcgguuagaagauuuaaagagcaagaccuuaggagacuuagugagggaagcugaaaagaucuuuaauaaacgagaaaccccggaagaaagagaggaacguaucaggagagaaacagaggaaaaagaaaaacgccguagggcagaggaugagcagaaagagaaagaaagggaccgcagaagacauagagagaugagcaagcucuuggccacuguaguuauuggucagagacaggauagacaagggggagagcggaagaggccccaacuugauaaggaucaaugcgccuacugcaaagaaaagggacacugggcuaaagacugcccaaagaagccacgagggccccgaggaccgaggccccagaccucccuccugaccuuaggugacuagagaggucagggucaggagccccccccugaacccaggauaacccucaaagucggggggcaacccgucaccuuccugguagauacuggggcccaacacuccgugcugacccaaaauccuggaccccuaagugacaagucugccuggguccaaggggcuacuggaggaaagcgguaucgcuggaccacggaucgcaaagugcaucuagcuaccgguaaggucacccacucuuuccuccauguaccagacugccccuauccucugcuaggaagaaauuugcugacuaaacuaaaagcccaaauccacuuugagggaucaggagcucagguugugggaccaaugggacagccccugcaagugcugacccuaaacauagaagaugaguaucggcuacaugagaccucaaaagagccggauguuucucuaggguccacauggcuuucugauuuuccccaggccugggcggaaaccgggggcaugggacuggcaguucgccaagcuccucugaucauaccucugaaggcaaccucuacccccguguccauaaaacaauaccccaugucacaagaagccagacuggggaucaagccccacauacagagacuguuggaccagggaauacugguacccugccagucccccuggaacacgccccugcuacccguuaagaaaccagggacuaaugauuacaggccuguccaagaucugagagaagucaacaagcggguggaagacauccaccccaccgugcccaacccuuacaaccucuugagcgggcucccaccgucccaccagugguacacugugcuugacuuaaaggaugccuuuuucugccugagacuccaccccaccagucagccucucuucgccuuugaguggagagacccagagaugggaaucucaggacaauuaaccuggaccagacucccacaggguuucaaaaacagucccacccuguuugaugaggcacugcacagagaccuagcaggcuuccggauccagcacccagacuugauccugcuacaguacguggaugacuuacugcuggccgccacuucugagcucgacugccaacaagguacucgggcccuguuacaaacccuaggggaccucggguaucgggccucggccaagaaagcccaaauuugccagaaacaggucaaguaucugggguaucuucuaaaagagggucagagauggcugacugaggccagaaaagagacugugauggggcagccuauuccgaagaccccucgacaacuaagggaguuccuagggacggcaggcuucugucgccucuggaucccuggguuugcagaaauggcagcccccuuguacccucucaccaaaacggggacucuguuuaauuggggcccagaccagcaaaaggccuaucaagaaaucaaacaggcucuucuaacugccccagcccugggguugccagauuugacuaagcccuuugaacucuuugucgacgaaaagcagggcuacgccaaaggcguccuaacgcaaaaacugggaccuuggcgucggccgguggccuaccuguccaaaaagcuagacccaguggcagcuggguggcccccuugccuacggaugguagcagccauugccguucugacaaaggaugcaggcaagcuaacuaugggacagccgcuagucauucuggccccccaugcgguaaaagcacuggucaaacaacccccugaccgcuggcuauccaaugcucgcaugacccacuaucaggcaaugcuccuagauacggaccgaguucaguucggacuggugguagccuuaaacccggccacguugcuccccuugccgggaaaagagaccccccacgacugccucgagaucuuggcugagacacacggcaccagaccggaccucacggaccagccccucccaaaugccgaccacaccugguauacagauggaagcagcuuccugcaggaggggcaacguaaggcuggagcagcggugaccaccgagaccgagguaaucugggccaaggcguugccagccgggacauccgcccagcgagcugaacuaauagcacucacccaggcccuaaagauggcagaagguaagaagcuaaauguuuauacugauagccgcuaugccuuugcuaccgcccauguccauggagaaauauauaggagacguggguugcucaccucagaaggcaaggagaucaagaacaagggcgaaaucuuggccuuacugaaagcucucuuucugcccaaaagacucaguauaauucacugcccaggacaucagaaaggcaauagugcugaagcuaaaggcaaccgaauggcggaccaggcagcccgggaagcagccauggggacugacacaaaggccuccucacuucucauagagaccucaaccccguacacuccagacuucuuccauuauacugaaacagauauaaagaaccuacgagaguugggagccacauaugauagagagaaaaaauauuggguccugcaagguaaaccugugaugccugaccaguucaccuuugaauuauuagacuuccuucaccagcucacccaccuuagcuaucagaagaugagggcacuucuagacagaaaagaaagccccuauuacaugcuaaauaaagauaagauccuccacgagguggcggaaucaugccaagccuguguccaaguaaaugccaguaaagcuaaggucggucccggggugcgaguaagaggacaucgaccaggcacccauugggaaauugacuuuacugaaguaaggcccggacuguaugggcauaaguaucuucugguguuuguggacacguucucuggcuggguggaagccuucccaaccaagcaugagacugccaaaguugugaccaaaaagcuucuagaagaaauauuuccaagguuuagaaugccccaaguauuggggacugauaaugggccugccuucgucucccagguaagucagucgguggccaagcuacuggggauugauuggaaacuacauugugcuuacagaccccagaguucaggucagguagaaagaaugaauaggacaaucaaggagacuuugaccaaauuaacgcuugcaacuggcacuagagacuggguacuccuacuucccuuggcccucuaccgagcccgcaacacuccgggcccccauggacucacuccguaugaaauccuguauggggcgcccccgccccuuguuaauuuccaugauccugaaaugucaaaguuuacuaauagccccucucuccaagcucacuuacaggcccuccaagcaguacaacgagaggucuggaagccucuggccgcugccuaucaggaccaacaagaccagccugugauaccacaccccuuccgugucggcgacaccguguggguacgccggcaccagacuaagaacuuggaaccucgcugaaaaggacccuacaccguccugcugaccacccccaccgcucucaaaguagacggcaucgcugcguggauccacgccgcucacguaaaagcggcgacaaccccuccggccggaacagcaucaggaccgacauggaagguccagcguucucaaaaccccuuaaagauaagauuaacccgugggccccccugauaguccuggggaucuuaauaagggcaggaguaucaguaccacaugacagcccucaucaggucuucaauguuacuuggagaguuaccaacuuaaugacaggacaaacagcuaaugcuaccucccuccuggggacaaugaccgaugccuuucccaaacuguacuuugacuugugcgauuuaauaggggacgacugggaugagacuggacucgggugucgcacucccggggaaaaaaaaagggcaagaacauuugacuucuauguuugccccgggcauacuguaucaacaggguguggaggcccgagagagggcuacuguggcaaauggggcugugagaccacuggacaggcauacuggaagccaucaucaucaugggaccuaauuucccuuaagcgaggaaacaccccucggaaucagggccccuguuaugauuccucagcggucuccaguggcauccagggugccacaccggggggucgaugcaauccccuaguccuagaauucacugacgcggguaaaaaggccagcugggauggccccaaaguauggggacuaagacuguaccgauccacaggaaccgacccggugacccgguucucuuugacccgccagguccucaauauagggccccgcauccccauugggccuaaucccgugaucacugaccaguuaccccccucccgacccgugcagaucaugcuccccaggccuccucagccuuccccuacaggcgcagccucuauacaaccugggacgggagacagacugcugaaccugguagauggagccuaccaagcacucaaccucaccaguccugacaaaacccaagagugcugguugugucugguaucgggaccccccuauuacgaagggguugccguccuagguaccuacuccaaccauaccucugccccagcuaacugcuccguggccucccaacacaagcugacccuguccgaaguaaccggacagggacucugcguaggagcaguucccaaaacccaucaggcccuguguaauaccacccagaauacaagcgacggguccuacuaucuggcugcucccgccgggaccauuugggcuugcaacaccgggcucacucccugccuaucuacuacuguacucaaccucaccaccgauuacuguguccugguugagcucuggccaaaggugaccuaccacuccccugguuauguuuauggccaguuugagagaaaaaccaaauauaaaagagagccggugucauuaacucuggcccugcuguugggaggacuuacuaugggcggcauagccucagcagcuucaugcacugcacugacuggagucagugcccuagaaaagucucugaccucguugucugaggugguccuacagaaccggagaggauuagaucuacuguuccuaaaaaaaggaagauuaugugcugcccuaaaagaagaaugcuguuucuacgcggaccacacuggcguagugagagauagcauggcaaagcuaagagaaagguuaaaccagagacaaaaauuguucgaaucaggacaagggugguuugagggacuguuuaacagguccccaugguucacgaccuugauauccaccauuaugggccccuugauaauacucuuauuaauccuacucuucggacccuguauucucaaccgcuugguccaguuuguaaaagacagaauuucgguggugcaggcccugguucugacccaacaguaucaccaacucaaaucaauagguccagaaaaaguggaaucacgugaauaaaagauuuuauucaguuuccagaaagaggggggaaugaaagaccccaccauaaggcuuagcaagcuagcugcaguaacgccauuuugcaaggcaugaaaaaguaccagagcuggguucucaaaaguuacaaggaaguucaguuauagauuaacaguuaaagaucaaggcugaauagcacugggacaggggccgaacaggauaucgguggucaagcaccugggccccggcucagggccaagaacagaugguucucagauaaagcggaaccagcaacagacacagaagccccgauagacgucaguguuagcagaacuagcuucacugauuuagaaaaauagaggugcacagugcucuggucacuccuugaaccugugugucugccaauguucugaccagauaugugcccauugcugaaccuucauuagacucuuuccuuguaccccuccccuacccauuucuugaaaauagacauuguuuagaucuaaaaagucccaccucaguuuccccaaaugaccgggaaguaccccaaaccuuauucgaacuaaccaaccagcucgcuucucgcuucuguaaccgcgcuuuuugcuccccagcccuagcccuauaaaaaggguaaaaacuccacacucggcgcgccaguccuccgauagacugagucgcccggguacccguguucccaauaaagccucuugcuguuuacauccgaaucguggacucgcugauccuugggagggucuccucagauugauugacugcccaccuggggggucuuucaauacuagcgggugucgggcucuuccuagggaacguuugaugucgggaguugaauuugcuuggacccuuuccuacucggguacucuccuuacugcagcuagaaauguacuccauguguucguucuuuuaguuuuccagcacagguaagggcaaagggaauacugugucuggcaugcugucgucacauggcgauuucacaggcugugagcacugcacagcuguaaacuguaacuguauuuacuugaauagccgaguucagauggagcaugucucuuuuauggaaauggcugagaaaugcaugcucuuugacaguuuguauaacacguauacugauacagaaaacagcaggaacuacugaaagguaaguucuuaacauuuaaagagacauuuuaaacuucauuaagcauuaagggaauuuuguacugagaaaacagaaggcuucucuccuuagacagguucaucucauuugccaugugcuacaggguguagauuguccagccauggauucagguagacacucagaggagacacgcucucugauccuccacugagagagaaugugcuuaguguuugcauuuccucaaaccuuacacauuaaugagaauaaaaucuccaucuuucccuucaggguggcuguaacauuguuuucuuuguacauuuugagcuaggaauccccuuuguauugaagaauagaaaauuacuggccucuugugaaaacaugaauuuuuuaccucggagcccacccccucccaucuagagauuguucccagaacacuccuaaacuuuucaccccaaaacuccucacccuaaaguucgaacccucccaacuaaaaacuguuccaagaacauuuuugagauaaaggccuccuagaacaaccucaaaaugaaccagguacuccuuaguuacguagguuccuugauaggacaugacuccuuaguuacguagauuccuuuggcagaacucccuagugauguaaacuuguacuuucccugcccaguucucccccuuugaguuuuacuauauaagccuguaaaaaauuuuugcugaccgucgagacuccucuacccugugcuaagguguaugaguuucgaccccagagcucugugugcuuccauguugcugcuuuauuucgaccccagagcucuggucugugugcuuucauguugcugccuuauuaaaucuugccuucuacauuuuauguauggucucagugucuucuuggguacgcggcugucccgggacuugagugucugagugagggucuccccucgagggucuuucaguaucugggaguagggaacgacuguuguauuccauugaacccuucaaauucaauagacugcugauucuucuucaaggguuuucuuacacuauggaaaguuauuuucuagccucacuuguuaagugauugcauauacuuuauagaaaggguuugaaauaaagacaagaacagauagaauuagcaaagaugccacuaaccagagucuguuaaugugauuuccugauaacugccaguagcaguuguuaacagcaguauggagauuaaaaauaggcaucaggauguauaucauaaaguaauacugggcaaguuccaaaguuaucuuaaauauuuucuuguuuaucuaucuucuagguucuuuuuuguuuguuuguuuguuuguuuguuuguuuuuugagacaggguuucucuguauagcccuggcuguccuggaacucacucuguagaccaggcuggucucaaacucagaaauccuccugccucugccucccaagugcugguauuaaaggugugcgccaccaccaccuggcuuauuuucuagguucuuaaggacaggagugagauggccaagcaugcagcacccuccugguagcuuuuccuuuagaauuauuaagugauucuuuuuagaagaagauguuagguuauuugguauguuuuuaugcugugaacucacguaggugagaguuuaacaggcaaauucagguauauauacuuaaauuguuacuuaauaaaauugucauuuuauuaagauacacuuuucucccuucuggauucgacaggaguugcaagcaagggaagaugguguguagggucuugacccucugcugcccuaagucugcuuuccuuucuuacuuucaucgugggcagugaggcuagaaacaacucaguuacccuguuuguggcuugcugugcccuggguuuucacuguuucuuuaaucucccugcuuuggucuugcuuuuuuuucugaggaauuuguuugguuacagcuucauuuuuuuuuuccuacaaugauuuguguauuugaauauuuuuguuuuguuuauugagacaggguuucucuguguagcuuggcuguccuggaacucagagaucuguccugccucugccuccugagugcuggacguauacacugccacacccagcuucgaguuugaauucauuuagaauuugggucaguuagacgacauuguauuuucauucugguagaaggagagaacagauuccuccaaguuguccucugaucgcucucucucucucucuuucuucuuucugucucucuuuuucuuuuuuccucugauaugcaugccaugccaugccaugucaugucaugucaugucaugugagaguacauacaccauacacauuaauguuguaggauuaacuuauuuuugcuaaaaagaaagaacaaaaaaaagcugaauuauugaucucuaaauaaacuuucaaccugaaaaauuauggagaaaaacugcccuuuaaagcaaugcagugguauguuuuuaaaauuauaaacagauguguauaaguacugcccuauagcugacacuuguguccuaugcacaagggccauuugguguuauuuuuaauuguucuccaucuuaauuuuggagacauaguccucacugaaccuggagcgcucugauugauugggcugggcaccagcgaguuccagggaucugucugccuuucucugcuuuaccuagcugcaauuguguaggaccacacccugcacagugaccaggauccaaacugugucugcaugccuucucaguggacacugacuguguccgcaugccuucucaguggacacugacuguguccgcaugccuucucaguggacacugacuguguccgcaugccuucucaguggacacugacuguguccgcaugccuucucaguggacacugacuguguccgcaugccuucucaguggacacugauucucauuaccccacacgcaucugcucacacucugcuggugucuaagauuucacauugaacagaaucuaaaugucccuuaacuuuuugagcagaaauaugcuuuuaaaaacuauccaggcaaguaguuauuguuaccacaaggcaccgaucgacauuuggguuugagaagauggaaggaucccucuguucuggggucuuacuuaugcuucugugggugaggucuuuauaacaacauugcuuauauuguggauauucuguuuauugagaugcugucagcucacagaucuggaauuaccauucuguuugcagcuucucauuucccaaccgcuuuccucaguacucuuucacccacucaggcacccugaaucaccagucuggccacguguuuauccuaguuccuccucaccucacaccuuccugccuggcuuucauuugcgauccuuccacugugaucaugcuauguguacuuugcucacuuccuccucuucugucugaaagcagccaccaaaccagugaaagaaaguugcagacucaaacugacuucuucauggcggagccugucaacccuucaacacugacguccaguugugaccguuuuggcuuuauuagucauuuacauuuucacuguaaaguuucucacugguugguuggcuuggcauuaauugaccuuacauaucugcuuugaccaaacuucccuuuaaauauguucagccuugcgggcuggagagauggcucagcgguuaagagcacugacugcucuuccgaaggcccugaguucagaucccagcaaccacaugguggcucacaaccaucuguaaugagaucugacucccuauucuggagugucugaagacagcuacaguguaguuacauauaauaaauauguauguacauauuacaguguaauuacauauaauaaauaaauuuaaaaaaacuguucagccuuggacauugaagccaguagaagaaauaacaaagauacaaagcaaagacuguuacauguacgcuggacuugucauuugucagaauaaauuagauuagaauuucagguuuucuguugguugcuuuaaugucuaauagcaggcaugugcuugcuauguaccuuuucauauuugauuguugaucuguuuaaaacuggcaucucuguugcuuuuaagcacuguuaugccuaguuauagaaauaguuaauuuuauaaaugucucucauguacagugauuugccaccuauaauauguucucaguaauacuguggcuaagggaaauagcagcugcuuaccagaguagaguaaaugcagaggcauuuuaguguuugugaucugggcugauuuggcugugagcauggagcucugugaagauucugacaguguucaacaaguccuacaggugagcucuuuggauggaaaaccuuuucagucuucaggcaaccaagagggggaaaaaggaaucaaaaaugaaauugugaaugaaauggaaagaacuuuccuguuuucaccacagagaccguuauuuaauauuaagaaugucgggcuccuugaguugucacuuguacuuugccaguaauaaauauggcuauugaucaggguccuuuuuuuacuguuguugaauaagguggucaugauuucaugcagacuguuagguauuguuuaacucaaauuaguagugauauguuuagaaauuccuagcauuuuggcaagcauacugacaguuguccuacacagucuuucauucauuucaacaaauacuuauuaaauauuuucuguaugccagaugcugcucaggagacacugccaggaaucaacauaccaaaggcucuugcucuaaucuuucuugucuuucauuauagaauugcugaaggugauaagcuagaugaagaauuagcuguguguauguguauaggaagaccaggugugcuauucagugucugaguugugcuuuaagguacgugcccuagagauggcaccuuacugagaaggccauaccaaagggggaguaaacagguaaaggaggcagcuaugaaaucaccgaggaaaagaauuccagacaguacacaguccuuaagaguaugauugauguaccuacugacauggaugggaauuuauaucuaggccaaaacaaaugucaacugccuugauuuugauaucaggguguuaaaagccucugaaagugaguggagaauuucucuguagacagccacaucauacuaaggccaucuucaugaaaggguagguguaauggcuauuccugguugucaauuugacuauaucuggaaugaacuacaauccagaauugaaaggcucaccagugaccuuaaucuggaggcugggagauagaaguuucugaccuggaucuugguauggagaucuugaggcauaguggcuauggauuccagaaaauuaagacagggagaucucagaguucaaggucaucugggauuaaagguguggugucacacaccuuuaaucugggcuacaccuucugcuggagaccuacauaaggacauuagaagaaggaagucucucuccuuugccugcuugucuggugagacugggcaacugcuagaucuuugugcuuccauucacagcugcugcugaccauuguugggaguuggacugcagacuauaagucaucauuaaauuccuuuacuacccauaaguucugugacucuagagaaccuugacuaauacaguagguuuuugaaaaugcaaaacuaucucuuguguuuugcaaauuguaucuuggguauucuaaguuucugggcuaauauccacuuaucagugagugcauaucauguguguucuuuuaugauuggguuaccucacuaaggaugauauucuccagauccauccauuugccuacgaauuucauaaauucauuguuuuuaauagcugaguaguauuccauuguguaaauguaccacauuuucuguauccauuccucuguugagggacaucuggguucuuuccagcuucuggcuauuauaaauaaggcugcuaaaaacuaucucaauaaugcaaguuauugucauugcuccuggcuaacuuuuagaacuugagugaugcccuauugcucaagacaguacauuuuugagucauagaacauggagaaaucagcugguacugaccuggaaacuuuaucccacuggcuagcuuucauaaaaguguugaagcugcuuuaugugcuauugaaaaaaaagaggaaggccuggcguggcuugaggaaaaccaucuuuaaacgucaguuuugcuacauagcuggugugggucaaagcaacaugccuauggccugacuucagcaucccauggccuucugaacacguuguacuuuuguuuuuauugcuguuugcuuguuaguugccugccccugagccaagauauuaggcaguuaaaauaucuuucuuaguugaaacucaguguuugucuuaaaggucgcuacucugcuuucccaugaugcaaaucugugacuuguuuuucccgguaaagccuucucgaacuuucuuccagaauguuuucuugcgccugcauuuuucccguacguauuuaguuuaaaagguacuccuggcugacagcggcucaucaguccuucacagccauucauuuucagcauccucuucuuaguauugccauuuuacuucagcuuugaauuacuuuuguuuuuaacuugauuugugaacugucuaguaguucuuguuuggcaaauaauuuagaaacagagcuguuuaccaucuagguugagggcauaaucuuguucaagcaauuuaugguucacucauuaacuugcuuggucuguuuuuuagggggugauuuuaauugacuauagaaauaaguaauuuauaaguuguaucucaugcagacuccauaaauucauggccuuuuaaaagguaucauuuccuuguccuuagcucacauguacuauuuucugugugcugcuguuuguuaugauaguugguucuggcuucguuuuacaugaaauccuaaggagagagaaaaauagaauuacuaaaacucuauuugacauaacuguuagaacuagaauaggcucugggauaggugaagccuuugaauagaaaguaggauuauccuuuucaaguuguuuauggggguuuuguuggcuguguuugagguuuuugaggaaguguauuugcuuuuaguuuugaacuaaggucugaguuauaggccagucuuggaauccacugguuguagaccaggaacucagagugucaucuugccucagccucucaagugcuggggcuauagacacgagacaacauuccugcugucuugaauacauggccugcgaugggacaugcaguacuuguacucccuuccugaaaguuagagcucaaaacagugaccagacugaaagcagcccagagcaaaggggaaggaguguucauuaaccagcaggcaaacaugucagcuauuuuguucuucuaaauguuaacacauucuguauuuuuuaaaucucuguuaacaauggguagggugguuugggaaucggugagugcauucaguagcugauugaggaguguucuaggucuaacauggcuaucuuucuuuuuuaggaaacugaaaauggccuuugagcuaugcuaggucuauaaugggaagcaucacaguucgauauuuuuguuaugggugccuuuuuacaucugcuaccuggacaguucugcuuuucauuuauuuuaacuucagugaagugacucagccccuuaggaaugugcccaucaaggggucugggccccacgggccauuucccaaaaaauucuacccacguuucacucgagguccaggucggguauuagauccacaguucaaagcaaacagaaucgaccguuugaugaauaaucacauugaagauccagauaaaggccucucaaaaucuuccucugaacuagguaaguaaucaggucuguacuuuuuaaauugugugacaccuaagacuagaagugugccauuguucccauaaguaacagaguuguaauuaaaucuguacuggagcugcugacagggaagaugguugagcucugaacccagagaucauaggcgacccccccaaccccacaccccaguuuuuugaguugggguuucucugugcagcccuggcaguccuggaacuuacucuguagaccagauuggucucaaacucagagauccugccugcuucugccuccccacugcuggaauuaaagguaugggcuaccacugccugccauaggaacccuuuuuauauaaaagcuuauguguaaauuuuuguggggcauggguauaaaacuggagacuacugugguuaauugggaugaaauaaucuauugcuuuuauggaacauuuucaguauuuuuccuccggucacagauaaauuugucuugugauuguaauaagauguuaauucauuuuuguuaauucauuuacuuggauuuuuuuuuuuuuuuugagacaugguuugucugugcagcccuggcuguccuggaacucacucuguagaccaggcuggccucgaacucagaaauccgccugccucugccucccaagugccgggauuaaaggcgugcgcuaccacgcuccccacuuuuuuuuuuuuuuuuuuuuuugcgauagggucuauguauaccuagcuggccuggaacucacccugugguccaggagaguaaucuaccugccucugucugagugcugggguuaaagguaugugugucaacgcauacaauguucuuagcguaaugguuugagcagguauucaggguucaggcacacuuggugugcauuagauugauaaguaucugauguuggccucagcuuacucauuuaaagccugaaccuacagucaaguugaaaacugugguuguguagugugaugauaauggugaagccaaggcucuggggagaccaucguaucgcaguggguggugugaucaucuuuuuucagaguaacuucacucucuuucagguaugauuuucaaugaacgugaucaggaauugagagaccugggcuaccagaagcacgccuuuaauaugcucauuaguaaccgcuugggauaccacagagacgugccggacaccaggaaugcagaguacgcuccuuauuucuucccuuucuaaaucuuuuucuucuucaguuuuggagacaggguuucucuguguagccuugguuuuucuaguagauuaagauuauuauuuuucuguauauauuaauacuggagauuaauauggcagcaauuaguucuugaccagcuuuucccccaaguaaccacacagagaccuuuuaauauuuccaagcguugggccuuagcugggcagacagacauucagcuagcucaccucagcuaagcggagccuagcuccauccagccauguggcugugccuuccaggcugugguuaugcccaucuucucccgugugccuccuggcaaaaggccuuccuucuuauucuuagagcuccagucucucucuuaggaaguuccgacuucuacuucucccgugugccuccuggcaaaaggccuuccuucuuauucuuagagcuccugucucucucuuaggaaguuccgacuucuacuuccugcccagcuaauuggccauuauuauuggcuuuuuauuaaagucaaucagagaaugcuuuggauagguuaggaaggacagagacaauuucacacaguauaccccaacacuugcucuguagaccagacuagccuggaacucagagaucuaccugccucugucuccugagugcuaggauuaaaggugugcaccaccauugcuagacuggaguuuauucuuuaaguugauaacuguuguuggucaaagccacuuaucaagaaguuacuauguccaugaaagcucuuauaucgucuaagaauucaguuuucuuaaauccuuuuuacacuauuggguaaaaacuaaaaauuuuguugaagacaacguuuucuuacuguguuuccauuguaaaaccucauugagaggcugcacuaaccuagcacugcacaggcagugacuucaccaccucauuaacuucuccacccaaaggaagaaaccacgccuaaagguaaaaucauuaacauaauguaaagcaaagaguaaaccagugcuuucuaaaugcuuaaacgucacuauaauguaagauagaagcugaacaagguagcaagaaauuaccuaagacauuugcuucauaaaauaccagcuuuucuuguuuugauuguuaaagguguaggaggaaguccuacccgacugaccugccaacugcuagcauugucaucuguuucuacaaugaagccuuuucugccuuacugcggacugugcacaguguuguggaccgcacaccggcccaccuucuucaugagaucauccuuguggaugacagcagugacuuugguaagugaugcuaggaauggucaccguucaugggcucuuacucacugugugaugaagcgacagcugggcuacagucuauccauugcuauaggaugauuuuguaaucugucuacaguguuauucaaauaugcccugggggaauuucccuuugguuugcuuuaaaaauguccauuaugaaugaagcuccaauucauaggagcuuaagaagacuuccacuugcccuucacccaguuucccguguugguuguguuuccuacuuagaguacaguguaaaaagcagagcuccauaguggacaagugacaguuuaucuuucaugagugcuguuagcaccagcacagcccugagaaauacacugcaccgcccagcagccccugguacuccccuuagagcuguacucugccuuugugccccugaaauccuucccuggcaucugguaaccucugauuuuugucauuucaaaagugugaugcaaauggauaugcagguuguccccuuuucagauuggcacuuuugacaugguacagugugguaaaccacacuguagaguaagucugcuacaccaguuauuuccagacuagagugagcagcauucagaaagcuauuagauguuaccugaaugccaguuuucugagacucacuauguauuuuaggcaucuuuuuuuuaacuguagauuuuugcaaagaaaaguuuuauacuguuuuaccccuguuuagcucucagcuuccuucaaggugggugggauccauuuuuacagagacggagauacaaaaauaagugaccuagcuggguguagugguacauaccuuuaaucccagcacucuggaggcagaggcaggcacaucucucaguucagggccagccuggucuacuaaguuccaggacagccagggcuacacagagaaacccugucucaaaaacaaauaaaacaaacaaaagaagaaaagaaggaaagaacgaaugaaagaaagagacuucccagaaccuaauuugaauaguagaguuaagauuaugccuagucgccuggcuuccagcuguuucccuuuagcacagcacugcaggcacagugauggguggcccagagaggcauuuuccauguacucagcaucauuggaccgucuacagcacuagcagagcuguacacuuaggggcugaugagcgagcacagcacucaugagaccuggguaaauagagaaacuuuaugggcaaaauuuuagaaaaguucauagacaccaaaacuuaccauuuuuguuuguuuuggguuuugaggcagggucucuuuuuauaguccuggcuguccuagaauuugccacacagaccaggcuggccuugaacuuacagagaucugccugccucugcaacccuaguacaaggguuaaagguguguaccagcacacucagcuuguaaagacaagaacaucuuuuuuauagucuagguuggccucaaguggcuuucagggcacuugaacuuacaacaguccuccugucucagccuugagugcugggauugcaggcaagaaccuucacauuugacuucauuucaaacauuuucuauggaaauauacgucuaaggcugcaguuccucauggcugggcuccagcuuugcuccugguuucucuuccacagaggggacuaggaugcuuuauagugaggccaucuaacacauuucuuugaucauguguagauuuuggcacacauggcagauccauuagaaauagaagaugcuugcuguaugucuugugugguguaauaauggaacuguccauuuuagaugauuuaaaaggagaacuggaugaguacauccaaagauaccugccugcaaaagucaaggucauaagaaauaugaagcgcgagggauugauccgaggacgaaugaucggagcagcccacgcuacagguauauccacgcuguggcucuguggugcugggcaccuacagagguacacagaaagccauacaagacgagcuacuguucuguugcuucgaagagacaccauguacaaggcaacuuagaaaagaaagcauuuaauuuagggcuuaugacuuuagaggguuaggccaugcgugacagcaagcaggcagacauggcacuguagcaguagcugagaacuuaaucugauccucaagaaagaggcaaagacacagcuaacgaggccugccgggggccuuugaaaccucagagcccaccucuaauaacacaccuucucugacaaggcuguacccccaauccuucuuaaacagcuccaccacuggggaccaaacagucaaacaugagccagugggaaccacucucauucacacccccacaccacauuuucauuggcuguugcccaaaggaaugaagaagaguucugucugaaacgauuuuauaacugccuugcugccccaaagcacagaguacagagaucgcugcuugaacccucacuggccuuuuucuguaguggccucucaguuaauuauuggccucucaaacagguuucuuaucuugcuugcuuacauaaguagaaaaguccaagccaacauguaacugaacuuuuaaaaauuaaauauagaaacacuuaaucuccaaacuacuugacuugaauuaugcuaauaacuguuaguguggagugcacaucucuggagucaguaucaggauuccacuugguaaaucagauugauucccacacugguccugggagguguucaagcuuccaucauccaccauaugcuaaucucucccugaaaagcaaagaacaggugcagccuucugcagaagucacacgagugacugccuuucguuccuuuugguuucuuugauuugguuccaggcuggcuucauucuugcucgauagcugagccggucuuuaccuguggcuccugcuucugccggugcugggaucacaggcgugcaccaccacgccuggcugcaucacuuccuuccauacuuaccuagaaagacagggguggaagauugccauugcugacuuccucuuauugauuaugauaaguuacucauggacauaucagaaaucaugagggcaguuugacaaguccuuacuggagugggucccucauaguggugucacuuacuuccugcuguaagcgucucuguuucagaguccccacccccccuccacagcccaguugaguacugggcacugccaguccacuguagcauggccuguuuuacuugcugggcuuaguugggacuucacuuugggaauuuugucuuuuucucuaaaaaccuaccaagaccugaagcagcaggcauuaaggagaacagccuuucugcauccagugccugggucugcaucuccaggguuucagccaaagacugaggaaguuggcccugcugggucauuagagauggugagcaaaagacagccgaggagccuugggaacuaugcuguuggcuccguucagcuauggcauaggauuugccagggucaagccggugugaggucacuacugccuguuugguguggccaaguggaaucuuacugcauucaguuaauuaacuuguccucauggaaaaagcaguccucccaggguuagggaagcuuugaagacaguucuuguuauggaagcccugaccucauuuccuguugagcauggcuggugcucaggaggaugccuucuccugcauuagguagcagcuggauguuauguguccucauuuaaguggacaaacaggcaacuaugugacuaauuugcuguuaucacugaaaacuuugggguauuuuugucaauaaucaauguuuugagaaguccugucaaaucuauuuuuuuuucaagaaaggguuucucuguauagcucuggcuguccuggaacucacuuuguagaccaaggcuggccucaaacucagaaauccgccugccuuugccucccgagugcugggauuaaaggugugcgccaccaagcccggccugucaaauguauuuugaugcugcucucugguaacauuucagguuucucaaggaaauuuggaguuauucaaaccaacaguuuuuaaccuugcucacauuuaucaaaacucaaagagaacaagaugaaguuuuuaucauuuauaucuugcuaauggacuccuuugagcccugugggaaguggugagaagggagcuggagguagcacauggagaaacccagggaaagguaaaguguauggaaggcagcccacugggauuggcacagcagcuggaauuccacccugcaggccucauccucuuuccagaaagcauaguguaguggucaccaguucucagugacacugagccaucggugacaguaauggucucuaaggcaagaaugaacuaaauagauacauugaguaaaaugacuaauaaaaguggacucugcacagcuggccacugucccugcaccagaacacuuugggucugccugucaauagaagagccuccugaguugccugacagcuuguuggggccgugcauguaguuugugcccucucugaggaaaguguacauuucagaaaaaacucuuggccauaggacuuccccugaacccuguuggcagugcagagggugguuucuugguggggguggucaugguggccauccauagccuguauauaacauguccacccacguuggucagcuguacuuuggucaagugugaagcgucacucuuguaucuucucccuucaccucugcaggagaaguccugguguuccuggacagccacugugaagugaaugugaugugguuacagccccugcuggccauuauccuugaggacccacacacaguggugugccccgugauugacaucaucagugcagacacacucgcuuacagcucauccccaguaguucggggagguuucaacugggggcugcacuucaagugggaucuaguucccguaucugagcugggaggcccugacggcgccacggccccaauaagguaagagcaguuggaagaaucccacuagccuuucuuuagaaaagaacaguauauuaaagaaaagugauucuuaguaaggggcaaaggaaugacuaaauuuacccagcaaaaacaauuuuaagucuggcaguggcgaugcacaccuuuaaucccagcacuuaggaggcagagacagucaaaucuaugaguuugaggccagccugguguauacagcauuacaaaagagacccugucucaaaaccacaacacauuuugguuuugguuuuuuguuuguuugauacaggguuucucugaguaauagcucugacuguccuagaucucacucuguagaccagucuggccuccaagucaggucaucugccccugccucucgaguggugcugggauuaaaggugugcaccaccgcaccuggcccagugagguuucuuacgugguguagguuuguaugagcccaggcaagaaucagucacugucaguugccugugagugcuguguagcugguaggggccgugaauagguaacuguugucugggguacugugggcucugugugcuguggucuguaucacucaucuccaggucaucaccagaggcugcagagaucugcaucugagaccacaaguguauuagauuccaaauguuuuuuuuugcauuuuagaauauuugcaucccugugauuggauauucaagaugagacccaaggcguacugcaguaaacuugugcuuucacacacuuucucaacaagaagucacaucugucuuuuuuguuuuuguuuuuguuuuuuaauuuuuuccuauaauauauuuuggucauauucuuucucuucaacuccucccagauaccuccuuacccacccaacaucauauucuuucauaaaaaauaaacacacacaaaaaaacaaagcacacaugaaaauacacacacauacccaaagaaucuguuuuguguuggccaauuauuccagugccuggggccugcuuugggugugguugauauaccaagugucacuccauugaugaaaacuugccuuucccugacaacugucaauuacaaauacugucuugacugucuuauuuuugauuccuuugaaaguccuuuuuaaaaagcguuuuccagauauuuauaaguagguuuuguuguuuuaaagacagauggggcucaugucauguaacugccguaccugguuuauguaauacuggggacugaaacuagagauuucugccugcuguaaacucccuuaccagcuaagccccauccaagcccauguguaaauguuucuaagagcaucuacuuuucucccaagcuuucagucuugccuucugucuugaguguauugaauaguuacuuugaaguccguuugauaccuucauaauuaaaacuucuuuacgucuccacauuauugugggcuguuucucuuuucugugauuuagcucccgcauugcgugauuccucgucugucuguccuuuugcuagacauucuggaguccuugcugagugugcugccucucuucuauaggcucaccaggauuccugaacuccagagcaagggcucagaagccuggaaguugggauuaagccuuuagguagugucugcugcagcuuuucuuauugcaagacagccgcaaucuaagcuuuaauggcauuguccuuugcuggcaagcugcugugggggauggaggaacccucauguauuuuagcaguuaucagcaucccuggccuagagcagauguuagcacuagccuccaccccacccacaugccaggcacaaugacuaaauauguagaguucugaaaaugcucuaacauuacagaugucaccgcuggcacagccauccacuuugagagccacuccugaugucugucuuacucaaaaguuugagauuuuuuugugguagguccuggagucaauuuuuguuccccucuaccaggcccucaaaaggaauuauagucauugccuuugguuccuuucaaagucaauuacaguaagaaagguaccucaauacuuagaacauaaccuuaugccagauaccucauauagccucagcaauccagaaaauuccaguguguaacccagccucuucccuauuagacgaccauguuucuuucuuaucuguuauccucuguuguuaccucuuuuguaaugacagcuaaucuucugugccccagagucucagggacuuuguaaauaguugguaacugguccuauugaaugagcacaggcugugguucuuuucuaggucaccuacaauggcuggaggcuuguuugccaugaacagacaguauuucaaugaucuuggacaguaugacaguggcauggauaucuggggaggagaaaaucuggaaaucucauuucggguaauuuugauuuugugugugaucuguuccuaaauugcuuguaguagaaucugauagcaguucaagggcagagagagcaggugggccccgcaaaccacucugaaucuguaagcauggcuguuuguaauuuagaaacauaccacaguuuuucuccauaaccuuucagguugaacgcuuauauagaaaucaguaguucagcuuucuuuccuagcaaaaguaagugaaucucacaaacguuaaguauguauucacaugacauggcaugacaugacaugacauggcaugcauauggaggucagaggacaguuugcaggaaaucguucucugcuucuaccacguaggucuuggggauugagucuaaguuguaagacuuuucugcacgugccgcccugucucucagcccuggaaccaaguucuuacgcgugugcucuugugcccauguggaagcacaguggauaggagcugcccucuccuucugccauguggguccuagggauugaaccugagucacgaggcuugguggcaagccguuuuacucacugagcccucuugccagccuuagaaucaaguucuuuugaauuuaaucacucuguauaguuuauguuaaaaauauuuuugcuggggagcuggcucaguggucagagcacuuacccugcaaggaagcguaaaggagucuggauccccacagccaagguaaacgccaggcugggcuggcuccucacuguaacuggagccuugggaagcagagcaagccggcuagugcgagccgccagacaggggagcugggugugacugagacccugcagcaaagguaugaggcagaagagagacaaaggaaccaccccuuccccagauauaauuuuuauuuaguuuacguaaacggguguuuuguaugcgcguauaucugcacaccagaagagggcaucagaucccauuaaagguugugagccacccauuugguugcuggaaauugaacuuaagaccuccggaagagcagccagugcgcuuaacugcuaagcuaccucuccaucccaagguucccaguauucuuaggccucaguguucacucucauguauggcaugcgcauuuguaaguucagauguuccuuguccuuaaauccuuaagagcaaccaaagaugauaacauuuuuaauuucagaaggaccuaauuuguaggugccccccacuuuauaucuaguaagauaagcaucuguaagcugcauagccaccauucauaaagggucagucaugaagaugugcgcugcuucggucugacagccauccuguuugcuucuggcuagaucuggauguguggcggcaagcucuucauccucccuugcucaagaguaggacacauuuuccgaaaaaggcgaccguacggaucuccggaaggccaggacaccaugacacacaacucccugagacuggcacaugucuggcuggaugaguacaaggugagugagucuggccauugcuuugcuggugccuuccugccucucuugccugagucuccuuggcugaccuucgcugcuaggcuguuccucucugggcuucuucucaccaggauucccucagguuugguuuucacucuuuuugacauuacaagcaucggaagcaguucuguguguguucuggaccucacugaucgcucagcguugcuuucccguuucuauacuaccuccuacagcuuuguuuucucugcagccucuuuaucaugauuuacaugucaauuuuggagcauucugucacaccagaaagaaacgcuguacgcuuuaggugucaccucuguccacagcccuagacaauggcguaucugucuccuggcucccuccacagucucugauacagcuuucacauguuuguacccuuuccuguggcuuucacugagcacuuguguuuagccuggccuggguugcagcuguucucggcacuucacuacuuccuauugcucagggauacucuguccaccauuuuauggguauuuggguugcuuccauggauguuuguuuguucguuuguucauucucauccucucucucucucccucuucccucucucucccacucucucucugguuuuuugagauagaguugauuggagccuugguuguccugaaacuugcuuuguagaccaggcuagccucaaacucccagcgacucaccugcuucugcuuccugagugcugggauuuaccaugaacagguugcugugauucguugugugcaguugcuauugucauuggucuccaucuccauccuucagccuucacguucauacaugcacaagcauaccuggcuaaguaccugagcucuggcuuuggaaacaaagcugacuaggggaauguaaucugcagcccuagaagguaaauggcagcagaugcccaggccuugacgugcugaggaggaggaagcugggcuccaagcaugccaaggcuguuugucuccucccucuccuaacccagagcucuguggaacucagcuccuuguauauuauuauucucuugucauggaaguugccaaaauggagaguagaaggccuuuguuauguggguuugagcagggggaccuugagagagagagagcucugucaaugauccaugccacauuuccuugggcgcucuagugucagcucaucggauggcuccuuuuuccucccugaugcugauuuucccaggcagcagugugagcagagugcugcgcuguacugcucuccaggagcgcugcauaugacacccggcagcaucuucucaaaucgaccccagucauggaaaugaucaaauuccacucucaaguaaaagauuggaagaaaaaaaagucuucaggacuuggucgccucuagucccaguagagacagaugauguuaaggccaaccuugucuacauagugaguuuuaguucagccagggauauacagugagucccgguuucagaagcaacacacaauaaaagccguuauaagcuguaagugugccacuaggugaaguguaucaguguuuggaaagacugcagagccguagaccagcguuuccaagugacuaguacguguuuucuaagucuugcacguguaagaagaucauccaaagagaacacaaagccaaaugugcauuucacugguaugauucuuuuuuuuuuuuaaacauuuauuuauuuauuauauguaaguauacugcagcuuucuucagacaccccagaagagggagucagaucuccuuacgggugguuaugagccaccaugugguugcugggacuugaacucgggaccuucagaagagcagucaggugcucuuacccgcugagccaucucaccagcccuacugguaugauucuuuuuuuuuuuuugguuuuucgagacaggguuucucuguauagcccuggcuguccuggaacucacucuguagacuuuguagaccaggcuggccucaaacucagaaaucugccugccucugcuuccuaagugcugggacuaaaggcgugcgcccccacgcccggcuugguaugauucuuauuuacugugguaacuaugaguuauaaguuaggcgugcugcugugugguggugaucccagugcugggguggcugaagcaggacuauuaauuagaagccagucuaagcugcauguuugcacuguucaaaaaaaaaaaacuacaaaaaacuguuauuguauuaaauauuuaaugcaagaauaacuacaauuacuuguaauaggaauuuaaaaauauuucuucugucucaacuacauuuucucaugaggcuguauuuuuaaaacagugagauggcucaguggcuaaagugcuugcuguucaaguccugagucuuaccuaaagguggagagagccagccccacagaauuguacugacggccacacauucuccaaggcacgcggcccacaucaccauaauagcacuuucugauuaaaacaacacggcaacagggugaugcaugugagccaccuaauaaaaaccacaagguuuuguauugagaaagaguuucucuuaauuaaaaaccuaaaacuacauugaggucuuuuauuuuuuauuuugguucguggugauguuuuugagagucuagacuggcgugcagcucccucgggagagcaggcugguuuugaagucacagagauaugccuacucagccucucuagugcugagguuaaaggggugcgcagccaugccuggcucaguuuuaauuguuaacaaggucaggauacauagcuaaggauccugaaucaacucauguugagaguaggagauuagacgcuagaguuugccagucacucaucugauacauagucugcugacuuagaguuucccauugucuucugugaaacggaauuuauugaguuuauguuaugguagugacauuaagaaaacccaggacuccucacugaauauauauuucuagcaaauuucauucucuuuuaaaccuaggagcaauauuuuuccuuaagaccugauuugaagaacaaaagcuucgggaauaucagugagcguguugaauugaggaagaaacugggcugucagucauucaagugguauuuggauaauauuuacccugagaugcagauaccuggcccgaaugccaaaccucagcagcccguucucaucaacagaggacccaagcgccccagaguccugcagcguggaagggugagcuggcagucuugagggcucccuggggaggaggggcagggagagauuggggugcugugauaguagaaauggaauguucucuuuggggccuucuuucugcuugaguagaaaagcuuagagaucuuaaacguguuugcgguuuucacuaagggcaagggccuuacuuaccugugcucccugccuuggagggacugagaccuuuuguagguugugcugucuuccaagagcagagacacaaucgggaacacaggcagugugaggcccgaaggacccuucccagggauaagcaggaaugcagcagcuguuccugucgagacucagcucuuggagccgacugcagacagagacugaggcgacaguucaucagugugaccuguaguaagguuucacaccagcacauggcacuccugagguuagcagaaggcacaccagacccuuucagucaaguuuacagcuuagggggcugcccucuaaguuacauugucuaagucauuucuaaaacuggcuuucuggaggcuggggagauggcucaguugauaaagcacuuuguagcccaguguggggaucagaguuucggaucuuuaggacccauguagacacugggcaggugugguggucuacuuguaaucccagugcuuggaaggcagagacaggauccuuagaacaaacccagcugaugagcucugggucugggagacccugugugugccucagugaccaagguggugguagggaaucuugcaugagcaugcacacacaaaggugugcucguccacaccugugcagacagcacacacacugcuguucuuaucucccucuuuaacuuccuaagggcauagcucccagcuuuuguauuuuaggagaacugagccuaguacuuuucuccucauuuauaaagccccagacaacuaucuaggaguuuacuggguguucuaagaaaaggcaaauauuuugugcccauauaguugauaaccuuuccagcauagagcuuuccagaucagcauguacauaggguuuuguucuuuaguccaggcuguccacauauucaugaucuccugccucagcuccaugacugcuugaaugacaggcccaacucaccaugcuuggcuuuauuucuucaucuucaucuuagugcugcgugggugcuuuccugggacuguggacagcacuucccacucugccugcaugggagggagucccaagggcacugucuucuuuugcagcucuaccacuugcagaccaacaaaugccugguggcccagggccgcuccagccagaaaggaggccuagugcugcuuaagaccugugacuacggagacccaacucaggugggucacaccuccccgugcacagucacccgggggaagggagcaccguccugaagguuagagauccuugacaauggcugcaaugccacuagugguuaaguggcaagggaagugcucuucuucaaaccuuaaaguccucaauagaugaaccagagucagauuuuucugaccaguuuauggcuuuuaggggacaccacaacagaauuuugauucauuucauccacuuaauuucacuuaguuugucuuuuuaauauuaaaauguaagcagauaauuuauuuugauuuguuacuguucaggcuggcagcauaaccuaacagugauuuagaccacaggcgcugucaggacuggccugugauggccauuccauuuuagaguuagcauugguaucacauaggaauagaaggaaacacuuggccauuugauaaguagaauguauaccuggauauuucuagaauagacugcuuaagaaaaaugguuagagcacacacacauggggcagucaguuuuugacucauguauggaacugaggauagcaggugucuuuccccacugagccagaccaggcacgaguuaacugguuaaaugugcuuuguuguuacacugauacugcugcuccuugcauaauaaacagugcaguuccuuggcuguacuggcuucagguggccagugcagggccugaagcaagacuggguguucuagcaccugcugcagagugucucacugaaaaauacuuacccuguuugaggcuggagccugaaaccaagagcauuugcauuuacauccaagggaaacccugcuucagggugacccagguaaaauccaucaucuugcaacagacauugcuaccugaaaugggguguggcacucugcagaaggucugggcuagaacagcuuaugcacaccacuacccagcagaugggcagugguaaaacaucagcuugucauggucuugcccacaccuccugagcucucugaugcuuuacagggcugugaccagacucuaaaacuggaaacaauuuacaaugaugugaucacuuaaauucaguuaaaucagugggccacugccuggguuccuuuggaauaacacuguguuaagguggccgagaagagaaagaggaguggcuugcuuuggccucaguuuuggagggcucugaucauggcugauguucacgugugugaugucaugaggccacagcaaagggggcaguuguggaagcaaaugacagaggaagcucuucaaggccuguucaagagugaaagggagagaagggcagcacuucaaggacucccuagugacccaggggcagaaggccuccuucaccucccaauugacugagaugguugcgguggugcuggggccgaccagugugucugcuuguggagacuacacggaacacacugaagccuuauccaggccgcugcaguaccuaaagcagcacuuguucuuuaaaguaauuuuuuugcuuuucuuacuaggucuggauuuauaaugaagaccaugaauugauuuuaaacaaccuccuuugccuugacaugucagaaacucgcucaucggauccaccccgacucaugaagugccaugggucaggaggaucccagcaguggaccuuuggggugagaagcuugcuuauaaacaagguuccuuguuuauaaggaggacaggaaccugggcuuuaucuaguccugauguuccugcaucuucccugcaugcuacaagaauauuuguuuuuacauaaaagcaaguccuuuuucuuuccccuucagaagaacaaccggcuguaccaaguguccguugggcagugccugagaguuauggaccugauggaucagaagggcuacguuggcauggcgaucugcgauggcuccuccucucaacaguggcgucuagaagguuaaaggugggcccuggcuggacacaacauaauucaccugguuuugucaugccugccauaaaucaaggugcuuuaagguugcugacugcagcagacaagaaccuugguggagggcgaccaucucaggagcgccacugggauuuggguuuacuuccgagcugcuguuaagggauucuuguuuauccagggaaaacagaaaauaauucuaaagaguugggucuacagaguauaaacccaggaaguaggcauuuguauucauauuuauguuuuucgcauucucccuuggagauggaauuguuucuguccaaucaggaacuugucacaauuuccuuucauagaggacuucauaagagauuuuuuucuauuucuaucaugccuaauguuccaaauagauuuuaaaaacugguugagugcauauuacuuuuagcuucagaagauaucauguauauuuaagaggcauuuaacuauuauaaauuauuuugaugacuuaauauugucugucuacauuaaauaaaggaucuuuuugaucauuuaacuaggauguuugacucuucuaucucugucuugcuuuggggccagccuauugucuggaugacuugggaauauagcugauggccuguuaagcuagacagcaguugcaaacuucaggaaguggcaguuccuuagcuugaccugagugaauuuggauacaccaguuugccugugaaacucucuuuucaaacuccuaaguggaaagaucuuagagaaaaaucucccuguuguagacuucaaaggucagcugguccauuuaggaaacaaaaggcaagaaguggauuuaaacccagcagugaccacauugaaugccguguuacugaacacaggaguggguuccuucagaagaguggauagaaaggcaagagcaacugcagcuccgacagaaaggaauggaugggcaggcguuacugugaauggacauaauccacauaucugcgugauggagcuguguuaacauggagguuucagcagggagugcuauuagagguagaaaggggucuuucauccacaagaaauaaucccaaacauuucuauagcuaacagcuuccaaauacaugcugccagaacuagaaauuccaacaaacauaucugccuacaauuacggugagacauuucagcaugccuuuuaaaaccugacagacaccuugacaauacauacuauugcuaaguugaccugguugggaaacacuccacucaacaccagaacccauguucucauguaugucagguccacguaugucuaugucagguaaacuacaguccaaaguaucaaauaaaaaucaacuauaagaccucuagauaguuugaaacugauccacuuccacuuguggguagaagacaaaugaaaaaggugguugaaaacagccgaguguaugauaugcuaacaaauuccuuggacaauugagauuaaaucuuaaaauccuaucuuagauagaaaaaaguacauuugaagcucaagguagaaguaaauaugaaaugucagaacagaaaugaaauaggaaacaaaauuauucauauagcaagcuggcuugccagugcaauugauaguccucuaguuaagaugagacuuggugggaucaggaacgaguggcaagcagcccgagggcagagcagagugcagcccuggagaggugggcaagccuuacacacacaaccacacuauuccugcugcucagccaaggggcucagaaacacugagggcagcacuuaagauguccacagcagcuuucauuuauuauccaaaguggaaaaaaaguggcaagaacaguuuggcaggauaugguaacucagcaaaaacgcugccuggagaaugaagagagguaggaagagcuugucaccagaccuc

SEQ ID NO: 2377 - RNA, 226995 nt, Mus musculus
cgccgagugcgcgcgcccgcgccgaugugugugagugcguguccugcuagcuccauguugccgccucucccgguaccugcugcugcugcugcugcucccggggcugcgggaaaugcgagaggcugagccggggaggagcaacucgagcagcagcagcggcggcggcugcggccgcugcggcgggaggagccccccaggaggaggacggggauccaugugucuuuccuggugacuaggaugucgucggaggaggaccggagcgcggagcagcagcagccgccgccagcaccccccgaggagcccggagccccggccccgagccccgcagccgcagacaaaagaccucggggccggccucgcaaagauggcgcuuccccuuuccagagagccagaaagaaguaaguugagcgcgagggagccaggcgggcggccagcggcggcgcggcccggagcugucaggcccccggcccggugggggcggggcggcccaggcgcggcccgguucggcggcgcccgcgcaggucccgccggccgcgccgcgcacuuuacuuuggaguucggccucgcuucugggagaaccgcccggcggcuuccccagggccuagcccggcguccgcacacgccccgccgagcacgcccagcuugcugccggcccggccucucggagccacaaagcugugggcgccagggacggagcugucaaacgccgcggccgggugguccgggugcggcggccggcgcucuuugucagcucgcggcuccuuuaacuuuucuugcucccagaccggugcuuuugcuucuuaaugauacauuaggaagccauucgagccuguccuccccaucccccaccgccccgaaccgcaccgcccggcuccgcagccggcgcucgggaucgcacgggcccagguguaagcgggcgagucggaguuucgggaacgcggccggguuccgcggcgcugacggcccagagcacuuuguuuaggggagacagcuuuaaacgucgcuggacgaguaacuucaacuccagcugggcaggcaauggcuuucgauuguuuuugagcguccgugaggacugugccggguggaugaacugggcaagaaguguugucuuaaaaagugguuauucggcaacuuggcuugaaaauuaaggaaaccguuuuagugccaaugaguuaguugaucagcaauaguggcucuucggggugcugcggaagauuggugaccgucuuucaaaguugcagaauggcguguguugcuuacucauuucauuguaugauauucucauugaacuguuggcgguggaagggugcgcugggacuugcaggaagaagucagcacauuuauggauaggcuguuuguuugguuuacgugcauucauuuguugugucuggugguugcagcaaaaauaguguuaacugagccauagcaagcaagcacccuggccucucggaacccacuaagcucuugacacaguguauuuggggugggugguggagaggguuugcuaucuuuuuacuacuaaauguuccagggccuuuagucgccuguauauuuuaucaccugccagcucuuaccuagcugugaaaaaucuugagagaaacacuuuauagaggauguauacauuauuacauuagcuucuuugugauacaaaguugcgaguuuauuuugucuguuacuuuguaaggugauggucugcauaagauaacauuaugccugccuugacuggaauuuggagacguuuuguggaguuuugaguaacuuuggacuuggucaguuugacauaaauacuguuuuaaaaagcaacaugggauuaagccauauuagaaguuuacuucgauucauucccauuucacuguuugaaaaacaucugcaucucauaagaggguucaugauggcacaggccuguaagaucuuuuuaagccuagcacucaggaggcagaggcagguggaguucaaggccaauuggucuacagagggaguuccaggacagacaaggcaacacagacaaggcaacacagacaauucccugucuugaaaaaacaaaacacauuaaaaaaucuuacuauacuuuaauuugagguaaguaaauguuuuauauuugcauuuaauucuucuuuuuugagagaguagacauacaagcgcucauuuuugcauuguuagggucacgcacuugcaaaugcuugagcacacaccgugugcuucccauugagaugaguuaagguguauuagugcaacuccuuugaaccgggaggaagguucacuuaaguuauugccacuuaauuauuuuaauucuuagcacuauuaaugaagaaaaaauggccuuuugagaaguuaaacauuuuccuaaagaaugacaguguagucuuaagaacacucuggccaauucuguuuuagauuuuuuuuuuuuuuuuuuuuagauuugaaaagcaacacagaauucuuuacaaggaaguaaaauguagugguaauuagcuucuaacuuuuaaauucuuuaaaauuagaaaacguuugaagggaguggaaucucuaauuguauuggaaacauguaaguggaaacuaaugugugaaauggaaagcaaagagguuuuugauuguguaucucuacaccauauuaguauccaugaggaaaagagccuguaguuagugaggacccagaaggugaaacugauguguaacaaaugugauuuagguuuguaguaaaugaauaguguagaauugcaaagagugcacugaagaaacaaaagcuaauaucguuuguuuguuuguuuguuugagacaggcucucuuuauguagcucuggcuagccagguacuuguagaccagguuggcuuugaaaucaaagaacucauggagaucugccugccucugcuucccgagugcuggaauuaaaggugcauaugcuuccaugcccgauuguuauguuugaauuuuuauuaaguaaacaaaucaagucuuuauaguuuauuuuauuuuauuuuuugguuuuucgagacaggguuuuuccuuauagcccuggcuguccuggaacucacucuguagaccaggcuggccuugaacucagaaauccgccugccucugccuccgccucccaagugcugggauuaaaggagugcgccacaaucacccggcuaagucuuuauaguuuuggcuagcugaauuuuuguuguuguuguuauuguuuaucacauuuaaaaggcauaggguauguaguuaauggguuuuacauuaaaucuaauuauauuaaaauuauuaacuaucgaaaagcaaauauuuugaacaaaagauacuacuuuuuugaggcaggauuuaaaaagcauauauauauucauauauauacacauacacacacacacacacacacacacacacacacacacacaggaauuuccuguuguacaaaugucaaauguaacucacagugaaauuuacauuuguuugaaauuucuucuuaacugcaaagacucaaacuauuuaguuauuuugaguguucauaauccuuacuugaggcacuguuuuugccccaugguaaaacaguauagggugcaggucuaauucuguuaacguuaaaagaaauuuuuccugaagagagagagagagagagagaaaguguguguguguguguguguguguguuaguuuugcuuuuaaaaaacaaaaaacauaaacauaaacaaaaacauaaacaaaaaggaaaacgaggguuugucugugguccugaacccacucuguagagcaggccggcuuuggauguuacagacuugacagacuucguacugggauuaagaagguguuaacuaccacaccugacuucuguaugaagcccaggaaguguucugccauauuuuuugucaucagaauugaugucagggugaacaaaaauguuggagcagcagguggcagagacaggauuucugagauacugucuucaacccuuauugagucaaauuugugcccugaaucacuuuucagagggcaauuacuguuauuggagagacagcugagugucacuguuacagaaaaauaggaacauggauggugucuugcaagggugucuugcagugcagcuguuaacuguuguuacuuuguauuugcaggacucuuucucuaacauuucucauaccugccaauuugaaauaagugauagacaauugaucuucacuacugaauaaaacgucccccagaucacuuucauaccuuuugagauuaugcaaguauguaauguauaugauagcgauuuguagucuuuccuuuccuaucuugaccuacccuauccuacucuuuacuuuccagccaacccucccuuucucccucauuuuuuuuuuuuuuugagauaaagccuauuauauauccuaggcugaccuugaacucaauauguagcuugagcuggccuagcauuugaauauucuuuccucagccucccagagcacgcauuguaggccugcacagccaugcuaagcaaacaauaauucuuaauuuuuaauacuuuuaagcuagcagguaagugggguuuguauauaauauauacuauauauccuaucauauccauccauccauccauccauccauuccaccuaucuaucuuugguucauaggaugcucuuaaguguuuuaauuuaauugaaaacuggaucuaagauuaucagccucccuuuccuguuggggagauuguucucuaacuuggccaacuguaacuguaacaguaacuguaguuuacuguugacuuauuccuaggaauauguaauauuuaagaauaugauguuuuuagucauaauuucauauugcuuguuaauauauuagguuaacagacagauguccaugcaaaucuaaaagugucuauauaguuuaauuucucauuuuuaaaugacuuauuacaauuuccacuuauucacuuaauucugugaugcaauguguagucaacuugcagaguuacaaauugauuacaagacuauauauaagaugcauuaccugcuuucuguuuuguaaaauuauagguuauucucugggcuacagguuucuuugauuagaugguggcuguccagccuuuauauccuuuaagucgaugaaagcuuauaacuaaggagcuuucuuggaacuucauugaccuuccaaaauaaauacggucagucuuucggcaugaagaacacuagauugcacuggagauauggcucugugguuaagaguacuuacugcucuuccagauacaggaauuugguucccacauccauguugggcaguuuguaaggcgaacauacauauauuuagccaaauacucauacauauaauaucuuuaauuuauuguggugguacacaccuuugauccuagcacuugggagacagaggcagauggaacaguucuggguucuagauaggcauggucuacauaacaaaguuccgggccaaccaguuacacagugaaaccuugucuuaaaacaaagcaagcaagcaagcaagcaagcaagcaagcaagcaagcaagcggcauccuuuaaaaacccacagagcacuagaagcucucucuguaugcuuuccugguggaggggguggguguagugcacuggagagggugucauguuuuggcuuuucaucugugacucucuuaggcaacaaguugaugccacagaauaaacuuucuaauggaugugguuuuuuuuuuuuacauuugcauuuauuuauaugugugugcacagauguguauagauguggacuuaugcauuccuugguuuauuugugaaggugaaaggacaagcuugggaguaggcucaccuaccaaguagguuccagugagaugaaaagugccuuuagccaauauuucuuuguguuguuuuuagugaacuaauuaaucccuuccuucucuuauaauauguucuuuaucauguuuauacccaguaacuaguuuuagaauuucuugguaagauaaguuuuaaaaaguuaucaaguaaaauaagcaugauuuuuuuuugaacagugggcucauauaucaaugugugcugguaguggguaugaaauauuuagcaggaaaaccaaucaugaauuuggaaucugaaguguguguguguguguguguguguguguguguauguguguauguauguauguguguguguguuuuccugagacagaauuucucuguguagcacuggcuguccugaaaccuuguucuguagaccaggcugcccuugaauuuucaagagauuugccugccucugccuuccaaguucugggaucaaaggugugugccauagcuuccugaagaaucugaaguguuuuuuuuuuuuuuuuuaagauuuauuuaauuuuacuuuaaauuaauuaaucucuugaggcaggguuuugcuauuuaucugugguuggccugaaacucauuguguagaccagucugggcucaaacuacugagaucugucugccucugccuucugcaagagaagcagguucucucaguaugagcuaucucuacauccugaaauuggacuucuaaaucucuugcagaaugagaaagacuuaagagcacagguuagagaagcaggcaugacgcagcucuucuguauuaauauguuaggaaaggcuuuauguaaaggauguuucacugcuucugcuauugcugcuaugggcagaaggagcuguauaaaacacaguuugagaugacauaggcuuucuguuuacuuuuaaauuaaaaacaccuuuuuagauuugugugcauguuuacaccacaugcaugccugccugagccugaggaggucagaagaaggcaucagcucccuuguuaauagauuguugugagucaccaugugagugcuggcaaccaaacucugguccuuugcagaacaaguguucuuagcugcugagccaacacacacacacacacacacacacacacacacacacacacacacagaguucucagcacaacuaggaggaaucgguucucgguucucuccuucuaccaugugggauuugggaucaaaucaaaaucagauggccaaccuuuacugguugagccaucuugcagacccuugcucacuuuuuuuuuuuuuaaagacuaucauuuuaucaguaauuggaauuugaccuguauaccaggcuggccuucaaguugucaugugccucugccucccaacuucuagaauuacaggcauguucaacacaucugacucuguugacauuuuagcuuuuuuuagggggacacauaucacucacuuacagaacaugcuaaaauaucaugaacaguuaacucuguaagagaaaagucaccagcuacauggaguccuagaaggguuacaagaaguaguauuugcauuaaagccugaaggguuggugagguuuagccaaguagagugaugagaaagugagacuguguuugggagagcaagggaaugaauauauuuauuucagaggaaaguuaagaguuuuucuggagaauggaggcagaggcuuaauaauagggagugagauaaaguuguaguauaguuaggguuaucaaggcauuucagaugugcuacagagucauaguuagauccugaaugaugguugccuuggaaaaaaaaaauggugaguaaaaacguuugguuguucuuguuuuagucauauuguuuugagaugaugaucuagaguccaggccuguucccaaacuccugguccucuccugcauccuuaguguuguuuuacagcuuuggcuggucuggaacucagggagauccaccuguaauuuaauaagggcuauuuuagaaaaaccacuaagauaaaaaguaugaagagauaugcuaccugcaggcaguaauauaugugcugcuguuacaaugucacagcaaaggcaaagggcagcuuacuggagauguggcagagaaggaagaaguccucaccacuaccgaggaguguaaaaguuucuggcauagauggauagcuaggggauagaagaaaugcucaacacguaucuggggauguaggaaugguauucagggauagcucagcguacguaacuaaggaugugaugauguacccgaaccuacuuacaagcaguggucugcguugcaguuuccccucuccugaugggaaugcacccaaggccucauauuuuagaaaguuccacuugaacuauaccucugaccccuacuguacaguuuuuaaucaagacaaagagaaaaaucugugugaaccagugugggaggcugccuguugguauguuggccuuuuuaggagcugugaaguuauaaguuuaaugcugacuuuauccuauaaaaaguacacaagcucaaacuuguguugauuuuguguauagaaaaauguuuggaaggguuuauacacuuuguaauauacuuccugaauuaaaaaaaguuaguaauuuguuuuguuuugcuuuugagacagagucucacuauauagcccuggauggccuugaauuuauugccuuuguuucuccagugcuggaauuaaaguuaucagccaccaugccuggcaaagguuaauacuuuaaaaauuuuugaggaaaaaccaguaauuaauauuuuuuaaauuaguuuauuuuucgugugacuuugugugauguguuuauauagagaguguugaggcaggguuucaccacccuucagggacuuacugucgcuggcugacuuagaaacuugcuacauagacaggauaaccuauaacucauacaaguccauccaccugcuucugccuuccaagugcuggcauuaaagccaugugccaucagguuaggaucaacgcaggguuuuuacugaauguuuuucauuauaaagaacaguaguaacucccaaggaaagcucuguauuuaguaauguuaucacaaaaaaugauuuuauuuuaucauuuauuuauuuauuuauaaauaaacauuauaauauuuuauuauuuauuuauuuauauauaaauauuucagucugagcuauagcugaagauguggaauaaguucaaggcuagccugagcuauaagaggcccugcucuuguuuaaacaacaguggaauugggaauucaaacuccccuccccccccuugguucuuugguuuuucaagacaggguuucuccuuauagaccuggcuguccuggaacucacucuguagaccaggcuggccuugaauucagaaaucugccugccucugccucccgagugcugggauuaaaggcaugugccacuacgccugguucauacugagccaucuugcuggcuucauuucuuauauauuuuguaguuggcaauguuugcuuccuaaguuuaacuguaaccuauuacauuagaagcaaaguagucugacugucguuguaguccauauguuuuuguucuuaauccuaucuuuuaguggagccuaguaaaaauaggacaaaacaaaaaaugucuuucucuuuucucucucucucucucucucucuuuugagacaggguuuaaaaauccuguguaacucucuaccuuuccuagaacucaaucuguagaccagcauggccuccaacuccugccucugccuucugagugcugggauuaaagaccuuuauuucuuguuacuuggauuuuuuuuucccaaugccagaguauuauugcauggaagacaagcauuguggcauugagcuacaucucaacauagcuuugaaacuguaaugcauuucaucuuugauauaaccaucaaauuauguuuaaaagugaccacaugaaaucuuaaaucuuucauaauuagugcuacuaaaguugaaguauuugguuaugguaucaguguuuuucuccaauuagacuuauaucagaugauauaccuauuauugcauauugaaauugacaccaucaucaccaccaccaccaccuauauagcccuggcugcccugaaacucaauauauagacuaggcuagccucaaauuugccugcuucuuccuuagugcugauauuaaaacuuuguaacaccagcacucuaggcuaggugugacuugcaagaauauuuaaucugagcuggaauguguuggcauaugccuuuaaccccaguacucuggaggcagagguggacagauccuucuuaaaaagccuccuuggcuaucuugcuguuuuugagggaacugagacuggggauguccuacauagcaccaaaaacaaaaacagaaguaaccugcuagagguaucaccaugcccaaacucaaauuguacuauagaacuauaguacuaaaaaugccaugguagcugggugcugguagcacuugccuuuaaucccagggcuagggaagcagaggcaggcagauuucugugaguuugaggccagcuuaaaguauguggggguuauauacacaccaagaugguaucuguauaguacuaaagggagagauggucucugcuguucuuaguaaccccauugggccauguagucaauuuguuuguuguacccuaugguugugucuugucuaguccuguuuggcaguaguaaugacacuugauuagguuuggguucagcuuuuucuuuuucacuuugggaguccuaaguaauugcaguucuaggaguuggguuagacuuugcuggagaucuguggagagugagagguugccagacugacuauuccagaggcucagcaggguucaaguccuaguugacuuucuggucuaauauaguacaaaagcaaucacuaauaagaguagagacaccaccuagcugaacccaaccaaaauugugaaauuaugaauaaauaugguuuguuagcagcaacagguaauaguaauaaugguacacuaggcugguaagaugacuuaguggguaaaaaagugcuuacuaccaagucugauucaggggauccgcaugguagagggagaaaaagagaaaaagaacucuacacauguacuuuggcgcgcgcacgcgcgcgcgcacgcacacacacacacacacacacacacacacaaguauauaagcagauacaagcagauguaauaaaaauaaugaaaggagaugguuuuauggauuaagggacuaaaauaugucugauacaaaugauaaugaccucuguuuuuaaaaggucuuucccugagauaguuaaaugaggcuucuugcuacuuugacccuuacuucuaagguauuuugauguagagauggauuauuacugaggaguuuaguauuuaaaaaaugcuguuaucaggacugugauuuuagguugguuaauagagugcuugccuaagaugcaugaagccccguguugugcagugacuguaaucucaacuggggagguggaggcaagagaaucagaaguucaaggucauucuguacuacagcuccaauaugaggaaggccagccuuaaauacaugagagucugucucaagcccuucccuuccuucccuucaaauaguuacacacacaacuauagacuggucuguaauuagauaguuccuaauagcuaaaagaauuuugaauacccaaaaaaaguuaggguuuuacauuuuugacuugugcaccugugauagagugaaccauuuguacuuuguugggaggucuagguucuauucugguucuguugccaccuacagggugugugaauaagggcuagucaguccuucacccucuaauaccugccuuuguuuuaacugggcauuauguagauaagcauggccuugaucucacagagacccaccugucccugccaccuuaguacuggguuuagagauguaugccaucgcuugcgucugucucucuaguccacccuccccccauuuaaaauagaaacuuuagaacaugagagucuugaacuaguauguauuucuuuuucacaucaaauuuugcaggauaggagcuaaguuugugaauaguaaguaccuuuucacugcagucacucuacuggagacccucuuccuuuguguuucuaggguauggcacuuuaagauuccaugaugcccacuagagcaucaugaagaagaguagaggagaguacagaccauuaacccuuuaaaaugccauuuaaaacagaacuguuuguguggauaacuuagcacucaggagacaguggcaggaggaucuccuguucuuaaaggccaagccuggucuacagugaaaaacuguuucaaaaagcgagagugagagagcgugugcaugugugugugugugugugucucaguuaagagcacuaauuauugcagaggauccaaauuagauuucugcccauuacaaggugacuuauaaccaccauaacuccagcugcauagcgucugaugcccucgucugaccuuuaggaguacuaggcaugcauguaguauacauacacacaugcagguaaaauacugacacauaauaaauuagaaaaaauauuuuaaaggcacccuauguuuaagcuugaaccuguaaguggaauauagucauaguggucauauggccaauguggcuguaagggaagcuaggacuauaauaaaaaaaauuauuuuauauauguguugcccuggcuggccuggaacucacucuguagaccaugcuggccuugaauucagagauccuucuugccucugccucccaagugcaggauuaaaggugugcaccaccacugcccagcaauuuuauuuauugugcauguguuuggauauacaugugauacagcaugugugugguaugacagagaggacaacuugugggcauugguucauucccuaccaugugggucccagguaucagacucaggucagacacuugguagcaagugccuuuaccuacugagacaucuuguaaaccuggguuuugacuauuacagagguuuuauuguugagauucagcccccccccccuuuccccaccauguggaaggaaagaguuaaauauuauaauugcuguguauuauagugaaauuauaggugacuuauuuuuuuuccuaguuaggugccacuggucuguaaugccagcaccuggaggcaaaggugggaggaggauugcugugagauugaggacauccugucuacaugaccccaagccaggcagggaaucauagcgagacccugccuagaauaaauaaaguaaaucugguuuuuuuucccccuaaguauguuccugaagaaauauguuacuauuagccaaguuuacuuuuuuuuuuuuuuuuuuuuuuuuuuuuuugucaaucacccugggaagauauugggaaaagucaacuaaggagcacuguaucagagaggucagcauaagacaaaauaccuguccuuccucacacuguggaaauucguugucugcuaauacaaaaugacucgaaguagcagacagcacaaagaacugaggacucuuggagaaagcagccauugcucuuaacugcugagcccaucaugauucuagcccuguuaaugauuuuuuuguuuuguuuuauuuuuuuauuuuuauuuuuugagagaggguuucuccguguagcccuggcuguccuggaacucaacguuguagaccaggcugaccuugauacagagcuccaccugccucugcuuuccaaauacuuauuucuggaaguucuccuauccccuuuccuauuuuuuuuaagaaaaggucucaugccuguggagcuggcccugguggcauuggcacgggagaguugucuugucccuugccagcugcagguaaggaagcaggcccugcccauccucuccugagcaaagugggagaguuggccuagugggcuaucagcucagcuaccacccaccccagcaucuacuccaugaacugcggaggugugcgccaccacgcccggccuaagauuuucauuuuuuaucuuuuuguucuauguuguugcgaggagguuacaaggguggaggucagauuuggaggaauggggagaugaaugagauuucgguacaugaugugaaauucacaagaaucaauaaaaagguaaaaaaaaaaaaaggcaagguuucucacuguaguccagccagccuugaaugugaucgugaugaaauucuccugccucagucucaaguaugcugguaugacccaccauaccuggcucucugaaaucuuaaaugacaacauauugcugaagagaacuaaccgggugaugggucugugggggaaugagaagcugguauguggcugguguuugauagguacuuguaguguuuucuggaagucacaucuuuccacacuuagucacuauggcagaauugucagaccuaguuuuacaaguaaaggagcugcuuuaggacagucauaguugcaaagacauaucuagccauggccccggguuuuaaauaaacacaguccuuauauuggaaggagaaggaagggaucaaauuggggcuuuacuuuuuuuuuuuuuuuuaaacuauggacaauagagagucauugaggauauuaaacugcagaaacauaucuguuagaaaaaucaucuugguggggcaguaaaaccauaacuagugauucugcugcuugauuauuaauacuaagugauggaucuuugcuuagcacguaugaggggcuuaguuugauuuuagcacaggaaaaaaaagccuauugaaguaacuucuguuuuugcuuccuuuccuuuccuuuccuuuccuuuccuuuccuuuccuuuccuuuccuuuccuuuccuuuccuuuccuuuccuuuccuuuccuuuagcaguguccuaaguaaacucuauuuucaucucauuccccguucaugcucccuucuuuuuuuaaagguuuauuuauuauuauauauaaguacauuguagcugucuucagacacaccagaaaagggcgucagaucucauuacagaugguugugagccaccaugugguugcuguuauuugaacucaggaccuuuggaagagcacucagugcucuuaaccgcugagccaucuuuccagccccgcucaccuucuucuuaacaaauacucuuccuacuuucauaucuuguggucacaaaauguagucacuugcuugcacaggugugggugagaugucuauuuuugaguaugggcaauuuaucagcuacuauacuauuaggagaaaugaugccccuucuccuggaucucugaguuugaggccagccuacucagguuuacggugagaguuccagggcagccagaacuacaggaaaacccucuguugaaaagcaaaaagcaaaaagauaguuuucauuugauuuuguuguuuugggucacgguguaacccuggcuggccuugaaggcauuggguucugccuaccugucuacccgggauuaaagagguacacuacuggauugguccucauugugugugauuuuucuuuuuuucuuuucucuuuuucccuuuuccuuuuccccuucuuacucuucucuguccucuucuucucauucuccuucuuccucuucuugcuccucuuccuucuuauacuauuuuuaaaaaugauuuuuuuuucauauguaugaguauuuuaccugccuguaugucuguguaccagguaccugcuuguuacuuguggaggccagaacuuucuuucuuucuuucuuucuuucuuuuuuuuuuuuuuuuuuugguuuuucaagacaggguuucucuguguagcccuggcuguccuggaaaucacuuuguagaccaggcuggccucaaacucagaaauccgccugccucugccucccaagugcugggauuaaaggcgugcgccaccaccgccuggcccuuauuauuuucuugagacaaggucucuuuacauagcucuggcugucuuggaguuuacugugguauugacuaaccuggucucaggcuggccuccaaaucacagagauccaccugccucuacuucuggaacacugggguuaaaagugugugccacuacacccagcuucuuaauucuucuuaaaaugugucuuuauaaacuauugugaguauauagaaagugcaguuguuuguuuauggaucuuguuucuuuuauuuuauuaaaacccacuuaaugcuguuaguuuuguagauuugccaggauuuuuguagcacaggaucgugccaucagcauacuuauuugauauuuaauuuuaaaagccccaagccaaucuaggaguuuuuuauuuauuuuauucuauuuauuuauuuagagacaggguuucucuguauagccauggcuguccugaaaccucugguuggcuucaaacucaaaccugccuuuguuuaacagccccccccccccccccauuaaaggcaugugccaccaccaucugguucacaaguucaaaacuagccuguacugcacaacuuagugagaucuuaccucaaaauagggaaguuuuugucuuuguuuuuguuucaaggggcugagcagauaggucagugauuugacaagauggugaauuuaguaugaggcagggccggggcaggagaaauuccaagcugaauucauguuuuuuuguuuguuuguuuuuuguuuuuaauggcuugggcucagugguagaauguuugccaagcauugcaaggccccauguuuaauccguaucacuuaaaaaaaaaaaggcagcuucagcaacaaaauuauucuaguuuuguguauuaauaguugucagacuagaaagaugaacuuuaaaaaaaaaguaauuuaaguugggugguaguggcucaugccuuuaauccuagcauucaggaggcagaggcaggaggaucccuuuaaguuugaggccagucuguucuacagagcugguuccaggacagccaggacuacacagaagaauccuguuuuguaaucacccccaccccauucccccagagagagguggggggggaggaagggagggagagagagacagaucaccaaaugaauuaaaaaccuagguuuuacuaggaucuuauacucagauugguauggaauuuagugugugcuuguauuacaaguuuuagccacugagccugugaagauggauccuuggcuauaaaaucacuugauuuuccuuuuucugauucaggugagcauuaaguagaaagacacauaguuaauagaaguaggaaguguauauacaagcagauggccauauuucaauuugagaaguuuuacauuuuucagacagaccuucuguguuggucuuggccaaaugacuucuuugcugugguuguuucaucugcuaaguagaauguuaguagcaccugucauagguuggaauuguaaguacuuaggauagugucugauauauaguaagcaauucaucuguuuauuagauacgccagaguagaauagcagguagagaagaaaauuacuugauuugaauuuuaucaccauaguuugugucaguuaaauguggcuccaaauguuuuuggggguuagagguuucucuauuuauacuucucuuuccaaggaagaauguguaaauaaaucuagauguaugaguuuucuacaguuugagagaggucagugacuucuacuccaagcauauccaaaacuuugaagggcuccauacauugcccauuagauaaguaaauuuacucuaaaaucaaaguguucugaaugagguccaucuuggauguacaggugaugugcguuguuuuuccucaaagcugaguucuagacauuuuaggaaauaagaacagcauuauuacuuuuuucccuaggaaagcacucaacagaugaucaaaggacacuguuuguuuguauauuuguaugucuugguuuuuuugagacaggguuucucuguauagcucugccuggccuugaacucagagaucuuccugucucuaccucccaaguguagggacuaaugacaugugccaccacugcccagcuaaaauuuuauuuauguauuugagugcccugucugcaugcacaccuggaugccagaagcggucccauuauuguugggaauugaacucaggacuucaggaagagcagccaguauucuuaacugcugaggcaucuguccagccuggagugcauguuuuuuucuucuuuuaauggguauuguccuauuucaaaagauuguggguaucccagcacucgggaggcagaggcagguggaucucugaguuccaggacagccagggcuauacagaguaacccugucucaaaaaaacaaaaaaaaaaaccccaaaaaacaaaaaaacaaaaaaaagauuguggcuaauagauuuacacgagugcguuuuuacuguuuuacccaggaaaguauauugaaagugaauagagauaaggugauaaguguccuaaaauuucacaaacaccaguuccuuaaauauugaugaauauauuuagcaaggcauaguggcacaugccuuuaaucccaguccuugggagucagaggcagguggaucucugugaguuugaggucagccuggucuaguugaguuccaggacagccaggacuacacagagaaacccugucuugacccuccucgccccaacaaaaauaaaaucaacccccuacacaugauuuauuuagggcuggcaagaugaugguucauuggauaaaauugcuuguuccuggugaucugagauugauccuuggaacccaucaaguuuaaggaacaaacugauccuggaagucugacuacacaugcuuguggcaugugggcucacacaucauauacauacuguuuacccuucuccccacaaauaauaacuuaaaaauaacacagggguuauugagaugauucuauauaaaggcacuaagcuggcaacuaguuuguucucuggaauccacauaaagguggaaggaaagaaccaauuccacaaaguuguccugugaccuuuauaugcagguugugaaacagagaggcacauaugcaaugauaauaaauaaaauccuaaaaaaaauuaccugaaaaaauauaacuuaaaugaauauacuuaaaaaagcuguguguucuaguauuuugagaccuggaacagacuaugaaguaaaucaggauccagcugaggaagaugaucauaucauaagcuucuacauggcgacugcaguuucaguagucucauuaggaauuaaaaagauuugggcacugcuuugguuugugcuuuaaaauuuauuuauguauuuuauguauaugggcacacugucuauauauaucuacacacuagaaggcagcaucagacaguugugagcugucaugugggugcugggaauugaauucaggaccuuccagaagguccugagcacuugcucuuaaccacugaaccaucucagcagccuguugaugaaguguggauuucucccgagguggcuuguauuaggaacugucuucacuuacccuugacuacauugcucuuacuucucauaugucuuuucuauagugucuacuuacuagcucuucaguaacccuuuaccccuggaguuagcugcaguuggcgcucccgcuuucucuuuuuaucuuuucuuuucuucucuuuucuccaucccucucccucucccucucccucucccucucccucucccucuccccucucccucucccucucccucucccucucccucucccucucccucucccucucccucucccucucccucucccucucccucucccucucccucucccucucccucucccucucccucucccucucccucucccucucccucucccucucccucucccucucccucuuuuccucacagagaucugccuaccucagccuccaguaugcuggcauuaaagguguuggccuccaugcuugguucucuuuuccuuaaaauuucuuuuucuugugggaguugguacuuuuucaucacaugaguccuggggauugaaaggacagauuauaaagcuggauggcaagccuuucuuuaccugcugagccaucuugccugucuguugagcuccuuaucucuuucuuccuggauagacaggagcuguugugucugcagacauugccaguagccugugugcuuaccagaugucuugugaucucacugaugacccuuuguugcuguggguaaacaagcaaagcaaagaauguauugauggguuuaggagaauuguuuagacuuuccuuauuacuagaguuuuaaaucaaaugucuaugaagucccauuguauuuaccaauccuaauauuuguugauucuaauccagaucagggcauuuuuuuccccuaccuguuaagaauaggcuacaucuagccaggcggugguggcacacgccuuuaaucccagcacuugggaggcagaggcagguggauuucugaguuccaggccagccuggucuacaaagugaguuccaggacagccagggcuauacagaauaggcuacaucuuucaaggucucuguggauaccugguaagagugacuugaacuucaguuaaaguaguguuucaauuuccccuccuuuuuucuuaaagaguuauuuauuuauuuuauuuaugugaguaugcuguagcugucuucagacacaccagaagagaacaucagaucccauuacagaugguugugagccaccaugugguuucugggaacugaauucaggaccucuagaagagcaaacagugcucuuaacugcugagucaacuccccagucccuaguguuuucaguuuuaaaggaugagccuaauuuaggauuguacugugauauaaauuuucucacuugcuuacuuacuuauuuauuuguuuauuuucaagacaggaucuuacuguguaucuuuagcuguucuggaacucacuauguagacccaagcuaccucugccucccaagugcugggauuaaagaaagaccugcaacacuauguccaggauuuuuuuuuaauuauuaaaaauauaaacuagagcugggcagugguggugcaugcuuuuaaucccagcacuugagaggcagacauaggggaauuucugaguucuaggccagccuggucuacagagugagucccaggacagccagagcuacacagagaaacccugucuugaaaaaccaaaccaaacuacacacacacauguauguauguauguauguauguauguauguauguauaaucuuuaucuucuuuggagacaggguuuauuuguagccuugccuauccuggaacucacuauguagaucagucugcucucaaacucaacagagaucagccugccucugccucucuagugcugggguuaaaggugugugcuuccauguucuaugcuacucuuaauagagaaacaguucuuuugaucuguuuucucagcucuuuccuuucugguuguuuucuuuucauuauuguguugugcuugcugcgugugugggcacaugucccauggaguacuguauccguggaggucagaggaaaacugagcuauuucucuggcccacuuuucuucaucuuuuuuuaaaaaaaguuacuguguucauucacuuugugugagcaugcccaugugugggucaguguuugugcgugcugauguuaguguguaggacaacuccugggauuccuuuaucuucguccaccuuguuggucccagagauugaacaaaguucuucaggcuuuaucugcagaaccaucucggugaacuuuucuuuuuuuaguuuuuuuuugagacagggucucauuacgcagcacuggcugucuuggaauucacuuuguagaccccgcuggccuugaacucucacagaucugcugucucugccuccagagugcugggauuaaagugugcacugccauaccuaauacugcaaacauuuuaguuuaauuuuguuuuuauguauaagucuuuugccugaacauggcauucuugccuggauauauaccuaugcacuauguguaucacuggugcccuuggaggccagaagagguuguuggaucagcuacgacaaaguuaaaacagacaguugugagcugucaugugggugcugagaauugaacccagguuuucuggagaagcagcuagugcucuuaagcacugaaucaucuuuccagccccacugaguguguauauguaaaaaaauacacauaguuaauaauaauguuucaucaugacauuuuccuucccuccuucucucccucccucccucccucccucccucccucccucccucccucccuccucccuucucccuuccuuccuuccuuccuuccuuccuuccuuccuuuucuuuucuccccauccccuucucuccucccuuuuaguuuauugagacaggguuucucucuguguagcccuggcugaccuggaacuuacugugcauguauaccagguugguuucaaacucacagugauaucccacccgccucugccuccuuagugguguggaguuagauaugcccaguuucauuaugacacuucuguacuggcuaguuuugugucaacuugacacagcuggaguuaucacagagaaaggagcuucaguugaggaaaugccuccaugagauccaacuguaaggcauuuucuuaauuagugaugaagggggaaaggccccuugugggugggaccaucucugggcugguagucuugguucuauaagagagaaggcugagcaagccaggggaggcaagccaguaaagaacaucccuccauggccucugcaucagcuccugcuuccugaccugcuugaguuccaguccugacuuccuuugaugaugaacagcaguauggaaguguaagcugaauaaacccuuuccuccccaacuugcuucuuggucaugauguuugugcaggaauagaaacccugacuaagacaacuucaaacauacauccauguaacauuuuuaucauauggauccaguaucuuuuccuuccucuuccuaauuccucuucuauagucauguauuuuuuuuugauuacucaauuaauuucauuagaguugcuuacaagagaugaauguagaguuacaccacuaaagaaaagguuucccccccccccccugcuucccagcaacuauuaacugaucacugggcaagaguguaccucaugagcuuuuccugucuccauggcaggaugcugacagaccucagucuucugcaggucuugcucaauuaacacagcugcugugaguuaagaguacaacugcuaugucaugcuugaaagauaguguuccacaacacucuacucccucuacucaggaaugucuucguugauauuuccuaagccuuggaggggguaauagagagagauguuccauuugugacaucauucaguagucauuuauccucuuugcacauugaucgguuaugagucucgguaguuugccuucaucacugcaaaaaguuuucucuggugaacgcuaaaagcagcauuuauuugugagcacaagcaugcauauuuagagggcauauugauugacagaacauguccauuuagcaaaacauuagucacucccccaauuagggccucuaaucucuuccaucaugggcuuuauuuuauaguacuagauguggagcaggccucaaauucaaugagaaaacguuugcuuaccuccauuccagugagugcauccauaauguuuggguagcaguauagcaugcaggugccauagcugacugaagacuugguggcagugcuuccuuaguagccugugcagcagaaaaggaacuuugauauuagcucuaacuuucuuuuuuuaaacuguucuucaaccagaacaugugguaucuucagcaauagggucuuacugucuaguucuggcggacaaccaaaauuaguggcaauuugccuguaauguguguauuuuaaugaauaugguuuccuaguuuauugagaaauucuuuuucuuaauaauccuuuaaacuuuucaaagaaugggaccuuacauuagaauaccuacaggcuuggaacucaaaaggucugacugccuuuacucuucugguuucuauguugacuugcuugccaacuuuaggcucuucuauaacauguacacacacaugugaacacacacacacacacacacacacacaaacauauucuuuuuuuuuuuuuuucgagacaggguuucucuguauagcccaggcugaccuggaacucacuuuguagaccaggcuggccucgaacuuagaaauuugccugccucugccucccaagugcugggauuaaaggcaugcgccaccaugccuggcuacacacauguaguuuuaacuuucauuaauuuuuaauuuuaaaaauuuauuuguguguguuggggacuuguagaggucaaggacaacuugguggaguugguucuuuccuucauccacguggauuucaggguuuaaauucaaguuucaggcuuggcaacaaacaggugccuuuaauuguugagcugccuaacuggcccaacuuuuaauuauuuuaugcuuuuaauuuaaaaaaaaauaguuaaauguuuggaaagucacagauaaaacauguuauuuauugcuucuagcaucugugcccugcuuuucuguaacucuccuuuucuucuugucuguuucuaguugcuaaguacagccucaaguuuccacuaaguauuugacuuaaucuacuuaaagaugucuguacuauuugucuguagguaacauugagaauuuugggcaaguuuguuggcggaggaggaggagaaggagaaaggaaccaugcauggcaugagugagaagggagaagguggugaaggucagcagucauuaaucuugcugcugacgagauccugguauacagaacaugcccuugugcagcaucuucaucugugucauagagaaugccaugaaaccaaagugauugugugaggaagucuauuaauagagauuuuuaaaauuauuuuuuauuaauuguauauuggacaucuguauggagguuagggaguugguucuuucuuccaugugagacccaagaacagaacuugguuuaucaggcuuugauagcaagucccuuuaucugagcucucauaugaauuauuuuuacuaaauucuaguuuuaaaagucuaaaauguuuaaguaagugugugugugugugggggggggaggaaggcaaugaauauguuacacauuuuuggguacucguggaggccacaggauguuggagguuggaagcccuggaauuggaguuucaggggguuagccuuacuaacugcuaugccaucucuccaaccuaaguguguguguguuuauguuuauuguauucuauuuuuugaaagggauaggaucucacuauauggcucaggcaaaagaucugacauaacucgauugauagaaccaggcugguuuugaaccuagagaugcacuugccccucuacuuagguaauuuuaggauuaaugguauguguaaccacacuccaccaccaguuucuauuucuauuaaaaccuuucuuuuuuuuuuuguaauauacuuguuuuagaugacuaguguaaauuuauuuaacuaggaaaaaagucuuuugauucaaacuuguaggauuuuauuuuuauuuaagaaugauuaugucacauggaaagaaggaguauaaaguuuugcauuguguuuucugaacacauuaaaauaauuucccaguucauuguagauguuucuuugggaugacauuuuaauuuuuuucauaauaauaaaaauagguuuuuuuuuguuuuuuguuuuuuuuugcaguggcuuucauauaacucaaagccugguuuguccugggccuauucucuauguauuauaagcaucugucaguacaguuaguggcucuauagcagucugcuugcugucuugguuuugucuuaaaucuuaacuccuuggauuuuauuauucugaaguucugugagauaauugcaauguuuuagaugagaauauuuuuguggaaagugaugauagucuguaggagugaggguucugagugguuggaugguucagaguccugcaccaaaugaagacaauucuuaccuggcaugcgugggagguuagagccugaccccaaaucuuuaaaacuuuccuuuauuuuaaaagaauuugguacuauaagacaugauuacuuuauuuaagucauaauuuaagcuaguuuauuagauauuagagcaacaaaagcagacaauaucagguuucuuuuuccuucccccuuuuuucuugguaucagugcuaggagcaauaaaacauuuggccagcuucauuaaggauaagaaagguggaaaaacuguuuauugaacagaaggauaauuguuguaguuguagauguuuguuuuaaagcuuggaaaaguaugcuuuuuuccccaaaccuuuuauuuaacaacaugauaaauaucuauagauaagagggagaagaaaaagcuaguuauagaauuuuagacuuuuaaagugaaaagcuuccacuguuaacuggaagagucugcuguagcagaguaaaacccuagcggggguguuugugguacaaaucaaagaucacuuugaauuucucacuucauaauaguggauugggaagaauuuacugaagggguuaagcucaguaaagugcucacuuggugaagcgagaugauggaaagauguaguuguuucccuuuuuuuuuuuuuuuuuuuuaauguccuggacuuccaacaaacuucuuuaguuuaaauauuauaaaaccauaagcugcacuucuugguuuguuuugauuuaaacagcagagagggaaagaacaugguuagcaaagaguuaauaaccaagcaggcagucucugcuggcuucuuagaaguaggauuccagaucugggcuuuagaggaauccauuccacuuuuuuuagguggcuguugucugucggaucuacuuucuuuaauggagcuuccuucaaucuauccccuccucuuucuuauuauuauuuucucccucccaaccucccucacucccuuugccucucucuuccuccccuuuccucuccgaguguggagugugcucgugcacacgcgugugcccugccccuuguauguguauucggauucucauagcuguaggguaacuugucagagcauugcuaggagacuuuuuaaauuuuaaauuuuuuguuuuugugagacagggucucucuauuuagucuuggcugacuuggaacuuggaauauuuagacuaagcugaacuugaacucaggaucuuccugccucugccuucuggaugcagggauuaaaggggucuuaauagcuauguauuuaucaaacauuuuauuuauauauuuaaaauuuuuauuuacuuuuaugugccugcauguaugucugugugaagaugccagauccccuggaacuggaguuacugagcuaggaauugaaucuggguccucuggaagagcagccaguacuuugcuaacuguuaagccaugccuguuuuaucuuuucuuguguugcugcugcuccugcugcugcugugggacaagcuugguaggaguuaauggagagccugccuuauuaugcuggaagaugaugcugaaaguuuucuucucaagugguauuagauuggcuggguuaugugauuaaucuuucugguuauuuaauuuuuuuugagacaugguuuuauauaucccaugcuggccuugaacucauuguuuagccaaggcuggcaucaaaauuuguuaccuuaaugcaucaaccuuuugauugcuauugggauuacaggcauucaucacuaaguucagcccucaauuccaauuauggaugagguauguguguauauguacuucuggggcuggagagaugccucagcagucaagagcacuugcuguuuuuccagaggaccagggcuugauugcuagcacccacguggagguucacuacugucuuuaaugcuaaucccagggucgucuucuggcuauacagacaauguauauacaugguacauaaagugaaaagacccaaaagguauacauuuauuuagaacauaaauaguaauguagcacagucacacaacauuuauaaaaauguuauaucauuuugaguuauaucaucaaaagcuuaaggauuuucagcaguuuuacugaugagcauuugguucuguuaaacugcaauaacaaagacaguucucuugagccuccuguuugugucucccaagugcuuuaagcaguccaccaagugaacuaucccuagucccaggauuugugucuuuuuaaaauauuuuuuaaauuuaaaaaauuuuuauaaagccaacacaauagauacuagaaauguauguauguauguauguauguauguauguagacaggguuucaauguuugccacaugcuggaacuugcuauguagaccacucuggucccaaacucaggauaggaaguguuguuaagcggagccaccucucaugcucuauguacacacacacucucucucuuuaagauuuauaucucuuauuuaugaguacacuguagcugucugucuucagacacaucagaagagagcauuggaucccauugcagaugguugugagccaccacuugguugcugggaauugaacucaggaccucuggaagaguagucagugcucuuaaccccugagacaucuucccagccccauauauucucuuuuacaguaaaauuugugaggcaauauagagggcuguuagucuguucucagguggcauuaguuguguguguguguguguguguguguguguguguguacacauguauauauggacauguguauagauaugggaauacccccauguagaggacaacuuucuacuuuguuugagacagaaucucauuuguuauuugcucugaauaaacuaagcuagcuggcccaugagcuuccaggaauucugucuccuaucuacuagaugaacaguuguacuugacuuugacauggguucuagaguuuuuaacucagguccuaauacuuguaugucaguugcuucacugauccuuuuucuagccucucuaccucauuuuugagacagguacugaaccugaagcucagugauuuagcuagacuggccggccagcaagcucugggguccuccucucugcuuucgcagccuugggauuucagacacacuacuaccccacuggacaagcacgugaacaacugaacuauuauuccagauuuacuaguuacauuucuccaccauauaaaaccuugcaauauguuauuuacaaaaaugaauuuaaagugguggugguacaugcccauaguccuaguacuuggaaaguagaggcagguggaucucugaguuugaggccagccuaaucuacagaucagaucaaguuucaggacagccagggcuacacagagaagcccugucuccaaaaaaccaagaaccacccccaauuuuuuuuuuuauuguaccuugaaacaugcauacaugcauaaacuuagcuuggccauuuuucugaaaguauaacuaaaggaaacugaagugcaugcugugugugcuauguaugcauuguugauuuggaaacaagguauucuaacaagacaguuucaaaauguaacuacucagcuucuggcccuuuaaucccaggauucagaggcagaagacacuggauuucucgggaguuccaggcuagccuuuuaaaaaaaagugagagcuugccuuuaaaaacaauaacaacaaacggcuggagagauggcucagugguuaagagcacugacugcucuuccaaagguccugaguucaaaucccagcaaccacaugguggcucacaaccauccguaaugagaucugaugcccucuucuggugcaucugaagacagcuacaguguacuuagauauaauaauaauaauaauaauaauaauaauaaaaucuuuaaaaacaacaaacaaaaagccccaaaauucugguaacuauucaauauaacaaucuuuccucuuuuagacagggccccacauggcacagucggccuccaaacaacuguuauaguuaaggaugacagaauuucucauccuccuguuucuaugacuuuagugcuagaauuucugguaugagcccucauaccugcugaggauugaaccuagggcuuugugaaguuaggcaggugcugaaccaacugagcuauauccucagcucuaaaguauauauacuuaaauaaauuacuguuauuucuaaugcaaguguauguguuauaaaaucauuauuacuguaauuguaaaguuacuuuuguuuguguuugagacagggugucacuauguagcucuggaaaacugaaacuugaguaucugccuuugucuugagauggaagauguggaccacaauacccaguuguagaguuaccuuguauacauauuuucaacucuaaaccuguauaaaauauaaaguaacaaagacauacaggacacuaaauucuagcacuaaagucauagaaacaggaggaugagaaauucugucauccuuaacuauaacaguuguuuggaggccgacugugccauguggggcccugucuaaaagagaaagauuguuauauuaaauaguaauauuaaauauuaauauuaaaccuuuucuuaggcagacaggcaggcaggcagacaauagaauccugaaucacuuuuaaauuauuuacuuauuuauuuuauuauuauugguuuuucugagacaggguuucucuguguagcucuggcuguccuggaacccacucuguaguccaggcuggccucgaacucagaaauccaccugccucugccucccaacugcugggauuaaagaccugcgccaccacagccuggcccugaaucacuuuuauuugcuaugcuuuaaugguaacaguaacaaaaagucauuuaggugucaaacauauuaaauacuuuuauacuuguuuguaucuauuggguuuuguauguggugugggcaugcauuuaaguguugccaguguacacaugcauucauguagaagcuagagcaggauguuaccuucuucaguggcuguacaucuuauuuucuugucacaaggucucucacugaacuagaaguaauauguccuuuuuggcuaggcuggauggccacugcccucucaggauccaccuaccagccauuuugggguauggcguguggagccauacuugacuuuuacguggauguugggaauuuauacucaggccauuaggcuuuaaggagcaagcacucauaacccaucuuaagccaucucucuagccccucuuuuauccuuuguggaaaguuugagacacacacauguguaguuuuuugguuauauuuauaaguagaaaagugcccuugugacugaaaggcaggcauaggugauuggcugcuuguggauaaaguguaaaccuguucucccugugaacaguugcccucauuuguuuacagauauugauuaaacaaacaaacaagcccucagaauuaaauaauuacaguguguuuuucaauguuuuuuuaaaaaaaaauuuuuauugccacuaauagaauauugcucuucagcagggaugaagagauggcucauuuguugcucuuguaguggaccuagguuucauucccagcacccauaugguaccuaacaaccaauuguguuuuaggaaauaugaugucauugucugaucuccaaagacaccaggcacacacauggugcacgugcauauauuccaggcaaaacacucaucuauaaauauguaaaauaaauaaauagaaacaauaucuuagcacaugcugcuguauagccauucuccaguuguuaucuacaaaaacugcuuuauauaucaggaaaaaacaaaagaaaaagcugaacauaacuaagaaagcagaaaauucuuuaaaauuuccuuauuaguuuuuuuguuucuguguguuuuugagacagggccucuuuauauaguucuggcacccacuauuuagaacucacagagguccuuuugucucugccucccaauuuaaucccucuguugggauuaaagauguggcucaccauuuauauuugacagugcugauaagaacauauucucaacuauacuccuuaauuucauuuuugaguuaacuaacuguuaaaaguuggaggauaauuuuaacauuuuuauguacuauucauaggagagucaaauaauaugauuuuuuuuguuuuuuguuuuggggggggggcaggggaggcaggauuucucuguguagcccuggcugcccuggaacuagcucuguagaucaggcuggccucaccaccuaccaccaccauccggcugauauauauagugauucacucuuuugggggugauauguguuaucccuaaaagcuucaaguuccuuugagggagccuuuuauuauuuauucauucacuuacuuauaugagagucucuuguugcugaagcuagccuaaaauauugucaaaaaugaucaggaacuccugcuuugagggcucuacccucuaaaugauacucuuuauagguuuacuguauaacuuuugucuuaccuuguuaaauugaaauuucuuaacauugucuagauguucuuuuuuguuuguaagauaagguuuuauguugugcugguacuuaacuguguacuuuggguggcagcuccuuucucucagccuucugaguaucaugauuaugcuacauccuaugauacccagccuccuccuuugcuuccuuuuuuuuuuuuuuuuuuugagacagucucaaaacuuuuaaacaauuuuuuuuucuuuuucuugauuugauuugauuuguuuuguuuuguuuuucaagacaggguuucucuguauagcccuggcuguccuggcucugucgaccagacuggccucaaacucagaaauccuccugccucugccuccugagagcugggauuaaaggcgugggccaccacgcccagcuuugauuuuucuuuuguuguugaaauggucuguuauuuaaaaaagguaaaugaauguuugauugucuuuugagacagucucacuauguuggccugacugacucuuccuguguaggccaggcuuguuuuaaauucacagaacuguaccugccucugacucgagugcagugcaccaugcuagcauuuuugaucugcuacuuauaucagauaauuuucuuucagcaccuacaaucaaaaauaaauaacuuuuagagauuuaguuauccaccauuucagaacguuaggccauaaaaaugacaacagcaggcuuagaaauucucaauguuuaggaaaugggcugaggguggaaagucagugguacagugcuuuucucauuugaggaagcccuaggcuccaugcuuggaccauaaacaguacaaacaaucaaaaauugaguaccuaccauauuggacuuuuugcuuguuuguguguuuguuuguuuacaacacauaggagauaagggacaguaucgcaaaagaguuauaaauaaaauauauccuguuaaaauauucaaagagcuuagagauaaaucuaaaacgccuauaccccauaccuauucuguuuguguuuacacaagaauacuaauacucauucuacucuaacuugauaauguagcauauauuaacuuuuuuacuuccuuuuguaugucacaguuauuugagcaucuuuccauuuuuagcucauauaugucuaucuuaguuacuguuccauugcuguaauaaaauacccugacuaaaucaguuuaauggagaaaguacuuauuuuaguguauaauauuuuacaucuugguggggaaaucaaggcaggagacugaagcauccugucauuuauuauccacaaucaggaaacagagauggauaaaccuguucaguuuuacucucuauacuuuagacuagaguccaggaucccuuaucuagggaacgguaucacccacaaugggcaagucuuucuacgucaguuaacacaaucacuggcauaaccccucauucguauuccuagaagcccaucucuucagugauucuagagucugucaaguugauaacaguuaacacuaaccaucaaaacaucucucaugucucucagaauguauccagguggggcuguggagaaauggcucaugguuuacucacugcuaucccaaagaacccagguuugauucccagcauccacaugacaacucauaacuguaacuucuguuccaguagaauaagacaaggcugucuccugguaucugcaggcagugcacauacauugugcacacgcaggcaaaacaccaguacauguaaaaaaauuugaucaaggguacaaaauugaaucucacuuaagcuaaugauuaugcuauuuuauuuaguaaauuaaaaaauugucguguguguguguguguguguguguguguguguaguggugguaauaguaauagggugauguauguguaugugacagagauaguuugggugccugaguggugccauggcaugcaaguggagaucagaggacaacuuucagagaucaaacuuaggucacagugcuuuauguuguaagcucuuuuuaucuacuagauuauuuuagacacuugggguucuagcaccugucuuuguggagaaaauauuugauugcugagagacaacaaauuuaauuucagauauaguaaguucuauaagcaaaaguacauaugguaauguacuaacagcguuugugaucugauaaauguuagauuucagaaaagcuuguugugugaugacauugaacuuguauuuccugguggaugagguagcugugagaaguuuuauuucaguuuauuuuauguauaugaauguuuugcuuacauguauguaagugcaccaucugcaugccugguauccucuggugucagaaaaggucauuggauccccugggaauggaguuauagauagaugugagcuuccauguaggugcugggauuugaaccagaguccucugcaagagcgguaagugcucucaaucccugaaccaucucuucagcacagucgggaguaauuuuauuuaauaagagcauguagcucauugugaggaccacagaacagagugggugugccauauucaggagacacucaugucuuaaaaagccaguuuuauuuuguaauaggagcacuauaggaagucauauuugggagguacacaggguccuccucauacagugauugcauguauaaugauaagcugauuuuuuuuuuuuuggccuggauggugaggagcugaccauacaauggcugcaugccugggaacugaucaugugauugcauggaugaguagaaguuguuuguuuuuuucuaaacaguuuauuuguauuuuuauuuacuugucucccugacuguccagcacauuugugcuggugccugcagaggccagagaaggugccauucuuuggagcugaaguaauaggugguguuaacugccugacauauaugcugggaacagaacuugaauccucuggaagaacagcaaauacucuuagccuuugagccaccucuguagccccaggaacugggauguuugacaucaauuuaugaaauugguuauauaauugcucuuauuggagcauuuuaaccuuguagauuaguagggauguugaaauaguugauuugguagaucgaguguaggguuagugugguggucaaggagagaaaugaucuuaaauguuuggaaggguucaaugauaagaucugcuaauagauuuuuaauggguuaggugaggaaaagaaaguugcuuuuuucccccuuauuuuaaaaaaaaauuauuugccgggcgugguggcacacgccuuuagucccagcacucgggaggcagaggcaggcggauuucugaguucaaggccagccugguguacagagugaguuccaggacagccagggcuauacagagaagcccugucucaaacaaacaaacaaacaaaaagauuuacuuauuuauuuauuuauuuauuuuaauguaugugagugcacuguagcugucuucagacacaccagaagagggcaucagaucucaauacagaugguugugagccaccaugugguugcugggauuugaacucaggacuuucgaaagagcagucagugcucuuaacugcugagccaucuaucucuccagcccugaaaguugcuuuuuugauugccauuuuucacaucuguggacaaguugcuuuuuugauuaggucauguggaacaaauaacaaacaagaggucaaguaucuucuuucacacucugcuguauucccuuuuagacaggaucucucacugaagcuugccacguuagcuaggguggaugucucgugagcucccaggauccucuuuguuaggguuacagucauugugggaucaugcccagcuguuuuuguuguuguuguuguuguguauuuuacuacugaacaagccaguuagaggucauguggaacaaauaaauagcaaaccagaccccaaauuuaaagaggcuaaaaauguugagcuccucagucaugccauuaugugagcuugguucuccuuauaccucuauuaucaauuuucacaugaguccauuggggaauaauaugauuuugcuuuuguuucuuggccaggaauugcuugauuccaaaagucuggugagaagccgaguaagggauggugugcagcaucugagggaaggagaagaaaugcucacuuuuuugcaugaguccuggggauuugcauucauauccccauauuugcacaguaagugcacauaccuacugagccaucuaaccaggccuuaacauuuaugacuuuuugguuagacuuuugagccaugacauaaaacaaauaauauucaagcagcaguuuugaaagaaaaaccuugacaaaaaaaaguuuaaaaugaaaugauagucaaaauauguagauggaaagcuggaaauguagcucauugagagagcucuuccuaacguguacaaggaccuacuucagucuuuaauacuccucuccacauggccccccccaaaaaaaaaaaacccaaaacaggguauugguaggaaugcacaccugcaaucccaguacacaggaggcugagguuugugcucccugccaauccugacaaccagaauuguucuggcacucacaugguaggagagaacugacuuccuuaauuuuuuuuuugaccuccacaugugugcuaugacaucuguuccucccccaaaaauaaauaguuagauagauaauacaaguguuuuuaagacaaaggucauaaguggaacaagcagcaugauggagaacacuucauuuuugacagaacgauguuugugggcuggcaauguuuuucuguggaguagcuuuaauuucuuuucagugucuacuuauuauggugguucuuaaaugcuuuaaccuuccuucuagcccaccacucaccagaaguaguggaaaagaaaggucauuaugauaugggagaaguggaccuguuuaggaaugguucguuggagcaaaucccaucugcauuguuaggaaaucagcaguucaauucacaggucagcagcagcaccuugauccacucacaaacugucagcuucacggauauauuggcaguccaguucaguaguguugggacaguagcaguggugacacagccuagcaagaacagccaggcuucaacugaaugggcaagaagucagcaggagggauuuggaccagcagggacaccaggagaaguucucugccuugucucucucaacaaagagaugaucagcaaagaagcaagaccaagaagugacagucuguuaaauccuauuuauacucccuccaaacaucacaugugcuccaccagucuugccucagcucaugcauccgucuuagaugacaucacuuagccaaucagcccaaguauguggaagcaagaagcuucaggacaccaccagaagguuuuuggugcauuucucucaauggagccucaacaaauggagcucaauuaugcagugcaaggcagacuaauaagaaucugucauuaacaaagaaucuuucuucauguguccuuucacauucuugcuuuagcagaauauucucucuccugugucugcuucagugaaacaaaccuuucuuuacaagucugucuuaguaaaacauccuuucacccguguccacucaggaaaacacuccuuuacuuguuugcuccagcaaaacagcaucugacacaauugacuuuuccaaagaaccuuaaguuuccacuucaaucuggcauugguagucagauucucauccuagucuuucugcuuaguagccauuugauaagaucauguagcagguuuuuucagcuuuaaaugggaucacaguaucauuuacuggguugugggcagauaaaugcauauaaagaugacuugcagagguuaggaggagugaacaguugucagaguaaacuauuguuucuuugcuguuggcagugaauauggguaauagaaugauuauuucauguguaaaauuaaaacguaacuguguguggugguuagugcauacuuguuauucuaguacugcagaggcugacagaggauuguggguuccaggucagugauggcuacagaggaagacccugauacaagcaaaaccaauaacaauaccauaaggggcuaaggagauagcucaguugguaaagugccugaggauuugacuucagauuccuggcucucauauaaaaaccauguguacacaugucuggaacccuaguccuugguaggcaguaaugggcucuucucaguucucccuugcuagugcugguauuaacaaguaagcaccuucccuauuugauuuuuaccuucuuuacauuuauuuguguguguucgugcacgcgcauuuacguuugugugugcaugcauguagguaccuguggaggccagaagaacuuaagaugugagcuaccuaaugugggugcuaagaacugaacucaguccuuaacuacucagucauugcuucagccuuucuuuuccguucuguuccuuuccuuuccuuuucccugacacaagguguuuugguuaguuuuacugcugugaauagacaucaugaauaaggcaaccauuuuauuagggauggcauacaggugcagaaguucagucuauuaucaucaaggugggaacauggcagcauccaggcaggaaugugcaggagaugaugagaggucuacaucuucaucugaaggcugcuagcagaauacuggcuuccacgcagcuaggaggaggaucucaaagcccacacucauaaugacacacuuucuccaacaagggcacaccuccaaauagugucacucccugggucaagcauauucaaaggaccucauggguuucuuuuuguagcccuguagaccaggcugggaucacaggugugugcuaccaucaccaggccccauguccucuuuuuuaaaaugugaguucugaggauucagcuuagguucuuaauaauugaaaggcaagcuccuuaucauccuaccuacugugauaucuccgucuuugucuccacucuccaaguacugugauuauaagcauguaccaccauacccaguuuuuuaggguguggggauagaacccaguguuucaugcauaccagacaagcaugcuaccacugggcuacaucccuacaguagucuuuucuggguuguaggaugggaauuaaacaagacuuugugcaugguacuauacaaacacuucauacuucauccccacuaguucauauuucacuuguauuuauuuuccugcacauucuuauucaggucuugucaaaugucagaaaccuuaauuaaaaaaauggcuucaacaaguagaaauuuuccucacagauauaauucaguagcauaugaaauugucacagacuuagauauguucccccuucugguuccuuucauucucaccauauuggugguugcuagauaaauuuauucagcagcuauaauauaugaaaaauauaauguuaccaugggaaauagagaacaagauaauggaacuugaugaggaugagggagaagacaaacuaacauagguaaacauuucauuauguaugaaauguuaauuauuguugaaauaauaaaguaguggacaggauaagaacagcgagcaguauuggguuaguaagcugauuagggagguuucaguaagaugacugaaucuaaaagggacgacugugagagugcagaggcugguguggaugugggggauuagcauagggagcaaugaaugcaaaaaggcucuugugcuugaguuuuucauagaacugaauugaaaagaggcaucaggacugaacagugugauaaagggcaaguaagcaaaguauugggagucaggccauguaggaccuugggagaacuuuuaugugggaagagaugccugugggagcuuuugagcagagaagugaccuaaaauguuccuuucagagcgccugguauaggugaggccuuggguucaaccuuuagcacccuaaaggaggaaaaaaaaugcucauacuacagcuuuguugagaagagaaugagaggauacgggagaagcaggcuuacuauuaugagaaccauaagcagccaggagagaggguuuagaggaagagagaaguaggcauauugaagugauucuucauguugucaggaccagcucuaaggauuuauggaauauuauugauagagggugugaggaaaaagaggauuugcauuaacagucauugucagaaagauggcauugcucacauaccucuuucauuuggaacauaaacauuuacugaagccuuuauaaguuuuucucucagaucuuuguggggccucgacuaggcgugcuuccauguaguagguauaacugaggcugggaaagccauaauguguacaucagcuucauaugggagguguauucuauaacaaggaacaaaauaugagcuaggaggauaugugauugggucacuaauaaugaaguggguuuuuguuggguuggccauuacucuguggugacuuguaaauaaucuuucauaauuauuauuuagauacacacacacacacacacacacacacacacacacacacacacgguauguaucuguauguguaucagaauggaacauuuuggacaaguucauuaagccuagagcauuuaauggucaugcauauggaacacugagcacaaugccuuuaaaacacguaaggggaaaaguaaugaagugguccgaagcucaucauuuuaaccuuugaauagguauugauuauuaauaauuacuaaccaggugaaugguaaauggacaaguggggccaagaggaaauaccugaaauuuaguaaaaagaauguuuaaaguuauccuuuugucuuauucaaauaauguagcucacuaauacauuuguaugauaggucaugacuucaauugagugacuacuuugaagcuuuuccuguucuggacacuguugugcauagacaguauucacguugguauacuuaccugguagacuucuucuaacuucugaguugugagcuuaaaaaacgcuuuccuguccuguccuguccuuuuuuuuuuuuugcuuguuguuugcugcuguuuugagacaggguuucucuuuguauccuuggcgcuccuggaaaacucucugcagacuaagcuggccuguucccgcauaucugccuccagagcgcugagauuagugguguguacugucacuguuaggcuagacaggguuucucuguguagcccuggcuguccuggaacucauucuguagaccaggcuggccucgaacucagcuauucacccaccucugccucccaagugcuggagcuaaaggugugagacgccacuguccagcuaaaaacacauaucuaagaaaauuaauuuagguuuaugucauaaaauuucuagaguuacaauauuccacaacuuaaaauauauccacuuacuuauguccuuuuucauauggaauucccacccccaagacuuacuuauuuguuccauguauguauguucauauguuacagacaugcuaguggaagccagaagguguuguaaguccuugagcuagacuuacauacagacaguuguugugggugcugggaacugaacuuggauugucuagaagggcagcagcuguucuuuaaucacugagcuaucucucuagucccauagaauucuuuuuuuuuuuggaaggauugauugaggauuuggagggagaucaguuuaaugugccuuauauauaauguauuauuuucuuaccaauuugcccagagaaauguuuuuccaggugaggagagaguauaauaaugauaaauaagauuucuuccccuucaucugaauguuggggcuugagcccaggaagacuuuuauuuucaaugaaguuuugcuauugacuagauguaaggcauuauacguuuuuauuuucuuuacccuuguauuacacuuugucuuacauaguuacaguugagacugcagagaugccucaguggauacaacgccugaugggcaaguaugaggcccagagcccaggucuucagagcccaugugaaagcuaggcaggaguggcagagggggacaugggguuuguuucuuuccugguguuuguuuuuguuuuaagcuaaccgaauaucacggugugcaucugugugugcaagagugcauauguguaguggagacacggagcagaauugagcaauaguuaacuugucuuuggauauggaccaguccacugaagagcugauaagauaagaaguuggaguucuggaggauucccuguuacuagaauguguaugaaguagucucugugcuauauauagcccccucagucguuuccauauaauuuaagucuccuccuuuaguguuauugcaagacaaggccucacuaguuaugccacagugacucacucaaaauguggaggaacccauuuggaugaauuuauauaaguaauaauaaagccaaagcuacuuuuccauaucucagaaucaaaaaaguuuuuuguuuuuccuuuugagcuuccuuauuuuuguuuuguuuguuaguuaagauuaaacuaucagaggugggaaggaucugagagaguuggcuccacuuucaaacugaccauggccauuuacuuucugggccuguauuuucuugauagaaaauggggaggagucuuaagugucuguuacccugugcuugugauuucccucccucccuccucacuaccccccaccccccuaacucauaugcccgauugguuguuuguaguuucuguagugaccauuuuccucuuaguaugaggguuacucgucauauugguguguacuucugaacuuagaccucaaguccucaggaaaguaucuaacagaguacuuuuuaguucugccuccaccaguuccuuugugguacuaacaaauuaccacagaguagcuacuuaaaauaauagaaccucccucuuuguuucuuucacuauuggaagcugaaaauccaaaucaguugaguucauucuuuuuaggcuuuucaguuugguuugcagauuagcuguauucuuacuguguguugacauggucuugcuuuuuuuguguuuguuuguuuguuugaauugugaugucauuuuguuaaacuuguaugugugugugcaugcaugcucaugcucacacaccuauauggaagucagaggauaauuugugggaguugguugucuccuucuaugcugugggucaugaguauugcacuccuguugacagguuuggcaacaagugccuuuaccugcugagccaccaccucaacagcccugagacuccuucucucucuuucucuuucucuuucucuuucucuuucucuuucucuuucucuuucucuuucucuuucucuuucucuuucucuuucucuuucucuuucucuuucucucucucucucucucucucucucucucucucuuucucuuucucuuucucucucucucuuuuucucuuucucuuucuuucucucucucucucucuuucucuuucuuucucuucucuucuucuuuguuguuguuaauuuacaaagauaagauuuauucauuuuauuuauguuagauagaguuuugccugaauguauguaugugcacuagcuuugugcuaggugcccauaaaggucagaagagguuggauccucucgaaccagguuaauggauggcugugaaccaccauauuggugcugggaacugaaccaacccaguuccucugcaagagcaacaaauaacuuuuaccuuugagcuaucucucuagcccugcuccccggccccaucagacuacaucuuaaguccauuuuaacuucauuuuaccuuaaaggcagcucuauuuuuaaauaaaguuacauccaaggguaccugagcauuagggcuucuaucuuucagaaaaaaacuuacugucuguauuucugauaccauuuuucuucuuuugaguugccuggacaaaaugcuucagaaaagcaucuuaaagagagacagguuuuagccuggcgugguggugcacgccuuuaauuccagcacucgggaggcagagcaggcggauuucugaguucaaggccagccugaguaccagacgugaacauggugugccuauacacauguaagcaaaguacucauacacauuaaaauauccuaaaagagaauuuaaaacauauauuuacuuaaguauaaauacauccacuuuaaugagauugauuaaauaauauguucguuauaaaacauccuaauauuuucccuuagccuugauguuucacuucacaagaugauaauauaggaguuugggaguuugguuuugaucauuuaacauuauuauuaaucauauaucuuuaaaguuuuuuuuuaauaauuauuauuucucuguguagcccugucuauccuggaacucugagauauaccugucucugccuccagcgcugggauuaaagauguaugccaccacaucuggcuuauuuuaaaguguuuuaacacauguugugugcguuuaccauaaacuaacaaaugguauaaaucacaaguacgguggugaucauuugaucauucugucuccacauuucuggcuuguagauaagaugcuguaugcaaugaaacaugaguacauaggaguauuugcuuuuuuauuuuuugagaaagaauuucauguauccugagcuugucuuuacuauuuauguuguuacuccugcuaacugcugguauuacauguaucgaccacuaugcuuaguuuuauguggcuucugggauagaacccaggauuucaugcaugccagccaaguacuuuacaacagaauguuuuuagcuuuuuguuuuuggucaauauuauuuuugggaagcaguauugcuguguagcuucaaauguccuuaaauuuaucauacuacuuccucaagcucuggaaucaugagauuauagauauaugacaccauaccugacaaagagggcuaagagagauggcuuaguaauuaagaacauggucuuguucuucaggaggauucagguucaaaucccagcacacacauggaugcuuacaacuguaguuccaagggaucugacauacagacaugcaugcaggcaaaacaucagagcacauaacauaaaaauuuuuuaaaaaugguauuuaaacaaaacaagugggauuguacuaaacauucucuuguaauacugucucuauucacaugugcaccuugaguucacucuuuagcccagaauggucuuguggucuucuugccuuagucucccagugcaugcaugacugcgugcuugacuguaguuuuguuguuguuguuuauuucauuucuugccuuucccccccuuuacuuuuacuuuaaaauuuuuugucuucucuggucuauguaguaaaauccaugccuagcgauggcuuuuuagggaccccgucauucauauauuuaaaauauuuugugugggucacacaugcaaaucagagaauaacuuugggcaauguucuugccuuccaccuuguuucuuguuuuuuuucugcugagcuacauaaaccaguuucugggugauucucuuuuucuacuuccuaucuuucacuauaggaguccuggauuaacgggauacuuuuaugggcucugagaauuaucagacuggucagguguauguaguaagugcuuguacucacugaguaaucuccuugaucuucuuuucuuauugagauggguuauauguguaaccccgacuggcuuggaauuuguuagguagaccacucuggugucuugguaugagucugugcuggaauuacaggccugugguacuaugccuugcuaauuccugaauuuguuauuuucccuuucuuuaaaauguugauuguuaugaugaauccacaaagaaaacuguuaguuggagccaugcuagguaacuaacuuagucauguagaacuuggccugaucucugaugucaacacucaaugugaaaaggugguucaaguguugacuuugccacgaagagacgaggugauggaguuacauauucuagggagguuugggacaaguacugugaguggauaagagucuccugucaguagugcuuucaucucaaucacauguaagggaaauucacaaaaauguuaaucagcuguaugcccaggaggaaaaaaagccaguuggacugucaguguaaucugugcaaugcccaagagaguucacaaguuccuuggccuuugagagccuguucugucuguagucuagaugaagacaaugagaacuuaggugaagcagcacuuuagaaaaacuguguaagcaucuucacguuuaguuguuaugaaaucuuuugaauggagguuguuacuccuguuuuccuuuucaacaaagaguuccagagaguuguagagccagaauuugaacgaggcagucuucucauaggacuuguguuuuaauguacuggaggcucugcacuaacacaguuccgcuaagcucugucugaguucuuuauucugcugauacuuuucagcaaaggucuuuuugcugcaauaauuucuuucaugagacuuuccacuggugauuccuuuauccuuguuaaaaauuauccaccuuccuuccuaaggauauccuuuucccuuuacucuuagaaacucuucuaucuuaaaaaaaugguugguuauauguaaguauguagagaauaauguaacgaauccccuauccugucaucacuuaaccuaaaacaacaacacacaccagcuuuaguucauuuauuauuacuuuugauaaaauauauuauugaaaaauaguuuuuuuuuucuaaagaaaguaaaugauguauugcauagagauuuucauauguacuagaaaguacagugaccgggcaugggggcaugucccuuuauucccagcacugcagagguaggugacugugaauucaaggccaaccuggucugcgaaaugaaauucagaacauccagggaaacccuauacuguguuggggaaacaaacaaacaaacaaaccaaaaaaauggccuaguuuuaggaauuuuguuuuaucuugcacuguauuuuuaguacacugguaagcuggaaggaaguauagauacuauaggcauguaauuaauauuuuugugugcuuuaaaaaauuuaauguauaacugcauguacacguguguacuagaaguggguauaagauuucauuaugacauaguugugagcuaccauguaguugcugggaauugaacucaggaccucuggaagaacagucgguucucuuaaucgcugaauaucucuccagcccuaauuauuuuuuuauuugaaauuucauacaauauauucugaucauaguuucuccuuccccauccccuccuggauucuccccacuuccauacuuauccagcuccagguguuccuucuuuuucuccuuagaaaacaaccacaaccugcccucuugcauuacuucaaaccaggcaugguguuacuuauaaguaauugagaauguuaucuuuaaaaaguaaggauuuuaaaagucagaaaagcauuauaguuuugauuucuaccuauuugauugcugagggauuauuggaggaaauagagguacuuugcaggcagagggaguagcuugugcaaaagcuguaccacgugagugagguuuuuuuuuuuugggaggggggagcgggcucauugucaaacaguaucuauucaauguaaaguaaccccaggcccauggggaagaaaguuccaaggguaauagagaauaaugcagauuaaauacccacucacacauuuacucacguauacucacacauucauucucucucucucucucucucucucucucucucucucucucucucucucucucucuaaccauacauccagauuccagcagugauaagcaccuacuucuccuccagccugaguggcaccuggcaggaccucauaguuuagaaauggagcuccaggauggguccugauagcagccuuguccauccgugccccugccuugcuggagguuaaagcaaguugguaggaugccuaggagguaguugacaacucuuccccacucugcugcagacauuauuuggcucugaucucauucauggccucuucuauggagcaugugucccacuuguuggccacaggcacacagccauaggucuuguuggccuguagcauguaggcugcaucuuuggcugcuccuuugccaauacuuguccuguaguugcuggaagacucacaaccgugguucccugcugcgcugcaucuuccuccugcuucugagcuaacuccuuagcuucugcuucuccucagccuucugggggggucccaugccucucuaugacgguagcagucuagcccuucaucugagggugcaaacccuuuuuugaagaucaugguauagugacagucaucaucuucuccaaaggagaaggaugugaggccagcuaccucuaccacaucauguaguaugcuccacucucucuuucuuguucauaggcugaaacuuuuucuugaucuguucacuguccuggaugaaaccagacaccucuuucuccauccuuuuaugaaacuccacuuuuugcuguauaucuuucuugcucuuguaguuucuucaggcaggcagucugcucuccggccuuaccaauaggucugccaucuugggacugggugagaggggcgugagugaguuuguaauggaaggaauaaaauuuaccaggaguuuagcaagccugguaccagacaagagaugaaacuguagaaguaguauggauuuuaagucagucuaaggaauaguuuugauuuaguuuugaagguuggggaaagacguugcaauauuuaagugugauguaagaaguaauguacugggcuagagagguggcucacggauaaggcuguguacugcucuuguagagaaccuggguucaaauccuaguaccaauggaucacagcuccaggggcaucagaugccucuggccuccacagcaaccuguacacuaacuaaacaugauuguguguguuggggcgcgggggggggggggccgggggggaggcuggcaggacugaagugguuuucuuucuuucuuucuuucuuucuuucuuucuuucuuucuuucuuucuuucuuuaaacuaucuauacagacuucauuuucuuugguguuccccuuccucucucauuucuuucucuucccuuuaugccuucuauaaucuuaaauuuuauuauuuuuuaauguuggaccacuggcagggcuugaacugagguuguuuaaaaagugacuugggaauggauagcuggccuagcgagcacuuguugcucuuaaagaggaucuaucuggguuugauuucugcugcccacaugaugcuucacaaccaucuguaacaucauuuccagcagauccuauguccuuuucugaccuuucugggcaccaugccagagguacacaagcauacauaaaggcacacaauuaugaaccuuuaaaaaaacaaacaaaaaaagcauugauuguuaaggagacucuguuguugucuuaguaucaauguuuuuuauguuaccauacuaauaggaauaaaaauuuauauaaguguagguaacuacugaauacuaaacuguaguaauagacauguguuaaugagauagauaccauuaucccuuuucaacagaugaggcagaauauaucagggagaaauuucauuuguuuuuaggaacugggguuguggcucuuuacugaucauuuguuuagcuugcacaauauccucaauacuuuccucccaucuuaaauaaaguuacguuucuaguaagaagaaaacaucaagcuuacgcauucaucuucucuaauucacauacacuuaaaacacacacacacacacacacacacacacacacacacacacacacacacacacuuuuaaacuaucuuuccaccucagucuauacuuagcauguuucauagaauccccucugcucuagagcaagucucucauccuuggccaucauuuucucucaucauuuuuuuuucuaggguuucugguuuaguaacuguguaacuaaugacgugagagaguccucaauguagcuaaugacaauguuugauucuuaggagguaguuugauauuuuagaaugcucauagguuuagauagguucuucuuuggaugaacggaaucaguauaaucaguauacauaauacauauuaauagaaacuauauuggauuggucuaauacaacagugauaaucuguagaccggagagucaagaaccauuuuccaagucuagacaacugaaugacuuagaccuagaagucccuaaccauagcuugggagaaagcuuggaagagucuucaguccugguugaaagaaaggccucagaagguggagucuaaugccagcagguggcagaagugauagaugcaguaaaaggggcacguaggccccuggacuuuuauuuccccaguaagccuuugaaagauaccaugauuuaacccagugugccccucuguccccacucuagaauacuuccauagaugcacagauaaauuuuacuuccugacugugugugugugagugugagugcgcaugcaugccuacaugccuguuagggcacacauggagguaagaggacaguuuguuagaauugguuuucuuuaauauacggauccuggggaucaaguucagauuguugauauuagugcaaaagaccuuuaaucaacugauccacuuugcaaguccaaggaaaacauuauuaccguuauguuaggguuuuacuugguauguuuuacacacacacacacacacacacacacacaguauguuuauucacauaagcacacacacuguauguguguagaaaacaugcagaaaaaguugcuucucuucacauagggagaauagucauaaaagauuuauauguuauuaacuguaguuguauaugauuuuaguagaugcugaauaucaacauaauaaauaauuaaauaauucaucugaauagucuuuucuugguggacagggagaaaucucugcugguacccuaucauuuugaaaauuacauuccaguuaauuuguuuuuuguguauguggggagggcaaaugagccaugguacucacaugggaggucagaggauaacuugcuggaggugauugucuucuacccugugccuccuaaacaucaaaaugaaguugucaggcuugucaggcuuggugauggguaccuucaccauuugacuaucuugcaggucuuucauaucuauuuuuugaaacuuaacacuguauuaguuacuuuccuauugcccugauaaaauaccaugaccaagacaauuuauaaaagaaaggauuuacuugguguaugcuucuagggugguggugguucucaauugugggaugcaaccucguuggaguuuguauaucagauauuuauauuauguuuuauaacaacagcagcaaaacuaguuauuaaguagcagcaaaauaaauaauuuuaugguuggagguuacccaacaugaggaacuguacuaaagggucacaacauaagaaggcugagauccacuauucuagaggcuuagaauucaucaugauggggaagguugguagcuggagcaggaagucuagagcucaucaugugccacaaguguaaaguugagagcuaacccgauauugugccagucuuugaacucacgaagccaccuccagugacacaccuccuccaauaaggcuacacuuuuuuuuuaaagauauaaaauaauaauaauaaguuuuuaacaguacuaccuggagacuuuuucagaugcuuaagucuauaggagacauuucucauucaaaccaauacaaauacaaugcucaaaugaaaauccuucauuuaaugacuuuguuugcuuuauuauuuauucaugauaaauucucaucuugccuuccugggccaaagauuauacaaauucuaaugacuuuuaaaaagguguuuuuauguauguauguauguauguauguauguucauugauguuuugccugcauguaugucugugugaguguacuggauccucuggaaugggaguuauaggcaguugugaguugucauguggauucugggaauugaaccuaggcccucuggaagagcaucuagugcucuucuuaaugcugagucauuucuccagcuucucuaaugacuuuuaauaaugacaaauaucacuaaagaauaauuauagcaauuucuguucuuacuaagaauaaaugucugguauggugaaacaagccuucaaugccagagacaugaagcuuuggugacuuagucaguuuacuuugcugugaagagacacugugaccaaggcggcaacacuuauaaaagaaagcauuuaaguugugcuugcuuacaguuucagaggguuagucaauuauugucaugacagggagugugguggcaugcauggugcuagagcaguagcugagaacuacauucuccagguggagagguugagagagacugggcccuacaugggcuuuugaaccucuuccaagaaggccacaucuccuaauccuucuaauucuugcaaagcaauucacucucugguaacuaaguccauuuuuauucagaccaaacuuggcauuacagauuucauuucaaagggaaaauuaucuuuuuuacucaucuugaaaauuguagaagcuguauaauuuuaggaaaacauccucaucuuuuccaucuaaaaugguuauuuuuauguuucauaagucaucuaggagggaaggaucuuccagagguacaugggguggggggagauggaaagccaaacuuaucauuuguuuaaaagggccuuagguguuaaacuugggaguuggguauuuccuugcugugcuguagauaacuuuagggauuuuucuugcauuuuacucauuuuuagaauauuuguguugccacauggguauguacuacuaugcauguguagaggucagaugauucucuacuuccaucaugugagcaacucaacucaggucaucuggcuuggugacugugaccauuaaccucugagcuguuuuuuuuccugacccuuuauggauuuugaccacugaaaucaaaggcagaauugguaagauagcuuaggagagauauagauauagguacucugcaagagaagccagguaguggaaaguuucaggugauuguacugggaauacaauggaaucguugcugugugagauaguuccacccaaagaacaggcaaaaugcaauguacuacuaugaagaggucagaaggaccaaucaaauguugcuuaaagcuuucagcuuaaaauaccaggagguuauuucuugaaccaaaucuuaagacucauggagugucuaguccacuuuagcauuucuuuugaacaauagaccuuuauauuucuugugauuaagaaaauucauacguguguguaugggucuauguguuuaugccacuguguguggauccccacagaaaccagaagaguguaucagauugugugauuccuaauguaggugcugggaacugaacucaggcccuaaauaucuuuuaauauuuuauaguuucuauuuuaucauaaaaauaaagugaaaaauggaacucauauauuuaguaguugcugcauauagacaagagacuagacccuguucucuaaacuguugaccuggugaacuagcugauuucuuggcagaggcaccuccuguguuguaguguguuuagcagcacuaccagacucuacugacugaguugaguagcuucugcacuccauauuggggcaacaaacaacauguucagacauugccagauaauuucugggagaaaucaacucugcucccuaccauugagaaccaccauugaucaaaggcuaauaaauauaccuaaaagagugcuuggauggaaucaaguuuguguguuuuuuuuguuuguuuguuuguuuuuuguaaaugaaguguuaguuuuuggcucugaauuaaaaacagaagaaaaccaugguauuuguugcaguugaugaauaagauguccacugagcagcucuuucagaucuuaauuaaauaauuauuuuuucuguuggugauuaaaccugggaccuuguuuauguuagauaaauucucuacuacuaagcuguauugauugcucucaucuuuucuauucuauauuauuauacugauaaaauuaacuaacuaauuaauuaaggaagaaauuugggucacauuauguagcccuagaauuugcuguguagacuaggcugaccuuacgcucauaaagaucuaacugagagcugggauuaaaugaagguuugaacuaccaagucuggccacuuuuuguuuuuguuuuucuuuuaaaucuacuuaauuuuuaaaaaaauuacacuugacuuauuucugugguucuauguauucaugugcacauguaggagucagagaacagcuugcaggguucuuuuguuccuuuuaacauguggguccccaggaguugacucagguccucaggguuggaggcaaguacccuuacccauugaaugaucuugcuggcccaaucacauaagcuuuuaguaaauggaauuuucagguaucacuuuuaaauuuuacuaaauguagacuacagccuuuuaagagucugaacuuuguaaauaacuuauuagaaauacaaaagcuaauaauggauauagagggaguuuuggaaaaugucacuuuaaagaagcaaaauccugaauuaguaguuccaaacuuaagauauuuauuaacauggguuuguccuuacauucaggcuuuaaggaagaaaauaauuuuuauuacuuaauguguuauuaugcaagagaaagcucaaauguuauuugcuguauuugccaaguaugcuuuauaugguauuuagaucuaagucuuaaaauucaacauuuaucugggugugauaguccauggugcacaucucaguaguuaggaggaggaggaggaagcaauauuaggaguccaaagccaggcuggguuauaugugagagugucucaaaaaacaaccaagcaaaaauuuuauaauuugauuuuaugugcuuaauuaauuaguuaauuucuugcuguaggccucgaaguagaggaaaaucuacaguggaagaugaggacagcauggauggacuggagacgacggaaacagaaaauauuguggagacagguauuggauuuugaugagaguuuugacaaaauaaucaucuguacuuauuuauacacuauacauagcguuuguauagaaaugucuguguuagcauuugucuguauaugaaacucucaagucauccaucugcuuaaauuauuugauguguauugauagagugaaaaacuaagguugcuuucucaguuuuucccuugagugcuuauuuaguuugaauuauuuuguauacaugaaugucuuuuauugaaacaaauacaauuuuuuuaugucuuuaguauauuucugacuugugaaccauuaaguauauguuuaaucugcuuuguuuaauaugaauauagaggaaaaugcuucauuagugaaugguauuaugaaguccuggguuaaucuguaaacuucuguguacucagccuuccgauaucuuaacauacagguaugcauuguguacccacaagaguagauaaguaaaauaccaaaaaucauuccaaaauccaacaaauucaugauuuaguaaguuguuggccucauggccugaguagaagaugacuggguagucugccagcugugcuucccacgugugugugacaccuggacagcauucugcucuuugcuguucaccaagaugaguauuauccuuuuuuuuuuuuaaaagauuuauuuauuuuauuuuuaugagucauuguaccugucuucagacacaccagaagagggcaucgaaugcuauuauagaugguugugagcuaccaugugguugcugggaauugaacucaggaccucuggaagagcagucagugcucuuaauugcugagccaucucuccagccugaguauuaucuugauguauaaauaaucucauaaaguuucuuagaaaaaauugaaagguuacuucaucuuuucuaaaaaaaauuuuuguguuuguaugagauuugccugcauauauaugugugugcacaggguagccaaggaaaucagaagagggugguggauuuccugguacuggaguuauagguagaugucuguuuuaguguggcuguuuuggccaucaaacuuggauccucuggaagaacagucagugcucuuaaccacggagccauaucuccaucccuacuuuaucuuuuuuaagaaaaguuauugcgugcgugcuugcgugccugcgugcgugcguguguguguguguguguguguguguguacaacuugggaaguuuucuccuucuauaugaacuguggggaucagacuuggcagcaagcucccaagauauaagauacaauuucaaaacacaugaaacucaagaagaacgaagaacaaaguguggacacuuugccccuucuuagaauugggaacaaucacccauggaaggaguuacagagacaaaguuuggagcugaggcaaaaggauugaccaucuagagacugccguauccggggauccaucccauaaucagccuccaaaugcugacaccauugcacacacuaacaagauuuugcuuaaaggacccugauauagcugucucuugugagacuaugccggggccuagcaaacacagaaguggaugcucacagucagcuuuuggauggaucacagggcccccaauggaggagcuagagaaaguagccaaggagcuaaagggaucugcaacccuauagguggaacaacauuaugaacuaaccaguaccccggagcucuugacucuagcugcauauguaucaaaagauggccuagucggccaucacuagaaagagaggucuguuggucaugcaaacuuuauaugccccaguacaggggaacgccagggccacgaagugggaguggguggguaggggagugggggggaggguaugggggacuuuuaggauagcauuggaaauguaaaugaagaaaauaccuaauuaaaaaaaagcuguagacagaugaugcugaaauucagggggaaugaaaggaagaauaaaucaugucuuucucucucuucuuuuuaaauuggguauuuuuuuuuaauguuuuugacuuauauacuaguucacauaguauuauccauuuccacacacauuucuggagauggaauaauauuuuuuucuguuacagggucuagcucuauagucuugguuagcuucaggucacuauauagcuaagauuggccuuaaacuugugauccuguugucuucccgucuugagagcuagagucacagccauggcuggcuaguuuguuuuuauuuaaaagaaguuuuauuaugcauguacagaugcucucccuguguguauguuuggguaccagugcagugccuguggaguccagaagaagguauuggguucucuagaacuggaauuggaaaugguuguaacccccuguguagguauuaggaacugaaccuaagucucugcaagagcaaccauugcucuuaaccauugaaacauuuaucauugaucuuuauuuuuuauucuuauuucuauacuauuccauuuuauauguauaucuguuuauuacucauuggcugauucuuuuugcuauuuguggauuguauucuuauuaaaauaacagaauagauaccuuuucuauguauuaauuuaauuuaauuuggauauauacccaauaauggguuugcuggauuauaugguuauucuauuuauaauucuguugaucgauauacuuauuuuuauuugaaauacaggauuuuugcuuuguugcacaggcacuuagggucaagugauccuugaugucaguauuagaacuauagagauaugggauugggcauuugcaacugcaugaggcuggugugcccccuccuuaccucccucucucccacguucccuccuucccugucucaguguuucaagaaaauguuucucaguguagccuugcugaccuggaauuaauucuguagaucagguuggccuguaaucauagagauccaucucugccucccaagugcugggaucaaaggcaugcgccaccacugcccuaccauguggcuccccccucccccuucaggaacauuacuuagguuuucuauaauaacugaacuauuuuucaagauuuauugauuuuuauuuuauguuuauaaauauuuugccuccauguauguaaguguacguuguauaagccuguugcccucagaggucagaagaggguguuggaucuccugaaaugggugauagauaaguuucccugugguacuggggauuagagcagucggcguucuuaacugcugagccaucucuccagucuuuguguguguguguguguguguguguguguguguguagaacaugauuuuaauauuuucaacuguuaauauucaacaaacagaauaguuauuuuaagauauauuucauaguuauaucuccuuuucauuucugauuucauuaaauauaauacuguuucugugcccucugguuagucuggcuaaggguuuaucuagcuuguugauuuucucaaagaaccagcuccugguuugguugauucuuuguauaguucuuuuguuucuaucugguugauuucagccccaaguuugauuauuuccugccuucuacuccucuuggguguauuuguuucuuuuuguucuagagcuuucaggugugccuucaagcugauaguguaagcucucuccaguuucuuuuuggaggcacuuagagcuauuaguuuuccucuuaccacugcuuucauugugucccauaaauuuugguaugacaugucuucauuuucauuaaauucuaaaaugucuuuaauuucuuucuuuauuuuuuccuugaccaagucaucauugaguagagcaaccagauucuauguguaugcgugucuuccauuguuuuuguugguauuuaagaccagccuuaguccauggugaucugauagggugcaugggauuaugugaaucuucuuguaucuguugaggccuguuuugugacugauuauauggucaguuuuggagaagguaccaugaggucugagaagaagguacauucuuuugcuuuacgaugaaauguucuguaaaugucuguuagauccauuugguucauaacuucuguuaguuucaccgugucucuguuuaguuuauguucccaugaucuguccauugcugaaaguggggcauugaagucuccuuauuauuauuguguggggugcaaugugugcuuugagcuuuaguaaaguuucuuuuaugaaugugguugcccuugaauuuuggagcaucgauguucagaauugaagauuuuuccuuugacaaauaugaagaguccuuccuuaucuuuuuugauaacuuuugguugaaagucgauuuuauuugguauuaaaacggcuggcuacuccagcuuguuucuugggaccauuugcuuggaaauuguuuucuagcccuuuacucugagguggugucuaucuuugucacugaggugcguuuccuguaugcauuaaaaugcuggguccuguuuacuuauccagucuauuagucugugucauuuuuuugggaauuaaguucauugauguuaagagauaccaagggaaagugauuguuacuuccuguuauuuuuguuguuagagguaggauuaucuuugugugccuaucuucuuuuggguuuguugaaagauuacuuucuucuuuuuuucuaagguguagcuuucuuccuuguguuggaguuuucuaucuauuauccuuuuuagggauggauuuauggaaagauauguaaauuugguuuugucaugaaauaucuugagcuguaggaagugcacccagaacucgguucuccccccccccccaaaaaaaaaaucaggguuaaguuuaggguuagguaaucuaugcuaauugagaguuuugcuggguauaguagccuaggcuggcauuuguauucucuuagggucuguauaacgucuguccaggaucuucuagcuuucauagucucugguguaauucuaauaggccugccuuuguauguuacuugaccuuucccccuuacugcuuuuaauauucuuucuuuguuuaguguauuugguguuuugauuauuaugugauuggaggaauuucuuuucagguccaaucuauuggggcuucuauaggcuucuuuguauguucaugggcaucucuuuucuucagguuaggaaaguuuucuucuauaauuuuguugaagauauuuacuggcccuuuaaguugggaaucuuuguucucuucuauuagccuuaccuuuucguuugaucuuuuuguuguggccugcauuuucuggauguuuuggguuaggagcuuuuggcuuuuugcauuuucuuugauauugugucauucuuuucuaugcaucugagauucucucguguauguguuggugauucuugcaucuaugacuccugaucucuuuccuauguuuucuaacuccaggguugucugucucccuuugugauuucuuuauugugucuauuucuauuuuuagauuuuggaugguuuugcucauuuccuucgccuguuugauuguguuuuccuguaauucuuuaaaggauuuuuguguuuccucuuuaagggcuucuagcuguuuaccuguguucucuuguauuuuuuuaagggagugauuuacguccuucuuaaaauccucuaucaucaucaugagaugugauuuuuaaaucagaguuuugccaaguugaugccaaguaaccuugguuucuguugcugauguucuuaugcuugccuccaccaucugauuaucucuagugcuaccugccuuugcuauaucugacugaagucugucuuuccugugauccugguugugucagaacuccucagaguucagcugucucugugauucugugauccugagauccugggugugucagagcuccugggagucaagcuaccucugggacccugagauccugguguggcaaaacuccugggauucugggauccagggauccuaugguccugugguccugugguccugggcguguaagagcuccugggagugggucuucucugggaguugugggacuggcuacagaauuagugcccaaggucuacucagggcaccaguccagacuggaagacccaucucuccagucuuaagugggcuaauuuacauucuuacuaucagcgcauaugaggacagucuuuuaucuuaacaccagucauuuuugucuuauuauuuuuuauagcuacuugggaggaugagaugacauuuugugguuuugguuuuuacuucuaugaugagauauuuucuuagacauucucugucauauaacacacccucuucuugcuuuugaguugaaugucuuacauauguugcaaguauaucacuuauuaaugaauaauuuguacuucacuucccauucugcagguuguucaucuuguugaugguuuccuuucuuggacagauuuucuuagaaaccuuauuaguuaaguuuuugcuuuaguuguucuuggugucuucuuuccccccuccuccccaugggcuuuccauaucuaaagaugucuuugugaugaggggugauuuuugaagcgcuucugcacuuuuaauaguuacaaaguuuuggguuuuauggaaugauaugacccaacuguacauguuuagaauuaggggccugcuuuauuucuucugcauugcaugcucacuuuguggagcaucuuccuuuccuuuccuuuccuuuccuuuccuuuccuuuccuuuccuuuccuuuccuuuccuuuccuuuccuuuccuuuccuuuuuuuuaaaaaguuugugugugaggagauacuguuuauagcucaguuuggucuagaacuuacaguauuaguuccaucccucucaaguucugaauuacacccuaccuacgaguuguauauuuuaaagucagguauuauaguucuucuaggucaugugucccuaucccucuauaccccuaucugcuuuuccacaguuucaggauuguuuuaccuucugaaggcauucauuuauugagucagggccucauauauagccccguguggccuggagcucccuauggguaccagacuaggggcaaauucauagagauauaccugacucuacuuugguuugaagcaugcaccaccaugccuggucuuuccuuauauauuuuguuauuaacuuuucuuguuccuugaagaaaauuguucauauuuugauagaaaauugcauucaauugauguguugaucaauuugagcuauguuguuuuuuuaaaaaguauaauagauuuuuuucaugcaauauauuauguuuucccuucccccugcuucuaucaguuccuucccaucuccccucucauaccuaaucuucaagcuuucuaucucucagaauuacaaacaagccucuaaagaauagcaauaaaauaaaacaaagcaaacaaaucggaauagaacaaaacagccaaacaagaaaaagccuaagaaagagcaaaagaaaugcacauagauggagagugcagacacuacacacuugcucauagaagcuguaauauauacacaaaguacuuguaauuuuuuuuuuuuuuuuuuuuuuuuuuuuuuuuuuuuugauauaggguuucacuauguagcucucucuggccuggaaauaacagagauuugcgugccucugccaccuagugguggaauuaaaggcaaacuaagguccuguaauuuuuuuuuuaaagcccugacguguguguguguguguguguguguguguguguguguguguguguaagaagcgucuacuguauuaaguuucauacaauuucucaaauggcuuuuggcuuuaucugucccuccuucccuuccuuuacuucuuuuuauuugaucauccuguuccaaucucuucccuacccauccauaaauauguauucaauuucccuuuccugcagaguauccccccccccucccggcuauacagauugaagcuugcuuauaucagugauuuaacggcuagcaucgacauauaagugacuauuugucuuuuuagguaugaguaauuucacucaagaugauuauuuucucuugucaacuuaccugugaauuauauauauauauauuuuuuauuagguauuuuccucaauuacauuuccaaugcuaucccaaaagucccccauccccccccccccccauucccacuuuuuggcccuggcauuccccuguacuggggcauauaaaguuugcaagucuaaugggccucucuuuccagugauggacgacuaggccauuuuuuugauacauaugcagcuagagacaugagcucuggggguacugguuaguucauaauguuguuccaccuauagggaugcagauccaucuagcuccuccauugggggcccugugauccauccaguagcugacugugagcauccacuucuguguuugcuaggccccggcauagucucacaagagacagcucuaucuggguccuuucagcaaaaucuugcuaguguaugcaauggugucagcguuuggaagcugauuaugggauggauccucggauauggcacucucuagaugguccauccuuuccucucagcuccaaacuuugucucuguaacuccuuccauggguguuuuguucccaauucuaagaaggggcaaaguguccacacuuuguucuuuucuugaguuucauguguuuagcaaauuguaucuuauaucuuggguauccuaaguuucugggcuaauauccacuuaucagugaguacauauugugugaguuacuuugugauuggguuacucagggugaugcccuccagguccauccauuugccuaggaauuucauaaauucauucuuuuuaauagcugaguaguacuccauuguguacauguaccacauuuucuguauccauuccucuguugaggggcaucuggguucuuuucagcuucugucuauuauuaauaaggcugcuaugaacauaguggaacauguguccuuguuacccauuggaacaucuucuggauauaugcccaggagagguauugugggauucucagguaguacuauguccaauuuucugaggaaccaccagacugauuucuagagugguuguacaagcuugcaaucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucagcucugagccccauuuuuuagugggguuacuugauuuucuggaguccaccuucuugaguucuuuauauauauuggauauuaguccccuaucugauuuaggauagguaaagauccuuucccaaucuguugguggucuuuuugucuuauugacggugucuuuugcacugcagaagcuuugcaacuuuaugaggucccauuuaucgauucuccaucuuacagcacaagccauugcuguucuauucaggaauuuucccccuguacccauaucuucgagguuuuucccuacuuucuccucuauaaguuucagugucucugguuucauguggaguuccucaauccacuuagauuugaccuuaguauaaggagauaggaauggaucaauucgcauucuucuacaugauaaccgccaguuguuccagcucauuuguugaaaaugcugucuuuuuuuccacuggaugguuuuagcucccuugucaaagaucaagugaccauaggugugugggcucaucucugggucuucaauucuauuccauuggucuacuugucugucauuauaccaguaccgugcaguuuuuaucacaauugcucuguaguacagcuuuaggucaggcauggugauuccaccagagguucuuuuauccuugagaagaguuuuugcuauccuagguuuuuuguuauuccagaugaaucugcugauugcccuuuguaguucguugaagaauugaguuggaauuuugauggggauugcauugaaucuguagauugcuuuuggcaagauagccauuuuuacuauauugauccugccaauccaugagcaugggagaucuuuccaucuucuaagaucuucuuuaauuucuuucuucagagacuuaaguucuuaucauacagauuuuucacuuccuuagagucacgccaagguauuuuauauuauuugugacuauugagaagggugguguuucccuaauaucuuucucagccuguuuaucccuuguguacagaaagccauugacuuguuugaguuaauuuuauauccagcuacuucauugaagcuguuuaucaggcuuaggaguucucugguggaauuuuuagggucacuuauauauacuaucauaucaucugcaaaaagugauauuuugacuucuuccuuuccaauuuguauccccuugaucuccuuuuguugucuaauugcucugccuaggacuucaaguacaauguugaauagguagggagagaguggacagccuugucuaaucccugguuuuagugggauugcuucuagcuucucaccauuuacuaccugugaauuuuaugaucacauuuaaaaaaaacccaaacuaccaauucauacucauuucuuuuggugccuuuguggccaaacacuuaaagagcauaaaccaagaaaguugcauugaaccauuagcagaaaguaucacagauccuuguaaggccgaaaugggacucgcuugucaaacaaagaggcugggauggguuuguggaguucuuccacgcacaggaccuagaaggcggcaucagaaauacgcugcuggcuuuuguggguguuacuggaguaggggcuguucuggcacaucugaaaagauauccuugugagugcaguaggggacucuuaaaacuccagccaccaaacuacaugcaucugaaacauguauuuaugaagguggacuugaagcugcccaguucuacuguagcaacauagcaaaaagaaauucgcuacaggauugucgcuaacaagaauaaauacaugggaaaagugcacccucuggaggagucacugucugaaugaagcagaguucccucucagcaaaguuugagaugccauggaggaggacuucuagaaugaaugaaagugguggauggaaagguuugauaucugugucuagagauggaagaggggccagucaucaggcgaaucacagaguucaauaaauauccauuacuguguuuagaguguugagagagaagcccuaauuaaccacauuggugacuuguguaaaauggauuugguaaccuacaggucaccaaacaaugacuagaagcugcagugcuguacaagaaugugaagggaggcacccucugagcaguccaggguaugcuucuugacaaaguccaagugcucaggacuuuuagaccugucuacuuuggcuugguuuggaugauucuuaaguuuauuagccuagugauggccaaauaguacuugacuuaagguucacuaauuaguuacaaaacugaacagccucaauuuuuaagaaaacuuaugcaauguauuugucuguaaauauuguauauauuuuuacugaaagucuguuucuuugaacauaagagggaagucuuggguuuaguuuuuuuccauauccuuuuuuuuuuguagcuucucuaguuuagaaauguauuucuuacagcuuuuuaagacuuugucauucauucuaguauauaugcagaacccguuguguguguggucugguuguaguagaacaaaucagauuuauaacuaugcaggguuaguuauccaaucuuuuuuuuuuuuguauuuagggaucacagauguaagacauuuuaucccuuguugacuuacuaaauuguaagguguuuugguaaaacaggcuagcuagagucuuaaccauggugcuauucacuggguuuacuuguuuaacauaaguuuaugccugaugucaauaaaacaaauacauauuucuuuucuaaaaaaaaaucauacucaauugaguaaauguaccacauuuucuuuauccauucauccauugauagaaaucuagguuuuuuccaauuucuggcuauuaugaaugaagcagaaaugacugguuaagcaaguaagugucuuugugguaggaugaagcauccuuuggguauacaccuaaaaauguauagcuggaucuugagguagaucaauuccugucuuccugagaaacccaacccugauuuucaucauggcggcacaacuuugcauucucaccagcaauggaggaguguuugcccuuacucuccaugcaugauaaucauuuuguuuuuauugaucuuagcuaucaugauuggaguaaaaugaaauaucaaaguaauuuugauuugcauuucccugauaacuauguguguuucuuuuaguguuucucagcuauucgaguuuuuccuuugagaauuuucuguuuagaucuguaugacauuuuaaaaauuguuauuuguuuacaugagaucuguuguuuuuuguuuuuuuuuaaguucuuuauauauuuuggaaauuagaucucuauuggacauggaguugguaaaauuuuuucccuguuccuuaggcuacccacuuugucugacugacaguauccuuugccauucagaaguuuuucaguuucaugaggucccauuuauuaauuaugcucuuacuaccuguacuauuguuuuguuccuaugcuaaugaguucaagacuauuccccacuuucucuucugucagauucaguguauuuuuuaaauaauauuuuuaaauuuuuuuauacucuagauuuuauuacccuccugguccacucucuugacuguucagcaucccauaacuccucccggcccccuaucuucaagaggauguccccacuccugaccccaccauuccucuaaauuccccugggcauccagucucuugaggguuagguguaucuucucugacugaacccagacccagcaguccucuguugcauauguguugggggccucauaucagcugguguaugcugccugguuggugauccaguguuugagugaucuuggggguucaguuuaaucgaaagugcuagagcaacccuacaggguugcccuucuccugagcuucuuucagcauuuccuaauucaacaacaggggucagaugcuucuguccauugguugggugcaaauagcugcaucugacucuuuaagcugcuuguugggucucucagagggcaguaaugauaggcccccuuuugugagugcuccauagccucaguaauagugucaggccuuaggacuuccccuugagcuggaucccacuuugguccugcugcuggaucuucuuuuccucaagauccucuccauuuccaucccugcaguucuuucagacagaaacauuuaugggucagaguuuugacugugggauggcaauucccucucucacuugaugcccugucuuuuuuuuuuggaggugggcucuacuauugggcauuucauuuaagaucccucccuuugaguccugggagucucaccucccaggucucuggugcauuuuggagggucccuccaaucuccuaccuccugagguugccuguuuccauucuuuuugcuggaccucagggcuucaguccuuuucccccacccaauacuaaaucagcacccccccaacucugcaccccuguccacuuucccaccuaggucccucccucccucuccccuugugauugcuuuccucucccuccuaagugggacugagguguccucacuugggcccuucagcuuauugaccuuuuugaguucugacuuuuuuuuuucuuugcuaauauccauuuauuagugaguauauaccaugcauguccuuuugggacugaguuaccucacucagggugauauuuucuaguuccauccauuuucacgcaaaacucaggauguccucguucuuaauagcugaguaguauuuaauuguguaaaugaaccacauuuucuguauccauugaucuaggggacaucuagguuguuuccaguuucuggcuaucacaaacaaggcuucuaugaacauaauagaacaugugcccuuguggcaugguagggcaucuuuuggguauauucccaggagugguauaucuaggucuucagguagaucuauuuccaauuuucugaggaaucuccagauugauuuccagagugguuguacuaguuugcaaucccaccagcaguggaggauugcuuucuccacauacucaccagcaucugcugucaccugauguuuugaucuuagccagucugauugguguaagguguaauuucaggguuguuuugauuugcauuucucugaucaccaaagacuuuaaacaauuucuuuaagugcuuuucagccauucaagauuccucugaugugaauucucaguuuagcucuauaccccauguuuugauuggguuguuugguuuuuuggugguuaguuucuugaguucuuuauauauuuuggauauuagcccucuauuggaugugggguuagugaagauuuuuuuucccaauuuguagguugcugauuuguccuauugaauauguauguccuuugccuuacagaagcuuucgaguuucaugagaucccauuuauccauucuugaucuuagagugugagccacuggaguuccuauuuagaagauuucccccugugccaaugaguuccagucucuuucccacuuucucuucuauuagauucaguguaucugguuuuauguugugguccuugauccacuuggacuugaacuuugugcaaggugacaaauaugggucuauuuucauuuuucuacauucauccagccaguuagaccagcaccauuuauugaagauauuuauguugaguuauuuaaucugucuguagcugaguuuucugcaguguaaugaguagaucuauuugcguucuucuacaugcagccaccuaauucgaccaguaccaucugcuaaagaugcugucuuauuuucaguguuuucuucugguuucuuuaucagaaaucaguuguccauagguguguacuuauuucugguuguuuaguucuauuccauagaucgacuugucucuuuuuugugccaugauguuuuuacuacuauaaaaguacaguuuuagauggggcauggugauaccuccugcaguuauucuguuauucaggaacguuuuagcuauccugggauuuuuuuguguuuccauuugaagcugaaauuuguucuuucaaguucugugaaggauugcauuggguuuuaauggagguugcauuguauuuguucauuguuuuugguaggauagcuuuuacuuuauuaaucacaccaauacaugggaacaugggacaucuauucucugauagucuuuucuucaauuucuuucuccagugucuuaaaguuuuuaucauacaaaucuuucacuugguugguuagaguuacugauauuuuauauuauuugaagcuauugugaaagguguuucccugauuucuuuuucugucuguuugucauuuguacauaggaaggcuacuaauuuuuguuagugaaauuuuuuuauccugcuauuuacguguuuaaucaguuauggguguuuccugguagaacuuuuagggucacuuaaaguacacuauucauaucaucuacaauaaagauacuuucaauucuuuccuucuauuuauauccuuuuuaucuccuucaguuucuuauugcucucccuaagacuucaaguacuggauucaguagguauggagagaguauuccaguuaguuuuuauauggugaguauauauugauuugcauauguuuaaucauuccuguauugcagggaugaaaccugcuugaucaugguagaugaucuuuuggcuguguucuuggauucaguuugcaaguauuuuauugggaauuuucacaucuauguuuaauuaugaaaaaucauuguauaauucucauucuuucuagguucuuuaugugguuuaggcaguuacuggguccucauaaaaggauuuuuguuguuguuguuaaauaauuugaggcauauugggguaacucuuuuuugaaauacugauagaagucucugccaaaagcuaccugacccuggguucuuuuugguugguagguuuaauuacagcuuauauuuaacaaaggauuauagcaauuuaaacaauugcuuaccugauuuuauucaaaaauuuuagguaguauauauauugagaaauuauuuauuuuucaaauagauuuuccaauuugguagaguacagguuuuuaaaauguaucuuuaugauucucuggauuuccucagugucuguuauuaggucugaucuuuugucucuaauuuguuaauguggaucuucucuccaccuuuuaauuaauuuugcuaggggugugguggucuuacugguuuucucaaagaaccaacuuuuuguuuuauugauucuuuauauugauuuuuuuauuuguuccaauuuuauugaaucagucccaaauuugacuauuucuugccaucuacuccuuuuggguguuauuucuuuuuuguuuuaggccuuucagauguacuauuaaacuacuaaaaccagaugucgcucucuuucuauguaggcaguuaauugugucccauaacacgggccauguuuugcuuucauuuucauccaauucuagaaaguuacuaacuuuauuaacuuuuguccggacccauuuuucauucagugaugaauuguucauuuuccacgaguuuguaauuuuucuguuuuuuauaucuggcauuaaucuauguugucgggauaggacacaggggauuauuuuguuuucuuguaucuguugagauuugcuuuguguccaaguaugcggucaauuuuggaggugcuaagaagaagaagguauauucuuuugaguuugggugaaauguucuguaaauauuucuuaggaccauuugguuuauaaugucauuuagcuguggcauuuccuuuaauuuuugucacuaucacugugugagggucauuuaagcugauuuaagcugaagcaguguuuccucuaugaacuugggugcucuuguguuuggugcauagauguuaaggaucacaguacccuuuauauggaucaacggcaugggucaccuucacccaccuuugagaaauguuguauguaugcuuuuuagugauauugacuuguagugccuuguaugcuaauguuucuuauccauacuuuuuuaaaaaacagggcaauugaagucugauaaaaggaaccuagaagaaucccccccucccccauuuagaauugauaaguaauuucaaaaaaauugauacuuguuuuauuuuaaaaguuugguucuaggccuugauagauuuuuuuuuucccugauugagaaacauuuaauuuuuacuauugaucuguugugauauucuaucaugguucacuuuuagccgacuauauguuuagguuucuuucccccaugaaguuguucuuaauaguccuaguaauguuuuuuucugcugucagcuguguaauauaucuguuuucauuucuuguucuauauucuuugauuccuuugauucccuccccuccccuccccucuccuccccccccccaucccucuccccuucuuugcauucguaugucuuuuuuggauggaaucuaguuguacuuauacucagcuguacucaccaggccugucagcuguggcaacauuccuacucuuguuuucuccccugccuguccugguggugggggccaaugagccugcagccuuccuccuccccauucucuacuuccucccccccccccaccaauucccuucucuuucuugucucuauuuuauuauuuuaugcucugaugucuggguuuguuuccuucuaucuugggguuugauuuguucugcuuguuugcuuguuucuaguaacaugaauacccuaauuaguuuuuuguuucucuuuuucuucuggugauggggagguacugguugcuacaaaucucucuuaguucuuuugcugaacccacuagguuuuucucugcuguuuucauugucucaagaaaaauuuaaauuuucauuguaaauaacuuguaaauuuucuuuuuuauuuauuuuaagcuuuauuccacuguaguaaggaaaauucaugcuacacccuuauuuauuuauuuuauuuuuucuguuuucugaugcuuguuuugggacauggucuguccuagagacaaugaauguguauucuagaggugauggaugguauaauaugcaaaugucuguuauguuuauaauuuaccuuagauuuuuaaagugugggugugucgguguguauguguacauaugugcaugugccauguguaugaguaccuucagaggcuagaagaauggguuagauuaucugaagcuagaguuauauacaggugacugugagccaccuguugugcaugcugguaaauaaggcacugagcaucuaacauggcuaucauauauuaugauauguuauggucucacucucucuuccucccuuucccucuccaucccugcccccccccccauguuuucugugggaaugguuuauuccauagcccaggcuggccugggacuuauuacauaccugacacuggccucaaacucaaggcagucuuuuugcuuuagcuuucuuuggcuugaaauuguuauguacagugcaugucucgaugacuguucugucacuaaauaaucuuucacuguuaaaucauccaccuauugauaauuucaaagguuuaccacauagaccuacagacaacauauuuuguuuuagaauuuugguuuuugguguggccauauuuuaaaccaauuuggauaaauauuaaguagcauaauuguuggauuauaugauuggaauuguuuaguuuuguaaauaccccauguagugucaagugucuguaccauuuugccuucucaucagcaguauacuguggguauaggauauaguucuucacuuauuuacuauuaauuuacauguguuuuuucaaaguagguuuguucuuagcacuauauaguuggcucauguucuuaauccauuugacaacuaguacauuuauauuaaauaugaugaaagugauucgucuuucaauaauuaauuuuauuuuuacacuuaaucuuagacaaaaggccgagaagugauuaauuuuauuuuuaauuauguguaugugugucugugucaguauguacacaagacaccagagacaucagaucccucuuuugagcugguguuauguuggugguugugagucacccaacauuggugcugguagcugaacuuuagucguaugcaaagauucuuaagucucuuaaccuuacucagcuaucuuucuagacccauagcaauucuggcuguaacugaugaugcuguccuuugccuuuuaugguuuuguuuguuuguuuauuuuucuccacuuugggaggcaagaucucucuucucucagccucccaauuagcaguauugcaugcuuugccaucuuuuacagcuagcucuuuuaauugaacauuuuauuuucucuuagcaugucauauagcccccauugcugguuuuccuauagacuguguauuaauacaaaacugugugcaugugucugugugugcacacauguguaaucaugcacaccuauaagugugcuuguuugcauauaugauggccaugacuaccugaaugcuaaauaggaccuguggauccaaauuccaguccucauguuugccuaauaaacacuuuguccacugagucaucuuccuaaucccuuccaaguucagcuuaaaccuucuauugugguaaaguucuuuccugcuuuuguaucaguguugacaauuauuucacuugugaaauacacacaugcaaauacauaaugcaaugagcaaaccucuaacuguagauuaaucaagaguuuuaaaaacauuuacuuacacauuuugcauuugagauacugucccuuuauguaguccuaaauugcugaguguucuaaagauuuuuuguuguuguuguuguuguuguuuuuugagacaggguuucucuguguagcccuggcuguccuggaacucacucuguagaucaggcuggccucgaacucagaaauccaccugccucugccucccaagugcugggauuaagugcgccaccacugccccgcucaagaaguuuuuacaauucugcaaauuaggcuagacaguggcaacagucuucucaguuuauauuuucuuucucacagcucguauucuucuuuuuuuuuuuaauuucaauauuuggagguuauuaaaaauaaagauauguucuuuucuacccagaaucuaggaccucugauuaagucagucuuuaaaauucauuacaaaguaggaugcuuuccaguaauguacuguauaguguggugagggagggcaugcuugaacucugauguauuuuauaagaggcauuuauagucaaauaugcucuaaugucugugaauuuguugaauacauuuguagacuucauucagguuuuaugguuuaagccaggaaggcccagacuuguuauauaguccaaucuagcguugacuuccuuaguuuauggguauguaccaccacaccuggcguaagaauuuuuuugcuuuuuaaggaaauuauuuuguaacugguugaaguaaaaguguuuuauuuccuuuaacuuagguguuuucucuuauuugauaguacuuaaagaaugagaguaaaacuuguauuuucaguauuuauuuuaguuuuuauaguacaaaaaugauuccucagaaagcagucccaauaaucuuguuaacaaaauucguguuagagggugccugcagugaaaaaguguacaaacaaacccaggcuuugaagcucaacuuugagacuugauucuuugucauaugggaagauauguguuuauaaggguguguacauauauaugugggguuagugugugcucuugcacaguaaaguacacguggaaaucuaaagucagugccaguuaucuucuucagcugcucuucauuucacuuuuuaaggaauuccuuaacaauuaauuaguuuuagugcagcugaagacagucauuuuucuguguugagugucuauucucucuaggagucuacuugucacuucccuccugguucuggauguacagauggugaaccccuagcuuuuuuuuguggguacucgccaucugaauccaugcuggcaugaugaucacauugcugacugagccucuugauccuuauuuuuaaaaugaauauccucuggcagagacugcuccuuuuuuuaaaaguggggagucagagaucugcuagucaauuuucauaucauugggcuucugcucuuauuaagcacacuaucuacuucuuccuuuaaccucauuauacuaugcacauacuaaaauuuaucuuauuuaaauuuuuuuuuaaacaguguuuccuuuauguaguguuggcuguccuggaauucacuacauaggccauacuggccucaaacugauagagauccaccugccucugccucuagaauacugggauuaaaggcauaugcuauuauugcccauuaugauuauuuuauuuuuaauuauuauauguguuuguguuaucuguguuugaguauguggacaugaguguauuugccaucagaugacagaggcacuggaucucccagaguuggagugacaggugguuggaagcuuuugcuuuaaccucugaccaaucucuccagucuccaugcaugacccccuccccccagcacacuccccccacccccaugguuuuuccuuuuuuucuuuuaaaagauagggccguaggcuaggcucaaauucacucucccuccugagugcuggggcaauaagcauggcugguuuaguauggugcuaaggauuaaauacaaugcuuucuguaugcuaggcaaauacuauauuaaccaagcuacauucccagcuuaaauaagcauacuucugucaugucaguuacuguuccugcuaccauuuucucuuucugaaagagauugauugauugauugauugauuuuaaagauuuauuuauuaauuauauguaaguacacuguagcugucuucagacaacccagaagagggcaccauaucucacuauggaugguugugggccaccaugugguugcugggauuugaacucaggaucuucagaagagcaguaaaugcucuuaaccgcugagccaucucuccagcccccugagagagauuuaugaagacuagguaucuacuuuauuuguauacaguauauuguauguaguuauaaucuuguuauaaauaguugguauaaagaaaugaaauauggagcuaaagagauggcucacagugguugaaagcacuggcugcucuucuggagguccugaguucaauucuuagcaacugcaugguggcucacaaccaucuuuaaugagaucugaugccucuucugugugucugaagacagcuacaguguauucauaaacauaaaaauuaaauuauuuuuuaaaaagaaaugaaguguuaacuucuuagcacaaagaagucaggaguguucuuucuguuacacccuaaacuauuuuuagauaauuuguggucguacaucaagagccacagguacaauucauugaguagcuguuuaguauacaugaggaagauaagcuguaggugagaugagcaagacuauauagaccauacugcgugaauguguacagccagaauagcaacuguguacucauacuuaauaacaacuucauguuuacacuuggauucaugcauuauauuuuuugaucugaaggauagcuuuauuuuaggaggcauuaucuauuugauuuugaaaacaaaccaaaguucauuaacuugucaugguccuaugguccauggcugaguuaaagaugucugucuguuguggaugauuagauuuuuaagccauuguugacuuaaacuuucucuugucuuaaaccuaauucuuuaggguucaucaagaguuguggugguguuaaaggguugaaaugauguauaaguacaugaaguuagaggucagauuuaauuuucuuuguaucuccuaaaugccauauaaccagugauauuucaugaaguauagauacuuaaguucuuuuagaagcuuccuuauugggaauuagguucuacuguagucuaguuacauggcacaugugccaccuaguggcuagaaaauuaauuaggcgcucccuccuccccuuuuggcuauagagaauuuugugacuaaguggaacugaguauuuuuauuuaggcuggguuuaaaguugggaagugucuggcuucauuucuguuguugggauaauaccccgacuaaggacaacguagggaagaagaggauuuauuugacucacaauuccaacuuacugucuguuguuuuaggauagucaaggcuagagcaugagcuuuguguagacauuguauccacaaucaggagcaaagaaagaguguauccuuguuugcuugcucacagcuuucuuauuuuuuuagaaauauauuuuucauuaaugauuuggcuuacuuguauuuaaagaucauuuauuuuuauuuuaugugaaugcauaguuugucugcauguaagucuauguagcacauacaugccccguguccucaaaagucgaaaaaacucccuggaaugggaguuauauauuuuuuuaauuuuuuauuagguauuuuccucauuuacauuuccaaugcuaucccaaaagucccccauacccacccccccacuccccuacccacccacucccucuuuuuggcccuggcguuccccuguacuggggcauauaaaguuugcaaguccaaugagccucucuuuccagugauggccgacuaggccaucuuuugauacauaugcagcuagagucaagagcuccggggaacugguuaguucauauuguuguuccaccuauagaguugcaguucacuuuagcuccuuggguacuuucucuagcuccuccauugggggcccugugauccauccaauagcugacugugagcauccacuucuguguuugcuaggccccagcaugggaguuauaggugguugcgaguugccauguuuugaugcgguaugcucuuaaccaccgaaccaucucucuagcaccucagcuauuuuucuucucucuagggaaugguacuuaauacaauggacaguuaaauaagauaauccccuaccuauaaggccacaggccaaccuggucuagauaauuccucaucaagacuuuuuccagaugauuauagguuguaucaaauugauaauuaaaacuaaccguuguaggaggugacuguauccauccaugggcaacaacuguguccauaggagguaaugauugauauacacaggggguugauguccagugguuuacucuguugauggcuacauugguuuacuuguuugcuugcugauuuucacuguguagcucuggcugucuuggaacuccuaaugcagaccaagccggccuucagcucaaagagaucaugugccuuugcuuccuaagugcuuugauuaaaguaugugugccaccauacuuggucccugguuuuuuaucuugucuuuuugagauagaguuucacuauguagcucuuguuguccuggaacucaguuuguagagcagacuggcuuaaagacaugcaucacuaaccuggcacacccacacauugauuuuugagacagggucaguuuaaaucagacaaccaauuggcuaugagcuccagggaucuucuuauuucugcuucccaaaugaugggauuauaggcuuuugauguggauucuugagaucugacuucaaguuuuaauucuuguuuagcagggcuuuacaggcugagacauuguucauguucucccccccgcccccaguuucagauaugaaaauucuccuuucuguuucuucaguuucagacaugaaaauuguuaguucugucuuuuacaaauuggacugcauguaacugaacauuuaaaacccuaugaaaaguaaaaaguggccaauuaaaugagcuagugucugguuuauccauuauacaaaugcuggcuggaauauuucauaaguuaucacugaucuucacagucauuuauccaguugugcucugaaugagaucacagguuuaaucuuuaguugauaucaucccaacuaccauggcauguuucacuucuuacugccaaacugacaauuuuugaagaguaggacuaggagaagaauacuggucacagaguguguggcauccugccuugaguggggcagauaguaagaucuaacucacucuacacaggaagaguguaagauagaaacauuuaggggaaccuauuguuaugguuugugauuggagguuuugcuuucuaggaagcaguuagaaaauuucuuuuuauugauuaaaaauaaaaagucaaaccagaaaaaucuaaucaggaauaaaacccacguuuagcaguccuucauuuucuuuagcaaguccauguuaggauccuggauagagccauuggccugggaaagaggacacacagagcuagccuugauugcuaacauuguugauuagaacugguucugaaucuauuauuauuauuauuauuauuauuauuauuauuauuauuucuucuucuucuucuucuccuccuccuccuccuccuccuccuccuccuccuccucccccucccccucccccucccccucccccucccccucccccucccccucuucuuugguuuuuuugagacaggguuucucuguguagcccuggcuauccuggaacucauuuuguagaccaggcuggccucgaacucaaaaauccaccugccucugccucccaagugcugggauuaaaggcgugugccaccccugcccagccugaaucuauuucuuaaagauaagcaaaccuacccacaggguaaauucuuucauauuugcagcuucuaaagcauuguccuugugcccauuuuauguguacacuccucucagcuuuacuucuucacaccccgaagaauaugugcacuaaguauaucccacagauugaagaauuaugucauuguuuaguauuuugcauauaauacagaugcagagaguugcuaaaagaaugggauucuuuucucucuuauugggaaaacugaggagagcaggcaacauaaaguaacuucugacuucuagguaucucucuaaaguucugagguuaguguuggcuuucuaagucacuacuuagguucuggucgcaucacauauugauggcagcauaaaaaggacuagcugcuuucuuuuuaauaucucauuguuaauguuucaugauaaaccauuuaaaaaauuuuaaaguuuuuuuuuguuauaucaguuccccauucuugauaauaauuucuguguuagaguuugaauugaacuguugugauagaaacuccaaaaauauagcaguagguuauauacaaugaauuuucucucaaaguaugaaaaaaagaucuacccuuuuccccucucuccaucccuuccucccccuuuccucccucucucccucuuuggucccacaguaugcucuuguugagaucuguuuucucuucucaucuuggguuccauccaugugggauuugaacuuagguuaucaaguuugcacaucaaggccuuuauccaccaagauagcuuaccugaccuucauuuuguguguugcucaugaaagguuguguuugauaagauuucauuggucucugugguugcuuacgagcccagauuucuuccauccuuguucuuugccacuuagagcucucauugcuuuguggcuuggguuagcuguuagguccguuuaaguccaugggaaagagaaauacaauuuuaucaagagcagauuguuuucuuuuagugguagagaaauggcacaguugcuuccagucuugugacuugcuaagcaacugccaugcuuagcugucuguguagagggucucuaguugauccaguuaugaacccacuuaaagcuaugagaaugagcacaaaaugauaauuuuuguguggacaggacauuaugcuuuuuuaucuuguacaucuuucaagcucuuaacauacuuucagucuauguauuuauuugagggugcauguauuuucucauuugugauguauucaucuagucauggguucaguuaucacauagaaauguauaauuucacugugaucauugcauuguuaaucucuuuauauuugauaugaauacacauuuuguugauuggaugcuuuuuuuuaaacaaaauuugucuguaggguagucagaauaccuugauugauaagucuuauaaaauauggccauuuuuucuguuuccaucauugaaaaggcacagugauguuugaacuaugaaaauacagucuguuguuacuucauaucacuaauuuuguuagaauuuauauucauuuuucucuuccaaauacuuuacuaaaauucauguugacuuuaggugauauucaaaaaaauaauaaaaguaaaauugaaauacuggugugagagguaugagaugaaguuucaaguaugcuaagauggccaugucuagaguauuguaaagcaugaucucagauauuggugagaagaagguaauaccguauauguaggcuuaaagguuauuagacccagaggagauugcugaaaccuggauaauaauuaaacuuuucagcuagaagcuuguguuugcauuugcgagucaaagacauaaacugaggagacauuagauuauuagauauuuuauucauucauucaugucuguuugucccucccguccccuccccuccucuacuuuccuugccucuccucucccucccccuuccuccuccuacuuucuggugaaguuuauauaguauaggcuguccuggaauucaccaugaauuaaagauugugcucuuagccucucaagaacugugguuuacaggcaugugacaccuugucugacucaaaucauuugauccucauggauaauuuuaugaaaccuauggugaaacaguuugacagaugaauuaaugagaaaugccuuuaauauaauauuuaaguagccaucaggucauuaaauugauacuugagacauggucuacagguuuguuuuuucacucggggacuguguagaaaggucuaaauaaauuuccaauuagaaaacaaggauuuguuuaauggggaauugugucaggagcuuuggcggaggaggaauaucucuuuaaucugauaaugcaguaugacagacaauagacaucuucuguuuuuaaagagaaaagucauuuuggggguagagguguuuuaaaagcuucacagggccuggagagauagcuaaagaguuaagaacauuuggcucuugcagaggaccuggguuuaauucccacauaguaggucacagccaucuguaucuacaaucuaggauaucuagcuccuccucuggcuuccaaggucacugcaugcauacagucaaaacaaccaugcauauuaaaagucucacaggaaugcuuccaagaaaguauguauacaguuucuggaguuagaguccugaggagaauuuuaaaagacagcagaaucaaggagcugucuguucaaguauuuagcuuuuaaaagugacuaggaugcauaacauuuauauaagauuaauagucucaauuuacaaaaccugaagaaacuuaaaaaaugaaccacaucaaaauacacuuauuguauagaucaacuguuccaauccugaagauaagguucuaaacaguuauuucuaaugugaaccuucucuaagucaauuguacguugaccucaaggcacagugagccacggcuuacaugaugcugaugacuguuuugcauuagcaaacugacacuaauuauguauauggacuuuucauauuuuugaaguguugucauuuguuuuauuuuuuccauuauuauauauucuuuguagguaaaauuuucaguaauugaacucaaaaugacucuuuauauccucuuguuuacugugaagcagaaaucaaagaacaaucuguggaagaggaugcugaaacagaaguggauagcagcaaacagccagucucagcucuucagcggucugugucugaggaaucugcaaacucccuggucucuguuggcguagaagccaaaaucagguuagaacuggacuagagacaccgacaggggaaagggugguauacugacuggagacagggcuuggaccugggugggacuuuaucauuuuagucaccuuauguuugacaccccugugugauguuggcacagauguugacuaugcuauggacuuuggugacuggauagcagggaguaugcuaggauagugcucuagucacucuagaugagcaucuggauggcaguaugcuuccugacugaagaaguagccaagagcuccuaaaguaagaauuaaguuuggggggcgggggccaagagacaguuuuaucagaggaaccagguuugguuccuagcauuaacauggugacugaaacugcaacucuaguuuuaggacauucuguccucuguggauaccuaggcacacauguagauaaaaugcuuaaacacguuuuaaaaaaguugaugggaaccuuaagaaaggaauuucugauauguacacacuuaacacacuuguaaucuuaccccucuucauucuuuaagaaaggauaccuccccauucacaauaaacaaacaaacaaaaauuguaaaaacuguguaaagaaguggugcuggugagauggcucagaagauaaaggcacuugcuguuaagcuugaugacucagguuuuauucucaggacccacuuggucaaaagaaagaauugacugcaguagaacgucuucugacugugaugugugcauaugugcugcacacacaaaauaaauaaauaaauaacaaugguaaaagugaguuuucuuuucuuuuuguuuuguuuuguuuucuucccuaagcuuggauggucaggaacgcucucuguagacaaggcuguguuagcccaggauagccucgaacucaagagaucugccuugcucugcaucccuagugcugagauuaaaggcaugcacuaccacugcuggaugaaaguuguuuuuuauuuaugauaagaaaaaaguauaauuaaaguugggguauuacaaccuauuaguauguaguucaacuuucauggcuuauauuuuucaaguucuauuaugaaguccugaauaagacuaugaaaauauuagauaauugaauguucucagccuuuuaaaauguuuuguuuucauuauuuugcuuuuaguauuccucccuuuucuuuuuauccucuauaaaaucuuaugaagcugcuccuccucuucuguguuuugaggguuguuaaguaugucugccucuaccuuucuuuaauucucagggaagggcaucuaaucugacagcuguaagcuuugcuugugucuuuaugagccacaaauucauauuucuagugaggcuuaauuccuaaaauccaaauucugcugucuucccaguuaacauuuccauauagacauguguuagauaccucauucaccuuuuuagagggccacagacuacucuuuauuccaccucuuccucugcucuccuuuucaacaaauaauaccaauauuuaucugguugcuuauggguugaucugugauuuguaucuucuucauaguucauacuugauuaacccacaauuuccuguccucuugacuuggccuacuugguugaagccguugucuuuaugagacuuuaauuaucuucuuacuuccuuucucuuucucauuaucuuuccauagucuuauuuaguuguaaaaaguaucaaaucuaagucauaucuggucuucacuaaguuuaauggcuacucuauuuaaaugugaauuuuuaguuauauuuagcauucgaggucccuuuugauucaguaagauagucuguaaggcauggucuguccucagguuuaacugccaugguuugugaagacacuuuauccaccuucugccuuaguucuuggacgcuuugugucaucugucacaggaguuauuauuuugugagagcauccuccucgaccaccuucuuacuguaauaacuucugaauucuuuaacucuagugugaaccuaggugaagaguauccaguauuuguuuuauccuuaguucacuuuccaccaauauuuugagagguuuaaauauuuucaaaauaaaaguacuuugucaggcagugguacccuaugccuuaaaucacaggcagaggcagaggcagguagaguucuugagauugaggccaacuugguccacagagcaaauucuaggacagaagggccuacccaaagagauccugucuugaauuaaaaaaauaguauuauguuuuacuaauuuuagaucucauuaugaagucuaaucaauuuugaguugaauuuugcaugggguauuagacaaggguuuuauuucucuauauaugguucuccaguuuuccuaacacuaaucauugaaaacuaccuguuucuuuauuguguacucuugccauuucuggcaaacauagacuguuaguaaauguguggcuuuauuuccuagauuccuaucuuguuccauuggugacauaguuuuauaaucucuuugugaugugcuuugaaguaagaggauccgauuuagcuuuauuuucuucucucuacuuugucaucuugcuucaggaucuuguuagaccaugccagcuuaguacuuguaacucuccagcuucaauuugcugagggcuaggauuauaggcguguguacuguauuugcuuuuuaacuuaguuuuuuagauuaagauuuuuuucuuuacauguauguaguuccaacucuauaaaucuauuacucaucuaaauuuacauaagcuauuuauuuauuggcuuuugugauggagauuauuuucugauuuuucaacuggcuuauuagcauacagaaaugcagguuuuuguauguugauuuuguguccuguaacuugacaauagacaauauucaguucuaacaguuuuuggguagagccuucaagaguuuugaauaugcauauuaauuagguuuuaucaucagcaaauauaaauaauuuuacuucucuucuuaaaagaugcuuuuuauuuauuucccuugccaaguuaaguuagcuuaguauuucugccauuauauuaaaaagaaguagcaagaauaaccauuauuuuuuguugucuguauaguuguuuccuuuauuaaaggaaauuaauuugcacuuugccaacuuuguucucaaaguuuuuuuuuuaagauuuguuuauuuauuauauguaaguacacuguagcuguccucagauacuccaaaagagggcauuagauuucauuacggaugguugugagccaccaugugguugcugggauuugaacucaggaccuucggaagagcagucgacgcucuuaaccacugagccaucucgccagccccuugaagaguuuuuuaaaaaaagauuuauuaauguauuuuauguaugugaguauacuuuugcucucuucagaugguugugagccaccaugugguuguugggaauugaacucaggaccucagaaagagcaaucaacacucuuaaaugcugagccaucucuccaguccuucccagagauauuuuugaguaauuggguucagguuuuuuuuuuauuugacaucuuuauuucauuaauuuccauuguaucaccacaaucuguuucuuuuaaacauuuuuuauuuuaugcacgugguuuguguguuuguguguguguuacuguguuuuugcaguggaugguugugauauacuauauggguguuagcaacuaaauucaagaacaauaaauacuuauaaccacugaaccaucuuuccagauccuaauuuuuuuucuuuuaauuuuuugucauugucuucauuuaaauucaggcgaccucuuuuacagaaaacuuaaauuaucaacaucuaaaguuuuaauuucuguaagugaauaacugcucuuuugauuagaauuuuagcuucauuuuacaaaguuuucauuauguuuuauuaucauuuuuuuauauacuuuaguuuguauuaaaggacuccuauuuguauaauacugaucauuucugauauauuagauuuugcagguccauauguuuuagaauguuugccuuuauuaaaaaguacaagugugacuagaugugguggaacacaccuuuaauccugggaccaggaggcagaaucuauauagugaauucaggccagcaauggcuauacacugagauccucuccaucacauaaacguguguguguguguguguguguguguguguguguguguguguguguguguguguguugguugguugguugguugguugguugguuguauccacccaugcauauuuaguauaagaagaauaucauagaagagaagaugugcaaggucucuuauuaaguguaauaguuucuuuuuaaauugaauagacucaagauuugagcagauagcgcagaauauucccauuucuacauuuucacuuguccccuguaguuuaauuuuguucaguaguauuguaugucuauugcaguuaauauaucuuuacauuuuuaaacugaagcucuuaauucacaaaaaguucacaucauggcuuacucuuuaugagauaguuugcuggacagauagauaauggcauguaucugcuauaacauccucauagaaacuaaccacacaaucuuuauuuucuuccuauuuaauccagauugucuccugagucccccaauucauuaauaacucaaaaauuuacuaaacuuuuauuuuucuuuauauauacugguacauauaacaugcauaaaggauguuuauaaaguaguaaauaaauauuguuagcauagguuuuacagagcccaagaaugugguugucagauuuaauaucuagauuuccuuuugagauggauacuuagcuuuaauacuuagguuuuaucuuggaguggcugaaugaguagagugcuugucacgcaugugucaggaccuaaguuugaaucaccagaacccauacaucuagauguugucacacagcauucuguuaucccaguucuccuaugggggauggagacaggacaccguuuggaacugguagacaguuaaccuggugcacacacuaggaaauaugccagaaaccuuaucuucaacaagguagaaggcaaagacaauggcucacucauaauacuguucauacaugagaaucuacccucgauccucagaguuuuaaauagucuugugguauuugggguuaguuuagugcuagaacacuuguguaucauguauuuaaagcucaggguuugaaccuuaguccuacaauaauaaguaaaugauuaaaagcaccccaaagggccuacaaaggugguucaaugguuaauaccucuugcugcucuuccagaggaccccgguucaauacccaauaucaauguuggacgguuuauaguugccuguaacuccagcuccaggagauccaguaccccuuucugacauccauggaaaccugcagauaucuucaugugaauuaaaaauaaaucuugaaagaaauuauacuauagaaaaguagaauugcaaauauauaguuguuauuuauuuugguuauucucauaguauagauuauggaaauauaguuagaaacuaaguuuaaaaauuaaccaaggucauugcauaaaguuacuuuucucccccacuaucuuccucaccagugaacagcucugcgcuuuuuguuauuguggagagaaaaguuccuuaggacaaggagacuugaaacaauucagaguaacaccuggacuuaccuuaccuuggaaagaucaaccuucuaacaaggacauugaugacaacaguagugggaccugugagaaaauacagaacuacgcuccacgaaaacaaagaggacagagaaaguaagccguuuugaccucuaacuuauuuuggaucuuaucaguuuauaauugaacaaacuuuuauuguguuugacacauccaugcaguacuugcugauuuaccauuaacccaacaaacgguuauuuguucagucauuuuauucuacauucuucuuaccuaucaaaauuaguauggcgacaaaaguuaaacccuggaagaaaaaugaaauaaagauacuaggggagugcucauggaauuuucaaaugcaagaaagauaaaauauaccaaaguaguuuuuccuuuccuucaugccuaccagcuuuuacuuguaagaaugcaauauuguacccacaccagaauugcuggcucuauucauagcccucuugccauucauucauuuugucauuuauuuuuuucauucucaguuuaugaauacauguguuuuggaguguauugagcuggucuauaacuugauuaaaauauaauuauguuaccucccuauuugccuuucuuucuuuuccauuccuaucauugaagauaucuuuaaaaaaaguuuacauagcuauguguaugcauauguauuuauucauagacauguuguaguuaccuaaaacucuuguggagugugcuuuuagaguguuuuuguuuguuuguuuucuagucauguauuaaggacauuuuaauaugugaacuugauaguuaaggaaauagaaguauucguaauugaaaaaaauauuaaaauuaauuuagcuuaagaggcuagagaaauaucucagcagauaaaauacuuacugauauuuguagaggaccagauuuuguuucucuguauucugguuaaaugguucaaugccaccaguaaggaauuugaagguaucuacucccucuucuaaacuucugcggguaccuucacacauguauacacaaguguacguguacacacacacacacacacacacccuacuuuaaaaaaaaccaguguccauguggugguuccagggauuccaaugcccucuuuggaguuacacaaguucucauacacuugugugcauacacacucagcauacacacaauacacaaauaauuaaaagaauaauuuagcuguagaauccuauacuuugagagugacggugcaauuuuccaaaagucucuugucuuuuauggaaauuuaagugacuauauagcacuguugugcugauauuugaagauuugaaguggaaaguaauaaaguuucaacgaauuugauauuagaauuauuuaagaaaacuuauaagcauuguauuuauaguuaugacuuuuuuuuuuacuuugaagcuagaucaugcauaagaacuuuauuuuugcuuucaccuuaauucucacauguuaauaucaccaaaaguucagcaagcuuauaaucaguaguuagcaaauagaguggaguaggucaggcuauaucuuaauaguucuauguucugucuuggauaaagacaauuauaauauucuuauguggaaaauggaauuggguuucauuacuuauaaaugauuuuccauuaauuuuuaauaaaaauuaagagauuggauaauuuuauaaaaauagauguagcuuaacaaaaguuguauguaauugguacucauuauuaaauaaugauaaguuuauuaguauauacugagaauauuuggcaaucuuguaaggggagaugguuuacuuuaguaaugauuuuaaauauuuauaaauguaugcuacuaaugaaguauaaauagcuaauuaauuuucaucuucuuguuuuuguuuuuuaguuaaaagguuuuacuauguagcauaggcuugucugaaacucuguguagaccaggcuguccucaaacucaaaaagcuccaucugccuuuguuuucaagugcuggauuaaauauguggguuccugauccuggcuucaagcauauuugauaaaaauaguuuuuaguaugauucuucuuaguucauuuagggcuuuuuauuuuuuauuagauauuuucuucauuuacauuucaaaugcuaucccaaaaguccccuauacccucucccugcccugcuccucaacccacccacuccugcuuccuggcccuggcauuccccuguacuggggcauacgaucuuuauagcuugaaauuuuguguguauuucaauuggcuucucuuuuuaaaauuguuauuuuuaauuguguguugcuaugugucugcuuggagagcagagguaaucauacaguacuugauacuggauuuuugggaacugaacucagguccucuguaagaguaguaugugcucuuagcugcuuagccaucucuccaacucucaacuggcuuccuuugaucucuucccuaaaagaucugcugucauccuuagaguugauacagacaucugauaugucauacacauaaaaccuauuucacacuugaaugcugaauuugacugagcuuuugguuagaaacugauuagugauagacuauuuggucaucccacugauuuuguuuguuguucaguuugcucuugugauuaaaauaugcuaaacacaauguggaguuuacuuuaaccuuucuuucucccaauaaaauaacgauagcaaugaagaauguauuuguagaaauggagaucaaaaagaauuucccguagacauucacaaaaaugagauuuuaaaguuagcacaguauuuuuaguaucuuaauguauuucuaaaacuaagcugaaauuaccaguuauuuuaaauauauuugauaauuaaauguaccuauugaacuaugguaauacuuuuuucuuccaauaauuugagguauaaaagguuuaguauuauauccaguagugauuaaauaaaaaauuccacgagcuuaagcauuagauuauuugagagauauuguagugguaauuauuuuacuuuacauauuuaauguugaauauaagaaaugucuuuauuauuuaaauguauuuauuauuuaauuauuagguaauagccaaaguguuguuguuugccagaccucaaaucuuccaugugguaaacaauuaauucaacuuuguuauucacuuuuaucucuuauauacuaucuuucuuauuccccaugccucuagggccuguuuuccuuuuacuuagugaggugcagucuugagauuacucagcaucauucaugaccagcugcugacacaucaggaucaugagaaagcuacaguucacacauucccuuuuuuccucccuguuuacacucaaauggcucuucauuuuuccugggaaauagucuguacguuugguuaccugccagcuuuguguuaagauaaugcauguuaaaauguccucauaugcuuuauauguaaaacugaaaaaaauuuucauuguauuuguuaaaacaugguuccuggauagaaugaguuaguuuucaauggaaaaaugaauuuauaacuauaauuguuauauuuccuaugauugagagagcccuuuaaacucuugcuuacauaaaauaauguaacacccacuuuaauauugugaauaacaagaacagaugaauucuugaaauuuuuguggcuguaaccuaguaauuaaagcuuauuugacauacuuuguacucauuauuauaaaauaaaaugauuuuuuuaguuaccuuuuacaguuuuuaucuuucuuaauuuuguuuuuagagaacgaccuccccagcagagugccguuucuuguguaaguguaagcacccagacagccugugaggaccaggcgggcaaguuaugggaugaacucagucugguuggccuuccagaugccauugauguccaagccuuauuugauuccacagguagggaccucucuucuguaacagcuuccauuugauucuggaagcauuuauacuuggugcuuauucagugguaaauucuagaaauaaguaggaucaugcaagcaggacacuuacaaaaugugucauaaguuuguuugacuaagcauuugauugccauagguauuugacaguugaaagaaagaaaagcuuuaaagagccuggugaaaacauagggagcauuuuaggccaggccuuuuaucagugggugugaaauucaggucuuugcuucaagugguuuacuuacugcaacaguguggugauucacagaaugugguucuagugggaauugagucaguugcuguaguugaacugaugguugaugguaggccaaguguuguccaacggagaauucaaucagaugguuguucuugccuggaaaauaccccccccccccccccccccccccccccgucauuagcuucguauuaaacaguucuuuucuuuuuauguaaggacaguaaauagaauaguauuuaaauaaaacaacuaagggacuuuugcuuguggaagaaguaauuacuaauuuacaaacaucuguguacgucagaaucaccagaaggcuuguuaaagcaaagauuacugggcugcacuacaagaaauguugauuuagugggucuuaauuaugcccuguaauuuugcauucccgagagguucccaauuagcuagucucacccccaagucacaguaagggucaguuggagaaaggcuacuuuaauggaaucacaugaggauacauuguauuuuugcacaucuuuguuuuuugagauaauuauucuucuguaguccccauuagccuugaacucauaacuauagcacugguagacuuugaauggaaccuccuacuucagcuuccugagcacugagauuagaaucaugaaccacucccaccaaguugcauuaauaccuuuaguguuuauuaaauuguucauuuucuuacuuuuaggcacuugcugggcucaucaucgauguguagaguggucacugggaauaugccaaauggaagaaccauuauuaguaaacguggacaaagcuguugucucagggagcacagaaguaaguagaagaaacaaguauuuaaaugaggacuccuccuccuccccccuccuccuccucccuccuccucccuccuccuccuccuccuccuuccuccuccucuucuuucauccuccuccuucuugcuuguucugguuucauuuuguuuuuuagaguuuaauauguaguagagaaugaucuugaauaucugauccugugccuguaccuuuucaguauuuguacggugcugaggauagaauccagacuugaaacauccuuagcccuguccuacaaucuucuaaauauuuuccaguguaaaauuucacuugugagaauuauuuauuaaaugaguacuauaauagaaaaugcucaucaaauugcuaauuuauaccaaguuuauuuuucaguuagcuuaaaacuuauuucacauuuaaauaaaaagagaucaauuuuugaaauggggauccuaacuauauuuauguguucaugugguuauccauccauccauccaucuucuugaacucacagaagucccccugcuucuguuucccaaguguuaggauuaaagguguuugccucuaugcccagcuuuauguaguggcuuuuauuuauuuauuguuuuaugagaccagguuccuuuuuguagcacugaaugaccaggaacuugcucuguagaccaugcuggccuugaacucagagauccaccucccucuaucucccgcgugcugguguuaaaaagccugcaccaucacugccuaguacacguagugacuuuaaaagagcaaacuaauauaaauuuucgcaauauggaagaaguauguucaguauguuggugaaaauauuuuuguucauuccauuugucaguucauuuaaccuuuuuagcaauaucccaaaguaacguauagucuguguuuuuaaaaguuuccccuuuguuuuggugcaccuuuaaugcucacaaguauaaguacaacagcuaccucccaucugugaaggcagcccccuccccacgagaucuuuccugucaucuauaaauuccuuuuacuuuuggauaaguaaauggagaagugacauagaucuuugaaaauaacaugaaagcuagagacuuugacuauaggaacuguguuucaauaaguaaggcuuucagaaguauagacucaaauuauugaaugguaugaguaauugucaauuuaagaauaguguggugacacagucuuauagcucuauuuacugaggagacuaagguaggaagguugcaaaaucaggcccaguuuggcuucagagugaauucaaagccaguuuaacaaucaacuuagugaacucccauaucaaaauuaaaaguggaaaggggacuagguuauaguucaguugcaaaugcuuaucuaguauaugaauggccugccuuccacccugagcaucucuuaauacccuccuccuucuaagccagaacgcuugguuuagaaauuggauguuacauuuaauuguauaaguugucagcaucugaaaaguuuacguaccuugcuuagugugaucauacuuggauagcuagauuaugacugugguggauaagggaguauaucucuucucuuaaaacuauaaauuacuuucagacaauauagacacccuccauacucccaaccauauuguagccugagcaauacauagguaggacaaauauuaccaucauuuuaccuugaggcauuuuucaguauauuagacaaacaaaacaaaacggagagauggaaauucugaauguugaaaagagauuuagggcaucuaaggagaggaaagacaaaaguaaccucagaccuauuauaauaagacuuaacauuuuaaaauugcauuuaucugucugucuaucucacugccugucugugcaugagugcaugcauuuauuauuuacuugugcauguguaugcaaguguuuacucacuagcaagugugugggugugauggucaaaggacaacuugcaggaauugguucucucuuuauaccacacagagcccagaggauuaaacucaaggcuuaucgcaaaggccuuuguuuagccaucagccuucuccugccacccucaacaaauacuuuuguuugugaacucucggaauaacaaacuauggcuucuuuuuaaauucuguccuuuggcucaauagcuacuggcauuuauauuuuuaaauauuuaaagaaaaugaaaagguggguaacauuucacaauaggaaaauucuaugaacuucaaauauuagggucuaaaaauaaaauuucgaguggagguaaauaacaccauaccaacuuauuuucauguuauguaaaguuacugcaguggaauugauucugcagagauccacacuuugaauuccuuuuuagcauauuacuaauuacaguugaaguuuuucaguuuuucauugucuugaccuuaaacaaaacaaaagaaaacaauaacaacaacaaaacaaaaaaacccacaaauguggcccaugccuuuaauucuagcaccugggaggcugaggaagacugauguauaaguuugaguccagccuggucuauacagagauuuccaggacaaccaagguaacacagagaaacccugucucaaaaaaagaagacaaaaaaaaaaaaaaaaaaaaaacaacccaggucaaaccaaaccaaauuaaaguagaggucuaaugcaugacaguuaggucugagugcuucugccuccugagugcugggacuaaaaguuguaugcacuacuccuggcaucuucucucuuuuuaaauagucauugucucuaguaguuuucagcugucuuuaucuuuaaaaaguacgcacuguuucauuggacuuacuuuuguuugcuuaucuguuuuuuguuagaauuuuuacuuuuuacuuuucaguuguuuuuuucccccuugucaauuugaaguacauuaucaaauuuuuuauuugagaucucucuuuuccuccaccuggucucuaucucucuguuucugucucucugugugugugucugucugucugucucugccaugaguaugaaggugcuuguagaggccagaagagcacauugcacauuugcuacuuuggagcuggaguuauauagcgguuguaagccaccuaaagugauugcugggaacugaauuuggguucucuccauaagcaagaccuauuucuccaucuccuugauuuugugguucugguuuugugguguauguacucaggaccgcuaaccucucuauuaguacugcauuuucugucucacacaaauuuuauuuuaauuuucauuuguuucaauaauuuaauuuccuuuuagugucuuccauuacucacuuauuaccacuauauaauuccauguacuuggauguuuuccaugguuuuuccuguucuucuuuaagaaagauacagcauauaauuguaguuuaaaaaaauuauugagauuugauuugugaccuggcaagugguugauccuagaauauacauguucaguucucuggccuauacugcccuucuuagucucucuuuuaaucccuuuacuuguauaugugauaugaguguauuuauguguguuaguguauguauguguacaugugugcaggccagagguugacaucaggugggcccagagugcacggaugcugcuaaucuagcucaucaggcugcucuugggauccucugcuuucauugcuuggcuggucuccaagcccacucagcuuugaugugggucccaagggugcaaacucugguccucagacuugcacagccagcacuucauccaccagacuucccuaacccuuggcuuuuccuuauacuucuuauuaucugaggugauaggugaguguuacuccaucagguuucucuuugcucgugagguuuagcuuuguuucacacuccuuuucauuuuaugugauucuuuaccaguaaaauuaguuaauugugugguacacauccaucagaguccugcucauucauuuauucauucaaucauuucaucuggccaguuuaaggcuuuugaguaaugaccuuaauauaguuccauucauuguuguuauuaguaagcauggaaagccuucugugcuuuugguuuuuguguucuguuucuuucucuugcuuucccucucucucucucucucucucucuuucucucucucucucucuccccuuccuuucuuucucucucucuuucucucucucuuucuuucuuucuuucuuucuuucuuucuuucuuucuuucuuucaucauucauuaaucuuuuucuuuucuuuuuuuuuuaacaguccaguccuuauucccccuccugacccacccuaugacaguuucucaucccauuccuccucaccugucuccaugaggauguccccuccaacccccacccuuccagaucuccccacucucuggggccucaaggguuaggugcuucuucucucacugaggaccaggcaguccucugcuguauauguguccggggccucauaucagcugguguaugcugccugguugguggcucaguaucucagagaucuuggggguccagguuaguugagacuucuggucuucccauggggguugcucuccuccucagcuucuuccagcuuuucccuaauuugaccacagguguccuugacuucugcaucugacucuuuuagcugcuuguuuggccucuugcaaggcagccaugcuaggcucuugucugcaagcacaccucagaaucaguaaggucuuggagccuccccuugagcuggauccaaauuugggccugucacuggaccuccuuuccuucagucuguucuccauuuuugucccugaaguuuuuucagacaggaacaaguauaggucagaguuuuugacugugggguggcaaccacagcccuccacuugaugccccauuuucuacuggaggugaacucuacaaguucucucuccccacuguagaggauuucaucuaaggucccucccuuugagucccgagagucucucaccucccucaucucugguacauucuagaggguuccccuaucucccaccccccaagguugccuguuuccauucuuuacucuggccuucagggcuucacuccuguuuucccccuccaauaccucaucauaucccccuuuccccuuccugucccuuuuccuacccagcucccucccucccuuucuuccccccccccccuugugauugcuuuccucucccuccuaagugggacugaggugugcucacuugggcccuucagcuuauugacuuuugaguucuguacuuuuuuuuuuucuuugcuaauauccacuuauuagugaguacaugcauguccuauugggucugaguuaccucacucaggaugauauuuucuaguuccauccauuuuuaugcaaaacucaggauguccucauucuuaauaguugaauaccauuccauuguguaaaugaaccacauuuucuguauccauucuuccguugugggacaucuggguuguuuccaguuucuggcuaucacaaacaaggcugcugugaacauaauaggacaugugcccuuguggcaugauggggcaucuuuuggguauauucccaagagugauauugcugguucuucagguagaucuauuuccaauuuucugaggaaccuccagauugaucuccagagugguuguaccaguuugcaauuccaccagcaguggaggaguguuccucuuucuccacauccucucuaacauguguugucaccugagguuuugaucuuagccauucugauugguguaagguguaauuucaggguuguuuugauuugcauuucucugaucaccaaggacuuuaaacaauuucuuuaagugcuuuucagccauucaagauuccucuguugugaauucucaguuuagcucuauaccccauuuuuugauuggguucuuugguuuuuuggugguuaguuucuugaguucuuuauauauuuuggauauuagcccacuauuggaugugggguuagugaagauuuuuuuuccccagucuccugguugcugauuuguccuauugacaguguccuuugccuuacagacgcuuucaaguuucaugaggucccauuuauccauucuugaucuuacagugugaaccacuggaguuccuauuuagaagauuuuaccccugugccaaugaguuccagucucuuucccacuuucucuucuauuagauucagcguaucugguuuuauguugagguccuugauccacuuggacuugagcuuugugcaaggugacaaauaugggucuauuuucauuuuuucuacauacagccggcacuauuuauugaagaugcuuucuuauuuccauucuuuauuuuuggcuucuuugucaaagaucaaguguccauaagugugugguugaggucagagauagugauucccccagccauucuucuauuguuaagaauuguuuucacuauucuagguauuuuugccuucucuagaugaauuugagaauugcucuuuccaugucuuugaagaauuguguugggauuuugauggggauugcaucaagucuguagauugcuuuugguaggaugggcauuuuuacuauguuaauaguaccaauccaugagcauggaagaucucuccauuuucugagaucuucuuuaguuucuuucuugagagacuugaaguuauugucauacaggucuuucacuuauuugguuagagguaccccuaagauauuuuauauuauuuguggcuauugugaagggaguuguuucccuaauuucuuucucagccuguuuaucauuuguauaaaggaagaauuuacugaaguuauuuauccgcuggagaaguucucugguagaauuuuuguggucgcuuauauauacuauuaugucaucuguaaauagugauaccuuuauuucuucuuugucaauuuguauuucuuugaucucuuuuuguugucuuauuggucuagcuagaacuuugaauaauauauugaauagauauggggagaguggacauccaugucuuguccccgauuuuagugggauugcuucaaguaucucucuuguuuaauuugauaucggcuguugguuugcaguaaacuguuuuuauuauguuuagguaugggccuugaauuccugauuucucuaauacuuuuaacaugaaggggugucuuauuuugucaaaugcuuuuuuugcaucuaaggagaugaucaugugauuuuugucuuugaguuuguuuauauaguagauuauauuaguggauuuucauauauaaaccaguguugcaucccuggaaugaagccugcuucaucgugaugaaugaugguuuugauguguucuucuauucaguuuucaagaaguucauuuaguuuuuauuuuuguguugauauucauaagcaauauuagucugaacuucucuuuuuugguugugucuugcauugauauucauaagcgauauugguuugaacuuccuuuuuugguugugucuuugugugguuuagguauuagaguaauuguggauucauagaaugaacuagguaguguucuuucuguuucuauuuuauggaauaguuugaugaauauuggcauuagaacuucuuugaaggucugguagaaaucugcacaaaaucugucuggccuugggccuuuuuugguugggagguuuuuauugacuucuucuauuuccuuauggaguaugggccuauugagauaguuuaccugcuugugauauaacuuugguacgugguaucugucuagaaaaccaucuauuucaucuagauuuuccaguuuugucgaguauaggcuuuuguaguaggaucugcagauuuuuugaguuuccuccauuucuguugauuuguuucccuuuucauuucuuucuuugugaauuuggauacugucucugaguccuuuaguuuguuuggcuagggguuuaucuuguugauucucugaaagaaucagcuuuugguuuuguugauucuuuguauuguucuuuguuucuauuugguugauuucugauccuagagcaggggaaauuuuuccaccuucuguuauuuccucaguuucuuucuucagagacuuguaguuuugucauacaagucuuucacuugcucaguuaguuacaccaagauauuuuauauuauuugugauauauuacauuauaaaggguguugucucccuaauuucuuucucagccuguuuauuguuuguguacacgagggcuacugauuucuuugaguuaauuuuauauccagccacuuugcugaauguguuugucagcuguaguucuuugguaggcuuuuuaguguuacuuauguguacuaccauaucauaucucaaauaguaauaccucgaauucuuccuuuccaguuuguagccccuugaucuccuuuaguugucuuauugcucuagcuaggacuuuaaguacuauguugaauagauagggagagaguggacaaccuuguacuugauuuuaguagaauuauuuuaaguuucuuuccauuuaauuugauguugacuguuggcuugcuguauacuuuauugucuuuagguauacacuuauaucccugauuucuccaagacuuuuauggauuuuuguauauugaaccauccucgcaucccugagaugaagccuacuuuaccauaguggaugauguuuuuugaugcauuccuauacuuggcuugagaguauuuuauugguguuuuugcaucuuuuuuuuucacagauuguuuuauuaguaagguacauauauuucuucaugucuucuuaccccuccucaaaguuuugaaaagucauuuuuuuucucuuuccagcgaugugcauuuugcaaacaccuuggagccacuaucaaaugcugugaagagaaguguacccagauguaccauuacccaugugcugcaggggcuggcaccuuucaggacuuuagucacuucuuccuucucuguccagaacacaucgaccaagcuccugaaagauguaaguuugcaugugaauuuggagaguuacuuuacuuguauuaaaagggaauacuaugaaauucucaaucucagugugugagaggccaaggcaggcggaucuuaaguuuuaagccagucuggauagucuacagagugaguuccaggacagccagggcuaaaaaagaaaacggggaaagaaaucgaaacaaaaaacaaaagcugaaagaagaaauugauauccagaagauauuaugcaguccuagugggucuccccugucccucucuccucagcgucucacuguguagcucuggcuauccuaacccucaaaggugaccugcuugcuucugccuuccaagugcugcucuuauagacacgugccacuaaaccugguuuauugugugguuuugaguggaaagcuaugaccaguaauuuuaccgguauuaauuuuaaaaaugguuauuuucucuaaaauucagcauuugcauauuuuaaauucuuauguuuaaaaaacaguuuuaaaccauuuuagaagacauacugagaggauacaguauuuuuuaacauuucuaaagaaaagaacaauucacuuaauaguugaauagugcauuuauuuuucauagugcuuuuugcuaauauuguagucuuucaccucacauugcuguguuucuuugaaaagauggucaugaaggaguuacugagaaaauaguguaaaauaagcagcacucucuucaacagugagaucuaggagcuguuguagagugaguuugaguguauggagaucaguaucuuuuacugucaguggggggaugcaaaguugauuccaguguucgugagaauauuaucucuaggagcaucacauacuugcuggcauuuuguucagggacucucuauaccugguugugggacagacaucucuagugcugcuucacagcccauccaucuugcuuaucucuaauaugcagugcugcuuuuugcuuucuuuuccacuaguguuuuauaguaagaaaauguucauguuugaguuuuaaugagcacagaacauuauaauuucuuuuuacuuuaucacuaaccaaagaucuggauuuuugcuauuguugcaauauuuugcuuagaaaauuuuaguuuauguuguauauaugucagguaugugugcauaugaugugugagagucagauuuuuaaauuuuaucuuuagauggguuccagaguugaauucuguugccaggcuuugcacagcaaggguuuuuaccuguugagucauuugcuagcugaagagcaugcacacuucacuuucugaaggcuucaugguuauuuagucauucucuccuacaugacuucuugccuguuaacuuuuauguacaucuuaccaauguauuuauuaaucuuuuaauucaugccuaucucugugcauguauuuaaccauguuuuuaagacauguuuuuuucuaucuuuugagguuuaagaaauacaaauauagcuacuucaggcuuaacuagaguaauuccagauagcuagauuaacaugaucauugacucacuuuuuuaucauuguuuuguaccuaauuuuaucuauagucagaguuauauuuuauuuauaauauaaucaugcauuuauuuacuauacagacuuaaauuauagcuaagcaaacucuuaauuucaaauuauguuuaaacuaauaacugauuuaaaauuuuaauaauguuuugcauuaugccuauuaaagagaaaaguaaacaguuauugcuaugagauuauuuauguaguuaauuauuuuuuagaaauuuaaguaauugugccauuguuucuuuugaugaucacguucuuuauguauacugcuggaguucagucagcauguaaaauuacgaacuauaagaacugaugacauaacuugucauuaacauugugaugaugagagaucaugcuggcacguaaaguuaagaggaauacugaggucauugguucugugucuucuuccaaaguauggaaauuuggcaagggaaguauagauuguagcaguaugagagcauugguaagugagggugguacucccccuuucccaaaauucccacuuggugaccauuccaaaaauuaauauaaggaaauaaaaugugaguauuuaaucugguucauaguauuacuuuaggauuucacuccauacugggaguaaaagagaaguggacacuaccuguuauagagaaaauaguaaaacauugugucaaaguagcagccugguaguauaaacauacccugcaaggcaaggcuugucuuuccuuuccuuuccuuuccuuuccuuuccuuuccuuuccuuuccuuuccuuuccuuuccuuuccuuuccuuuccuuuccuuuccuuuccuuuucuuuccuucucuuuaaaucacaggcauaaaaccuggaaaucuuaaacacugcucuguaaauguuuaacaaucaccugccacaugcgcccccauggauuugaggaugugggcauauuugcauaguggaggcuagagauugaugugguugucuuccaccauugaucuuuaccuuaucuuuugagacaagucucucacugaaucaggaacuuacagguuggguagacuggcuaaucaguggcaauccguuuuucugucaugucuguugcccaucuucaccccaaccccaagcugcagauaugacaauaccauuugccuucuuucuugugguuugccuaucaaguaauccccugaagaacaaguaaauuauggauguuauccaggauacugagaagaaaggucagagagcuccaagaauuuagguuuguacccguagcauaugugugaaagccaugaauggcugugcauuuauuuuucauacugcuuuuugcuaacauuguagucuugauuuuuuuuuuuuaaagauggucaugaaggaguuacugagaaaauaguguaaaauaagcagcacucucuuaaauagugagaucugugaguuugaguguauaguauuguguuggugauagaaauguaaugugagcaauauaaauaauuuuaguauacuuaauagcauguauuauuuuauuuaccuucuuuaaaaauaccaguauuucaacauguaaucaauacaaaaguuuuagauacuugauuuguuuuccuacugugauuuuagaauuccauaugcauuuuauaccuaguguacaucucaauuuggacuauacguaucuggcagucaguaucuacugugccaaguuagagcuguagaauaucaaaugcuaggcaguuuuacagauuuuuaaucaguauuuugaaaacccaguaucaagcuaaaauuaauaucugaugucaauugcuucccaauuuaaaaaaaaaguaaagagacaaaaaucaaagauucacuuuuaaaagggcaauuauuuaugggugcauacuagcacuuuuuuuugucaguuuaggcaucaucugguuguuauaaaagggaggcauggaaauuauuuacacgaugaaauaguucaggcaucaguggaaugggaauccucacgugacaccauuucaacagugauuucagucgacauacuuuccaagaaugucacuaucucuaaauaagaaauaauccuuguugucuagaacuacuuuggugcuuccauauucugggagaagaacuuuaucuccaacuuucacacugacaggcucaaucucuccgcccuuuccuccaugacuguugcuugcaacacuuuuccuugagccuuuucuggaagcauaaugccaccuuugguuacauuuuggcggcaccccuucccaccaauacucugucaaagagcggaagaaacuuccuaaaagcuuauccaccaaugacuugugcugcugccacagcugcggacucuagcacuuucuuaauauuaaggaaaauaccuuaucuuccauuaaaaaugagauuacuacuacacuucuauuuuuaaaauaaucacuuauuuaaagugccugacaaauuuaaucacuuaaaaguaauuugaaaagugagccuucaucuuaaaauacauuugacuaagacuugauuuauuuuggguuauuggauguacaaagcagaaaagauaagcucccuaucuuuucaaggcuuuacacuauuguguuguaguuauuuaauagaaguuucuucaaaguauacagggaaaaggaacauuaaguuaaauuccaucuuuucuuuuagauuaaaaaggaggagguauugagauuuaucuguuuguguguguguguguguggggggcauugggcuauaggcuggucuccaguugagcugaggucugaacccugagagugguggugauaauucaccuacaugacacuguaggcgcucccuuaugcuccuggaacucuggcuccugccuaaguuaccgcccccaacagcccccacaagagaagcauggucaguaguuacauagccaauggcccaagcuucugaccuucaggcuaaacaacuccccaguuaccuagcaacagugaagaccauagaaagggcuguucagcccuaccuugaucucuuacuugucucucuugcuucuuaccccucacucucauccccucucuccucucucuuugucuucucuccucucuccuuucucuuugucuucuccucuccucucucuuacucucucuuucucuuuagccuccccacuaccuucucucuuucucccugcauuuccacaguaaagcucuaaaaccauagagagucucugcucaucaaggcugugcgcacccucgcagguguugggaaccucuucccucaucccucucuccuauaacccugggcuuuagcaagguagcuccaggaaucccagguagggcugccccuuggccacccucugaagagugggauagaggaaugcccacccagggaugaguggaaaguguauggcagcucucccacuccugacagaccagaggauagggaaaacugguggggugugggccuuuucccuuccccaggcccccuccccuuuuuuuguucccaacauguguguguauaaauugugguaccccuguuacaguuuauaaggaaguguuuuauguaguucaaacugacucugccuuagcugugcagaugaggccaaucauggagucuugcuucuuuugcuuccaccucuaugugcugagauuacagucauaugccaucaucucuagauccauugauuggcucuuuuaaaaaguuaauguuuauuuuaugugcauguguauguguggcauucguguagggguguguguuugugugugguguguguguguuugugugugugugugugugugugugugugugugugagagagagagagagagagagagagagagagagagagagagagagaggagccaggagaauauuugugcugugguugguucucucuuuucugggcuucaaaaauugaaguuacaucagccaaucugagcagcaagcaccuuugaugguuacgccauccugcuggcccucuugauuaauucuuaauuuaagagaacauaaugauuacacuaagauuuugaaauugugcuuugcguauccaggugauguuuuagagagaauagaaucauaaggaggguugaguuuacuuagaagcuauuguaauacuaagaaacuauuaugggcuaaacuguaaaauccaaagaaaaguauauagauaauuuaauagaaagaauuuggaucuggugaaguguccuaggauagggagauguuguuagcaaaaggauauuaaaauuucugguuuuuuuuccccccauucuuuuuuuagaaaaaggaauaaauuuuauuuuagaaguguugaguuuuaguauuuuuuaaaacauuuggaguugagcugcauaaggcuugauaauaaaugguugaguuuuaugaaaguguauggaugauaauacagauuuuagagcaucagcauuuaaugaacaucaaaggaguuuuuacaugcgcagcagaaauguugcagaauuuguauggaaagaugaagauggguucuaagauuuccaguauucaaagucauacaaaggagguacaggccccuaccauaugcuguaggaaccguaaggagaagcugaggaguugccguggaaaggguaguguaaauguaagagugaugagccuuguacaguuugcuaaauguuaauaagaugcagucuaaaacguaacuauuggauuucaugugauuuuguuuuuguaaccuuucuaagguggcuucagguaugaggcgguuauguagcuagacuuucuguaaggugcagccugccguccagaccccuggacuucuuuuguauuuccucuauucuaggaauuguccucacauuuuuaaaagacuguuaaaacaauuaagucuguauuacagagacugcuaugauuuacaaaaucuauuuauuauaacccucaacaggaagauguucuugacuucuaauguauguaauaggaauagauuaccacuuaguuuucacgaugcuugauuugcaaagguagaaaguacuuuuagcugaguggauuagguuggacuggcccaacuuuggacaaaauaggagacauugaucuguuaaacuuguuauaauagaagaucuacauuauuagcauggguaugcuuuuagaauuccuuguuucucuuuuuauauuauaaugugcauaaguuuaguuguauauuggcugaaagcacaauuuauucuuuuuuuguuuuguuuuauauaguaaacccuugucauaauccauuuuagucauggguguuaucuauaaguauguugauuuuaaugguuuuguaacugguugaguauauaauuagucuaugaauuguauucauguguguguauguauauacauacauauauauguauguguuacauauauauguguauauauaugucuucuagcaauaauguuauacauaagauauuuucuaguauuaagaaaaccccuaaguuuguuggaauagucuguuuucaauuaagaaaaacauuaaucuaauugauauuaacauuguuauuuuguauuuuugauuuuaaguuuacaagaauuuaauaugaauaaaauacuuaauuuuaauacuacaagugucuguguugauuucccccuccuaguuccuuguuuuguucuuucuaaugcauguacagagcaucagcaaaaauacuugcaaaauuacgugauuaaauuucauaugguuauacuuuaauuauaauacauuagaguguuuuaagugaaaccucauucugacuuggcaaaauguggauaacuucgaaugucugagagauuucauguaaauucccuucaaguaauuuuaaacuguuaaguuagaaaaauauuaaauuauaauacaauuuuauuguuuugcuguuaauuuuagcaaaggaagaugcaaacugugcagugugugacagcccgggagaucuuuuagaucaguucuuuuguaccacuuguggucagcacuaccaugggaugugccuggauauagcuguuacuccacuaaagcgugcugguuggcaguguccugagugcaaagugugccagaacugcaaguaaguuucucauuccaacucaaggguauguguugagucucagugagaccugcuguuacguauuaaaaguuuaugagcuauaaugaagguucuuuauacuguaagcuauagucacacuaauuucaccauguaugucuacuagcauuuacuaacuuuucuauuauuuugaagcauaucuaaacaaaacucacugugcuaacacuuuauuaauaaaugauauuuuaaaauaaagacuagaaaaaaauuuuuauugagaggaauuaauaggauaaugaagcaguaacuguagaaauaaguuauaaacauugagccuccaaaucuaggauggucaauuucuacugacuacugucuugcuacaaucuugauguucaucuucuaaguagauucuauuccguauaguucaaacaaagcaugguguggaaauuaagcaucuggagcuauacuuucucaucuauuguauuucaucccuuggccauuucuccacucuccuguaauucucucaccgcaaguauauaguuaguguagcauuuugagagugcaucuuuagugauacauaaaugguugcaaacacagcauuuuuuaacuaggcaaaaguaaagccuaaaguugcucuggaaagucuaauuuacagguuauuucagaagaacagucagaaucagaaucacaaaguaaaucaaacuguuugcuuucauacuuugcuaaaaucuaagaagaucaguuaacauuuacuugauaauucguauguguauuuauugucucuugagaagaggugugagaggaauggccuccagcuuauucauguaguggaagugcuuaaagguaaaacaugguagaguuuguuaaacugaguaaccacuggaggccuuggagauacaucuugcuuguuuacuuggguuugauucauaaauuucaaaaagaguccauuaauuuucauauuuuuuaaauucuuaguaucugagaaucagaaauaaguugcuaaguaucaagagagacuauuuugcagagcaaguacccaguuuuggugcaaaacaguguuuagagaaagucuuugaauucuaacucaugacaauauuuuuucuuuuuauuaauuguuuagaauuucauuuauuagcaauaguggccagcaugcacaaacucucccucucucccucucccuccuccacccccgucucacugggugugcgugugcgugugcgugugcguguguguguaguagagggcauuacuguacugcuguggaguugguucuauccuuuuauuucuuugggcaccagggauugaacucaggugaucaagcuuugcagcaagugcuuuuaccugcugagccaucuugucagcccugaugaugaugaugauuaucauuauuaucauccccaucaccagugugggaugguguguauaaaacccuuggggugaaaaggggcugaugagguccaggugaucagagguauucagacauaccagaagagcgcaucggaucccaucucucucuagccccuguuuuuuguuuguuuuuuucuucucuuuuuuuuaaggcccauuuuucuuaaaauauuuagcacguacuguuuaaaggacauucuaagguuuugaaccaguacacuguuugggacucaguagucuuugaugaucuuuuuucucacuuuauaccugaagucuggauucagggugguauagguuagaaaauagcaguauauauacaaauggaaggucugacauugggcuugguccucuuugguuaugugcaguugucuuuccaguucacccugccaacacggcaucacuagcaguuguaguucccccuaaaggaugaguauuaggguuuuuuuuuccauuuuuuauuagguauuuagcucauuuacauuuccaaugcuauaccaaaaguccccauaacccccccccccccacucccaaaauguuaugaugagagaguuuugcuguaccaccuccuccucuguaggagucuacagugacgaagggacgcuaaccauaggagaaagcuuuaaguagcaugaucuuucuggauucaugaaguggguagucucuuuaauauucuauacacaaaagagacacuguguuuauggauugugcaaguuuuaggauuguuuucaugcauauuuaugagaacgcaaaaguuuaaagauaaugcuaucuuauuuuuuagacaaucgggagaagauagcaagaugcugguaugugauacaugugacaaaggguaccauacuuuuugucuucaaccuguuaugaaaucagugccaaccaauggcuggaaaugcaaaguaagugauuuccuaauuuguuuuuagauauccucuauauguauugcauagagaacugacaccauauuccuguucaaaucuauuaucaucauuccuacaagaacagcuuuuaaauuuucuugauauauaauugauauauagaagcugcauauuuuaaaagucuguaauuugacacaagcauuuuacuauggagccaucaugggaguacacccuuuucauuaucugaaaaggcuuccugacgccucuuggaaagcuuuucuugauuuugcacauucuucucuuauuucccagguagcuuugcuuuucucauuauucauuacuguuuacgcucuagaaguuuguaggaaugcuuuuaaauaguuuauauucuuuaggagggggacccuuuuugacccaauauaauuguuuuuagacacacacacuccuuuauuucuccuuuucuguuuuuacuaaacuaucuauuggcaaacauuuggguuguuuauaaauugggacagguacgaaaauaugguaugauuuuuaucaacuaacuuuuuguaugauguuuuaugaaagaacuuaccuucugaaguagggucauucuacauaugaggaaacugaaacucuggugauuuuuccaagcacaacaugguuuuccaucauggacaauaauugaaacagugggcacucaucucauugauuaugggccaggguucccauucagugcuauguuuuguucugucaacugcaacaaucugcuguucccagaaacaaaccaagaugacugacauauaucacacauuuuuuuuauugaguuugaucucuuagucucagucugacuggaggccuucuggagaugcagaugccaguguuggguuccuugcaguuaccaugagcuccaucaagggucauuuaaucuuauuuauaugagcuguacuaauucuuuucaagcaacaaaauuuguguucauuaacaucugugacacagcacuucaucaggagcaagcuagacgaaguuuaaaaugggccuguuagacuuaagucuguaacaacucuauaaaagcuguucucaaauucauuccauuaaauaaugaaaucuguaacaaauggccuaucaagcuaucuuuucacaguucugcacugaaguuuguugaugugcuguuugcaguuuacuugcugugagcagguaugugcaguacaggaguaugauaugaagauuaugacacugcagugguacauauucuguguuauccagagguggagacaucuuuaugucaugauuuaaaacaacaacaacaaaacuuauuucuuacaucuuugacagcacucaggauuaacauaaauaugcaggcauaguaguuagucugcauuguggcauuccugacauuagucauugcauuuuauuuuaauuuugauuauuauaucuccccuuuaguauuuuucccucccuccguuuccuccaggaucuuccuuugggagcucaguuuggcuuaguguuucugcugccucagcuucugcuucagggaucacagguguaccaugaugccgacuaacuuuaauguuucuguaaaaauuuccaguucuuagguuuuuguuuuuugauuugguuugguugagcugucuucugugauuuuccugcagccacauguucuuggccuguuggcccacuaagaaaggccuuauuguuucucugcuccuugcuuuauuguccagcguaucgugucucuggcgguuuuccuguguaggggaugaagugacgcuauggaggcagcaccugaaauugaaggcacaggguugcugggguggugaauguucugggcuccaccacacagagcuggagagggagcaguggccugugggagcaagacacugagcugccuugagcagaccucuuuggaccugugcccacuuuggaacugcuucuagugcuuuucacacuucagaagacaagaaggcugagggugccgcucaggccauaagugugguaaaggaagcacaggggaaacagcucucgcguugggcagcguuggaggcugcguucuaucuaauggucuagagagccccggugaacgcuauuagguaguagcagaaaauguugagaugugagcaguguagugugaacagaagggcucaucacccagagaacaagaugcuuuuaguaacuccacucaucuguggcuaccugggagauggagucugaggguuccagccucuuccguguucucuuggugguucaguuaaggagaaaaacacacggcauggaauauuuauacuuugaccuucacuacaugccucuacuugccuuacagccuuucugaaauacaaaggugaauucaaaauuuauuuucuuuccuuucugauggaaacagaauauuuaagguuaucaauuuaccuuugauuaaaacuuugguuaccccaagccaauuuguaacuguguaaaccugaccucuaauguacuguaguauguuuauacuuuuacuuuacucagaauuuaguugguguaggguuuuuguuguauguaguucuggcuggucuagaacuugcugguaaagcuacagguuaccacugcuuuuugaauucugggauugcaggccuguggggugguuuuuggcuuuuaagcaaaugcuuacacacuuguaauaguagcuuuuaacacuguguguuuguuacuuucuugauagauaaaaucccuuuacugcauauuuugauuaacagauuaaaaaauuaauaaaauuaaucacuuuuauugguuuuaucaauuucuucuuguguuucccucccuuaacuauacaugcauguuuggcuuuaccuuagcaaacagauuggcucaguguuuuauuaguguaaaacuccuaacgcuguuaauugcccaccaccucuaccucugcucccuuugggccuuuaccugguaacuugagcagguauccuguuuaccaacugagugugauucguuagcauuuuauucuacagccuucugguucuguacauuuuugauguacauuuuaaaugacuuaguacuuagcuguuuagauuaguaaaaaucaaaauguuagcuucuuuugcuugauuaaauuaaguuauaaaccuuauuauuauauuuucauugccaaaauacguuuuaccuaacauggggauaaugugcuugcaugaggcaggagaaccaccaguucaaggucagcuuguguuacauguuaagaaagaaagaauuuauaucuuucuguaaauuccaaguguacaacacuugaaguuuuuuuuguuuuugaaucuuuguuuaccuauuuaaaaaaaauucaauuuuuuuugaaagaaccuuuuuuacccuaucacagacuuuauacucuagaaacacuuuuuucaaggcuuaucaggugaauuaguggguaaaggcacuugcauugcaaccauggugaccuguguucaauccccagaacccacaugacagugggaggggagcaucuauuccaggguguagccugcugcguuuccccucccucccuuccuccuuccuucucucccucccucccucccucccucccucccucccucccucuuccucuucuccccucucucugugcuuguguuuguuuugacucucucucccucucucucugcaugucuccauuuccucccugucucucugugucagcucucucccagcucucuguguguguucacacuccuccccucucugugugucugcccccacccccaccccacccccggccguguguacacuccccucucucuccguguccacucuuuuccucucucugugucaaucuauacucucuucauuucucauacacacacgucauuuaaucauuuauuuguauuuacuuuugaauuuaauuuucauucucuuuguuugagaggacuuuuggaucuuuacuuuuugguaauucuuaugauuuauuuucagaaccugacaguggcucuguauugauuaguuauggcugaaacauuuuuugucacugagccuuggggagaaguguuuuuguuguuuuauuucuaauauuuuaaauauuuaccuauguauauuuaguucuuuguuuucuuucuagaccuaguaacaacuacauaauuuuuguuucuugcuaucaaauauuaucuucuuuguuguuuucauuaucuuaauaaauuuucuguguaauguuccccccuucucaaauuuauuuuugccccauucuccuagauuugaucccuaucauguucugccauccucaucuagcaugacaguuacuugagguacugcugaguguaccacuggauauauagggaucagggacaggguuucucuguguagcucuggcuguccuugaacuugcucuguagaccaggcuggcaucaaacucccugagaucugccugccugugccucugaguguugauaucagaggugugugccacugcuucccagcaggauggguucuuuuaagagccuaugcaugacaaucagcauaaaagcuaauaauaauuuagcuguuuuuuuuuuuuuaauuguuggggauugaaucugggagauuuuacacauaacagaaagcacucugccacuacaauacacacccucauugcugucacaguuuuucuugggagguuuauucucugggcuguuugaaagaugagcaacucaugauacuauuuuuuuuuaaacauucucuauaguuuuuaguuauaaucuguucauguguuuaacauuagaagguucauuguguauggccucaccaaggcaaguggcuguuccuuuuaggggguucuaaucuagaagaggugcauucuacuagaacagaacaagggcauuccucuaaucugcuguaugccagaauuuagaugaguaucuuucccuguuuuuuuuuuuuuaagaauuuucugcuuauauauuauacauuucuuuaaaaaguuacuugauaauuauuuuaaaugacaaauuggaagcaucaugcugcccauucaacugggauucggcuguuguuaacauuuuuuuuccuucuuuuuuuuuucucucucuuucucucucucucucuuuuuuuucccccgugacaggguuucucuguguagcccuggcuguccuggaacucacuuuguagaccaggcuggccuugcacucagaaauccgccuaccucugucucugcaucugccucccgagugcugggauuaaaggugugcacccccacggcuguuaacauuuuugagaagaaaaugucaggugcucucucugauuaucugauucugucuauaccuuucuuuuaccaucugauugauuucugcaaaggaacugcauucugcauucagcuuuugacaguuaaguuaccuacauaaugcccuuucagauuuggauauuucaguauacaagaauauaaaaaauauucuugcuggacauguuguccccuaaaugaauauuuuuccauaaacaguauuucugugacuccagaaacuuaugucaguauaguaguuuaucuguguuacccucuauuuuauuucugcugcgugaauuaaugucacauaaaauacucuccuuucccaaguagguuccagguuccauuaauauuagagagucuacuugcuuauuggaucucuuuuguuugcuuccuuuaaucugaagauuuuucugaagcccuugucuuuugacccucagcccuucucccugacccucucaucugcaacauagaaaugucuuccuuuugucuuuguuauuuccuguguuuagauugcuagaguagcaggaugcacugaugcgucuccgucuccguagaaauugccugguuaacacccuccauccuuuauguuauuuuuuauaucuaauaacccaacgguaggggcagagacaccuuuaagaccauaugaauauuuugcuuugagcagaugaaguuagaaaggggcaugugugcauagauuuacaugaucaugaguauuuacucacauguacacacaguggggaguacugcccuuguaugucuuucugauucauccuguuuuuuuuuuuuuuuuugcuuucuucuuuuguaaagauuuucugucauuguaagaacucugaauucaagaucauauaugcuuucauuuagucucucauuaaaaaugaguuguuuggguuuuauuccucuuucuuuucuuucagauuuuuacaaaaauaguauauaagauuuuaacauucuuuccaaaagccaaaacuuuuaccaaaugucuauugagagaacugucacuacuuucuucuuagaacuuguuccuugguucuccuaaucucuuguaaguagccuacaucauuguuuucuaggcuuauccuucauuuguguuuucuuacuuccucuuuuuacacuaaaagcacauuauagacauugcuugcauaugccccuuuuauguaaaaauauuggaaauucuucagucaguucuuuguaguuuuuuaacauagaaauuauaucaauucagagauugcuguauuuuuaugcugcaguuuauuugaccaguuucuugugcuuuguuagucaagagguuuccaguguuucauaauacaaaugcuccagaaguauguaaccuugugcacaugcagaugucugaauuauugagagaaauugccacauaaauauuuagaaguagaauuacuaccuguggauuguaugugugucuaguuuugauuugugcauuuugccgugccaaaacugagagagcugcugcagcagcugugccagggaugcagcuguugcauguuugccucacaugguagcggaugagugaacaugaucauuucuuaaauuauuuguucaucuuuaagagucaauuuuuaccucuguauuuggucuguuaguaaacguuuuggcacuuuugagaguucuuagagaaauacaggcuauuaucauguauuguuugauguacauguuuuuauuaguuugucaguuugucuuuugacuuguaauaguucuuuuggccauggaaaagauuuacuuugagacaaucucauuguguaguccuggcuguuuuaguuccaaagcuaacaaggaguaaauggaauaaugcagcagcagcauuuugccaugcacagugguaagauaaggagccaugucuugcugaaauuacucccuggucucucccuucuccucuguuaagaugcuuugagaauuucauacaauguauuacaaucacauuuccuccacuucuccaauuccuucuggauccucucuacuuccuuauacauucagcuuuguguccucuuucuuaaguagagacuaacuuguacaucucauaaguuccuggaucuauggccuuucacuggcuuuuagucagcuccaguggaucugccacacuuagcuuucguuucucagcuuuccguguauuucuuuccguggucaucugaaucuggggacuaaaauagagucuggcuucuuucugauuuuuauucugggucuagcaugcagaagaaguaugcucuguucuuugaaccaacagugccuuaacuaguuuuuucuuuauaguccagguucucuuuuucccaacaagcuuuaugcuuauuacccucuucucccaagccugggaagagggguaaaaguguuuuuuuuuuuuuuguuaguugguuuggauuuuuguuuuguuuuguuuuguuuuguuuuuugguuuuucgagacaguguuucucuguauagcccuggcuguccuggaacucacuuuguagaccaggcuggccucgaacucagaaauccaucugccccugccucccgagugcugggauuaaaggcguggccaccaugcccggccugggguaaaagauuuaagucagcuacaagguuuuccacauacagcagaguauauuauaugaacuaacagcaguuuuuacagcaugcacaagaccugcacaacauuaauccagacaaaaaacccaacauguagaggagcugucaugaagucuuucauuacagaaugcuccagaaguauguaacuuugugcacauguagaugucugaauuauugagagaaauugccacauaaauuuuuagaaguagaauuacuaucucucauccgagcugaagagcuauuggcaauugcugacuucagggagaaggaaaaucaguuuucguugugugucugcccugguagacugacugcuaccuuguuucuagauuauauuuuauccuugaaauuuggcuuguuaauguuugugguuucuuucuuacguguuugcuuuccugagaaucuuuaaucucuauuuaaaacuuucucaagguuucagugcaguuuguaugagaugauucaccauucaagacaaauugcuuuuucaaaaauaaauugaugugacaaguaaugaauaaucuacaaagauuuuguucauuuccaaaauauuuacaucagagcugcaauuaacaaauguauaauaucuuuuauguuuuuacuuuucuuggucuagaauugcagaaucuguauagaauguggcacacgaucuaguacucaguggcaccacaacuguuugauaugugacacuuguuaucaacagcaggauaauuuauguccuuuuuguggaaaguguuaccauccagaguuacagaaagauaugcugcacuguaauauguguaagagguaagaaggcacagcugcuccauugaauugcuuuguugauucuuugcuucuugugaacaguugcucuacuguguuguuaagcuucuagccuuuugucuuucaugcagccccuuuucuagagugcuguuguagguuagaaauaugccuuuauuggggggaggggggaaagagauucacuguggccuagaucucgauguguagaccaagcuggccucagacuuuuagaguucuuccaaccuuugccucccaaggguugggauuaaaagcaugcuucacaaauacccagcaaauuuuuaguguuaauuuuaaugaaucugauagacauaaagaagcagauaggcaauagauaagaacaggcaagaucaaaaaugaguacuaggauaaaaauucaagagaagguaguuuaaaaauaaggaaggaaaaauaugucaaugacacuguaauuauguccuuaagugucaucaucuuuuugaaauccuuuggcaguuucuaacccagauagccaucuuuuucucaucuuuuuuuaaaauuauguauuuucuuauuuuacauuucaaaugcuaucccaaaagucccccauacccuuacccccacuccccuacccacccacucccacuucuuggcucuggcguuccccuguacugggguauauauaauuugcaagaccaaggggccucuuuuuccacugauggccgacuaggccaucuucugcuacauaugcagcuagagacacagcucugggggguacugguuaguucauauuguugucccaccuauaggguugcagaucccuuuagcuccguggguacuuucucuagcuccuccauugggggcccugugauccauccaauagcugacugugagcauccacuucuguguuuaccaggcacuggcauagccucacaagagacagcuauaucaggguccuuucagcaaaaucuugcugguguauacaauggugucuuuuucucaucuuuaaucucaucucaaucauucucuuuuuuuaagcaauugacuucacuuuccccagguacuaauuuggcuuuaaauuagaggcuuuuauuuaaauauacuuaucacugcagauggguucacuuagaaugugacaaaccaacugaucaggaauuggauucucagcucaaagaagacuauaucugcauguauuguaaacacuuaggagcugagauagaucccuuacauccagggaaugaaguggagaugccugaacuaccuacagguaaaaaaaaaauaaaguguguguauacuuuuuaaagcaauauauugauuaguuuccuuaauuuauaaugaaguuuuuguaucaaaucccauuguauuuucaauuucacacaacucuccuuccucuuuuguauuugaaaaagucucacuguguaguccauguuaaccuugaacucauucacuuucugcauuagccuccaagcgcuuggaucauaaauguaguagucacaucuaaaaccugugaagcuucuuuuaaauauucacacacucaaacuuguaaugcuuuauaauguucacauuugaaacuguaaauauauaugcuugugauuaacaaagucaaaucugcauugcuucuaauaauuuaucagaggaagcaaaaaacuugugcugagguagaaaaaaugaauuguuuuuuguuaagauuaugccaguggaauggaaauugaagguacugaagaugaagugguauuucuggagcagacaguaaauaaagaugucagugaucaccagugcagaccuggaauuguuccagaugguaagacuauaguuuugaagaaaauagguaguauguaaauaucuucuuggaaauuguuuaaagaggagcauuguaagaccuggagaugugacucaguaguacagaggggaugcuuaggaaaaaaauaaucaccuuuggcauauccauauucgguuguaaucuaaucuuguuaauaaauaugaacuuuguuuagggaacaaguaauuuucauuaaaaaguaaucuauuaucuucuuauaauugugaauaaauuuauuauagauuagguauuucuugcaaagauuuuggaaauuuuauuauauuaaguuaucucaguagugcuuuuugaggguauuuuaaagauguuucaacuaaguuuuuacaauauugauaauagcuuuacugaauuuguauaauuaguaaacuuuuauauuugaggaaauugcuuauuaaauuaugagcuguucuaaauuuuuucuuuuguagaugaacuuuuguauuaaauuacauaauuugaauacauaacgucuuggaguuuuuuaagauguuuaaugucacauuuuacaacucauggaaauuuauacauuauacagauuuaacuggauaaaauaaguuauaucagauuccuaauuguaucuuacuaaauuguaucuuacuaauauaauaaguauguuugugcucguuuuggaaauuggcauuuuauaguaaaacucauucaguuacuguagagacagugguauuagagaaauguugacuucuuacuuaaagguuccuguaauauguuguuuauugcuagcaguucaaguguacacugaagagccccagaaaaguaauccacuagaaagcccugacacaguuggucucauuacuucugguaagcuauauguucagauugugcaauuuaauuggguuauaagauaguugccaagaaacuuuuuucagcuagagucacaaugaauugguugucuaagaaggauuuaugaucuggacauuuaguauaacagaucuauuacuugaaguuuuucuuucaucuucauucauagccugucaucagaccaggcuaaauuuuguucauuuguuuguuuguguuuugagacaggguucacucuguagccuuggcugcccuagagcuuacuguguaggucagguugguuuugaacucuuagagauuugcuuguuuuugucucccaagugcuggauuaaagacaugugacaccacaacuagcuuuaauaaauuagaagucugauuuaaaguuuaccagucauacauacuucaguguuugacauauuaauagauuagucaagauuggcauuuaagguagugauaaugaggauaaacaaguauuauaauccaggccgugucuuggcuagguuaacguguguagguaauaaucagagggaucccuaguguggcagaaauccuaucagaagccagaagcagugucacagcugcguggacagauuaccuuuauguucuaauguaguuucccuuuucaaagucugccacuucacuuaguauuguugauuuuuuuuuaaaacuagcuuuaaaaaguuuaacuuuccaugcauuauuuuuagucuguaggugcuuaaacuauaaaugugucauauggguauaauauaaauauauuaguugagucucuucucuuuguuuuguuuuguuuuguuuuuaaccagaaauuacuuacuuuaaggaucuuacaaagccguguucuuaaaaggcccacaauuuauuuuaauucacaaaucauuuggaauuuuugcuuuaauuacuucaauaauuuuguuucuugaauaccuucaaaguuguaguuuaaccagauaaucauguuuaugauuagacauuuuguaauuugcauguuaguuaaugccacccauauuguaaauuuuguagaaucaucugacaauaaaaugaauccugauuuggcaaaugagauugcucaugagguugauacugagaaaacggaaaugcuuucuaaagggcgacauguuugugaggaagaucaaaaugaagacagaauggaagugacagaaaacaucgaaguccuuccacaccaaaccauugugccacaagaggaccugcugcugucagaggacucugagguggcaucuaaagaacuaagcccuccaaaaucagcuccugagacugcugcaccagaagccuuacuguccccacacagcgaaagguccuuaucuuguaaggaaccauuguugacagaaagaguacaagaagaaauggaacagaaggaaaauucugaauucuccacaggauguguggauuuugaaaugacucuugcuguugacaguugugacaaagauaguucaugccaaggagacaaauauguagaguuaccagcugaggaagaaucaacauucucuucagcaacugaccugaacaaggcagaugugucuucuuccuccacacuuuguucagacuugccuucaugugacaugcugcacgguuacccuccagcuuucaacucugcugcuggaagcaucaugccaacaacauacaucucagucacuccaaaaauuggcauggguaaaccagcuauuaccaaaagaaaauuuucuccugguagaccccgguccaaacagguagggugauguuaaugaugacagaaaagauauugcagauaucauuuaaaaugggaaggauacauuuagcuuugguugacuuuucauccauagaacucaguuuuaauguuucuguuugggaaggagugcauuauuuaaaaaaauaugcucuuaacugagaauguaauuuauuaaacuucaggauauaaaaauaugaucuauuugauuauaguaucuauagaaaacaauuuuaaagaugguuuuaguuccaaaguaaucuuagaacuuuaaaaacacaguguaagauuaugucuaugguaauaacauuuacuuucccugcaauacauuuauuguugacauauauguauuauauuaaccucacaaauagaaauuuuaugcugaauaguuucucauuuugauguuuguuucuguauauaaaugcugucuuuuguaaaauuauuuuucaagauaggauuuacuucaguaaucuuaaauaaaacagucuuaaaaugugcugcuguucuacagcauguaagggacaccucuugaaugugauagguagacacucugaccugaauugcacacugugugcuuccagagcucuuacuguagggcucagaccccuguggauugaccauccuacucugagccuucccugugcuaggagucuaagcugcuuuucuuuguugggcuuugucauuguucucaaguaauauagauucuauauuuuaggggugaauuacaguucuuucuaaguacauuaaagugagacuacuaaaauuaagauaauccugcuuagaauuauuuguuguucuacauaauggcugcuuucugauaucaaacaguagggaugaacuuaguuuguaguauuugcuuggaauuguaagucuuauaauuuaaguugaucccaguaauuacuugacuuuucaauagugguaauauauuaauauuaaacaguuaacuuuggagcuguaaaggcauuauaaaaaaaucugcuuuuacugauuugucuccugaauaaauccuauguauuuuuuauuuuuuaaaguuaaauuacaccaaaggcaaagggacuagcucuugcucuaugggaaagacguuuucagugaacaguagugugugucuuucuaucuguucauauaggucagagagugccagugaucaaacucaggacauugugcuugcccuucgcccuguguguguguguuuccaugucuuugugugucuuaaauauguuguuugucauuuagcuucuaucaucccaugaggcuuuuuuuuccucuucacaaacuacuuccuucuaccuccuaucuucauguuguuuuguuaaguuagcuguauaacaguuauauaguucucugucucauauugguuccuaugguuuugcauccugugaagauacugcauuauaaacaguauaaacaguugugggaggaauucugacuauugcccauguuggccugcaacuccuucuauuccaccucuagccucaagacugaugggauuacggaugugagucuccagcauuaugucaugcuccacccuaggcuaacugaaacagccucugaggcucccguuugacugggauagagauggaugcuuugcuuucuuugcucugcuuuguuuguuaguuuuguaaugugcugaacagaauacucugggaaaagcuuuuuaggaaguugugggaaguaggauggaaagauucuaauugcucaaaucccuugccuguuuaccuuucagccuguuuuauuuuucacaucccacaguccuuugcuugguuuuucuugguuuuuaaaauugcuucuugauucaggaucuuucuguauagccagagcugcccuugagcuuaggguuaucauccugcccugcuucugcuuccuaagugcugggguuauaggcauguacuugucugcuuuaguuuauaaauucugaaauaacaguaaucuuaaaucauuuuuucaaaaguguguguguugcauguauauguauaaagcccuuugcaaugcugagcugaaggcacaugcaaacuagaaacaccaaacuuuuuguuuccuugugcugguucuaaagcuauucccucaaucuuggcuaaagcagccauaauuguauucagaaacuauugaauacuaaacugggugacuuuacucuaacagugccuuaucaaucacaaucaugucuaauuucuuaaucugauuagaauugggcuuuauuguucuuucuuugaaauaggaucucaugcuauaacccuuccuggccuggaguguacuauguagaccaggcuggcauucaacugauagauccuucuccaucuucuuuccaaugcagaauuaaaggcugugagaccacuugaggcugaccuuggguuuuuagagagagaacagguguuuuauguaaaaagacugcuauaagucauaaggacaagguauuguuauaauaucaucugcauaauugagcaaguauguuuaccaaaagacaucuggcaacuuuuauuauuuagaagugugaacuugccugugacguuccacacccucucugguuguucaucccuugagucaccuggcaauaguguugauuuacuguauuuguuuuucucuuuucuuugcuuucuucucuucccuuuuuggagguaagugggugguaagguacucuagagccuacacuguccucaaacuuggaguauucuugucuuacuuuuacagccuccuaaagcugagauuagauugacuuuaaauagaaagcuggacauaauauuauuuccacuuaucauugucccccuuuucuaucauacagcccuguaaauaccuacauuauauauuuauaauuuuuguauucuuuguagccaguucaaucuuuguugcagauuauccauaaucucuauuggauuucaaagcagcuggguucuauguaguucuucucaauuuucaguuccuuaauguuuuauauuuggacuauugcuauuuauucuaguuguagauagcuuaauaguaguagcauuguauuguggauuagguuuuuuuuuuuuuuuuggagguaaggaaaucuaagauuugggacaacuggaugagcuuaguguguuugauuguacagugcaauguuuauugaugaauuauuucaugcccacaugcaugcaaaaauauaauggaagagaaaaauagugcuuaguaguuguugaacagaacacuugacacaauaaagaacaaaaauaggggaaaaaaaccccauaaccuguucuugugcuuauaguccaauccagguaguugcagugaugauaccuguaggcagaacauaaugcagaaggcaagcauguaucugucaguggcagcucaccucuucucagugcuguauguuaaguucuuauucuucaaagcuggggucuaaaggaugaugcauaacugaauuuugacaauuacaacaguauuuucaguuuuaaggucuaaagauauauuagguaauuuuuuucuuugucagaauacauacaugauuuuucauuaguuccuuuuaaaauugaauauaaucuaucuucuuaugcccuaugauuauacacuuauuaaaauucauuaggcaacuaucaaguuuuuauuauauaaauucuucauagcagccaaguaguuuccuaauuauuccuguauugacacccagauuuucuugguuuuguaagcucuuuaauuuguucauccauguuauaugaaauguaaauacuauuugaaaugggauacaauuuuggcaucaaaacuaauguaaauuaugaugaauaaaacauaaucaccagaaaauucuuauuuaugaaaaaauuuaacauuauuuuuaucuugaaguuuuacuuuuuaugauaauuuauaguagguaugcaaugugugcauuaaggaauuaucucuagugaaagggaguggaaguagugacgacuaggcugagcuagaagcuugccuauacuucaccgcugaauagaaugauagggugcagaggaucucagugcuauaaccagagaagccuacagauccaguaaggaauacaggcucacuuauggugcuaggugaagaccuucugacaaggagguacccacggccuuaccugaaggguuagaagcagccauccaguuuuugggauuggaagggggaaguagcugugucaguugggcucugacuguugauaguacaguauguuugaagggcaggaagauugcacagacaaggagaaaauauauaugguguguggggguuggggagcagcuggaaagguuugccuuuuaagugaauugaggcacaaucagaggguucaaaauagguuaguuucuuguuaggugagauuuauauuucuuagaauuaaucuagcugcuggguagagaaagucuugaggagacuguaacgggguggaaggaagcagaaauaccuggcuguuagagcagaugguguacaagacaguggcaggcaggacuuggaugcugacaguggaagugcugaggggaauguaauggccagagacaaaugagaucaauucuucuaaguuugcuaaugauuugaguggaagggucgauagaaaacagaucagaagggcagagaacauguuuuugaccagaagacuagaugccauuauaaaacugagaaagacuagcaaacaaaccaacuauaggagagauuuugguugugacaccuguuagagguugucuaguuacuuuccugauguuuugagaaagcaccaugaccaaggcaguuuauacaagaaaggguuuauuugagguuuauaguuucaguggguuagaguccaugagcaugaugguugagaacaugagagcagucaggcagacauggcacuggggcaguagcugagugcuugcaucuuaauccacaagcugagucagagagagcaacugggaauggugcaaaucuuuugaaaaccuuaucccccagugacacaccuccuccuucucagccauauuuccuaguccuucccaagcacuuuaaccaacuagauaccaaaugcucagcauacguuucugggccuacaggagccauucccauucaaaccucuauagaaguuuauuuuucuuaaaaagauggauguauuaaggaaauagaaaaaaauuaaauacuuccuugaagauguuagaaaaagcuagaacuagaaaaugaauguagaacuguuuccaauaugcuauuucaaacguucacuguaaauaguguuuaggauuuaggcuucgguuccuaggaaauaugagggcuuuaggagugaaugaggaagagcuugcauaggaaauggagggaacuaaucauggagggagguguacuacuacaacuguccugaggaaaaugagaacagagaaugaacuuugagcaacauggaccuccuauggccccuugacuaaugcagggaugguggcacagacccagaugccaugagaagugcugcagugagcaggagugaugcugagaaguuuguguccuuguuaacugcacuuggguaaagugugguuagggaagugacucacaguaagacacagauagaggcuggugauggugcuggccucaagacguguggcugcuuaguuugaguuagaaguacaauuaguuuuuccuuucuguuucuuaauuuuuuuccccucuaaacaucauuaacuguuacugucucuucauugugaguugguggucaaucucuuauuuuugguuguuuaaauugcugauugcauuuuuguuauuacugguauucuuacuaguuugauaauguucuagacacaugguaaguacaauauaucuuguuuuaagauuuugucauuuaacugguaaaauaaucauacagauucuuaaauugcuuuacucaaaauaaggucuuuguuguuugacauuucuucuguuuuucuuuaaacuauuacauugguggaauaaacauuguucuugcucuucauuuagcuucaucgauuaguugagauugcucagugugguuccuuggaaguaaaaugccuucauuuuauuuuaacuaugagacauugguucuuguauauuaggugucuuagucuuuuaauuugcaaauuaggacaauuugcuuuaauaaucucuuaacuauucaaauuaauuccuuggguauacuuacucuuaagauaucauucacaucaauaaaaaucauccaacauccaugcccucaucugagcaugucuuuuagccugcugguuugaguguuuauacuaaugaauacaacacucucuaaaguugucucuuccccuguuuugguacagacauacuuguuagaugaguauaaucccugaguguuuucuucuaguauuaauucuuggaccgugacugacuuuuacauuuauuuuuguacuguaguuauaguucaugagucaugcuauaugaaccuugauuuuuauuucaccuuauuguaugauuuuucuacuuaaauauuuaauguaaauuaugcucgcaaacauuugaguuaaagucacuuuaggugauguuuauuuucccaaacuuaaagcaauuuguccuaauuuuccauaccuuugcauuuacuuuugccguccuaaaauguuuuaguugcuggcuuugaucuuuuauguugcugaguuuuauacaucuauuuucucaccugccauacccuagggggcuuggaguaaccauaacacagugagcccgccuuccugggccccagacacuucagaaggccgggaaauuuuuaaacccaggcagcuuucuggcagugccauuuggagcaucaaagugguaaauaaaacugcauuuacacucauguaucauuucuuucugguuuguuuuguucuauuggguguuaaauauuaaaccuuuucuaagauucagcuuccagagccacuuuuuaacauuuuucuuuuaaagauuuuaaugaggaggaaguuaaacuguagcauuuaaagauauauuuuuaauugauuuucuuugaaugauuuucuuuuguuguuguuguuauaaguauuucuuugaagagaaaauucuugucacauagaauaagguguaauuugggacuugcucauuuauuguaucauaaauugaaucgauuacauacagacagaggaaauguacuacagugucaggaagcuucauugugcauguucaccucauagucacagaauguucccauguuaugagcuaaugaugcucucucaguucuuaauguuaaguagugugaaaugguuugaagcaggaaaaguucaaaaaauaaucucaaagucagaauacuuuauugacugaagaaggugauuuucccuuauccucucuauuuaguuguuucuaggauagagcuauuuaaguuagacuagugaaagguuucagaaaacuuucagaguauauuuucuuaauuucuauuaaaauuggaagggcacauuuauucuuauccagauaacuguagccaucuaagguaauguggcauaacuuuaguuaauucauuuuaauuagaugauugauuagagauugguuucauuauguagcccaaccuggccuugaauucuauuuaaauccuucugccccagauucccaagugcuggaauuacagccaugugccacuauaccaaauuuaagaaaauaaaccaugauuuuaaaaaaugcuuuuguagcaaaugcugccaauuuucacuuacuaucagucuguaccuauggauguuaggggaaaugaacuaagagauuauuguaauccuaauuuuuuaaaagauuuauuuauuuauuuauuuauuuauuuauuuauuuauuauauguguguacacuauagcugucuuuagacacuccagaagagggcaucagauuuuuguuacggaugguugugagucaccaugugguugcuaggauuugaacucaggaccuuuggaagagcagucggugcucuuaaccacugagccaucucaccagcccuaauuuuuaauuauaccuuuaacucuuccccauaauccuccuugccacaagccacccuuguauuccuauugaaagcaacuuguccagugcaguccuacccuguuuauccuuuguucagagcuaaggacucucaagggacccaaagaacagggugagaauacaaggagaggcagcuuggagcuggaagguguuugcacuuaauuaaacugaaggggaaagcccaagucccuucccuuuauucaugugaugucuuuagucucccgacauaaacauagaguuuugacccugagccuguucuacucaguaggaagugggcucaguuuaugaaauggaugaaggccaucaggugaaaagguggcauacuuuuucaucuguuauaaggaagaaaaaaauuuuuuccugacuucuucuaagucaguuuuuaaguugcuucuaagaugcaaacuuuuuuccagucagcaauaaaucugaauaugaccaauauugguuggugccuacagcuuaagaucucaggaauuuuagcagauuuuccugaaugacuuuuucuuauguuagugaagauauagauaaguuauucccauuucaaacauuauuuuuaagguuuauuauuuugucauuaugccaauuuuauuaagaucuucaaguacuuuuaaauacuauguuaaaaugaauuagauauguucaauucaugugagagcuauugaauaauaaaggguacugaucacauuuucaugauaugaagaaugccacuuuacagaaguaaaaauaaacuuugcuaccuuguaauauuucagaauaaagaauaaacaaccaaggauggugggccacuugcuaacugaggaccuuaagaagucacuuacacuuguuacccucagaacaauuauccuuaaaguggagauacccugaggguuuguugagaagaaauauugcucaaaucaaugcaugcuaagugcucaguaaauguuccuguuacucuccucuccaaggauauaguuuuucuugauaaccauuuuguacugaagagagucuguacaugucuguguaaggauaguuacucuaaacaccuagaauaaaguaguaaggaagucaaaaauagugggaaaggccggcugauaggaagcacucauggugauagaugcaacacugauucuaaagcuuuaaguaguuuuauuucuaaauuauggauacauauauaagauagaaauaguaagucugcucuauuaauauguaucaucuaauuauauaaaaagauaaauauuuguguaauacuuaauaaaauguuuuauuucacugauauaucuggauuuaaaaguucuuuugggcuuuuaugaaauguuaacuucuguaucuguuaugcagggccgagggucuggauuuccaggaaagcggaggccucguggugcugggcugucaggacgagguggcagaggcaggucuaaacuaaagaguggaauuggagcuguuguauuaccuggggugagacuuuugcucuuauuauuccaguagcaauuaauggugauacucucauuuguaacaaguuguuuccauccuaagagucccaggaguagucucaucccuuuacaucuuacugugucucugcuugauaaaauguguuuuauuuuggaagucugcuuagguccuuucguuuucugauuuaccuuccuucucuuucuuucuucuuugauaucuuuuuauaugcaaaccuucuacaagagugaauuuuuaguguguuuucuuuuuuuuuaauuaaaaauauacuauuauuggauuccuuuuuaaaugucauauuuauuucauuucauguauaugaauauauuuuuuuuaauuuuauuuuauuuuuaauuuauuuuuuacacuccguauuccauuccccaccccguaccuccacccacccuccaucugcucaccucccauacuucuuccccacgugguugcucccacuccaccugaccucuaaacucccuggggccuccagucucuugaggguuaggugcaucaucucugaaugaacgcauacccagcaguccucuauuguauguguguugggagccucauaacagcugguauaugcugucuguuuggugauccaguauuugagagauauuggggugguccagauuaauuaagacggcugguccuccugcaggaucgcccuucucagcuucuuucagccuucccuaauucaacaacaggggucagcuguuucuguccauagguugggugcaaauaucugccucugacucuuuuagcugcuuguugggucuuuuggagggcagacacaauagauccuuuuuuuuuugugagcucuccauaaccucaguaauagugucaggccuugggacauccccuugagcuggaucccauuuugggccugucgcuggacuuucuuuuccucagcuucuucucuauuuccaucccuguaguccuuucagacaggaacauuuaugggucagagaugugacugugggauggcaaccccaucucucacuugauauccugucuuccugcuggaggugggcucuauguuucaucuaaggucccuuucuuugaguccugggaaucuccuaccucccaggucucuggugcauucugggggaugcucccaaccugaaguugccuguuuccauucuuucuguuggcccucagggcuucaguccuuucccucacccaauaccagaucaggguuucccuuucccucccacuacuucccucccaggucuuucccucccucccaacuugugauugcuuucuuuacucuccuaagugggacugagguguccuuacuugggcacuucagcuuguugagcuuuuugaguucugagaacuguaucuugguuauucuuuacauauuuuucuuuuuguaugugugugccuggugcacugggaauucagaaugugacaucauaaauucuggaacuggaguuacaagugguugugagccauuuuacauggcugcugagaauuaaauucauguccucugcaagaauaguauguagucuuauguacugagccaucauuucuucaacccucauuuuuuuuauuacaauugcuauauuaagagaccuauagaaaaaaaaugccugagaaaggcuguagaugaauacagauuccagcgauguccaagauuuuaugacuauuuuggauugagaaauacugauugacacguuuuaagguuucucuuaauugugcauugaaaaauauaugugauuuggcugugcuuuugcagucuaaucucugcguucaguaggcagaggcugacagaucucugaguugaaagcuggccucaucuauauagagaguuccagguuccaggaugccaaaacguaagaaacagacagacagcaacagaauacacacacacacacacucacagacacacacauaucuauauguguguguauauauauguauauauguguguguguauaauauuggcaaauacuuuauuagaaccuuuauuauuuaacugaaauacuguuuuuucacuuucuaaaaugccauuuuaaguucaaaaagcaugaaaucacucaguuuuacuacuaaccagaaccaagaaaacugggauucugguccuuuguguuuuauaugaaguaaauugaaaacugauuuauuucugggcauggugguucacacccuuuaucacagcaccugagaggccucaagcauugaauuuguggucuacuuuauuuacaagugaguuacaggcuagcagggacuacauagugggacccugucucaaaacagucaaacucaaaauagacuuuugagacauaauugauauaggguacauauauuugacacaugcaugcauacuuuagcccuugaaaaccacaaucaaguuacaaucaagguauugaagaccucgagcucuuccagucucccaggaaucgcugaaguccucugguucccagcuucucuuuuagcccuuuucuucauugcaugacugcucugaauuucuuguggcucaugucuguaguccuagcacuugggacugaugcagguugaugccaguucacauguuuaaauguuucaaaaguuuuggucaugccucaggauuaaauauuagguugcuuaaugguuuccccuguagcuguagucaucagcaguuguuaagacauuaaauugcuguuaauuaugccaugaccauaacaucgcauuaauacuauugauuaaaucugauuuaaauugaaaauguuacaguaauauauuuuuaguuaaaauuuuagccauuccccaauaaaaguauuuuaguauauauguuuugaccuugacuauagcauguucaguguagguucuaguuuuuuaagggcagaggaucauauuuuaguauuuuaggauuggccuccugguucccuauugcuccaucuaaaucagagcuuuugugugggcauggugccugccuaguugauuuggugaaauauaauuaaauucagaaaugagcacccucgguugguaauuguucuacuaauacugucauuuugauaaaccaaugauaauaauauucuaaaguagucgcauuuaguagcaaugaguaggaaccacauaugcaauuuaaaacucucugggagcuacauuuaaaaacuuauagugaacuaagaaaguuaauuuuaaugugccuuaugacuccuauauuugaaucauuaccauauucucauguaauguauauaagguugauaacuagcuauuuuuauauucuucugagucugguacugagucuuugaugacuccuauguguauuauaguauauucuaguuucaacuaaucacauugcuguucucaaguggcacuaaaagugauaugcauauauuuacauaugcuauaaauuuauaguuucaugauuagaauuucuguauaauuauuacugaagacagacuuuaagguuuucauuugaccuuauuuuuggcacuuguacaucuaaaguaaucacugugugaguuaaaaaaaaaaugaucaugacguaauuuuuagaaacagggacuugcuguguaaucaggcuagucucaagguaauccuccugccucaggauucuuagugcaaugauuauugauguacaccaccaugucugacuaugagucaaaguauuucucaauuaaugcuauguagaauuguuagucuagacauggacaaaaucuguauuuggauaagaauuuucaguuaaguuaguauuuaaaaguaaguacuacaagugaguaacauagcuugauguucgguguuuuugcuuuuuguaggugucugcugcagauauuucaucaaauaaagaugaagaagaaaacucuaugcacaauacaguuguuuuguuuucuaguagugacaaguucacuuugcagcagguuugaacuuaaauuuucuguuuuucaauucuucuucauuuuaaucuauaccaucugccuagauaucauccaguuagacuauaauacuaugcuaauuaagaauauauuuuuaaaaucugugugaucuuagcacuaucugcaauuuaaaauagcuuuacauguuauuaauuuucaggauauguguguaguuuguggcaguuucggccaaggagcagaaggaagauuacuugccuguucacaguguggucaauguuaccauccauacugugucaguauuaagguaaaugugcuuagauuaaaugaguuaaaguauuuuuaauaaagaauuuauuuacuuaugugcaugugugccuuuguauaugcaugcauauguaugugugcgugugcaugcauguuugugugucucugaacaugugcauguggauauuuggaagucaaagaauaacuuguaggaguuuuucuucuucucuucucuucucuucucuucucuucucuucucuucucuucucuucucuucucuucucuucucuucucuucucucucuucguuuuuugagacagaguuucucuguauagcccuggauguccuggaucucaugcuauagacuaggcuggccucgaacucagaaaucugccugucucugucucccaagugcugggauuaaaggcgugggccaccacugcccaacaguuuucucucucucucuuuuuuuuaaccaucuaugugggucuuagggaucgcuuuagauuaccaggcauggugcccagggucuuugcccuucaaacuauauuccuaguccuagcagaggcauaugaguuuuuauuuuguuuuaucacuaauaugguugucucaguucuuaagacuaauuaucuauuauauauaauaugccaauauuuaaaucaaguauuuguucuuauuaugcauauguggcaguauuuuaguacuuuuaauacuguuucuaaguguuacuccgauaaauuaguuccuaaaaaucuguguucuugauuuaugcaaauuauccuggcaguguauuggaaaggcauaaaauguagauauuuacucuuaaaacaguuuauuuuauaauuauauacugagagguuaguuuacuucauucuguuguucuugacuauauucgugugacugcccaugucucucccacauuuagguuccucagcccuucuucacauacauuuucuccuuauaucuaaagaacaauguuaguacuauauauuucaugcagaaucaaaacauuuaaaucccaaauuauuuaaugccaguuuaaaaaaaguuauacaugcauaggagaaacuauuucuucaugugucuucauauucaaauguguugagauuugacuccagaaaacuauugaagaaaucaaauaugauuccuuucaagaugugauuguaaaguuuuaugaacccaaugaugucuuaauauagccauuucccuugacuaccaugauagcaguuuuuggaggaaagcuaagauuuagagauauuacccagaacuucuguggauuucuuuuaaguaacccauccauuuccauuuccauuuucuuuucuuuuuucuucuuuuuuuuugcaauuuuuuuauuagguauuuuccucauuuacauuuccaaugcuaucccaaaagucccccauacccuccccacuccccaaagauuuuuuuauuauuauaucuaaguacacuguagcugucuucagaugcaccagaagaggacaucagaucucauuauggaugguugugagccaccaugugguugcugagauuugaacucaggaccuuuggaagagcagucggugcucuuaacuacugagccaucucuccagccccuccauuuucaacuaaacuaauugaacuuauauaaagaauauaaaauagggggcuggaaagauggcucagauauuaagagcagugacugcucuuuagagguccugaguucaauucccagcaaccacaggugacucauaaccaucuauaaugugaucuggugcacucuucuggcaugcaggcauauaugaaggcaaaacacuguauacauaauaaaucaauacaucuuuaaaaaaaagcauuaaaaaaauaaaacccaaccuauuauuagcuaauuacagucagguagcauuuaaauacaugcuuuucuagcuauguguggugucuuuuguaguauugauaauuauuuuggacagaacauaauacuauauaaaguccuacuaauuggagaaacaaaaggugauggugagaugccugaguucaacccuggaauccacauaaagguuuaaagagagagcugauuugugagggugccccaucccuugacuuccaucggugcacauguguacauagucacagauggauaugcacacacaguaauaaagaaacaaagguauauggagaaauagucaaggcacaucuuccaggcuuauuuuuuauuguggcaauagcaauuauuguagauuaaccauggaacuuuuuaaucuuuccaaagagccuuuauucugaaguugauauucucauauauuuagaucuaaaaccccuaaguaaugcucuucaaagagauagaguguguuguuguuuguauggguugcagcuauagaacacuuacuauuuuauaaaucaaaauggaauauuuuaaaauacaaaaaaauagaaacauuauuuguuuaauguuacuauggugaugucaauuuaugucauacggucucuaaaauacuguacaacugugaauaaauuaagguauauucaacaaauuagcucuuagcagcagcagggcucugaaaguggcucugaccugaggagcacuuggcagagcugcucuagauagucccuggucuaugagcuuuuugugguuaccaugcaguuuacuguacuauuccacucugcuuuucuucugggcccuucauaugguaaauaauauauuauaauuugguaauuucagacauuuagaugaaauuaauauguuaaucaagguaauaaggagauguguuuaaacaucaaaaccucagucuuauuaagcucuauaucuguagcauucauuuacucuuuucacgggucuuauuuugugggucauucucuaguucuaaguaguaagcuggugucacagcuugagcagugucugacauugcugacucauuacucugaauaaucacauucagguuuguaaauucagguauauaauuccuuccuuccuauuacauuuuaugguagugugucacuggacaguugaugcagaaaaauacuggcuaucaugcagaaaauguucacuguaauucuaaguaaggaaauguggcuuuugucuuuucuggguuuuuaauagcaagaagaccauaaucaugaguaacucucuauucuuauuuuauuguuuguuuuuagcccacugcacauacaccauccuaucagauuaauuucucaaaugccauuucccugggguaguguucuguauugccuugcucuaaucugcccacagcaucugacauguggucccuugcacauccuuaacuugccugcacacaguccuuugcccuuuucuuggaacauauucuuacuccauuccauauauuucuagcugagcuaaauuucuuccucaugugugugacugacagucugccuuuuuacuuaaugacucacguagcuagguuagcuauuaugcuuaguaguugucugcauaagaauggauaucguacgacuguauuuuaacguuugggguagauggaaaguuuugugcuuaugaaccuuuguacuuuugcaacaaauaaagacauucuuauagacaucaauuccuuuuaaaugaauucuguuucuuucucaguaguuuuuaggcuuucucauuccucaugaucugagaucucauaguucuuuucucuauauaccuuuccuguuuccuauucuguugucacugggaaauauaugcuuuugaaguugaucccaugcaggacagugcugauacacaccugugaccccagcacuugggaggcagaggcaggaggauaucuugaguuucaggcuuaucugguccauuugcacagagaaacccugucuuaaaaaacaaaaacaaaacagaacaaaaaaggaaaaguuuauuuccucacauuaauuuuucaugguauagcuucuuugagaauuuuauuagggauguagagagucucaaaaauccugccgauucaggucuuucagacagaaauaaaugaguaaagaugagcuauguaagugccagccuuaugaccuaaaauuccugaaggaccauaaaauuuuaguauuuuguuaugauaauuuccccccuuuuugguagggaaacaauugauugcagagaaacuguuugguagcuuauuuaguagaaaagccauacuguaacccagaagcauuuaaucccauucauagacauaccauguauaaagauuucauugcuguuguuuaaaauccugucaauaguaguagggcagcuuauucaacuuuaaaauccaaucauuauauguguaaaaauaauggaauuaaaucugaagcauugagaaguaugacucaaaugguuauguuaaucaggugggugccuaaaagugugcagauguggugucuguccuauuaaguauuugggcauaguaauguuuaccugcuccuguucuguaugcaugcauguauguaugcauguauguaugcauguauguaugcauguaugcauucacgcacaguggaaauucaugcaauguucuaguuaaacaaaaaugauucuaaguuaaauacauaaagcaaucacauggguuuuauuuucuuuuuccagaucacuaaagugguucuuagcaaagguuggagaugucuugagugcacugugugugaggccugugggaaggcaacugacccuggaagacucuugcuaugugaugacugugacauaagcuaucauaccuacugccuagacccuccauugcagacaguucccaaaggaggcuggaaaugcaaaugguacccuaggauucauguuacuuugucagucuuucaaguucugaacuucuguucucauucugugcacuuguagcuucucagauuuuuacacuuuaauacgaaaauaaacuugauacuuucacugggcuuuggguuucagguguguuuggugcagacacuguggagcaacaucugcagguuugagaugugaauggcagaacaauuacacacagugugcuccuugugccagccugucuuccugcccugucugcugucggaacuacagagaagaggaccucauucugcaguguagacagugugauagguacugcgccccuuaaccuccuuugcuaucuuuaaagcagguuucucaaagguaguaacaaaccuuagaaaauuacuuugcuggauuauaaauuuagggaacaaaacuuugcuuucuagauuuuuagucuauuagaagcuuccggacuacuuuacuauuuaaauuuuuaaauuuuagacacuucaggcuuucaauugggggucuuuuggugauuuaucagucccuugaaaucagauacauaauuaguguuugcacauacacauuuuuguggagaauuucucagucuuuugguagauucuaaaaauauucucccuacauucuucuuuuuucucacuauuucgccccuaaaacuuaagaucuugaucuuccuaacuaguaugugcagacugcuucuguuguuuuucuaucaguauuguuagcaguuuagcacugaauguacagugucaccuuugacucauugguggugcaggauuauuuguaaguaaguuguguaguuuuuguagcaaucggcuacaaacugcucuaaagcaagguccucuuccuugacaugcagcacaucuguugcucgguagaugcaguggguggcacucucacacacacaauuuuaauuguacucuucuguauucuugccugaucugacuagcugcauugcuaucuuugucuuucagcauuugcucaccauuggaugcuguccuccuaacagcaugcauaugcuuucuccuuaguguuuauucucauuccuuuuucuugacuuaucagagcaaggauggaucuuguggguuaauagucauaguuagggggaaaaggggacauuugagacuuggggcuuuagguuugaggacugucaucuccuguuacgauuuuaaaaggaguucaguuucaagcauacucacuucuuuuaaauguguaaauguguuuuguuuuagguggaugcaugcaguuugucaaaacuuaaauacugaggaggaaguggaaaauguagcagacauugguuuugauuguagcaugugcagacccuauaugccugugucuaaugguaagauaguaacauaaacugugaguuuugcugcccugugucuccuugauuugugagauagaaguuguuuuguguaucaaaagaucgccuagucggccaucacuggaaagagaggcccauuggacacguaaacuuuauaugccccaguacaggggaaugccaggaccaaaagugggaauggguggauaggggaguggaggggaggguaugggagacuuuugggauagcauuggaaauguaauuguugaaaauacgaaaaaaaaaaaagaauuauauauguguguguguguguguguguguguguauauaugcauauauauagacacaaauauauacacacacuuauauguauauccugauuaucauguuauaaauauuuuuaaauuagauauucaucaaaauaaaaaaaaagaaguuguuuuguacuauaauauacuuccuauccaaacuuuauuuaaaugguuguauaaugaaaaaaugaagcauaugcaaauuagauguaaaauauaauuuugcucucaagguuuaaccucuuggauuauuguauuuagaaaucccccauucagucucugcugguuuucuucucagugcuccuuguuuuguucuuguuuuggaagcugaggauaauaguggguaccaguaaucugagugcuuggugaugccgaggcagcaggauggugaagcugagcuagucuguauuacagugcauaccaggccaggcucagcgacauagugacaccuugucucaaaaagcacuugaaaauuaaaucaugaaauaaugccuuugaaaaacuaagagcugcuuuugggguugggauggagcaccuggguacacuauuugguuggcauacacaaacgcucuccccaccuccccgccccgcauuaagaacuaacauccuguuguauucauacauuuguugaaugauacauguacagcaacugaaaauuaauucuguauaagucuuuuuuucucaaacauuuccugauugguucuuuuucuguucagugccuuccucagacugcugcgacucuucucuuguggcacagaucgucacaaaagugaaagagcuagguaaaauuggaaauguuuuucuuuuaauucuuaaacaacugacuugaugcuuaaauuaaauuaagugaauugucugauguuaauaucaagaauuaauauauaaaauguucauaucccauuuugaugaaguaguauuccuauaaguuucaggaaauaaugaaaauaauagcucuuuggauuaacuguuaguaucuugcuugccuucacuucagcuggguauugugcuugcuuaguugucaguaaggagaaaaagaaagccuguuuaacuaagcacucauuuaguacuaauuaauauuuuacaauuuguucucugauaacuuagaaugaugacaugacauuuuaugauagauuuauccuuuaaccaauauuuuuacaauauuuggauauaaaaacauuuggauuauauugaaauuauuuuaauaaacaaguuuucacauuaaaaguuaucuucagaauuuaugaucuuauuaguauuuuaagcuagaacacaaaacaguguauuaauggguuugaauacauguauaucauuguacuuaaggaugcagguuuuuacaguguuuaacacucuuuguagguggucaaauugauacugguuuuccaaaugggcuucugaaguauauucauuucucuuauuuacguuuuggacuucacugggagaaagcuuauuauuugaguggcugcagcagcagcuuuagcuccaggaucuucuucccauguucauggaagccaagaugcuuucaguaaacccacccccuuuuuuguuaacauacauuccuguaguccuaaaaaguuaucaguguuuucagugucacugaacaucuucaguuugugcauuuuguagauaauugcugaauaaguauauaguuguaucuuuuugccguguagauuuuggaauauuaaucaacuuaucagucaguuuaaaaugaaagcuucaauguguguccuuggguuuguaaucuuagaccccccuaagaccuacacccaggauggugugugucugaccgagucagggaugagucagcuacagagccucacagucacagcucccaggagaaaacgcacaaaaccaaaacugaaauugaagauuauaaaucagaauaguguggcuguccuucagaccccuccagacauccagucagaacauucaagagauggugaaauggaugauagucgagguaaugcucauuaauuuucuugggacacuuccucucugaguguucuuagauuuguguaugcauauuuucucauauggaaugacuugugauugaaaucucuaagagcaguaugauuguguagcuuauaagguaggucauucagagcgauucuuuucaguuugcugauuugucagcauaagccauccucuaaacuuuguaaacuguugauuuauaaacauuuucuuugaucggaauagaauagguuuuucuaucugaaauugugauguaacaaagaguuuuaauagcaacauuaaauauaacacaauuuauguuuauuuccaagaugacuacauuugguguguuuauuuuggagugauuauuuucauuuuacucagaaauaaagccauaaucauuuuuaaucauguuuuaucacuuggggguauuuauuaaaugaauauuauaugacaaaauuugaagucuuaucaguagacuaacuacauaaaucuugaaucuuuuuguuuguuuguuugguuugguuuuucgagacagguuuucucuguguagcccugacuguccuggaacucacuuuuuagaccaggcuggccucaaacucagaaauacaccuguuucugucucccaagugcugggauuaaaggugugcuccaccacuuccuggcuaaaucuugagucuuaauucuugauguuaaacacaaagauuacuaaaaacaaaaacaaacuaaaauaaacaagaaagugauccuuuugaguucuuuguuuccucccucuuacugggcuucucuguguagcccuggcaacccaggaacuaguuguguagacuguguugguuuugaacucagagauuuggcugccugagccugggucauuaugccacacacacucccugggaacacaacacaggcaggaugauucccaccccauccuugggcaccuacugucuucucuuuacuucucagccacucucagugcagguuauuagaauggcuuggugauguuuuacuuugcuugguuuuuuuuuuuuuuguuguuguuguuguuuuguuuucuuuuguaguuuuuaaguuuucuguauuugauagaauaugcaguuucuuuguauauuuacauuuucuagaaggagaacuuauggauugugauggaaaaucugaaucuaguccugagcgggaagcuggagaugaugaaacuaagggaauagaaggaacagaugccauaaaaaagaggaaaagaaaaccauacagaccagguagaguauaccaacuagucucucucucggucugucugucucuguuucucccccuaccccuacugaaauguguauuaguguuuuguuuguguguauguaaaugcaucaugugaaugccuacuguccacagaggccauaagagggugucagauacccuggaagccaugugggugcugcgaacuguuaggauccuucagaagagcagccaguguucuuaguugcuaagccaucucucuaggccccgagguagauaauucaguauaacaaaacuuuugcuaauuuaccaauaauaacauuuggaacaauaauaaugaugacuuauaauuggggcuauguuuagcaucuuacaugggacugauggauccuuuacauugaaaguguaacuacuugacaauaaaucauuaucccaaauguuaaccauuuauuaguugguuuuuauuuauguucagcuuuuaaagcaauucauguauuuucuucaucagucgcuuuaaagguugaacauaaauaauguucuucaucaauccucuuuuaagcguucauuuugaauaguuuuauguuuuuauuucaguaauuauauaggcuuaaaugugaacaaaacaagguucuucugucuuauugaaucucuagugcaguugauaccauucucauuuuuuuaguucauuuuuuuauuuauguguaugugugagcuuaugugagcgaguguacccgagauuguaaaacuggaguuagaacuaugagaugccauguacgugcugggaaccacacucaaguccucugcaagaauuauaagauuuauaaccacugacccaccucucugcccguaaaucuuucuucucugguauauuucauugguagaaaaaaaagcauuuuucauuauuuuaaaaaaagguauugaagucucucaccaaaaguuguaggccacauuuauugaugucuguuuuuagucauaaagcauuagauuaaugcaaucucugucagaauuuugcauuuguguucuucaggacucuuagugaauagcucugauauuaugucuuuuuaauuauuauguuuccaaguauauuugugcuuuuagguggagcauauuucuuuuagaacaucaucuuuuagaaugauguuuucugucuaagcugcuuuaucuaucacaugugggugacauccacaucccuuuauuugggggcauuauaaagcaauuuacuggacaagaagaucacaacaaaagcuuaugagauuuggugcuguaaaauuugcuaagcauuuuaccaauuucauuuugcuuauauuuaugauaugggaagagcuacuauguauuauagcuauuugacaguuaauggauuacaguacuguaaaguaaaaugacuuaccugaguugaguuaguagaauucuguguuccuagcuucguguaucaugugacuucuggccuuucucacaugggaaggcuaggcagcaccacugaaaucauauugaucaaugaggguuaguguauuuuaguucaguuuucauucucaccgugcaugcuggucugcugugcuguucucaggaaguguaacuuaacaauuauggaagggaaagagacguaucagcuccuuaauauucaagcucuauuguuuuauuugguuuuuaauuugaucuugucuagaacaggaaaucuaaguaguucuuuccauauacuggcaaguuguauuucauguuugauauaauaacacugguuuugacauuuauuuuuacuuccagccuucucuacuuugcacaaaaaugagaugcaaggauauagggauugcucagcagguaaagugcuugcuauggaagcauaagacugagcaaaguuuaaguacucggcacccauauaaaaacuagucgggucaccauguacuauaauccauuuauuaaggagucagagacaaggguuacuaacauaacucauauaaauuuacauaagcacacaaauacacauacauaaaaaugaucuggaaauuuuuaaaggaacuuaauuauucaugauaucauuuugaauccugugacauacucugcugcaguguauaagguagagagagaucaaggauaagauccagggccaguuucuggccuccacacacauacaugcacacccauccacacacacacacacacacacacacacccauacacacccaugccucuacacauagacucagaccugcauacauauacucauacacaugaaaagagauuauuaauuuauauuaaacauacaauugaauuuugaaaaaacuucaccauuaaagacaaagucauucuuuguacuagagaauucuagaauuauuuaucacuugugcacuuucuguuuuauauagguauugguggauuuaugguacgacaaagaagucgaacaggacaaggaaaagccaaaagaucugugguuagaaaagauucuuccggcucuauuucugagcaguuaccuagcagagaugaugguaugugccaauuuucuuugguuuaacuccuugggauugauacuccguuggaaugaguggucgcuaccauaauaaugcuacaugcagcauuaugguuucaaucuaauaaaauauagucuuuugaguuuuuuguuuuuguuuuggguuuguugggaggagagagagugaaggagggagggagggaggaaaagauagagucuggucuuuuaguucagccucguggcgauuucccuacaugggccacggcuaccucaaacuaauauacugccucagccuugccagugccacacuuaacacacacaugccauuuccccacauucccuuuauugcuuuggugcuaagcucacauucuaugauggucuacgcuccucaccuuugcuuugacauuuuaaggccuuaccacucacucuguuagaugcuuccugugcuauauuagaagaguagaagaauuaacucacucaguuguaucagauacucucugccuacuuuagcaaaggccucucuuuaccugccuuauugaccuaauauacgaucaaacuuacaggcuauuuaauugcccaacaaaucuauuuuauuauauuuuauaaauacauugguacauuuuguuaaccuugcuuaagaaagcuaagucuuuguuuaagauagcccuuuguauaaguuugagugcucuggccaggcagcggugguacaugccuuuaauucuggcucucaggaggcaaaagcaggcagaucugaguucaaggccagccugguguauggagggaguuucaugucagucacugcuacguaaauguauuagaagccugucuugaaaaaccaaaaccaaaaaguccuccagcaugcauaacacagcaugccuuaaaacauccuucauaugcaaguuaguacuuuuuugaaaccuuaaugacuuuuuuuuaauuuaggaagacuuauuuuugauauaaccuaauauggguuuaagaauacuuaaagaauuucucuguuuucaaguauuuagaaaaaauuuuagacuugguuuuuaguucaguauuuucauuuaugccuaguaaaacuaaagcaaauucauucauugaauuuuuaaauuucaaauauuguuucuuacucuucuguuaacuuuuugauguuuauuuuauauucauauuagacuaucugcuuucagcuauuguuuauuucuucauguaauugauuuggaauauaaauuguuugaagauuuugccaaucucugcgucugcuuuauuauuuaaucgucuacuagguggagggcauacauuauuugcuuauuuaauuauuucuccucuagaaaguccuuuuguggggaggggcucauuuucuguuuagaucuuuuuucucccccuuuaaugaagugaagauucauuuugguucaugcuuucacagggguuagucaaugauguuugguguacauaggguaguuuagaaauuuuaagaacuuaauugaagauguuuucuuucagaaauuuucagcucuuacuuucaagcugagguccuacuuuccuagagcuacuuuagcuaaaauccuagaucuucaagcaguuucaucuuccuguguuacacagacucagggguguuuuuuguuuuguuuuauugcaacaaacucucagccauuguuucuuuuucuuuugaguucucaggagaaguguuugauguuugguagaaaagcuaaaaaacaaauuccaugaugugauaacuacuugcuguuuauccugcggggugaucuauugaguugguguggcuguacuucuuuaacaaacuggcuuuagcuguuaaaagaaaaugugcuauccauauccacugaauuuucuuuaggagcuugugaguagccaucuccucauaguucugaauaucugguguuuucauccuaugaaauuuguaaauauacuguuuaucaagucauguuuuuacuuugcaugcaaaugcuagcuauuuugaaacaauuggagccaagccuccaauuuuuaaucccaccacuuggaagacagaaguaaguagaucucugaauucaaggccagccaggucuaugaaugaguuccaggucagccugggcuaccuaaugagacuuuucaccaccccagacccuaaguccccccaaaacaauuguaggaauuguaggaauuuuacuaauacuagagagguaagaaauagaauuuuaaagauguucaaaacuuagaaaugugcuuuaagaucuuuguacaauguaagagcuuauuuguuuauacauaacuaugcaugcugguaagcuaugaaauuacuguauuuuucuagaaagcaaguaccacauauuuauaaacauggcucuuauuucaggcuggagggagcaguuaccagauacccuaguugaugagccuguuucuguugcugagaacacugacaaaauaaagaagagauaccgaaaaaggaaaaauaagcuugaagaaaccuuuccugcuuauuuacaaguaauauuuugcuuuauauuuauuaugugguuugcaaacuuaggaaauguauugagguuuuuuuaacugcuuguuuuuguuaacauccuacucauucuguauaauuguucacugauuccuauaaaugacauuuaccaggcuccaucuaagaaugaauaucuguuuuguucuuggugugcuuugauauuucuuucucgugaaggcauguguauauauucauauguauauguguauauauguauaugcauaugugcaguccuagggaucagugccagaaccauguagccacaggcaguuauaguucacugagcuauguuccagcuuuagaaaauauguuaucucucucucucuuuauaaauauuaugcuuucuuacuuuuuugaacauggauucuaagggaugaacuuagaucuucauguucauacugcuaagugugcuguuggccauaacaaugauacuuucaggaugggaaauacuacuuaaaaucauccauauaugugcacaugcgcaagccagcuccuauugauauuuccauuuaucaauagaauuuauugcauuuaauuuuauugaaaaaguucucaguagcccaaaaucaucacuucaauaauugcuuaccacaauuagugagagaacuaagucaaauaaaccaaagaaucuucagaucuuauauaaaucuuuugccuuauaaaauacuuuuuuuuuuuccaagacaggguuucucuguagcccuggcuguccuggaacucacucuguaguccaggcuggccucgaacucagaaauccaccugccucugccucccaagcgcugggauuaaaggugugggccaccaugaccggcauaaaauacauuuuuaauuaccacauaacuugcuuaguuuucuucuuuaguaauuagguuacugacauucauuuuuuguauguauguagaaguguagaugugaacacacauuuacuguaaguagaggucaaagaucaaccucaagguugguccaaaccuguccuccuuuaauuuuuuuuucauugugauuugggguucagugauugugcugggauaguuggccaguagggccauggcguaaucucagcacuagauuuacaagcauuggccaccagaauuguuaacauggaucccaaggguugaacuuagaucuucauguuugacagcaagcacuuuagcuacugaacugucuccucagucccuagacuacuaacuaguaucuuacuggcugaaugcuaguuagagagcuuagccuuuaggucuguguuagagauaaguaagcaaggaagcuugugcauauguguuuagaaauuaacaucugaucucuuccuuuaauaaauacuuuccggucuuuuauuuauuauuauuucuguguaugugggugucuacuaagguauaaacauugaugucagacaacagcuuuugggaguuaguucucuucuuccacuguggaaucugguuuucaugguuauacagcaaaugcuuuaccugcugugccaucucacaacauaccaucucuuucuuugccauagagucucaucauucaccauagaggucacucauucuuuuggccucucuggcuugccaugagccucaggaaucuaccuaucucugcucacucuccuauauccacucagcccugaguuauauacccuguugcuuuaacuuugguaccuagaaaaccuagauucucaugcaguaacaagcauuuuacucagaaucaucuccucaggaaagaaaaaauacuccucuuuggggggauugucuuuaugcccuucuuugcucuuugccugccuucuccucuccuuuuccucugaucuuucucuuucuccagggccucacuaugaaucccuggcuuacccagagcuuucuauuuaggcuaggcuggccauugaguucacagagaucugucugccucuguccucugagugaugagaauaaaagauaugcaccaguauaccuggcucuggacuuuuuuuuuuuuuuaaaucaguuggcccuuuaaauaauauauauauuucucuaaucuguuuuucaaaauggaugaaguaauccucuauuacaagaaaaccucucauucauucguacagguagagucucuuguuaccuugcuagucuucgaacccuggguuuuaugcaucuuggcaugcacucuacuaacugaaguacaucccuaaccacuaagccugcauuuuaaaauguccuaacaauuugacaacaauaauaacaaaaagagcuuaauuguguguuuuuaacacgauaaaguaaaaugcuaauuuuuuuuuuuuuauuucaugucgauggguguuuugccucugugucuguguaccacagagaggaagagggcauuugauuucccggaacuagaguuccauacaguugugagccgccauauugauguugggacuuuuuggaagagcagaaaguucucuuagccacugauccaucucuccauuuccagcucuguguuagcuuucaaauauagacaggugacauaucaaugaacuagguuccuuaauuuuuaauaaccauaauagaaggcacacuugacauucuuuuggauuuacugagaagauggucuguuccuucaauagaucuuuuuguuacaugaaauccauauuuaggaagcuccuuuagcugaccaucagaauuuggaagcgaguuguuugcaaaagagcauguaaauaacuuggucauucuuuccuucuuugcauuuuuguuuauauguuucuuuguuuuucauuuugugugugugugcuguuuguuuaauuaauucuugcauuuuauuuuuaaagauaguuuuaauguagccuggaugggccucaaauugacugauauauagccaaggaugauccuuaucuucuuaucucuaucucuguaguguuagaauuacagucaagagcuaauaugucugguuuuaaaggaacuucuaagaaaaauugaaccuuaaucuggugagauggcuuagcagguaaaugcucuucuuguuuuuaguuuugaugacuugacuuugguuccuggaaccacaguggggaaggaggaaaccgacuucuacaaguugucucuuagaucuacauaugcaccacauguauuuauaaucaugugucuguaagggccccuagccuacuguacucuuauggucauaguucauucuugaagucacuaauaaugucuagaugaaaaccauaucaagcuucucuuuaauauaaauucuaaagcuuaaaaacuuaccaaauucaucugaauauuauagauacucagaugaguaucuaccacaaauuccuuucacuuaucuuccugccucucucauacagucaaacucauuagcacauccagaagaucuuuaaaaagacaaaaucuaaaguucaacuacuucuucccuucacuagagucacccaaauagaaucacugcagaggggcauggcaguagcuucuguuucuucaacacuucacaaccuguucuucaccaggagauguggguuccuuucccaugcugggaucagacccaagccgucugcaugaaugcagaguagaugaaugcucuaccgcugagccauaauccagaccaagcgugaucuucucauaagauagaacucagucacuucucugcucaucccacucgucugagaauaaagucuaaucucuaaaucacacucugcaugacccuaaguaucccuucugacuccuucuuuuguucuucccgugguucacuuuucuccguucaucagccaugucaaguuuauuaucaaguuuauuucuucacggaucucucuacucuuuacauggcuggaacauucuuaucauucaggccugagcucaaaugacacuucucuguaauauaaacucuaaagcuuaaaaacuuacgagauucaucugaauauuauagauaaauauuaaagucaugaugagucauuaaaaguauuauuaauggcaaucuuguuguugaaguuuauacuuaagagacuauaccagcgauugauauccaaauaucaaauacauuuuauagucuucagcauucuucauuauuauagauuguagccuuguagauuuucaaauacuauuuugauagugggauagcuuauucauucuaaaaaaucugaaaauuuugaguaagauauaagaucucuggcagacuucauucaguccagugugugugugugugugugagagagagagggggggaggggagaaaggggagaggaggggagaggagaggagagggacaaacagacagauacauauacacacaccauuggcauuagaauagagagaggucagaggaccauuucagaugcugguccugaccuugcauauuguuuaagacaggugcuucuugucuacuguuuuaacuuuguguaacuuacuagcuggcucaugagcacaugaggauucucccgucucugcuuuccaucuugacauaggaacucugggauugcugacaugugcuauuuugcugguauuucauggauuuuagggauucuuuuucaguucuacacaguagugcagugagcauuuucacuacuuagucuacuuuucaucccucccauuuccuuucuaaaauuaggaccauuaacauuguucuaguuaggguuuuuguugcuuuaaugaaacaccauaaccagaaacaagcuggggaggaaagaguucauuucagcuuaagccucaggucacacugcguugcucagggaagucagugcaggagcauaugggcaagagccaaagcagaagcaucccggugcuacuuacuggcuuauaguccauggcuuguucaacuugucuuuuuauagcacucaaggcuacugggagugccacuguguggcccuucucuccgugauaugggcucucccguaucaguccgucaaggaaauacaccaaaggcuugucuguagaccaauuugguggggcugggauaauuuucucaauuaagguuacuucuuucaaaauggcuguaucauguaucaaguugacauaaaaccagccacaaacauuuucuauauguuuuuugccaccucagaaauuuuguauauuuuauauucuuacagaagucuucauuugcacauuuuguugaaccuaucuuucaaccuucuucagaaccuuucuuuguuaauaugugucuauaugcuucgaaauacuuguuuauuguguguaugugugcuugugcauguccaugaguguccauguacuuguguauccccggcauacauguagaaacaggacaacuuacagaagucaguuccuucuuccacuguguaauuccuaggaauugaauugagguugccaugcuucguggcaaaugcuuuuaucugcuguguuaucucacuaguccuucuaaaaaucugcauuuggguuuguggauauaccuuagggauuuuaccuaacauuuaugaggucugaguuucaacuuccagcuucuaccuccagugcuguaagcaacagcaaccuacugccccauuuccuuuuguagcaugaauaucuauccaccuaccuucuauggauuggugccacuuuuacuuaaaguguuauggggaaaaaaguaccugugaaccuucucuuuauguguguguggcaaguaaaugauaaaugauacuagcucuugcaaacucucugaaguucuuuaucuagaaaggucacagaguagaaaauauccuaauucaggguuucuggguugaagcaaaugaaggggaguccugagguccuccauuuguuuucucuguugaucucuguucugaggaguucgaagaacucacuuugaagcacuguccugucuagugcucaucugaguagaugaaauaaaagcaagcagccuuucguagcuugcaaauguucaugcauggucuaaaguuucucggauucauaguaucaguccaguccucugauguggcuguaugcugcagcaugauuacugcagacacuggagcugugcagauccuacaguaguggaucagaaucuugugguauucguaguagauaauccacaaauacugauaacagucaugaaacugccugugcuaugaguuaaagaaccagugacacugugcgugaguuuuaaaaugugauuguagaugagucuccaaacauagaauuauuuugcaguuucuugaaacacauucaacacaauuacauuuuuauuuguuuaauuugguuuuugagaaaucuaucaaauuuaauuuaacacaauguauacagaauugacagaaucuugguguauuucuauauucaguuuuuauguuguuaaaugcaaacauuuucuugucaaaaucaugacaagaugauguuagcuuuauagcauuuagaacuaauaauuuuuuuauguguucaucuuuguuuaggaagcauuuuuuggaaaagaucuucuagauaccagcagacaaaacaagcugaguguagauaaucugucagaagaugcagcucagcuuucauuuaaaacagguuucuuggauccuuccucagauccgcuacugaguucaucuucuacuucagcaaaaccuggaacucaggguauguagauuaauucacagguauuuuccuuaugccacaugccauuacuuucuaguuacuauaacacucauauaaauacuucuguuugaccucaugcuuuauucaaaucaacuuuauuaaaauauaauuuauauucaguaaauguagccuuuuuuaguggaaaguuauauaagacuugccaaauuaaauacuucuguuugaccucccucaugcuuuauucaaaucaacuuuauuaaaguauaauuuauauucaguaaauguagccuuuuuuaauggaaaguuauauaagacuugccaaauuaaccuacucguguaauaaucaccaaaucaguaguugugagagaaaacuuucaguuuauacuuuaucaagaacaggauuagucauaaaacccaaagaaauucuaaugugucaaaaacugcaaaaugaaugccgacagucaggaauuguuuguagauguaguaguaugucuacauacaguuucucauuacugacacuuuguuauaaaaaggggcuccagugccuugccacuauauuuaucaucaccuaugacugcaugagaucaugacuaucaaacaugucuucuagcuggccauaguggugcaugccuuuaauaccaggucuugggagacagaggcaggcagcugucugugaguucaagccagccuggucuauguaguuaguucuaggguagucagagcuacacaaugagacuuugucucugaaaacccuaaauauauaaauguauaucuccaguuauucuuacaucauuguugaacgaaguugcuccugguugagaaccaccauguaaauguaguaaauggagugacuauuagaagucaggagagagagagagagcugggggaugacuuuguaggaauagaacuuguguugcagugacaggaccugaguuuuauccugagaacccauauaaaaaugccagaugugguaguguuuacuuguaaucccagaacugaggaaguagaagcaggaggcucccuguguauugcuguauagccauucuagcuuaauuggugagcucaccugagguuguccuccacucuucacaagcauaugcgcacacacacacacacacacacacacacacacacacacacacacacauuugcuuguacaguguuuuuaaaaaaaauaguuaugaaggagggugaagaugcaguucaauuaguagaaucuuuggcugucaugcaugaagcuuugaguuugcuccccagcaccucauaaacuguauuccuuuugagaaaaggaaucaggagaaucaaguucaagguguacucuauuauguuaugaguucagaggcaaucuguggagcaugagauccuggccucguuaagaaagaaauaaagugagagaaagaaaggagacacauguguuuaaguauuuuaucaagagguucuaagagcuuuguuggauuuguaagaguuaugaguacagcguuugucuuuucuucuagauauuuaucaauuauagugugauauuaucguggcauacuuuugccgcuuguugaucuuuaauuuuauacacucuuuuuagaaagaagucuuaaauaauaguguacugaauaauggcuuuagguauuagguuaaagcuuuuuguacccagcauuguccagucaugaaacacagcuaacuuucuugugcuguaacuuuuacaucuggaaauucaaguacugauuucauguacuugaguacccaaagagcuuugugucucuagggcuguccuagauaccuaugcaaacuuuuacuuuuuauuugauuuccuugaaauauaugcaggcaaucuuccuucucauaggcacacaaacaacaauucuacaucaucauuaauaaagaaggauggaaagauacagcguuuuguuguuguuguuguuguuguuuagucuuaccaaguucaaacaaaaaaauaucuuagguuuuuuuaaguacucacuucauauguuuuuggcauuguauaauuacugaguauuucaaaguauauuuuauaaauauuaugacacgugaagaguuaaauugaaguuacuugcccuugcauuuugugaggauaacgucugauaaggugauggggcagguuuugaugcaaguguuuuuuccacaaaacuucuuaagaugugauaauuuucaguaaagcagaacuuagaagaugagaauagcacucauuucaaaguuuaaauuauuuucuuuucaguugagcuacguuuugccuuuauaugaaaaguuaaaugccuuuuugaauauuuuauuucauguagccuauucagccaucagacaaggaugcacuuuucuuguuuaaaaaaaaauguuauuuuuauuuuauguguuuggauguuuuaacugaacugugcauuguguuugcaagugaugucuauggaggccagaagagagcgcaaaucccucgagacuaaaaugcaugugagcuuucacuuggaugcuaggaauugaaccuggucucuuugaagagcagcagccaguguuuuuaccugcugaaccaucucugguccuagggauggacuuguaaaaauuuaugauauaauuuuauaaauuagaauuucauuacuuuaaaacaaacaaaagagcuuauucauuaaguagugcccuauaagcuaaaggcccugauuuugauucuagaacccaugucaaagaauuugguauuguuauagaugcuuguaaucccagcaugggaagguggagauaggaagacuccccaccuuaaaccaacccccagggcuuauuggcagccaccaauaagcaagcuucagacuaguacaagagucaaguguucuuaaucaucuccuagccccaugaaguguguguauauauauauauauguauguguguguguauauauacuucuauauauguauguagauauuuucaagauuuauuuacuuuuauguauguagauguuuuaccugcuuguauguuuuguucaccauguguauguacugcuuacagaggccagaagaggccauuggaucuucuggaacuggaguuacuaaguugguuguuagcugccauguggguacuaggaacuguacgugggucccuugcaagugaaaaaaacaugcucuuaaucacuaggccaucaaucuagcuccuaaaguguuauuuuuaugccauuaaaaaauauuuuaccuuuguuaaauuagacuugaaagcuuaacauuuuuaaaugucuuuagcugaguugcuaagguaauuaagagugaaaaccugacuaagagcuccacuguuuuacuacuugauuagguuaaaaauccuuagaauaaucaauccucuuuucauuuuucacauuuuccacuuauccaucgguugacucccaaagucaacuucaacuacuucaccuuuucuaccaugcagugguaacuuguauuaccucuugaucacacugcacaugaucugcagacuucuaguggcuuccacgcaccuuuuccuccccguuguuuugcuuaugucuuucaguaucccuauacuuccccugaaccgucacagccuaaucuucaccacguuuuugagaacugcccaggcuugcaguaucugcuaccuucauuccuucauguacuucuauaucagcaagugcucucuucccacaaccuuuauagcagauuuccauguuccuucacugucuuuguuuuauuuaggucuuuguccuuuguuuuaaggucucuaaauaauggaaaaauaagaaccaacaaugggaccagucaggaaaacauuuggcagaauuaauugaauuaaaaaacuccucucaauaguaacccuaaauguagauggcuuuauuuuguuuugaaugucaguauguagcucuggcugauccauaacuaacuauguagacugcccaggcuggccuccagcucuagagauucucuuaccuuugcuuguugcuaagcugauaacucuaguuugauuccuaagagccauaucguugguggagagauccaauuccugcaagcuucccucugcucuccucacacugagacauguccaugguccccucuuccccuaugcuaaauguaauuuuuuaagaagagagagcacagacagacuuaaccaaaucagaaacaagagggagacgauccaaaguacccaaccaaauuagugaugauaaaagugguuuguuuuuguuuuuguuuuguuuuguuuuuuuguggugguguugguuuucaagagagaguuucucuauguaauccuggcuguccuguaacucacuuuguagaccaggcuggccucaaacucaaaaagaucuccugcuucugccucccaaguuuuggcauuaaagauaugcaccagcaccucucaaaucaauagaacauuggcaacuuaaacauaccauagaaagcaaaguucaacaucucuuuaugauuccuuaaucaugaagauacuaaacauggaacagaccucaacauuauaagguuuuaauaggaaaacuaguaaacauacuauauuugcuaaauugaaagcaguccaucugaaguagguagcagguaagaguacgugcugucuccacguuuuauucaauauaaugcuugaaauguuaaguagagaaacaaagauaaauaaaaacaaucagaaauaggaaaaauguuauucaucauuaauuaaauccuuuacuaaaaggcuuuagauuugauacauuaagcaaaguaucagaaaacaaaaucuacacacaacaaucaguagcuuuucuauuuacuaauaacaaauuuucugagaaguaagucaggaaucuaguuaguccugaucacaauaaauuaaaacaaaaauacacagguaucagccuaguaaggagauaaaggaccuuuacagugaagaaagacacuggugaagacaccaguaaaaggaaagauaucuuauguucauagaugaacagaauuaauauugugaaaauguccuuaacucccaaaagucuguagaccuuugcguuguuuaauaaagccccagggcaguucuuccaagauuaggaaagaaaucagcuaaaagcacaaagccuccgaaucagcagcucagucaacacagcaggcacaacagugcugacguggagcuacccagcaccacaguaccagauccagcucuguggagccagagcaacagaaauaagaucuuggcacaaaacuuagucacguucaacagcagaaaggaaaacagcauccagacaaccccuucaaauacaauuaccugaguugugacaauuguccaaaaaaacaauguggaagaaaacauuuuuaacaaauaaugcugggaaaucuguguauuuguguguagaaaaugaaacucaauuuucaacuuguacuguagaaaaaucacuuaaaaguggaucaaacgcugggcgugguggcgcacaccucuagucccagcacucaggaggcagaggcaggcggauuucugaguucgaggccagccuggucuacaaagugaguuccaggacagccagggcuacacagagaagcccugucucaaaaaaccaaaaaaaaaaaaaaaaaaaaaaaaaaaaaaaaaaaaaaguugaucaaacaacuuacuguaugacuugaaauggucugcuacuaggaagauacuuuauagaggcauaagcaaggaaguuuugaaaaaugacacuaauaacacagaaaaucuauauugacaaguaguacugugugaaauaaaaauggaucuucacagaauaggaaacgcccaguagagugaggaaauaguagaguuggagaaaaucacugucagcuguguaucugauggaauuaacauagagacuccauaaagaacuaaacacuaaaaauaaccccaccccccaaucaacagggaaaugacuucguuuccaaacuaaaaaauaucagugaucaauaaguacaugaaaaauguucaccauccuuauccaucuauaaaaugcaaauuagcugaguauguuggcacagcuauuuaacccagcacuagagaauguagaggcaagcagaucucugugaguucaagggcagacugguuuauauagaaguuccaggacagcaaaagguaccaaugagacccugucucauaaaaugagagguagagccagaaaugcagauugauguaugcugagauuccaccuguuucuagucagaaugacuguguuuaagaaaacagcagcguucucugacaaggauauaguagaaguggaacuagagacugcuggcagaaaugggaacuaguccaacuacuauggaaaucaucauggggguuugugcagaaacgcaaaacuaguauaggauccaacuaugccucuacucaguguauaccggaaagaacuugcgcauucauguuaauguagucucauaauaccaaagaugcagaaguaggcaaauguccaucaacagaugcugacaguauaaagaaaacauaaaagagaugcagguaugcauucacauacauauaauggagaauaaaugaaacuggaaaucauauuaagcaaaauaacaccagagagugaaaaacaaaucucacuucuguuucucaguccagcauuuucauuuaaacaacgcaugcauguauaugacaggaaaguaggugggguuuauguagggcuagaaaggagucuaaaacuaaggagagauaacaaauacauuguguuuucucuuguggaacuagauugaauauugcucauacaauugugucuguaugaugcauguacauagacagcauaagggagaagauggagacagaaagugccagcugguggggcagugacaugagcacauaauacauuuuugaugugugcaaagcauaauacacauauaugaaaauguuacagugaaaaucauaauuuugcauguuaacaaaaauuaagugaagacugcaaaaacggaauguaacaaaaucuauuuguggccagucauuucuggaaauuuuuuuuuuucugcguauuuucaaauaggucccucagggccugacuuauuccuaccucauuguuauuuuugagaaagugagcccugagaguacauccaagucauuuguuaacaguuccaucuuguuccaguggcuuggacaaugucaguagacucaguuccuugguauuaagacagucuuuuagugaacuaguaauaaauauucaaacaaacagaaaaagaauuaguuuuagugaagaaacuggcuuguguguuacuagaaauuucaaaauacuguuuguuuuucauguuuuuaaauuguccuguuuuuucuagauaucauucuuaguugugucacuuaaguaaugaguugcuuuuuauuuuauaagauuuugauuuuauuuuuauuaaagucuucauuuuuuauuucauuuugucaaaauacaucagccuugaaaacaaaaucuggauuuuuaauguuuuguuaaucaaaauauaaguaccuuugcuuuuaauucuuucaagucauuauggucuuaauuuuaccagugccacuugccucagcugcugcuguagucuagaugcuuaggacauuuuagaauuuugugucuaggaaaauacuuaauuuuuauauacuuacuauaucuagguacugcugaugacccauuagcugauauuucugaagucuuaaacacagaugaugacauucuuggaauaaucucagaugaucuugcaaaaucaguugaucauucagguauacaugaauacuguuugccugauuucuguucugugauuugcgaagguguauggauguggaacacguuuauuuuuucuaguaacacuaguggguuugguguuuuucuuucuucuuuuucuuuuucuuuuuuuuuuuuuuuccuuuuuucuuuuuuuuuugguggacugugucaaagaagccaguucuucauugagugucuggcuugaggaggggagauagcaaguuggcucauuucugucaccuuucuaauugcaucagauuuaaggcauguugccuuaaaggucuugcugcacuuucucuuuuuguguguuuucccuuccuucccacuucugugguaaucaaccauuuuauuugguuugggucuuguaggucuugauuuaugcacuuuccagguugggagcucacccuucccuuuggguaagaacugagcaguggauggcucugaguagaaguagugaucuuuguuaguagugucucagcuggagcagcuugaggugcaugugugguuauuagcagugcuaaugugucacuaauccagacuugacuuuccuuucuguguacagcuaaagcauagugcucucaaugacuuccuuaaucauuuuaaugaaugguuuuagucuuacauauugcauaguauaguaguuuacaaauuaccugaauaauaguuucuaauacaagauuaaauaaaaacagacuaaaauuuaagacuaaugguauuaagaaaauaugaaaaaguagauaauaggcuacuguuacuagauguuauaaggugaugaacauaauuuauauuuuuagaauuuagcuauaaaauauuuaaaaauaacuuguaguugaaauuaguuuuaaaagauuauuaagcuuuaauacuguguguaccucuuugaauuaauuuuuacugaaacuuucauuccuguuucacacgugcacaaugauacugcuauuuuccauguuagagaaguuauucaugaaauggccucuuacaggaguuuaauuuguuaaaaguuaucuuuuugaugaaaagauaacuuuggguaucauauaaacuuauagguacauuguagcuaaauuuaguaauggccuauugaaaguacuaccagaaucuuagaaguaccggcuucauuuacaucacaguguuguaaauauaguauauaggcacuauuguccauucugugcauguucuggacucaccuuugcaucuauuuaacuuguucuuuuagauaucggccccacuacugcugaugccuccucauugccucagccaggugucagucagaguucacggccauuaacugaagagcagcuagaugggauccucaguccugagcuagacaaaauggucacagaugguaaaauacuuacccuacaucuaggcuuucuaaaagacuugaguaaauaugacuuucaaagcuuuuugcaugcaauuuuguguuuggacuugcuuuaauuauuuuucuauuaauuaaaugauauuuuauaagucauauugaauagguaaucauuaauauuccuuuuauuuuaggagcaauucuuggaaaguuauauaaaauuccagguauguuuuuauucucuuguuuuacuuuauaaaaaauggcauuccccuuagaaugaccuuaauaaucuucauguuauuucugugauuauuuuacuuagagcuuggaggaaaggauguugaagacuuguuuacugcuguacuuagcccugcuaccacucagccagcuccauuaccacagccucccccuccaccacagcuauugccaaugcacaaucaggguauucuauuacuuucuaagcaugauuuuauuuguauguauauuugcaggugugugugacaaugugcauucaaggucaaucucaugcaguguucuucaagaguuaccuacuuuuuggagagugccacagugcccaacuuuauuuacuuauuagugaauguguaggauauaugugcucaagcuugugugugugcacaagcaaaaauguuuuuguauaugcuaugcauuuacacccugauaugcacauggaagucagaagguaauguccaggaaucaaggcugccaugauucucggagaaucacuuaggcuauccagcuuggccagaagggcuucuacccacugaaccgucuuacuguggcccauuuucaaggucccauuaacuuuuuaaaauguauauuauguguguuuauagcuguuuggacacauacauucuagugcacauguggaaaacaggacagcuugcaagaauagguuaauuccuuucgucauuccgucuuggggaucuaacucaggugcugagaauuggcaacaagcaguaacuuuauuuauucccucagccuucucacccucacugccuccaggccuagguuucuaugcucuucaagcucuuuacuauuugauauaucucccagugucagcaucucucucucucucucucucucucucucucucucucacacacacacacacacacacacacagagccacguauacaaacuuauaugaaaaaaaaaacuuuuguaaugauugaaaaaucacucuagucacacuccaugaaauuggcuaacucccaugauucaucuugagagauuguaagggggccuggucucucuucuuaccacaggcccaccagagcucacuuuucauucugcucauccgcaagggugaccaugcccuccauucaacaacaguacucaaugcaucuggacuccguuuuacuguuacuugcucagaggugaaacgugcuuucauuuguaguauguggcacagauauaaaugcuuucuggggugguuaugaucuccucagagacugaacacuaguccugcucaccacagaaccuaaguucagagucgagcaguggcuuuugcccauuguuaaauuccugaauuuuuuuuuuuuuuugaaauuugcucguuuuguuugcccaaaguucuuuuacccuacuaguaacaauuugcaguaaaacauagguucaagacuucaguuuuuuuccucuuucaaaggcuaaaauacaauaaucaaaaauaagauuuauaggaguauuugaaagagagguuuagcccucuagauaucaacuccccaacaaaggaguuuaggauucuacagaaauguauguguuaauaauggaaagggauaacaucuguguguccuuuguuagugauuuagugcacugaauugugcaauucaauguuaccuuuauaaacuuuuaccgcuuuucauaugaaauuaaauuugacaaauaaauucucuuuacuauccuuuuuuuuuuguacacaaaaaaauugcauagcauaaauacuggaaaugcuugaauuuugaccaguuuaguuauuaaacgcaaaucuaccuugagguuugccauaauaaacauuuaauuuacauuuguguaaaacacuugcaauaacugcuuuuugcuuuaaucuacuauuucucaacuugugguccccacccccuuugggaaaccucuaucucuaaaaauauuuacauuaugauucuuaguacaguagcaaaauuacaguuaugaaguagcagugaaaauaauuuugugguugggaguuaccacaacaugaggaguguauuagagggucacaguauugggauggcugagaaccaucacacaagugguuuuucaugcuuuuuaaauaauuaagaauucuucaguauuuuucugaugaauauauaaaauuuuucuucauguauuuuaugguugaaaguacauauuuuggagauaaaaucaguuacaaauauacuaguucaugaaaaccuugguuauuagagcauuacacaacuucuugugcaaucuuauuuaaaaaaaaguuuugagaugauuuaaaagauaacugagcacgguuagguaauuuaagacaaaagguugaacacccuucugagccuauagccuguacuguuaagagugcagauuuuaagaauaucauugacuuauagagaagaauaauugaagcagaguugcauaaagcagcgagauuucaguguucauguuugaaaucguagaaguucuaauuuaaagguaaaguguggucaucugacagauauucaagaaggacaacuuucauuuuuuuucuaacaaacaaugaagaggugagguugguagauagugccuaugaagaucaaaguagaaguagauauuagugcuagguuguugacaucugugaauacugaccagaggcaauuaaguuagccuuuuuuauccaugcuucuccgcgccaagaaagauacaugaugauaaaaugaugugauaaguuauguuuggguaggauucuauugucaauauuggagaucaauuugaaaauaagaguuguaauaauggggcuagaaggaugggccaguggauuaagcaguugccauacaaguauaaggaccagaguucagacagacaguccccacauaauagcuaaggagguauggugggccacaaggcccaccuuuauucucagcccuugggaagcaaaacuagguggagccagccaggguucaggggacuguuaccagaggaagccuguugucuaaacuaggcugaauuuguuuacucuggguucagggagagacccuuauucaauaaauaaaauauagagcaauucagguagguauuggacaucuuuggguuccacauuuuguauguacauguauaugcacaugcauaugcacacaugcauccacacagaaguguacacauguauacaugaaaaauaaauaguuaucuauugaaugcauggaagagaaagaauaaaaugaaaucaauuaacaaauauauuagucaauauuucucacaggcugcauuaaaaccauauucaaagggauacuuuccuccuucuaccauucuaugugugugugugaaauacauggcuuuuauuuugguagacauagacuacacacaccucauucugauuuauaggcaguugcaauuagucaacuccauagauaaaagagugcaugcuauuuuucuaguguuacaaacuauaguuucuaguguuacaaacuauaauuaugagauuuuuuuuccuuaaagaauuauauuagcugaauauagaauccugagguauuuacugaaauagaaguaagucugugcuuaacccaucugacuuacauuaggccuaugauuacauguuccuugcugucuuuuucacauuuauguuuuuauuguuguuugcuuguuuguuuuguuuguuuuuugagacaggguuuccucuguguagucuggcuguacuggagcuugcucuguagaccauguuggccucgaauucagagauccaacugcuucugcuuccugagugcuggaguaucaaagaugugcaccacuacuaccaggcuuauauuuuuccuuuuuugcccugacuaaucugggcuaucuagcaaguaccucucucuaaaauuaauuacuuaaguagcaaaggagagauuacuuucaagguuacucguguaagcuugaaaaucuuuucuacauuuucuauguuuuuguuuuguuuuguuuuugguuuuuuguuuguuuuuugugugaagcuacagaguuaauacaugcaagacuucacaaagcaguacuuagcacauaguaaaagcaccaagcaugguggacuuaaauguagcauugcugauagauagccacauggugagcauguuuuuccaccaaccuuuuauuuauccuaauuaucugaaaggcaucuaagucuccuugccugccugccuaccugccugccugucugucugucuagauaucuauguguguugguguuuugccugcauauauguuagugugagggugucagauccccuggagcuggaguuaaggauacuugugagcugacaugugggugaugggcaagagcagguagugcucucaacuacugagccaucugucuagcuuucauuuaguaccuuuaaagguguauaaggcggcuaagugaguaaagcucugucugaauucaguccuggaauccacauuuuagaagaugagauccagcuccugcaccucucuccaggcugggaaaagacggcuuauuuuacauaguuuacauguguggaugaucacaguaaugacacacuagauggagggcacaaguaauucugucauuugccuaauguuauaaaaaagaagaugauaaaguauuuggaaagagaguugaaaauguuuguggaagcuggaaauucaaguagugagagggcaaaacuauaacucauuauuuuuguaacaauguguacuuaguagcuuaccaggaaguuuauguccugagagcuaaauagacauuacucuaaucacuguacauuuuaccuccauuuuacaaguugaaauagaaaucaguucugcuucaguuccagauuuggaauuaaaacuuagagcuguuggacuguaaaaauguuuauauaauauacuauauuuagugaaguaugauuguuagagaccacauuuuaaaacuuuuuaccuaaccacaucacccuuuaaucuguauuuuauaguauaucacugaaaaaaguauuacuuuaaaauaaaagguuuuauuuagaaauauuugagccacuugucacuuaugaauacuuugaaaaauaaaugauuguuuuuccuuccuuaagauguuuuuucccggaugccacucaugaauggccuuauuggacccaguccucaccuuccacauaauucuuugccuccuggaaguggauuggggacuuucccugcuauagcacaauccccuuauacugaugucagguauuuaaacuuucuauggaaaugaauuauacuaccccuuguucuuucuuagucuuuuaaauuauuaugcaugauauuaguauuuguuauauuuacuacaaauuuuacuuauggacaucaagcauauuuaaagcuauuuugaaacaaauccuaaguagaguaguacuugagcauagaaaguuacuuuguuuauaaagugaaaguguuuuguuauuuuuccagggauaaaaguccagcauuuaaugcaauugcaagugauccuaacagcuccugggcaccaacaacuccaaguauggaaggagaaaaugacacccugucaaaugcacagaggagcacauugaagugggagaaagaggaggcucuuggugagauggcaacaguagcaccaguucucuacacaaauauuaauuuccccaauuuaaaggaagaauucccagguuaguaguggauauguuaaaauaccuaugauuuuauucaauuucuccucaaugccaucugugccuuuguuuugaaauguauacuagaaaguguuguuguuuuuguuuguuuuggcuuuuuugagacaggguuucucuguauguagcccaggcuuuccuggaacucacuuuuguaaaccaggcugaccucaagaucuuccuguccucagauggguuuagugcagaguucuaucagaccuucaaagaagaccuaauuccaacucuacucaaacuauuccacaaaauagaaacagaagguacucuacccaauucauucuaugaagccacaauuacucugauaccuaaaccacacaaagauccaacaaagaaagagaacuucagaccaauuucccuuauuaauaucgaugcaaaaauacaauaaaauccucacaaaccgaauccaagaacacaucaaaaccaucauccaucaugaccaaguaggcuucaucccagguuugaagggaugguuuaauauacagaaauccaucaacguaaucuacuauauaaacaaacucaaagacaaaaaucacaugaucaucucauuagaugcugagaaagcauuugacaaaauccaacaccccuucaugauaaaagucaugaaaagaucaggaauucaagguccauaccuaaacauaauaaaagcaaucuacagcaaaccaguagccaacaucaaaguaaauggagagaagcuggaagcaaucccacuaaaaucagggacuagauaaggauguccacuuucucccuaccuauucaauauaguacuugaaguccuagccagagcaauucgacaacaaaaggagaucaaggggauacaaauuggaaaggaagaagucaaaauaucacuuuuugcagaugauaugauaguauauauaagugacccuaaaaaguccaccagagaacuccuaagccugauaaacagcuucagcacaguagcuggauauaaaauuaacucaaacaaaucaguggccuuucucuacacaaaggauaaacaggaugagaaagaaauuagggaaacaacacccuucacaauagucacaaauaauauaaaauaccuuggugugacucuaacuaaggaagugaaagaucuguaugacaaaaacuucaagucucugaagaaagaaauugaagaagaucucagaagacggaaagaucucccaugcucauggauuggcgggauuaauauaguuaaaauagcuauccugcccgaaagcaaucuacagauucaaugcaauccccaucaaaauuccaacucaguucuucacuguguuagaaagggcaauuugcaaauucaucuggaauaacaaaacaccuaggauagcaaagcuauucucaacaauaaaggaaccucugggggaaucaccaugccugaucucaagcuguacuacagagcaauugugcuaaaaacugcaugguacugguacagcaacagacagguagaucaguggaauggaauugaaaaccuagaaaugaacccacacaacuauggucacuugaucuugacaagggagcuaaaaccauccaguggaaaaaagacagcauuuucaacaaauggugcuggcacaacuggcaguuaucauguagaagaaugugaaucgauccauucuuaucuccuuguacaaagcucaagucuaaguggaucaaagaacuccauauaaaaccagagacacuaaaauuuauagaggagaaagugaggaaaaguuccuaaacagaauagcaauggccuuugcuguaagaucaaaagucgacaaaugggaccucauaaaauugcaaagcuucuguaaggcagaagacacugucaauaagacaaaaaggccaccaacauauugggaaagaauuuuuaccaauccuaaaucugauaggggacuaauauccaauauauacaaugagcucaagaagcuggacuccagaaauucaaauaaccccauuaaaaaaugggguacagagcuaaacaaagaauucucaacugaggaauaccaaagggcugagaagcacuugaaagaauguucaacauccuuaaucaucagggaaaugcaaaucaaaacaacccugagauucauccucacaccagucagaauggcuaagaucaaaaauucaggugacagcagaugcuggcgagaauguggagaaagaacaacacuccuccauuguuggugggauugcaagcuuguacaaccacucuggaaaucagucuggccguuccucagaaaacugggcauaguacuaccgcuagauccagcaguaccucuccugggcauauaccuagaagauguuccaacugguaauaaggauacaugcuccauguucauagcagcccuauuuauaauagccagaagcuagaaagaacccagauguuccucaacagaggaauggauacagaaaaugugguacauuacacaauggaauacuacucagcuauuaaaaacaaugaauuuaugaaauucuugggcaaguggauauaucuggaggauaucauccugagugagguaacccaaucauaaaagaagucauuugauaugcacucacugauaaguggauauuagcccagaaacuuagaauacccaagauacaacuuccaaaacacaagaaaaucaagaaggaagaccagcgcguggauacuucaucucucccuagaauaaggaaaaccuaucuacuggaacauggaguaccuccuaggggucauaccccuaaggaaaauugacucuccuuucucuagaagucaucaguuagccaugggagaucacgaacccuuccccuccaagccugguuaacacagaacagcuggauagggcauuggagccuauugaauuauaguuacagaugguuaugagccuccauguggaugcuagggcucacaccuggaugcucuggaagagcagccacugaucuuaaccaccaugccaccucuuucuccauuccccguuauggaacugucuuagacauguuauccaaggccaagcaaguucuucauuuguuucaucuauaucuuauacauuguaguguuuugauugugccuuguuuagauuaagacuaaaucaccaguugugauuucauucagaacucaaaacauuuugaauuuuaggucauuucagauuucugauuuucauauuauugauacucaaccuguuuugucuuaaaauaugaucugaauaagaugauaagcaguucauaaguaguuuuuauuacaacucugcauaaccaucuuucugaaagugugucuucugugcuuuuguagauuggacuacucgagugaaacaaauugccaaguuguggagaaaagccagcucucaggaaagagcaccauaugugguauuuaaauaauuccuauguguuagaucuuuaagcacaauauuugaaacuuauuuuuauuagguaaugaaaagaaaauacuuguuaaaacuuaaaaaaacuagcaguuagcuuuaaguuauauaaauaacucauuucacuaaagaacauaucauuuuuaaaguuauguaacagaucagaguguuuaagguuucaguuaauucaucucaccuugagauuguauuaucucuuaacagguaguaaguacugcuauugaagaugagauugguuuucuuuuuguguaugugagagaguucugaaauaccaccauaguuugaaaugaguacagaauucauaauucagauagcgaaucauuuucuuguaaggagaugggccugaagccuuaaagccuuguuguugugaaaaaugcuauugcuguuuaccugaccuuccaugcaccaauuuuucagcuauaaugauaacucugaguagagcuaaugggggggcgguggcggugaaggauaguuuuaugguuuguuuuaccuuaaauuuuguaaugauacaauauuuuuuucuaauuugccuugaugguaagcuucagauuuccagcuuuuuuuuuuuuuuuuuuuugguuuuucaaaauaggguuucucuguguaguccuggcuguccuggaacucacucuguagaccaggcuggucucaaacucagaaaucagccugccucugccucccgagugcugggauuaaaggcgugugccaccaugcccggcucagcuuuuuuaguuuggggaucaguuugcuauuuucuuauuuaaauugagggacaucuaauucuuccauauccuaaugauguguuugauguguaaaauauauauauauauauacacauacauacauacauacauacauacauacauacauacauacacauauauauauguguguauguauaugugauuucuugcaguaauucaaguacauauauagaaaugucuuuaccuguuaguagcaugcacuguauagaagguugguuacuguccaggucccuuuuuagcagagucaguaaguuuucaagagugaugcuucaaauauuuaacacaaguuuuauaguuuaaaaauaggacauuauuuuauuuuucuuuuuguuaaagcaaaaagccagagauaacagggcugcuuuacgcauaaauaaaguucagaugucaaacgauucuaugaagaggcaacaacagcaagacagcaucgaucccagcucacgcaucgauucggaucuuuuuaaagauccuuuaaagcagagagaaucagagcaugaacaggaauggaaguuuagacagguauuggaauuuuggaugauuuuuuuuuuaucacuuuauuuucuuaaauuccagcuguugccugccuccaguccugccuuucucaguuccucauuccauuccuccucccccuagccuccaagagguuacuccccagccccaaccccugcuagacuuccuccuucccuggggcuucaagucuuuccaggauuaggcacaucuucuaccacugaggccagaccaggcaguccucugcuauauaugugccaggagucguggaccagcccaugcuugcugcuuggugccucagucucugggagcucccuggaguuaguucuggguuaguugagacuucuggucuuccuauggggucacccuccccuucaucuccuucaauccuuccccugauucauaagggccaccuacuucaguacaaugguuggguguaaguaucugauuugucucagucagcugcuuguugggccucucagagaaaagccaugccaggcuauauaagcacaucauagcaucagugucaggccuuagugcuccucccaacccccaugaaauagaucccaaguuuggccagccauugagccaucuuuccuucggccucuucuccauuuuugucccuuuuagacaauucugcgucagacauuuuuauuguagguuugugacccagucccuccacuugaggcucugucugucuacuggaguggacucugaguuuccucuccccauuguugggcauuugggcuaaugucaccccuauugaauccugagagugucuuccaggucugguacuuucuagaggguccacccaccuccaacccccugaggcuguauauuuucauuuauucuccuggcccucugggcuucucuccucucccacuuccccucacccaucauaccugauccuguucccucuuuccacuccccuuucuucuauccaggucccucccucccucugccucugugauuauuuucuucccucuucuaaaugggauuauagcauccucacuuguaccuuucugcuuguuaaacuucuuauggucuuuggguuauauccuagguauucuguacuuuguggcuaauuuccucuuaucagggaguuuauaccaugcauauccuuuugugucuggguuaccucacucaggggauauuuucuaguuccauccauuugccugaaaaauucgugauguccuuguuuuuaauagcugaauaguauuccauuguguaaaugaaccacauuuucugugucaauucuuuguuugagggacaucuggguuguuuccaguuucugguuauuacaaauaaggcuaccauaaacauaguggaucauguguccuugugguauggugggcaucuuuuggauauaugcucaagauugauauagcugggucuucagguagaacuauuuccaauuuucugaggaagcuccagauuaauuuccagaguuguugugccagcuuauaaucauagcagcaaugggaggaauuuuccacauccucacagacauguggugucaccugagcuuuugaucuuagccauucugauuggugugaggugaaaucugagggucguuuugauuugcauuucucugaugacuaaggacuuugaacauuucucuaaacacuucuuuucuguuguaaauucuuguuuuguaccccauuuuuaaauuggguuauuugguuuuuuggagguuaguucuuaaguucuuuauauauuuuggauauuagcccuuuaucagauguggggcuagugaagauuuuuucccaaucuguagguuacugaucuguucuauugacaguguccuuuaucuuacagaagcuuuugaguuucaugaggucuuauuuaucaauuguugaucuuagagccugaaccacugguauucuguucaggaaauuucccccugugccaaugaguuccaggcucuuucccauuuucucuucuauucgauucaguguuucuaguuuuuguugagguccuugauccacuuggacuuaagcuuugugcagggugauaaauauggaccuauuuuuguucuucuacauacgaccaccaauuagaccagcaccauucacugaagaugcuuuuuuuucccacuguauguuuuccacuucuuugucaaagaucaaaguguucauacgugugugcguuuguuuuuggauuuuccauuuaauuccauugauucuauuccauugauaagucugucugugucuuuaucacuguugcuuuauaguacaacuugaggucaggugaggucagggauggugauuccccagaagauauuuuauuuuucagaaauuuuuugacuauccuggauuuuuuuuccauaugaaguugagaauuauucuuuccaugucugugaagaauuauguugaaauuuugauagggcuugcauugaaucuguagauugcuuuugguaagauggucauuuuuacuauguuaauccuaccaauccaugagcaugggagaucuuuccaucuucugaggucaucuucaauuucuuucuucagggauuugaaguugucauacagaucuuucacuugcuugguaagaguuacaccaagauauuuuauauuauuuaugacuauugugaagggaguuguuucucuaauuucuuucucagccuguuuaucauuuauauaaaggaaggcuacugauuuauuugauuuuaauuuuauauccugccauuuuucuaaaguuguuuauaagauauaggaguucucuucugggauuuuggggaucacuuauauauacuaucuucuuccuuccuaauuuguuuccauuugauuuccuguuguugucucauuguucuugucuggggccauacuacccugaacacacccagucucaucucaucucggaugauuugcuuuauaaauugcauuuuugauuuugggggaagggagguaguuauaucauuuuagaauguaucucuuaauagaauuugauaaguggugaaauagauuucucuuuuugguaauguauauacucaaauuggcuuuagauacuuauugaaauauuguucauaauauacuucuauaggcaucaauaggacauaaucugcuaccuacugacaucacuugauuaacuuucugugauauauguucuuuuuuuucuuaucuuaacagcaaaugcgucagaaaaguaagcaacaagcuaaaauugaagccacacagaagcuggaacaagugaagaaugagcagcagcagcagcagcagcagcagcagcaacagcagcagcagcagcuugcuucucagcaccuucugguagcaccugguucagauacuccaaguaguggagcacagagucccuugacaccucaggcuggcaaugggaaugugucuccugcacagacauuccauaaagaccuauucuccaaacaccugccugguaccccugcuuccacaccuucagaugguguguuugucaaaccacaaccuccacccccuccuucaaccccaucccguauaccuguucaggaaagucuuucucagucccagaauucucagccaccuucuccacagauguucucaccuggaucaucccauuccagaccaccaucuccaguggauccuuaugcaaaaaugguugguacuccuagaccaccuccugguggacauaguuuuccaagaagaaauucuguuacaccaguggaaaacugugugccuuuaucuucaguaccuaggcccauucauaugaaugaaacaucagccacaaggccauccccagccagagacuuaugugcuuccuccaugacaaacagugaccccuaugcaaagccuccagauacaccuaggcccaugaugacagaucaguuuucaaaaccuuuuagccugccuagguccccugugauuucagaacaaaguacaaaagguccucuaacaacuggaaccagugaucacuuuacuaaaccaucuccuagaacagaugccuuucaaaggcaacggcuaccugaucccuaugcaggaccgucauugacaccugccccauuggguaaugggccuuuuaagaccccacugcacccuccuccaucucaggauccauauggaucugugucacagacaucaagacgacucucuguugacccuuaugaaaggccugccuugacaccaaggccaguagauaauuuuucucauagucagucaaaugauccauauagccacccuccccuaacuccacacccagcaaugacugaaucuuuuacucaugcuucaagggcuuuuccucagccuggaaccauaucaaggucagcaucucaggacccauauucacaacccccaggaacuccacgcccucuuauagauucuuauucccaaaccucaggaacagcucgauccaauccagauccuuauucccaaccuccugguacuccccggccuaacacuauugauccauauagucagcagccaccuacccccaggccuucuccacagacagacauguuuguuucaucuguggcaaaucagagacacacugauccauauacucaucaucuugggccuccaagaccuggaauuucuguucccuauucucagccaccagcaguaccaaggccaaggacuucagaggguuuuacuaggcccuccagugcaagaccagcccucaugccaaaccaggauccuuuuuugcaagcagcacaaaaccgaguaccagguuuaccuggcccuuugauaaggccaccugauacaugcucccagacucccaggccaccugggccuggccguauagacacauucacucaugcuuccucaucugcuguucgugauccauaugaucagccuccagugacucccaggccucauucugagucuuucggaacuagucaaguuguucacgaucuuguugaccguccaguuccugggucagagggaaacuuuagcacgucuucaaaccuuccuguaagcucccaagggcagcaguucuccagugucucccagcuuccuggacccgugccaaccucaggaggaacugauacacagaacacuguaaacaugucucaagcugacacagagaaacugagacagguaaaugcugcaguguuuucaaauguuuuaaauauauuaucuguggaagcuccucauuaagucauaugguaauuuacacauacauuaaaguucuucuuaaguuauucuguagaguuuauuaaauacaaggaaaaagugaaaaugguaaaauuaacaccucuuagauuuaaccuggaucuaauuuuauucuucaugaauuuuuuggaagaucuuuaaauauaaaaacucuuacuuuaaugguaguuguucggucauggaaaaagauccaaaucaccaguuuuuguuguaauuuuuuguuuguguguuuaaugguuaaaugaagcuuuaaaacaacuuugaaauuuuaaaugugaauguagucacauaauggaaauguuaagaguuuaaaaaaauguuuaauuauaaaucccagcaauuuuguuuucauuuagcggcagaaacugcgugaaaucauucuccagcaacaacagcagaagaagauugcuagucgccaggagaaggggccucaggauacagcaguaguaccucacccagugccccuuccacacuggcagccagagagcaucaaccaggcuuucacucgaccuccaccucccuauccugggagcacucgaucaccuguuaucccuccacuaggaccuagauaugcaguuuuccccaaagaucagcguggacccuauccuccagagguugcugguaugggcaugaggccucauggauucagguaaugcuuuuaauuuucugcuauauuuaaguuaauauuggaagaaggaacuggacaaauaccauuacuauuuggcaagaaauuguuaugguuuuucuucuuuuuuccuucuuuuuguuuuuuuguuuguuuguuuuguuuuuuuuguuuuuugagacaggguuucucuguguagcccuggccauccuggaacucacuuuguagaccaggcuagccucaaacucagaaauccgccugccuuagauauuuucuucauuuacauuucaaaugcuauccugaaaguccccuauacccucccaccucccugcuccccaacccacccacuccggcuuccuggccccggcauuccccucuauuggggcauauagucuucacaaaaucaagagccucuucucccauugauggccgacuagguuauccucugcuacauaugcaacuagagacacaguucuggggguacugguuaguucauauuguugauccuccuauaggguugcagaccccuuuaacuccuuggguacuuucucuagcucugacaucauaaucuuaccugcccaaucauagcuuccaaaauguagcuauuaaauccuaaugaaguuucauaugauauguuagaugaugauacauuuuauucuuuaaaauaauauguuagaugauaaugaugcauuuuauucaauuuaguugaauuguaagauguuuguagagaguugcagauuggaaagaugccuccuuuuagagacugauacaguuggguuguagggugggccaacauguaugaucaaggcacucuuacuauucuuauaaggagaauaaucuuuaacgugugcuuuuuagaggacacacaguuuaaucuuacaccuaugucuguuauauucuguuccuuuuuuauuccaccuuaguuguaguuuauacccauugcuguuuugugcacuuuaaaaaauuugugugucuguauaggauguguauauacaugugcaagguaagagguagaugcugagugucuucuucuauuguuuuuuacccuauauuuuuggggaauaagaucucucauucaacuuagaacucacugauguggcaaggcuagcuuuucagucaauccuaaggaugcuguugucucccuuuccaccccacuaggauuauagccaucaccaucaugcuuggcuugugugcauguguacaggguauauaaaauguaguuguugcgcuuguucaguaaguacuuaguggcuaagccacaaguccaggcagugucugucugacuuucauuuucuuucgaaauuuucuacuugagugugugagccacaaaacacacgugguagcuagagaccaacuuuguagaguaaauucucuccuuuauguguucugagagucauacucagaucauuuacagggcaaacacuuuuaguuuugucuauuuaaaaaaaaaaauagccgggugugguggcacacgccuuuaaucccggcacucaggaggcagaggcaggcggauuucugaguucgaggccagccuggucuacaaagugagcuccaggacagccagggcuauacagagaaacccugccucgaaaaaccaaaaaaaaaaaaaaauaauaauaauaauaauaaaauaaauaaauaaaguguuguuuauguguguguguauauauaguguguacguguguauaauguauuuugauaucauguuuuucucuuccaacuccuauuuucacuaucauugagcuuacuaacaguuuuuuuuuuuauaaucuguagaguaacuuaauacuucuuuuacuuuucucaucucaauucuaaauuaucauucuuaauuauuuguugguucuuucuggcuuuuagauuuggauuuccaggagcuggccauggucccaugccaagccaagaucgcuuccaugugccucagcaaauacaaggaucuggaauuccuccacacauaagaagaccaaugucuauggaaaugccuagaccuucaaauaacccaccauuaaauaauccaguugggcuuccucagcauuucccaccacagggucugccaguucagcaacauaauauacuaggccaggcauuuauugaguugaggcauagagccccugauggaaggucacgguugccauuugcugcuucuccuagcaguguuauagagucaccuucacauccaaggcauggaaauuuccuucccagaccugauuuuccuggcccuagacacacagaccccauaagacagccuucccagugucuauccaaucagcuaccugugcauccaaauuuagagcaggucccaccuucucagcaagagcaaggucauccugcucaccaaucuucuauugucaugaggccccuaaaucauccuuuaaguggugaauuuucugaggcaccuuugucaacaucuaccccagcugaaacaucaccagauaacuuagagauagcuggucagucuucugcuggccuggaagaaaaacuagacucugaugauccuucugugaaagaacuggaugugaaagaucuugaggggguugaagucaaagauuuggaugaugaagaucuagaaaauuuaaauuuagacacagaggauggcaagggugaugaccuggacacuuuagacaauuuggaaacuaaugacccuaaccuggaugaccuccuaaggucaggugaauuugauaucauugcauacacagauccagaacuugacuuaggggauaaaaaaagcauguucaaugaagaauuagaccuuaauguuccaauugaugauaagcuagauaaucagugugcaucuguugaaccaaaaacaagggaucaaggagacaaaacuaugguucuugaagauaaggauuugccacagagaaaguccaguguuagcagugagauaaagacagaagcccugucucccuacucuaaagaagaaauacagagugagauuaagaaccaugaugacaguagaggugaugcggauacugcgugcucacaggcugcuucugcucagaccaaucacagugacagaggaaagacugcucuauugacuacugaucaagauaugcuugagaaaagauguaaccaggagaaugcugggccuguugucagugccauucaaggguccacuccucugccugcucgggaugugaugaacuccugugacauaacaggaucgacuccaguucucucgaguuuacuuucuaaugagaagugugaugauucagacauuaggccuucaggguccuccccaccaagucugcccaucucaccauccacucaugggucaaguuugccuccuacuuuaauaguaccaccuagcccucuuuuggauaauaccgugaauucuaauguaacaguggucccuaggauaaaccaugcuuuuucucagggugugccaguaaauccaggauucauucagggccaaucaucagugaaccauaauuuagggacagggaaaccuacaaaucaaacugugccucucacgaaucaguccagcaccaugucuggaccgcagcagcucaugauuccucaaacauuagcccagcagaacagagagaggccccuccuucuagaggaacagccucugcuucuacaagaucuuuuggaucaagagaggcaggagcagcaacagcaaagacaaaugcaagccaugauucgucagcggucagaaccauucuucccuaacauugguaggaaauuccuucugucucaaaauaaguuacugggggcaucugaguacaugcagcaugcuuguaaauuuucauuauugagauuacauuuggaucaguguaaucugagaauuuucugucuucucgggucuuuacaaugaaaagaugaauuuuagauuccuuccaggucagucaaaauuaagauaaccuugaauuguuaccucacucaguucugcuuuauaugguguugauggugguuuuaguuuuaucugccaauuguuaugagaaauaaauguaaggaaauuaugauagaaauaaaguuucuuguucuuuugugcacaaguguuugguaaagguuuuuugcauuuuaggguuuuuuuuuuaaucccccacagacacaucuuucaacuuauuuuuguuguuuuauuaguuuuaauaaaaacacaaguccauguaacccaaacacuucagugcuuugccuagaagaauuaagucagcaggcauauaucugaggaguauuuuuuucuaacuaauaacaaaaagcauuguaucaacaugugguacaaauuccauuauuugacucuuuuuucccacuuauauguaugcaaagagaugcucucacuauccucauacuuuuauuuuguagguauauccuggagauauugguaguuuuuuauuucuuuuaaaaacugauaacuaauuuagagggauucuuuaguauuggaaauaacuguaaauucucauuccuuucaguccauuacuaaaaaagaucauucuaauuggcacugugaagguuugagccacugggacucucguugcugaacaucacuguugugauccccuguagacugacagacuuguuuuaaaguaugcuucaguuauagacaccuaaaaugcagcuaccauuucuagauucccuuaugugguguagaaacauauaaugauucuugaauaagguauaagaauuuauaaauuauguaauugugauacuuaauuuuaccacuucauauaucuugagccaugaacuuaaauuaugaaguaaguaaugucaaaauacauuucuucuuuagauuuugaugcuauuacagauccuauaaugaaagcgaaaaugguagcccuuaaaggcauaaauaaagugauggcacagaacagucugggcaugccaccaauggugaugagcagguagguagaagugcuuuuuuuuucuuccuggcauguagauguacauaaaaacaccccuacuucuuagagcuccucaaaagccuaccuucugguuguaaagaguauuucaauucagcugaaugcagggaauuaauuuccuuucauuuuagggaaaauaaacagaauaauauaccacucaaacauuaggaagacugacuuggucagugaggaaauccaaacuguuuguguguguuuacuuuuuuauuuaaagaaguguuagccuaagauuuucauucaagaauuucagugguuaaggaaauuaucaauuuagcucugaaaugaaauugucccaacaugacuuugaauuagaaaaggcaaaacaguaauuuauggaacauuuggauacugagacugggauaguuggauaauuuuaacaucuaacagaaaaauggaaauuguguguucaagagagauauuagagaugaguaaucguuaaguuacaguggcuguguaccccagugaagugcugaaucuugaucacuuucuaacuuaaggauuauuugugugcccccaucacuacacuuuuaaaugcaguuucuauaccuuucuacagaccuagugaaugggauuuucuaggaauggugucugaaugcuuguauuuuugacaaguaccuugaaugaucuuuguguuguauugcuguuucugauuucugaucucaauuuauugugaugaucuuguugaaaaauuauaauagggagugcaaaugauuguagaauuuaauauagaauuguauaaguugaagauauagacauaggcuuuagggaacuguguaauacacugaguaugauuaagacacauuuuugaugucaaaguaaagauagugauuuguaaagauuuuuacuaccuagcuggauuuauuagcacuguucuucccucaagguaacuuuauggcauaagccuuuuuaaccuuaaaaccaugaaaccuuugaaauucuuuucagauauacagguaauaaaaauacaaauucaaaaagaaauagaccacauuuguaacauaguuaauaaucucugauuauauucuugauauguguguaucauaaugcauuaacaaacuuagcucuaaguuuuauauuuuauaacaagguaaagauugguaauuaccuacuaugaaugugcaacacuuguaggaaaaucauguuuccuacuggugagaguauaguauuaauaaauaauacugugauaaauaauaaauaauacuguauuuuaacuugauacucagagucaaggaaaugcuagauuuuguuugauccuuaauuguuuucaugggccucagaaucagaacucucagcaucucauauauguucaacauaagugucugugcucauuagacaugcaaugcuuuaucagccacaugcuaaguguacuggagaccauucugaguucuuugcagaacuaagguagugccuucugagauuaguguaguguguuacaugaugauggcagagagcaagcauuaaucggauugggauuauuuuguaccagagcuguaguagggagaagggagauuaaugaaucaaacuucugagggaaaaaaaaaucacaaguauacacucuaaagucuaauaacauuuaaaugcuucuuuauaauauuuuuggaucuauuuugaaauuguguucaauguauaucuuuuuuaaaaaauuuuuuccuauguauaucuuaauauguuaaagcauucaguggcuuaauaagacagacauguuuucaaauaagccauaaugauucuauaccaguuacuaguuuaauuagaauuaauaagguuucaccaaauggauuuaacuauagagauuaaucacuaguuucauuuuuuuuuaauuugguauaaucauuauauacaaaugcguacaagaauuguggaauuauuugagauauuuuuguuuuagacuauaaaagagcuaaguaguaccccuuauucucacccccaaugucuuagucuauaguccaaguuggcuugaaacucuuauguagcucaggcuggucccgaacuuguggcauuccucuuccaucaacuucucaugaaauaacaagcuuagucuauccauuuuuaauaaagauugcaacuaggaaaaaaaacuuccuuguuuguguauugaagcuagauuuuucacuguaaacguaucauaaaaauuauuuuucugaaaccuaugagggcccaagcucugcaauaguuuagcuggcuuuuuaugcagcuuuacuggucccuaugaagauaguggccuacccauucugagcggucauccauaguaaugggaagguacugagugcauacugagaagaggucuguugagcauccagaagccaguugucggaagucuccaguguuacucuucucuccccuggaagagaggaguguuagguaccugugugauuuguucugagcucaucaguugaugcugugcgcuuuucuuuacagauuccccuucaugggcccaucaguggcuggaacacaaaacaaugacggccagacccuagugccacaagcuguagcucagguaaugcugcucgaaucacugguuuauggaagacacauggaccuacuaugucuuaccaaacccaaaucauaaugaagccccuccuagaaaggaauaggagcugaucuucuggcaacacagugaaauaaagauguguuguugcuguguaaaauaaagacagauuuaaagacgagaauuucugcaaaggacuugcacacguuaaugauagaaagucacuuggaaggaagcgaagugcucuggcuuuauauucauuucuaacucucgaaagacauuucauauccugcuaauuggaauuaauccaucacauuuaaaauguauaauuauuggaaacaguaguggaaaaugucuguaaucauucuauuagguauaauuauuccuugagaugauuuuuuuuuaauauugagcaucuauaaugagcucaaguuuaaacauugaugcuauguucauguuaugaagucuggaaacaguaacucuuuucaugugcuauuuucuauguugauuuuuaaaacauauguuugccugguauagggggguaccuugaucugugugcuuugggaauuaucuuauauucugccaguuaucauuuauauuuacuauacagauaauuuaugcuuuuucccuauuaagaauauaaacacccuuugauauacuggaaaggcuuaaguguuguagcugaguuuucuaaguucucaguuugacugugaauucagugugcacuuugagcaaguucuugagcuuuuuaacugugcucuaucaaaugcugcaucagcuucccugcaguacuuacuauagggcugaacaugccauauucuggcuguugaacauaauagcucaugucuaacggaauuugaaucaaagauucuauuuaucagguucuggccaggaaauugugaaauuaucagcuauccaaacaccaugaaagaagcaaggcauauuauuaguacacaagacuaacauuauaaugagugcauuuucuuuuauauguauacuauauuaauucuuguuauaauuagcuuuuugugauauaguauaguuuagugaauguagaacauguguuuaugaauaaaaugaauuuuuuuuucauuuuuuuuccuucauuuugaaguuuuucccccccuuaaguugaaguauggaauuaaacauauuuguaaauuuuacuuauuuuaggauggcaguauaacacaucagauuucuaggccuaauccuccaaauuuugguccaggcuuugucaguaaguauaaaucuaauaaguuaccuguuuucuggggauugcuuguuugacuauauuuguguuguuuugaagcucggaauuaguguagaugauaccucuccuaucagaggucacuguccuaggcaucuuuacagcaaggcauguguuuucauugcuuuuuuccgcugugcaugaggaacuaguuagaaauaaauacuuuaauacaggaaaaccaucuucccuauuuucuucaacauuguuguuuuuuuaaaauagauuuaccucuuucccaauauagcauuaaaccauguuugcuuucaugacagucugccuauaacgaggacacuaaauggggaaaaacaaagggaauauauuuaaaagcuggguuguagcauggugugaaggucaagugugcaagaggccacugaacccuucuagcuguccuuaggggucccaaggugguucaggauagcauuuaacguucccucaaacugaaccuuucugaaaucuucagacuguuuagcuaacuuuuuucaccauuaucuuucauuuugcucaccucugcucuccugguuccagaaaccagaaaggcuuuccuugcgguaggucucauucuaccagaagcagaacuucugaaaccuugugaaaaagccuguucuugacaaaagcccuucaaauuuagugcacuagauugcaccuucauacauauacuggaacuucuggguuuaggaacaaacccaaagucuaaccuuuugaaauucccccgcaucaauuaugaucauaauuugaauacacauuuguauuaaaaauaaguaaacuacuaugaccaacuggcuuuuucuggcuguauugugcccauuggauuugguuggaucuuaauguauggcaauauucuguuaucauugauguuauuuucagcuaauguccuucuaggauuguguuuuucuuuguuuuauagucaaaaaggaauacucaauuuuuuacuaccugagcuaaccuuuuuuggggacuuggcaucaauggaauaaugugcucugggagaacaaggacgggaucucaguguacgauaagauguaauggggagagauauaagauauaauccguccaggacagaugagaaggcuuugcuugcuuagcuaucacuucccccuguagacuuagaaauuacaaaauuaauggaaguuaccaguguuuuaaacuuaauauauuuucuuuauaaaauguagaccuccaagugcuucuuuuuagaguuuucuggguuucaucucccuguuuccuuuuuccuccacuacaaagauguagggaagacuuuguaaacuuagagaaaucagcaugacugaaaucagcaugacugauuacaaaugacuacguaauccaugcucuugauguuacugggauauauuuuccuugccucuucagucuguacaauugaauuaauaaaauacaacauuuuuaaacaguuugguuuauggauuagauaauuugaugguucuuuuggaagauuggaguugcagaacuuacaagcauuaaguuaacuaguguuuuaauugagcauucucuggcuuucuugaguaaauacaauuuucuagaagcugauacuucauaguuauaaaggacucuaauaauuagaauuuuguuuucaauuuuucuuuaaaauauucacaauaaaauugucuucuuacaaaugaauuugcuuaacuuuuaauaaucuuggacuaccuagaaaaauuaacacacuugaauuuugguucuucccucagaugacucucagcguaagcaguaugaagaauggcuacaggagacucagcagcugcuucagaugcagcagaaguaucucgaagaacaaauuggugcacacagaaaaucuaagaaggcucuuucagcuaaacagcgcacagccaagaaggcagggcgggaguucccagaagaggacgcagagcaacucaagcauguuacugagcagcagagcaugguucagaaacagcuugagcagguaauagacagguuuguaaaguggaagccaucugcagccgaagagcuguauuagugggccucaggguuuggguuucugcuauuaaauagcaugcaaauuacacuccucuaggaagaccucuuaauaacugagggaguggcugccuauuccugacugagugaugcuugcugccacugaagagacugacucucacaacuccgggucagaacuguuuuauauacucucugugacccuggaaugauuggauugucuccuuacuacuaguaaaacacugcaccaccuuagcacuuaggaggcagagaccucuaugaguuucaggcaauccaugucuaaacagugaguucuaggauagcuagagauacacaguuagacccugucuuuuuuuauuuuggguuuuuuguuuuguuuguuaauuugcuuguuaagaacaaaagaaaaaauuaaaucauugcaguacacaugcucucacaucauuugcuaaacuaaggcuuucuugaagauaagacucacagagauaguguugaaacaagaaucagaucuggcaaguauuugguuaccuccauguuuuaucuuuccuucauccuuuggucucuaauuuuuaaugaaaguucaguuauagcauuugaaucacucugucagucuuuguuauagcauauuucuauguuuauuucuuacuuugcucuuaagaaucaccacugaaaugaagguaagaucuguaguucaguggcacagugcuugccuagcauggcugagagaccaaguucccucugagugccuucagaauaguuucacaaaagaaaagagggaggaaagaaacuuggaauaccuugaaagggggcuuauuuccaaaauaugaauccacgaaggccaaaaaguuauaaagcuuuaaagucacuguaaaaaaagaguuuaaaaugaacugugcaagaugaguucagaacucaauuauaguuauuucccuaaaugaauuauugccuuagagcucuuauaaaugcuuauucaugaauguuuauaguagcuuuauccagugucauccaaaacuaagauaggcugggaacaggggcaccucauuguuauccuagcuaugagaaaaggcugagguucacgaguauaauuaccagcauauguaucacagugaauuccaucucaaggagggacaaggaaaaaagguaccacgucccaccaaagacaauuaaauaaaguuugaugcaccuguuuuugaucagaaaaaauacauagcaauaauaaaacugcugguacaugaauacagcuuguauuuugagaguauuacauugagcaaagaggggucauuuccaauaacuuaauuaacauugaaaugacaguuacagagauuagcaguaacuaugaggaagacaggaagaggguuuuugauucuaaagaguagacauggggaacuuuuuuauacuggaacauuuucuugauuauaugacuaauuuaucugugugcuaauaauucauagaauuguacaccagaacuuaaacuuucccuuuguuuuaaguuguaaguuauaaagaacuccgaauaguaaugcuacaaguagacaagagguucagagcuuaggcauuuucagaaauuauaauuugaauguguccccaaucaaauuuaggguuuuguaaguuuugucaaucuuuuuagucuaagagagggaaugucaugugugcuaaaaauucuuuuaaaaugugucauuuuguguauauaagaaauggcaucuuacuaaaugguuauagucuuaguuacagauaucaguuauuccaacuuugugaauucgugucacuuccuuggcaucacacauaacugucuuuuuuuuuuuauuuuacugcuagauguguuauaguuuaaauagcaugugacuuucaugcuugaacuuuuguggauauuuaauaugcaaagaacuuuuacaagaaaaaaauuaacauuuuuguuugugugcacaugcucagauguuccacaguacacauguggucgcaaguuuuaggaguuagcugucugccucugcuaugugggccccagggauccaauucagcucauaggccaaaaauuaccugccaguguuuugguguggugccuaccuuguauaugugugaguaauuauuacuucauuguuucagauucggaaacaacagaaagagcaugcugagcugauugaagauuaucggaucaaacagcagcagcagcagcaacagugugcccuagccccucccauccucaugccagggguucagccccagccaccucuaguuccaggugccacuucacuuaccaugagccaacccaacuuucccauggugccacagcagcuucagcaccagcagcacacagcagucaucucagggcauaccagcccugcgagaaugcccaguuuaccuggauggcaaucuaacagugcuucugcucaccucccccuuaauccuccuagaauucagcccccaauugcccaacuaucuuuaaaaacuuguacaccagccccagggacagugucaagugcaaauccacagaauggaccaccaccucgaguggaauuugaugacaacaauccuuucagugaaaguuuucaagagcgagagaggaaggaacgcuuacgagaacagcaggaaagacagcgaguucaacugaugcaagaaguagacagacagagagcucugcagcagcggauggagauggagcagcauugucugaugggugcugagcuagccaacaggacaccuguuucccagaugccauucuaugguucugacagaccuugugacuuuuugcaaccuccacgaccccuucagcagucuccacaacaccagcaacaaauagggccaguuuuacagcagcagaauguccaacaagggucuguuaacucacccccaaaccaaacuuucaugcaaaccaaugagcaaaggcagguagggccucccuccuuuguuccagauucaccaucugcuucuggugggagcccaaacuuucauucuguuaagccgggacauggaaaucuuccuggguccagcuuucagcagucuccacugaggccuccauucacaccaauuuuaccaggaacgucuccaguagcuaauagcaaugucccuuguggccaagacccugcuguaacacagggacagaauuauucaggauccagccagucucucauucaguuauauucugacauaauuccagaagaaaaggggaaaaagaaaagaacaagaaaaaagaaaaaagaugaugaugcagaauccggcaaagcaccgucaacuccccacucugacugcgcugcuccacuaaccccaggccucucagaaacuaccuccacuccugcggugagcucacccagugagcucccucagcaaagacaacaggagccgguggagccagugccuguacccacuccaaaugugucagcaggccagccuugcauagagucagaaaacaaacuucccaacagugaauucauaaaagaaacuucaaaucaacaaacacaugugaaugcagaggcagacaagccuuccguggaaaccccuaacaaaacugaagaaauaaaguuggaaaaggcugagacacagccaagucaggaggauaccaaaguggaagagaaaacugguaauaagaucaaagacauuguagcugguccugucuccucaauacaguguccuucccauccugucggaaccccuacuaccaaaggagauacaggaaaugagcuauugaagcacuuguuaaaaaauaagaaggccucuucccuucuaacucagaaaccugagggcacuuuaucuucagaugaaaguucuacaaaggaugguaaacugauugagaagcagaguccagcagaaggauugguaagugucaguugugaaaacagcuguaucuguuuuuaagcuaucgcaguagauuaguaucaacaaauuucuaauuuuaaacuuucuugugcaaagaaucaugguuuuuuguuuuguuuuguuuuuauuucuguagaacccuguuuuuacuuauauuuacaaaauauaugagugacucauuugcuuguuauauaaaguaaacaugaaucauuaugugugccuuucagcugguuaucauaaccaaguuggacuaacuauagcaaaggaaguaugugugaaucuuuauuauaaauaagugcauaauuucuauuagccucucuaaaauuuagaagacagcuccuguacuugucuuacuuuccuugaguacucucagggaugucucuuauugggaacuuacugugucagaaaaauaacaugauuuuagauguggauacuauuuccaucuuuguaguuuucuauguaucgauauucuacccauuuuaaguguuaacauuggauuuucuuuccauuuguauuuauagacaguuuuaaauacacacuuugaauacagagugacccccauuucagugaaccuaauuaagauguuucacaaccaggaguuucucugccuuuugaauaggucugcuuguugcuuugcuccuugucuuucauaaguaucagugguuauuagugcauucacacagcuucccuggggugcugcucaguuugguuuuauaauuuuuacauuguaauugaaguacaguagaguuuuacuugucuaaguuugcaauuuuaagaauaaugagacuuguuguuuugcaaguguuggcucuccucucuucuguugucuccugucguucaguagagauugagcauucucgcaguuguuacuuuugucuaauuggcaguuauggucucuucuuccucuuuaaucuuugagagucucgugcaugcaaacagugcaucuugugguuguguuuuucuaguuguuacaauaugcucuccagguccaguccuuggcugaugacuccaggguguuuugugucugggaauacugaaugcccucagcccugugcccacagugcccucugugccccaugugcugcaacucuuucuuuucuccuauccuuuucuaaugucuuuuucuuugugaaacuuaguucugaaaucuuguaaugagcuuccugaacuugaccaaccacagauguguggaugcccaugcguucaccucuuaguugcgggggcuugacucacauaagaacuaccaucagcauguccauacuacaauuuguguuauucaagacuauuuaauggcacagggaagcaggcacgugucaaguauagaaagcagaagcuaagagauuagaaugagcaugagguguaugcucuugauccuugugauuaaaacaacaaaccauuugaagcugugcauggugguaccugccuguaaucucagcacucaggaacuugaggcaggaagauugcugcagggucaagggcagucugagcuacaaagugaaacuuuuacacaaacuaguaaacaaaaaauucaaaaucuuuugugaucuuuuauacucgucuuuugaaacauagcuggauuuacuuuguagaauaauuauaaaaguuagagauacuaucuguaaagcgucuaaaguggcugaguuaugcaaacuuaacaugcuugccugcucagucuuucauaagccaauuacaaaaguugcaugucuuuaaggacaucagcauccaugguccccgggugguuugagagcauaccagauuuguuugugcugcuguguuccuaaaucagaacgcacuguucagcgagauugcccuggugacucagugcuguaggccugcugauagucaucuggugagccuguuaagacagacauugcugguucauuguguaggcuggaccagggaaucugcauuucuaaucagucccaggagcugcuguguugcucugauacugcucuuggagaaucaggguucuacccaggcagaggcaauauaagccuacuucaacuuccucccuuuguaugagcuaagaagaaaaaguaguaguaauuauuaauaaaugaaguuauaugaaauuuaaauuuguucaugaauuuuaaaaguuguauuggaccauggccaacucauuuauaaaaauuauacagcuguuuuugcaguacuguaucagaacccauaguucacacagaccacaugguucauaggcuaaaauuauuacccuguuuuccuuuauaauuugccacccaugugauguuuuuauaacaaucagaaaaucuaauuuucaaaacacuuaaaaguuaaaugguuucacuaaguuuuucaauuauacuuguucuuagcaaaccauuaauaauaguuuuagaaauaagaaagcgugaaaaauauuccuguguuuugauauugguacuucuggacuuagauaaaaccuuuuucaaggccuguauuacucuuacaucuuugugaccaugaaagcaaaaggaaaggaagggaccuagagcagagauggcuuaaugguuaagagaauuaaugauucuugcagagggccucucauaguggcuuauaaccauuuguagcuccaguuugagaggauucagugcucuuuucugauuuucacaggcaccaggcaugcauauggugucuauacauuguauucacauagacaagauauucaaacacauuaaauaaauaaaucauuuuuaaaagcaaaggaaaaauuaauuugcuauuaucuguguacguagccauuacguuuuucauucaagcauagauuuugacacuaguuugaggggccaguaugacgucuucgagcuuucuagcugcucuuuucuuaccucuggugcaugagcuuaagauguuccuggaaccugugaauuagcuucacaucucagauugcaacaggucuuaguuccuauggggggaggggaaauaaauugccaaaaacacagcucagaagcugcucguucaucuggcauggugcuucccuggucucagcuuagauagugaggagcuauacuucauucuuguuucuaguucugcaaucuccugguugcugagacuggcgcuauuuuucauauuuuaauauaccuuaaugcagagggaagagggaacaguuauuuucagaaaacaacuucauucuguaacuuccccccuuuaaauugggaugccauguuagaaauaugagucacaaguuggagcuggucuagcaugaacuaagaaucaaacaugugggaaguuacuuacuucuuaaccuuuccaauuacauuagcaaacuuugggggcucaaaugcaaggugguuuuggagguggcaacagccaguugccaaaaacagauggagcaagugaaaacaagaaacagcgaagcaaacggacucaaaggacgggggaaaaagcagcaccucgcucaaagaaaaggaagaaggaugaagaggaaaagcaggcuauguacuccagcucugacuccuucacccacuugaaacaggugagcugucagaacagcccuugccacuuccaggaggggagagagcaaguguugccuuuucaauccuaggaaauggagauuuucaccuuauuacaauuaguuucuaauuaaaauagggagaaaggacaaggaaccuaauagacucuguuugcuagcaaacccacacuuuauccuauuggcauuggagauuuacauucuaguagguggauugguaggugauggucagucaagauuuacauauguucagauggagcagccucaacaccaggaaccuuuguaucccccuuuucuugugacucugaacccaaagaaaugcagccauggacucucauuuuaaacucucauagcucauugcaagcaaaaauggagagggacacaccuccccaucucuguucccauugguggugcuuggccuccauucuuacccugguucuuacugagcaaaaauaaagagcauguuuuucuuaugaggcacaugauggcaucucuuuaacagagggaauaaaacuuauuugauguauaucccagagauuucuguaguuuccagcauuuugaaucuugagauuuuuaagucuuauuuuucacaauccuuauuugacuucaggucuuagaaagcccagaaacacuuccauguuuguuaaucauguacauuacuuuuaaauguguuuuuuaauagcagcucucucugcucccucuaauggaaccgaucauuggagugaacuuugcgcacuuucuuccuuauggcaguggccaauuuaauagugggacucgacuucuaggaacuuuuggcagugccgcccuugaaggggucucagacuacuauucucaguugaucuacaagguaugucucuuugccagggugcugccuugccucagauuggagagcaucccacaacuggggaguauggcuuagcuuugcaucuaguuuacauaaagucuccaagauacacugaaacuuagauucagcuaaaagauuaaaaauauaucuggucaaguauuucuaacauguaugcuucaaauuuucaagagaugagaaugcaaaugguagaaaauauccauuauauccuuucuauaguaaaggaaacacacuuuuccuuguaaccuuuguuaacucuuaaaaugaauugaauugacgguacauagugggacuaaaauguaugguuagcuuuuaccuuggaaaaugaauuuuaaaaacuuuaauauauuucauuaaauaauuuaggugcuaauugaaauuaugcacuaauucuuagguuaccaaaauagcauaaguuagucaagguaauacuacguuuuaaauauuuuuaugauaacauaagauuacuucacuuugcaucuguccuauacaaaacaauuauuuugagaaauaugugagugucuguuuuccugguggcuuuuguuuuguucuuaagauaauugucuccaaguucccuuugcuguacuuacggcccuguucuucagcuagccuuccucaguucaggcugcuugucaguguuacucuuguaaccuccccuugcacuacaguauucuguguaguuacuacaggugauuccagcaguccuuggggagaccaagccauaaaugacaaacaguggcauauguaaggcugagagagagagaacugaaagugaacuguauuuguuaguauauuugauaacuuuagucuuauuuuuuuucuuuuugcuucuuuuagagaucuuggacaguccagguucucauaucugagauguaaauuagguuaaagacaaaugcuguauuuucauauuuuaauaaaaauagaaaaaaggaacguuuaacuacuuuuugcaacuuagucaauuuuaaaacugcuuuuuauugguuauuuuaaugaugaaacuugagaacaauuauacaaaauuaaguauaacaaaaauuagguucuucauuucaaagcugaaugcucaagcugggccaaguaggcaaauggguaacagcauuguauuugauaaccucguggcccuguguauauauauuuuuguucuugugcauuuggaacuggagaugccucuagauuauguuuccuguagccuugcuuccuugugcuaaaaauucucagaauuagguuuuagcaaggucaaugcauauuugcucaguagcauauaauuuaaaauuuuuuggucuccugcagcagaauaauuuaaguaauccuccaacacccccugccucucuuccuccuacaccaccuccuauggcuugccagaagauggcaaaugguuuugcaacgacugaagaacuugcuggaaaagcuggcguguuggugagccaugaagguaugacaauagcauccaaaucuuacagcucugaaguaucuaccuuugaaagcuauguguauacugaagugucugcagaacugaacuguucccucuguaucuacucuguucuacauacuuugauucuauuuguuugcucuugcaguugccagagcuuuaggaccgaagccauuucagcugccuuucagaccucaggaugacuugcuggcucgagcuauugcucaaggcccgaagacuguggauguuccugccucacuuccaacaccgccucauaauaaucaugaagaauuaagguagaaaccacuuuuuaaaugugcgcaugcaugccugcgugcgcauacauguguguugccugcauauguaucugagcaccacauaccugguguccacagaagccuauacuauagaacauuggauuucugcaauugauguuccacccugugcacugggaauugaaccucgguccucugcaagagcagcccaugcuuucaaccacugaaccauuucucccagcaucagaagcuacuuuuuacaaauugguugcuugguuugguuugguuuggauuuuuuuuucauuuuauuuuuuuauuagauauuuucuuuauuuacauuucaaauguuauccccuuuccuaguuuccccuccgaaaaucuccuauccccucccgcugcuccccaacccacccacucccguuuccuggcccuggcaguccccuauacugggacauagaaccuucacaggagcaagggccucuccucccauugaugaccgacuuaggccauccucugcuacauaugcagcuagagccacaaauccuaccauguguuuucuuugguuggugauuuaguaccagggagcucuagagguugauucuuuuaaaaaugugcuuagaauuugacaauaguauuuaaaggcauuuaagguauaaagugcucuugaauauuaacuguccaaugcauuguuacuauugaagugaaauuaguuugugaauuuuuaaagccuuauauaauuuaagcaguauauauaucauaauaaucaaauagacauuaaugguuaugggaaaaugucuacauaaaauauuucagagguuuuauuuucuaaacucuuugugugauuucuuggauuuauugauacuuacagacaucgaaaaugagagaucagccaucauagauaccagagguaucauggacaagaauagcucuaagcuacaggaagcucaccacugauuucuauuaguucuuugcccucaagaaucuuacugggagaaucagcuucccuuauuagauauauuugcuauccaacuaguuaauaguauguaugaacuucuuuagaauuuuauuccuuuguggaaaauaugguaacucccucuguucugagauguccauuuaaucuaagucucuuaauuuauuaauggggaaacuugucacuguacacagcagcaacaggauagauguuucuguaacgacauggaaguucacuugggguuuggaauauagggucuucuuucucucuuaccuuacaguuaagaauuccuagcuaugucaauagaaugaagcucuuuccagcuugugagugcacauauggugaucuagcacaggugucuguuuaaucccuggacuagcaacuuuuuccaggucuccuucaaugugagcaggagaaacagaagauagaagguccacagccauguuccgaaacuguagcuugaggucucaccaucucucuagugaacuagagccuugacugaaacaaugggggucuguucccuucuuuguuuuucacugcuuauuaguuaagagaauuaagugccaacaccaccaccguugcuguguuuucucucaucuugccacuauacgcagcugcgacagaauagauguaucuguggcuccauggaggcugacuugaauauaaacuuggaccagucagcacagccucccucuucaucucagaggugucaguuucucgugcuauggcggagucuggaguacuucccucucggaggucuuuacauuucaaucuacagcucuuucgaaagaauagccauuuguacuguuuuauaggucagcccauuuacuauguuuucauagcagcauaauaacugcuccauuugcuguuuuguuguugcuguugucgagaggacguugcugugguaccauguguggggcuggugagaagucccaguggaauugugcauugugaugcaugugcuccuccucuuucaggauacaggaccacuauggugaccgggacacucccgauaguuucguccccuccucuucuccugagagugugguugguguggaggugaacaaguacccagaucugucacuggugaaagaggagccuccagaaccugugccgucccccaucauccccauucuucccagcauauccgggaaaaguacguuuggcuuaaucuaacaaguuacuauuguaaauauuuugacuuugagagcucugaauauucuuuucuccccuuucagauucagaaucaagaagaaaugacaucaaaacugagccaggcacuuuauuuuuuacuucaccuuuugguucauccccaaauggucccagaucgggucuuauaucuguagcgaucacucugcauccuacagcugcugagguaaaggacggcaucacuuacgcugugcacugugugccauuuuuaaacuucugucagugauuuacaaggaaacauuucagggagcagaacagagaaggaaagggaguugcuccagacauccagguuguacuauucaguaugagguuuauuugggucucagcuaagcaaaaacuggagcugagaguucaugugcucuuguaaaagggugugugcuuuggagaauuuuagaaaaaaagcauuuccacaacuguccacguuauaaaaguuaaacauugcucuugcuaucuugcuccgcucuugcaaccuuccugcaagagaguggagaccuuccuguuguuccuacucucuacccauucccuuccuccuucucucuccacuugcucauggcaggccucuccacccccccccccccgccuuucucugccucuacuaaccucucaacuccucuccccaugcccuuaauaaacacuaguuuacacucaugaaaaaauaaaaauaaaaguuaaccauuagaaaaccauagucaagcuggcagugguggcacaggccuuuacucccagcacuugggaggcagagacagauuuccaaguucgaggccagccuggucuauagagugaguuccaggacagccagggcuacacggagaaacugugucuugaaacaaaacaaaagagagugagugagagaaaaccauagucaauaauagagucuacaaaagcgauagaaacuuucuccaggcaucuuaugccaacagcacuaaugaucuaucaaagauuuauuuguuuuaaaaacucccaaguuuuauaaagauauuuuauuggagaucaaacuuacaguuuaauuuauauaugugugugugugugugugugugcacauacauauauauauauguauguauauauauaaaaaucuuuuaguugucagcagauagagccuuagcugcacuguugaagaccguauuggccuuuuagccagagcuaggccuacucauuuccugugaucauagcuuuaggccuacagauacugagguaacuagaauagcucguuuacuguguauagaucccagugccaguuggaacucugaagauuucuguuuaugaaggcuuuguauauuacuucaugaaaauaaauuuauugaaguuuauauaaaaguauuuggguucuuuuguacuguaucaugaagauagcauuauccuaagugaugcacucuucuucuaggugaguaacaugguauuuacuuuuuguuuuagaacauuagcagcguuguugcugcguuuucugaccuucuucacgugagaauuccuaacagcuaugagguuaguaaugcuccagauguuccacccauggguuuggucaguagccacagaguaaacccaaguuuggaguaucggcagcauuugcuucuucgugggccuccaccaggaucugcaaauccucccagauuagcaaccucuuaccgguugaagcaaccuaauguaccauuuccuccaacaagcaauggugagcuuuuuguuaaucccaaauccauucucuguuaaaaaguuaagccugcucauucuaaaauuuugauuuacuuuuuaacaauguguugguguguagucuuugcuaaguugacuugcucuggcuguuguuuucuguggugugaugugcauuucuaugcucuggccuauggcaacaagacugagucuaacucucuguucaagcuguucagcuugcagaccccugagccacuugccccaacuagccugcuccaugugguacagaugaagccauagauagugcauuguuguucuguucuguuuagcugcuauugcauacacuaccuccggccuuugcacauccucuguagggcguauuucuucccacaggaaugccugggugcccauucugagaaucagcacaucuuccuuacaccugccaugaaguugcuuuccuucugcucacuggcaucuuaugugccagccuuguaccucacugccuccucaucccuggauucuuugccauauuuuugucuucccuaagcuuauacuagaaucuggcuguuucucaucuuugaacucuuuuugaaaguugccuauauuaaaguuuuuugccuauauuaaagucuuuguaaucuuaccuguuggcugccucuuucuuguuucuccugccauuuucugccuugaccuccaccccucuaccccaggagauucccucaguguagacuugcucuucugagcccuugggccuuguucacaguauaccuuggcuuucacuucucucugaugcuguaaaucgcauaaguuauuuguacucauugcucuuuauuucccauagaacuugcaguaucagcuuaccugucaggaaguggaucugugcucucuugaugcacuguacauauuugaggaucuuggugcuuugcuuuuguuugauucuuuagugcuagccuccuuuuucagcuguuugggaguggguguuuuccuuuauuugaacuucauugucaaauauuagauucccugccacuagagcuuagaaaauuuuuauuaaagcaaaaaaauauaaaguaaguaauccauguuguaaucgauuacauaguuucauuuucuauugugugcuaccuguaucuuuggucaguuuuaauugcuaacaaaaguccacuccuuaggucuuucuggguauaaagacucuagucaugguccagcagaaggugcgucgcuccgaccacaguggugcugccacuguaaggugguuauucuuggaaguggugugcggaagucaugcaaggaucugaccuuugugaacaagguacuuuacuauucuucccaugaccucguccuacuucuguuuuugccagugacuucugcaucaagacaaagugcuucaugggauaugauagacaagcauguaguagaugggcucagcuucaaaccaaacagcuauagcagacuacuaaauuguucauuuuuagaauacaguaagauauggacaguguaguuucugggguuuuuuuuuuuuguuguuguuuuuucuuuuuuuuuuuuuuccccuucuaaacuauuugugucucuauuuagcccuggcuguccuaggccaggcuggccuucaacucacagagaucuaccuuccuuugccuccaaagugccgggauuaaagccaugcaccaucaugcccagcuuugcauugguuuuuagguggaaaauuaucauagggugaauauugggacagugucuucacaguuggaggauauagagcacucacuuuugaaugucaccuaagauuagcaguccacaggguacuaguuuaauuagcaugugucuuacugaggucccacacauuucccuuugcuuuucaggguucccgagagaacaccaaaaggauggaaaaggauauugucuuuuguaguaauaacugcuuuauucuuuauucaucagcugcacaagcaaaaaacucagacaacaagguaaaguaaccaaaguauauugagggauuucugccuuggggcuacaguccccuccucaagaguccuauaggaaaacacuaguaagauggugcucaaauugacagacaagccugauauagccuucagcuauauuuuucccuacuaaauacccuauuugacaaaaaaguagaaaguuucaaguuacauuuuaacacgcauuuauuuauuuaguggcauugaggguugaauguaggacccaauacaugcuagccaacuacuuuaccacuaaguuauauccuaugccucuuuuaguguuuacuauugaggucucacugagcugccuuucacucauaauccuucugccuuaaucugaguugacaccccacuaccaccacaugcaugcauacaugcacgcacacgcacacaggaaugucuguguaucuaucuuguuuuuauuuugagaaaauaaaaaaaaauuuaaaaguuucagacuucagagugcuaggauuucaacuuuaugcugucacauauagauuauuuuuuuaaagaaaaaacuuuuuaaaaguuuuuuuaguuuuaauuuuauuuacacacauauauauguguguguguguaguauguguguaugucuuguguacgggugucucuugagggcagaagagggcauuggaucccuuggaacugaaguaacaacuaguuauaagcuacuacaugagugcugggaaccuggaagagcagcaaguacucuuaacugcugagccaucuuuccagccccuagcucaacuacauuuuaagagugugaaauuaaauagagaauugguacucagaucuuacauuauacuaauuacgaacaacucauuaaauauuaauaguuuuguuuuauuggucaguugggaagguuuguaaaaaagaaaauuauguguauucuuuaauuguaagagaagucaucgugugcauguccagcuuucuguggagucgcaugcagauugugucaguauggcuaacaauggaguuguucacaugaugcauuuuuaaugauguauuuugaaggaaaaauuuuccuguaaagcugccaguugucacucacugcuucaaugugauuucauuaauaugccuuucacaaaauaguacucaccaaacaaaacacuuacgacguguauuagucccugguauaguaaaauucaaauugacaaacaaauuuagguuuuuaauuaaaauuuauucuuagagaguauggguuuuccucauguaguuucuuaaaauaaugcaugggguggcccacucuggauuuaauccugagccaccuuucaggaugagcauaugagcagaggcaugacagucuaucccaaagcugagaggugcugguacuguucuccugaaguaccuggucguagcugagaggcucggaguguucaggugacucgcuugcugacagggcacuccuuucuucucuguuucucauggcaauugauaaagcccaaggcuaacauucaagauguagagacgaaccccugugugggugaugcugcugugcucuguuguauauuaucuguuguacaauugaauagaucuguuguacaaauugaauuagaucuccugaaaucauugauuggggaaggggaggucucccaagaaaguuuaagagaaucgucuccagauugugacuguguauaagagaggcacgggagccuugcccuuuaccuuuaucagcuucuguuauugcaaaauaaccauucucaguguucaaggucaacuugcuaugccuaaacauuuacucaucugugccugccccuuaagucauagacuauuaagcuucucuccaucaguagacuugcuuuacuggcaagugaauccuucccuuuucucaugauuucuuuuugcugcccaggaaucccuuccgucacugccacaguccccuaugaaggagccuuccaaagcauuucaccaguauagcaacaacaucuccacuuuggaugugcacugucucccucaguuccaggaaaagguuuccccuccugcaucaccucccauauccuucccuccagccuuugaagcagccaaagucgaguccaagccugaugagcuuaagguaacggucaaguuaaagccucggcugaggacuguuccuguugggcuugaagacuguagaccacugaauaaaaaguggagaggaaugaaguggaagaaauggagcauucauauugucauccccaaggggaccuuuaagccaccuugugaggaugaaauagaugaguuucuaaagaaauugggcacuugucuuaaaccugacccugugcccaaagacugucggaagugcugcuuuugucaugaggaaggggacgggcugacagaugggccagcacggcugcucaaccuggaccuggaccucuggguccaccugaacugugcucuguggucuacagagguuuaugaaacacaggcuggugccuuaauaaauguggagcuagcgcugaggagaggacuacaaaugaagugugucuucugucauaagacaggugccaccaguggaugucacagauuccgauguaccaacauuuaucauuuuacuugcgccacuaaagcacaaugcauguuuuuuaaggacaaaacaaugcuuugccccaugcacaaaccaaagggaauccacgagcaacaguuaaguuacuuugcagucuucaggagggucuaugugcaacgagaugaggugcggcagauugcuaguaucgugcagcggggagagcgggaccauaccuuucguguugggagccucaucuuccacaccauuggccagcugcuuccacaacagaugcaagcauuccacucuccgaaagcacucuucccagugggcuaugaagccagccgguuauacuggagcacccgcuaugccaaccgacgcugccgguaccugugcuccauugaggagaaagaugggcggccuguguuugucaucaggauuguagagcaaggccaugaggaccuggucuuaagugauucaucaccuaaagguaggaucacuugugugcuguugucaggccagugggugguguuccaugucagugucucuguuuuguaugugaugguuucaugaagaaccuuuacuugucggugcaaaucuuaaaccucuguguuaguacaccuuauuggaugcuguguuagugcaccuuguuugcucugcagauucuauauucuauucugcagagucuugaggaagagaagugauaccuuggaacucccuucaaggucagaagcagaaagcagggaccaaauccaaagcauugcaugauuuuguccuauucagcuuggauuuaaagcugggaauuacaaacuucauuuuguacuacugggcauuuuuauuuucauguuuacugauguagaaaguacuaaagagcugcuuuuuaaauguuuucauaguuuuuaaaaacauauggagcaguccaaagguauuuccaaagaaacuacccagucuguauuuuaauucucaacugggggaaugccuaucuguagcccuugcuaauugaauuauuccuuucuaauaguguauuuucuuuuguuccauauccaauuaaauucacuaauuucuuucauguuuacuguuugauguccuuaugguggcauuauuuucccccagauaucaucaagucuuugaaauaaguugcugccauuugacaaacguguuuguuacauugcugcccagauuuuauuuaaaagcuaguaggucuuugugagugacucuucuuuauccucucuugguuuuguacugugcccgguccuucuuuuuguuuagcugaaaggaaauucaucguaaaaauuauuuuuuuuguucauauguagauguuugggauaaaauuuuggagccuguggcuugugugagaaaaaaaucugaaaugcugcagcuuuucccugcguauuugaaaggagaagaccuguuuggccugacugucucugcaguagcacggauagcugaaucaguaagugucccgguuauagucuaacaugggcuuguuuucuaauccagcauguucacagugcuacuauagaaaccuuccuacuuuccaggacauggaacuugagugugggugaucaguuggcaagcuuaguaucaaguuucucagaggacagcuagugucaucuguccuguuuaaccaugugucugaggagaugccccugaccugcugaaguccugguuuuuuuugcagauuuuuuuccccuuuucuuaacuuuucuugauuuucucuugcccuuguccuagggguggguggucccacugcagcaguacugacuaguaucuucucugaguguaggugcauuugucaaauggaacaauaaagaaauguauucacuagaacuauguucuagagccagaccuggagaugaaggccuguaaucucagacacuuaggagguggaaguagauaucuaaguagacaucagucugggcaaccugcugagacucuuaucucagaauuguuaaaaaguaagaagagcguuaaggcucuaguugagugguacaaugcuggccuugaaagccugagggcuaggugggauucuucaagcuacaaaaagaaaagaagaccaagcuggugagguggcucagcauguaaaggcacuaccacuaagccuggcagccuaauaaguccaguaugguggacguaaagagccagguccaacggcucauccucuagucuccaaaggcucacacagcacucauguauacacuggaacacucgcccuuucucuacacaaacacaugcaggaguaaauggaaaaauaauuuaaaaaauaaauauaaaggaaacuuugaacaucucaguuacuuucaaguagaccuuaauuuaccaccaaaacugcuggaacagugagugacagcuuugugucaugaucacauuguacagaagggagaagagauccagaaacuaaaccacugagaugacccccagcugcucugaguucuagacauccagacagucauuauuacauugugaccaccucuuccugucuguaaacugaaacaucagaacucucacaugcaggaauucuuaaugcaggaagaguuaaucuccucaagaaaagguggccugggcuuaccaaguuuuguuuugaaauuggauuuauacaauauucaaauaguuaugaguguagccucauuauuaaauaggucacugacugugggggcaaaaaauaucuaaauuguuuucacccugggccuggcugaaaauuauauccuuggccagaugaguuaccauuuugugucucuuucuccuuucuuuagcuuccugggguugaggcaugugaaaauuauaccuuccgauauggccguaauccucucauggagcuuccccuugccgugaaccccacagguugugcccguucugaaccuaaaaugagcgcccaugucaagagguuuguguuaagguaucuuguuucaucuucacauaguacagcccaggguuucuaggcaccuuagugggguuugugcuugauuugucugcugcuuacaaacccugcugucucuggcuguguaugugccugacaacuucagaagaugcucugugucucugcuaggcagcuuucugugucugucaguaaggcuuuuaauuggcguggcuuucacauuauucagagguaucuucaguuguccuuuuauuguccuguugguacauugucaucuguaggccucacaccuugaauagcaccagcacuucaaagucauuucagagcacagucacuggagagcugaaugcacccuacaguaagcaguuuguccacuccaagucaucacaguaccggagaaugaagacugaauggaaaucuaauguguaucuggcccgaucucggauccagguaaggaaggaaguugaguuaggucucaagaugcugauguccaguaggaaaagcuacugcacauugggcgcagagagagaaucaggucuguuugcuuauuuguuucuuuguuuauuuuugugguacugugauuugaguuaaucccaacccuggaaucaugcuuugagaguuguguuccaccuugucagguuuucacaugaggacucuaguuuguagccuuagaacuuggugcugaaccucaaguagaaagcaggccuugggaauccacaucuuuauaucauguuaaaggcuguggagaaacaggcugcacuggauuuugcaugcacugagcuaaaaguuaaaaugaaugccagcacuugaagauagagcaagcugggucagaucaggguugaagacagaggucuucaacaacauuggauaaauucaugugccauuuuggauuuggaagcuauaucuuuuuagcacugccuuuuugugaaaucauugaacauuucugauagacauucuaggaguauugucuuaguccagguuucuauuccugcacaaacaucaugaccaagaagcagguuggggaggaaaggauuuauucagcuuacaccucuaaacugcuguccaucacuaaggaaggaagucaggacuggaacucaagcaggucaggaagcaggagcugaugcagaggccauggagggauuuucuuuacuggcuugcuuccccuggcuugcucagccugcucucuuauagaacccaagacuaccagcccagggauggucccaccuacaaggggccuucacaccuugaucacuaauugagaaaaugccuuacagcuggaucucauggaggcauuuccucaacugaagcuccuuucucugugauaacuccagccugugucaaguugacacaaaaccagccaguacaaguauuuacauguaaggcugcccauugacaaagcauuuaaaauugaaccuguagucuucaguuguggucuuaauguugaugugugucugucuaaucagaaacucuccugucaaagacuggaacuguaaagcucuuacuuugucagauucuccaguccccacacucauguuguuaaauagugucuauccgucccuaaaucagccucaguauuuucagaucuacccugcgauaaaauucuguuacuucaccccauccucuuccaaguuccagccccuccuggaaaccaguuuguacguacaguaaaaauuagaucaacaaucacaauucuuacaaguuuaguacaauggcuuuccuccuaaccggucgcuuuaagaaucuuguucuuagacaguuugcaaacgugccuggcaucaggcucucuuuaucauuuuuucucuugaugaauccuuuuagucugcagcacugugacuucagguugagcaucaccugugaugaugauggccaaugagcugaggcaggaaauaggaggugggauaauggcaggaaggcagaggauucuggcaaguagugagugaauaaaaggagaugcagggagagauuacaaagagauuggagugagaugcugggggaaacauugaggaagaagcaggcugggacugaggagagguaacgacccaugugguagacauagaauaguuugaauggguuaaagaagcuacaagcuaguuggggaaugagcuaagcuugugggcaagguauuuauuaauagguagucucagagucaacauccugggagcaggggcuggaaggaaaaaauguucugagguugacagaccaggagccugcccaccuccagagacccagcucugaaggaguucagccagugucaugaccuagguggacagcugccuucuuuaugguuuccuuguuuugcucuucugaaaugucuucuacuuuaccuggaugaucuuucuuauacauuuuaacaaccaguuacaagcccuucgcucuugaucacuuuguuucgucuuguuucacagccuuuuucucugaggugacccucugucagauucuguggacauguuagggcccugucucugcuacuuccaguugcuucucuccucacuugccuuuuagauauuagagcuugcucauucugugccuguuuccacucaugaggaaugcuuuuagugggaucuugacuaugucuucagcuuauaauuaaccucaaucauuauuuuuaaagaguuauuuauuuuauguauaugaguacacuguagcuguacugaugguugugagcuauaccaugugguugcuaggaauugaacucaagaccucugcucgcuccggccccgcucacuccggcccaaagauuuauuuauuauuauguguaaguacacuguugcuguuuucagacacaccagaagaggacaucagaucucauuauggaugguugugagccuccaugugguugcugggauuugaacucgggaccuuuggaagaacagucaguguucuuaaccacugagccauuuuuuaauuguuguuacuguacauacauacacaugcacaugcguagguggaggacaguuccaggaggcaguguucuccuugccaugcguguuugcccucaggcugccaggcuuuugcagugagcauugucuucacugacacuccugaguggucuuugagaguuucggcuuucugucauguccucucaccauuccugucuucagugauugugguaauggugguaguuuuuauaucuuagggacacaugcauggacacauuuaugaaaauagaaucauauuaucuaugcucacuuucccccaggaacacagagcucgcauuaccugagucucccaucacauucucaguacguugugugaugcuucacagugaugaagugcaaucccaucguugcacggccauuggcggucucacagcagaugccgugccaucagugucccauaggaauagucuuguauccauccugauaguuguaguuuuauggagcauaaucgaaaaaguaaagcuucuaucuaaaacuauauuuacuuuuucuuuuaauaacauauuuucccaaaaggccguaauugcuggcuuccuccugaagucugggacucuauucugguuuucucuuguguaggagguguucucaccuuuuuacaguugucagcuucguagguauacucugacacugagaucuuucucaaagaauauauucucguuuauauuuaugucugcaugugaauaugcacccugugugaaaaugcauguccacagaggccaaaagagagcauugggucccuggagcugagucaaaggcuuuguaagcugcuguaugcuuuguaagcugacugaacucaguuccccuggaacagaaagaagcaguuuaaccacagagccaucucuccagccucugacacugacugcuggugaagcugucuucucaugacuggccuuuggacuugccuuuuugaaaauuauauguuuuaugaccuuuguccauauuucaguuuguacuagcuugcaggguuaggugucuuccaguaugaaacaugcccaucagaacuccaguaucuuuuuuucuuacaaaguuuuuuuuguuuuuuuuuuuuuuggcuuuuuuguuugguuggauuuauauagacaagcauacaaguuuguaucauuucuguauacacacuuagguuguguucuucuaguauuuuaucuauacaaugaacuuccauuuuuuuaacuuuauuuuauuauacagccaauaauuguaaugcuauuuugcauacaauauccuuugcagccauugcuauuaccaugccauagguucucagacacaguuuggagugcuuguuacgcuggcccagauggcacugaugugcacucacauuguuuuuauguucugauuuguucacaucugagucacaccuggaaccagcaaacaugccggcacaguugacuuacuaugcgcucuagugagaagccucuggcagauuccaugaguggaggacuugauuuucaucccuccuuuucaccauaguuucuucccuggucagaauugaaagcacaaacccagauuagggcaauaaaaugcagauuaucugugaacauuguauuuauuugcuuuuuuaaaaguauuuccccacaucuguguuuacugccaccucuaagauaguauagauuuaccaggcacugguguggacagucuaagcugccaaauaaggcuucaguguguucaacugaacagguuuuuugucaucccagccauucaggaggcugaggcagaaggaucacaaauuuaaggacugccugaacaacuuagugagaucuuauuucaaaacauuuaaaaagagcugggaauguauccuguacauuucucucaccucagaauuuuuuuauugggaagaacuucaaaaacugaauuguucccaccuuuccugauacuagaacaaaguaauguuuucuguuuugcuguauucugcuauuucuaggaaacucagucaaaucugaaacaacuuuguaguagucauacuccuuauaguuccucucccucuuccuauuguauuggaugcuuacuguguggggcuuggugguaauugagcaggcauaguggagagugcagcugcccacccgagccacauagcacuuguagagauugucuuaauccacuuacuguugcugguguagggagucgcuagugggcagcuuagcuugcugugcuggugggagggaugaucagugcuaagggccgccuguaaugagguccuuccuguggugucuuuccagagugaagggaaggacauccaaguugcagucauccaaggacaguuaacacuuacacugucaucgcaguaagccaggccgaaagacaguguagaaaaggacacgggaacaguguaaugugcuaaagcugaaaggagcuguguuguuaggguuuuuaacuaaaccuuaaauauggcuuuucauaagacugcaagggcagugcauuuugaugaagagacuaaaggucugucggggauauugcaauguuuacuuacaauccuuuuuccuuccacuuagggacugggccuguaugcugcuagagacauugaaaaacacacuauggucaucgaguacauuggaacaauuauucgaaaugagguugcaaaccggaaggagaagcuuuaugagucucagguacuguauaaacugagcacaggcagccagugggacacaccgcaaaugcaucagcugugucugguagggugcccaggaaugugaccagggugcucccagcacagacugaacgugaggggaagucauucagaccacaccgaugacugacuaccugccuucucuuuagaaccgggguguguacauguuccgcauggacaaugaccacgugauugacgccacacucacaggagggccugcaaggugaggcaggaaggagacuguggcccagagggcuuugcucggggaggggcagcggagcuuuauacuugcuuuguuaacgcauccagagaagcagccauaguuuccucuguacaggggaagcucuucauuguuuucacacugaguuuucugaugugucccacagauacaucaaccacuccugugccccuaacuguguggcugaagucgugaccuuugagagaggacacaagauuaucaucagcuccaaccggaggauacagaaaggagaagagguaaguaggggaagggcuugcugagaucuguaccaggguguggcaguuccugacugcggcuuccaucacaucacucuuagagucucagccucaacccagggcuuugccgucuguuuaucuuacuucagacauucaaaugccggcuucuuccuuguaguagaucauaaagccacaugaaacccaccauauaguaccaaguagcuuagcauccuccuuucuuugucccuuaaucuggacagucugauaagcuccuuucaagaugguuccugucaaaguucuggcaaucacagggacuugauauauucacaugauauauuauugcaaggacuguaggcacaaauuuggggagcuauauguuccugcucauaugcacacuuagaaaauuucacaucauucauauauauauauaguauguuuuuguuuugucuuuaaaauguuuuauguaggacgagacauuuguuucuuaguaucucacagagaugacuuuggucuagcucuucagguuauuauccuuaauuguccuauuuacgugucccagcucuggcuuucacacauggcaucagcaccuugaauguagugcucuaaaucuggaguuaguguccaauacaaagcucuugggaagucugcugugucaggaagccuggaugugcccacugugaugaagcucuagucuuguguagacagugugagaccacaucuauuuacuuggucuuuguagaacuuaccuuuaaaauuaagaacauccuuaugugacuaggacagggccugccgagcagccuaguaucuccccugagugucaucuuguaugcauccucuagaguugccaauccuguuauuacucagcaaacaccuaacagaaggcagugcauucuuuucccaaugcagcugcuccacaguggcugcaaguuuuuugcucccugugcagucuuccagauaguggcugauguuugaguuggaaagacccagagauugacuguuugcccucccuuggcuuuauggggucgagggaacaggguguaaagcuuacuuggagggagucaugcugcuuuccagccacccaguuggguggccuggaguuugaguaagaauucuacagccauugaaugcugauccaaacagcuuuuucucuaaggggaacacuagcuuacccugagccaugguuaaaaaccagauucaggacacccugaacuccaucguguuccacugaguuuaagaugggauugacuuuugccaccacaggaccaaagaaaguccucaauuugugcauuaauuggugagacaugagguaucgguagguucuagaugcugucuaaagacagguuugggauugguggagguaaacauuaacaauguaaacucuauguuauagucacaaagauguuaggccaaguacagauguugguaguaaaaacaaugacggggauuuggacauagccccaaucacuuuuaugguagauuugcaguguucuaucucucuauggugacaaauucuaguuagcuauaggaucuuugaauagaggcagguucuucagaggaaaagguggacaaggggaaagccaugauguugacaagggcagguucaucucuguccaaaccaaggagccaucuacgguuugagggaguacugguccucaucuuacccaaagugguggagaggacacuaugagaagucagaggcucggcacaccagaucaccaccccacaacaguaguuucacuugccucugggauaccccaccgccucaagguucuaugggaccuaaacaaacucaguguugcuuuggcuugugucuguuuugcuugcugguuuugaaauagaggauagaacggggcacugcccugucucacacugucuguuugccaugggcagcucugcuaugauuauaaguuugacuuugaagaugaccagcacaagauuccgugucacuguggagcggugaacugccggaaguggaugaacugaaugcauuccuugcuaucucaccggguggcucgucccuaggaagaggcgauucaacacuucauuggauuuugcagacagaaagauauuuuuguuuucugacuuuuuaagaaacagcuucugggagcucugauuccucagccuugucugaaggaugcucagcacagaggagccggcuaggcugccuugcugcacacugaggucagcagagucacagaaugguccagcacuuuuuuuuucuuuuuucuuucuucuuuccuuccuuuuguuuccuuguggguggguuuuguuuuguuauguuuuguuagucucacuaaggagaaacuuuuacuggggcaaagagccgguggcugcccugccccagggugggggccuuccuaugaauguaagacugaaaucaccagcgaagggggcuguccagagugcuggccacgccuuacugacaggggcaggcccucaguuuaacuaaaguggacaccacugaucaaggaauguacugagaugacuuccuuagggauagagcuaagggauaauaacuugcacuaaauacauuugaauacuugauuccaugagucaguuuauuguaguuuuugauuucuguaaaauaagagaaacuuuuuguauuuauuauugaauaagugaaugaagcuauuuuuaaauaaaaguuagaagaaagccaagcugcugcuguuaccugcagaacuaacaaacccuguuacuuuguacaaauauguaaauauuuugagaaaaacaguauaaaaauaguuauugaccaaaugcuaccaggcgcugcagcagcucgggugcuuauaaccgugguagggauguuacaauauaauuuuguguuauuaaauaugccauuauaauuauguaauaaccaaaauuuugccccgguauuccugggcuuuuuggaaacugucucuuagugcuuguuuucuacaccuaacuucugacagcagcgcgugugcuacaacuacaacuuuuauagcuguuggcgauuuaaacuaauguuucauauuauauuguugcaucccuacuucuucagucagguuuuuuugugcuuacaauuugugauaacugugaauaacggcuuaaacacaacccaaauggaggcugaauuuuuucuucagcaaaaguaguuuugauuagaacuuuguuuccaaccucacagaaucauguaaacauagagucauguagcagggaccuaacccaacuccuuagccuucuauuuaacauaaaaauuugaaaaagaaaaaaaaaagagagauggggagaaagagaggugugauuaugcucccagcugcaggacucuggcaauaggguuuuucgaagauguaauuuuaaaauguguuuguaugaacuuguuuguuuacauuucuuuaauaaaaaaaaaccacacuguuuuguguuugcuuguagaaacuuaaucagcauuugaaccagguuagcuuuuuauuuuguacuuaaaaauucugguacugacacuucacaggcuaaguauaaaaugaaguuuuugugugcacaauucgaguggacugugagcuguggguacauucagugacucagcucucagcuuguaauguauauggcaugauguauuuuuaucuuacagaauaaaucaauuguauauauuuuucucuugauaaauagcuguaugaaauuuguuucuugaauauuuuucuucucuuguacaauacucugacauccuaccaguauuuguccugccgaguuugguuguuuucuguucuguauaauaguaucuaauguuggcaaaaauugaauuuuuugaaguauacagaguguuauggguuuuggaauuuguggacacagauuuagaagaucaccauuuacaaauaaaauauuuuacaucuauaga

SEQ ID NO: 2378 - RNA, 2025 nt, Mus musculus
aauuaucaauugcauaguaaugugccagaccaaagacuuaguuaacuuggaaagauugcugucuggccugauggaugaaauuaagaauacugauugauaaaaaaauuuucuuuuaaacuaacgguuaugcuaauggaacuuaaugagcaacauggaaauuccaaugccuguggggagaagggggcuuaaagagaaggaagagguauguuauaaauuauauagauagcagaugcaggaugcuagauaggaccaaaagaauaauauaagugaguggcuacaggucuuaaaauauugauccuacuuaccaggggaugggggaguccuuaccugaccuuagggccaugguaagaaccuuguuauaaaaaggcaugcuuaguccagacauuccuuuugaaagauacuuaagagaccugagcuagcacggagccuguuuguggagggaggcaggugacauguagcccaggcuggccuuccacucacaguaguugcucuacccuuucacuuccuucuguaugucuugauuucagcccuuagcgguaaagcccacauucacacacacccauugcuagacaagcuuuguuagagggagaaaaaugauuccagaagucaaggcugucuuggugccuugguauauugcaugcuguguggcccugagggcuugagugucaucccuagaacccauuuaaaaagccagguauggcagugcccauucccagcgcugggaagguggagacaggcugagccccagacccaugagaaagauccugccucaaaccacagugauggugcuugagggaugaugucugagguugaccuuugaccucuaaucacgugccugccugcacagauguacacauaaauacgcaagaaacccugagguguugaauagugcggaaagccaauggaaaacacaucguuacuaagaaauuaaugacaaacagccacuauuagcccagaauacccgccaacagccauuaaugcuaguauuacaaggcuuauguugcuuauuuaaacucuuccccgugugcguuuagggagaauugcacugccuguaauagcugaauauguacguguagacuuauuuguuuucuuuuguuugucuuuuugagacagggucucacuaaguagccuuagcuggccuggaaccuuguagauggagaucuaccugccucugccuucaaguauuaggauuaaagguguaagcuaccacgucccugcccagagaguauguaguguuuuggguuuauuuuguucgauuugguuugguggugguuuuuuggugggggcagaaagggguuuguuuguuuguuuguuuguuuguuuucuaauggaacaaaaggcuguacaaauacuggguaacaacaugugccaccaugucuagcucugacuacauaguuuuugauaaccucacuaaaauggagaggggguaaaauugggacacauauuuaaagugucagagagcugugaagcuagugggucacuauguucugggagacggcaggugucugaugucccuugacaaggaugaauguggucacucuggaggguacagcccacucacuguuuuugaaccccgaacuguggugcccuaggggucaaggagaaacucagacugcucuaguuggcuggaagagucaccuugaagauuauuauuauauuauacuuuuuucuuuuaaucuaaaguuugggacagauagaugaaauaggaaugacaaauauugcuaacuuaagucagguuacuaugaaggugaccucagauuguuagcuuuccccuuacaagaaaagaucugguuguccuggugcgcaccuguaauccccgcacucaggaaaaucaagagcuagaggccaguucgggguaacuucuugagacccuugcucaaauaaaucagaaaacgguguaaacacagugugaaaaugauccagaccagugguuccccccccuuccuaaugcugugacccuuuaauacaguuccucaugguguggugaccccccccccacuauaaaauuauuuuguuucuacuuca

SEQ ID NO: 2379 - RNA, 8690 nt, Mus musculus
uccgugaugucaccaguguuguaguaacaacaaacucacugagauuucucagucagaggcuggauauugcagugauggccuuguuugcccgacucugcagacucuuucagagagccaaugugaaugggagagagaccagagaggggaggaaggaugcuaaccuuccaccugagaguaaugaaggacgaaggagguggacuuggcgaauguggaguaaguccugggaaguggauguugagcuuccugguagggguggccugagcuggccuuuccaguaauguggaacuggagacucuggguagcgaaaacauuuccaugguuaucacaauucuugaacaucaaggauuucagaacaguacuuuuccauccccuaaggaaggaauugacaaggucaaagcuguuaugcuaugaaccucaagucuuuuuuugcacuggguauuguggguguuacauggggacagaaugagaccaucaggagugacaaugggucuaagcaaugccaguuugggggagggaaauccugcacuucaguccauggcuucuuuuagcuccuguaguuaucugacauuagugacagggagagaagggugcuccagaccaagaccucauguucucagaacuacucugaccuccuguuugugaaaguuccuaccuuaacuuucuuuaucaccaauuguagggggcagguauuucuacacuguaaacaaagaacuaucaguugauagacccacaggaggauucuauuccuacuucugggaugguuuauguuucgggggggggggcggcggggaaguugauuauuguguugacuauguucucccccugcaugacuuuuuaagccaauuccuuggcuuagaguaacacuuagaauaucggagcaucuccaagaucucaaauacuuuugaguaguguauuuaucaucugacuugugaaaccacagggcucagggcucugaagccaaauuguacccuggagaagacaucucucugguccucauaagcauguuuaaggagaaugaggaaacaucugccuacuuacaucgccugaucucucuagagugaugguagaacugagauccacugagaagaaaucucaugcuggcaccaaucucuugguggugucacgagguuacaggcauuuuuccuucucuguggucagucuacacucuuugcauucucacaucuaauauucugguauucaucuacguacaguggcucacagacagacaacauccucuguaccugucacaagcaaaaagcaguuugagaaggaagagaaggagcugaucaaaaagauccagcucacuaccaaggagacaaaugagcugagagaucgccugaucuacgugaccgagggauccaugaacaagagguauacauugcuccaaaaccuguggugucagucuggggucugcaaugccucccucaucuuaugcuuuuaaagguguggggucuaggaagcuaugccaccagaacauaccugggccccacuucaugccccuaaauacuuauuagaggagaggcugcaccugaagauuugucaggagugagaaggguaauauccuccucugcucccuccacuugaaaagaggaacuuggagucugagugaagaacucagggauagaagcagugaugauuuccuaugguucuuuggaaagccuuugacagcagguuucuagguaaugggaguuuguaguuguguuuuuacuugucucgcaggugacagugcuggaaccuccagguagcagcuggaggggccuggcccacaugguucuuuucagugcuugauuagaaugucugaaguucaugccugucccuccuugucugugugccuuauacucugaggcaguaauguugcauacauuauucuaccugucauuguguucccuuugucucugucugucuauuugucugccugccucucucugucucuaugucucugucucugucucugucucugucucugucucucugucucucugucucucucugucucucucucucugucucucucucugucucucucucucucucucucucucucucucucucucccauucucucacucuuucuuucuccaucuuguguauaggucuaagucugugagucuaugugcaugcacagguacugaccugugaagauguuuuguauguuuuuauuucucuccacaauuuggaaucuagggguagguguuuuggccugaggauuuaccugccuaaccguuuccaggugagguggguccugaggucugggaguccccacuuuaaauagcauugcacuuugacuauguggucagaaguguucauacauuuguaucuauugagcagauuauauaucuguggagauuucuggccucaucuccagaauuauguguaauaucugucucuacaguauuaggcauccaggguuuagaaucccuuuuaugaaaacuggagaaauaccaucacagguuucuggugggcaaagacccguagcuuaggcuccugagaacauaacuguuuagucugcccuucagcacuacugaguaaggcagagagccagggcacccuccaucuggaugccuagcuucugguguucuggggcuaggauagccaguuucccaaggauaagaaaaucccagcauuuagaaugcagagugugguuuccauggcugcaguaguccaggacccagccugaguucauguguuacuaaaagccuaaguucauggaguucugucuuccuggggucaggcccuaccacaggcaaacucgacauuauaaagaacugaaauuaaaggagaaggagaucaugacauaucuacacaacuuagagauggagaacauggaggcccgagagaacaagcaggaguucaagaaggagaaaaauuucuaucgguaaguucuugucagggaggccaacacuugugaaauggccauuucuacuuuccuuuuuuucuggucuggaccaucugcaggucuccuucuauccuuucugcuuuucagccaucaguuugccuuggaucuuuuggacucaguuuuccuaggccucuuagagacucuuaccacugccaguguucuccaggcauccucuggagccucuagacagacaagugauucagaucaugagaaaguuuuaugcuguacugggccucuggggcucaggcagguuuuacagagcuaacugagguguaacacaacgauagagugcccucccugugguucuacugacuucccugauuucauuugcagccuacuaauugggauugccccaauucauuggcugucauagguagauggagaucucucuuucuuuuggagaaacauggacccuuuuuggcguuuggacugcagcaaaaauuucuucuuccuugaaauggcugguugcuguuuguacagcugucauggauguauugagguggauuguauuaggucuucauuggaaccaggguccaggucagguuaaugggaccuguaaguagaaaugggaggaggaggcugcaggaucuuacuaugcagaguguguuuccaguaaccugcacacccggauccugcuggaggagaaucuuauaaagaaaaaguuggcgauauugcagcaggagagcaaggaaauacaugcugauugggccaucauucaagaacguuugguggaguugaaccugaguuguaaagaugaacaggagaagaccagcaaccuggagacucaagaaaaucagguagggacaaacaauuucguaaggcuaugacuaugugauaccauuggcacauuagaucuaucuuugcuucccccaccaacuuucuaguccauacucccaagcagccacccuccucauggaauauagcuguucuuugcucugucuucacacaaauauucugggaaauuagucucuugugagacacugaauuagccucuuuugagacacuguuaccacuggcaaguguacuuucaacucugcuuuagucugcauuccacucagggugacaggugaauaacaugucacauucuugcaugcaugucuucaagauagguggaaugcuauguggagguuaagugaguccuggguccuuagacaggagacaggcagaggucauaugacauucuaggucaauucaccuuggagggauuagagccaaguacaaaugucaaaugagugcuucucauuaucauugaucuggguggcauguggccuucuccuuucuuccuguaauccacugaggucucuuccuuugccauguucuuguuuggagcugauagaagccugaguugaucuuuuucagcccagguuuugugacuguuuuugaauacuuugccugucugcagauuucacagcaguaauuucaguuaaaauauuaauguugacugucaaguaaaguugaggaagugggagaaugcagccugagagcugccaugccuuuccccaccauuccugugucuuaguaacugccuuccucucccaggucucagaagcugcaagagagcugggauuggccacagcugaagaagacagcaucuugcagaaugaguugccaugccaggaggccccugcugagcaccauacccagaacccaccaucuuccucggaugaaucuuccucagaugaaucuucuuauagcacauguccugcgugggaauaggcccuaccgaggaagccauggcugauucagggcauuguucccuuuucucuucagacaacgacucuugguagagaacugaggcggcugcacugcuaccaaguguccaagaggagcagcaggcuggagggcugugcugcuaaaagugcagaaaaaagcugcugaacaauaauuuuccuuuagaguuuugguugaaguuuucauuuuuguucuuugaguuauuguuauguuauuuagaaguuauauguucuuguucuuguauuucauuguuuguuuuugccuuuaucucuauauuaauugaacuuuuaaaaccuauuuuuuaaaaauucuauuucuuaugcagaaaaauugauuugcaaguagugacucuugagacaagcuuccuuauucagguguucuauccccugcuguagaccuagaacucacauccagugauggaucuuuguaaguuccaggcagccagggcuguauaguaaagucauagccuagccaccuagggguauaaaaggugaugaucuuuugugucaaugauauuacuuaccccauggaaacacacuugaugauguaaucacugccauauugcauccauugugucaugaauucuauuacugguaacauauagcacucuauaacacacauucauucaugaucccgugaaccagauacugaguaauauacagccauuguucuagagcggcugcagauauaaaaacacucagaaaggaauauaaaauaaaucaggaaggccagagccaucugccucaguuuacuugcaauagaccaucagugauugaggagaacaauggcuucccuuugguucuggccugaaagggucagagccguuaacuggggaaaggucaugggucaucccuccugaaagggagggaugucuaaacaugacuuucugugagccagaguuuuuccuuguuccuagucaagaguuaauauuuacccugagagaagauguccuugggucuucagauaacaguuucuucuucugaaauucauucuuguuaugagaaaaugacuccaaaauugauaauauuguuugccagaugcaacuaaguaaaaauguuauuuuuugagcaaaauuugcaaagucauaccccauguuuuuaagcuguagaaaucaguaaagcuuugcuacuugccaccagagcgguaguccaucuguuucuuuaaggcauucucgaagcuggucuucaucaaguguuaaccacauagcagauauaaugaccuuccauggcuugcugggaaauagcuuuugauagaugcugcuguccuugaccauaaacuugcuguguuuuugcuguugcugauuagacuuauguuuaacauuuaugugaaugggugucuuuccuacugaauguaauacaguauguggcuccuccugagggacauuucucucagaggacagaagaaggaaccacaaccauuccuggagaugguuguuaggcaccaugugggucuucuagagaguagcagaugcucuaaccugugaggcauccccacaccuccugcaguuggcuuuuguccuuccagagaaugugcuguuuagauggccaggaucaaguccaguugaguggagaaaucucaggagauguguagguacagugccugaccugcgcauacucauuguccuaugcugccaggcauguaugcagggcucugaaguuaccacuggcaguucuguguuuagagccuuuuaauuggacaaaaugggguagggggaaaguuguggauugcuguuuguguuuucugcucccucaagagucccuaaacacgggugcagucaggugaaaucuuaauuggucagauaaggcuagaggcucuuauuggacaauugggaacacaggcagagcugaaauauuagagaguggaagugugauggagaagagagagggaauggaggacaaaagauggaggaauaggaagauggugcuagacuacggggcccuaguguccauaaauaccuggggauuucauaaaugggaaauagaguaauguagguacauuuuccugaucuaagugugcagguuguauuuauauguguugaguuuuguauugcuugaaugggcacuuugugcuuguagauuuccccuaagucuuuuguguuauuauuuuaagagguagaggggaagugugaguggcagucagcucacuguaggcuagccacaggugguggauggcauuggaaguaugaacagccuggcagcagcuaaccaugggaaacagggcaagagugcugcauggggcuggccacucaagguuaccgagaucaucuugccugucccuaaccacuuuagcauggauuggauuuuguuuuuauguuuuguuguuuugguuuuggguuuuuuuaaguuucuuuuuuugcuacaagcuacaaucaugcauuuccuuuugugcugagcauaguagcaaucugucuguauuagucgggguucucuagagucacagaacuuauggauagucucuagauaguaaaggaauuuauugaugacuuacagucggcagcccaauucccaacaaugauucagucacagcugugaauggaaguccaaggaucuagcaguuacucagucucaugcagcaagcaggugaaggagaagagcuagagcuagacucccuucuuccaauguucuuauacugucuccagcagaagguguagcccagauuaaagguguguuccaccacaccuuuaaucccagaugaaagguguagcccagauuaaagguguuuuccuuaaacuuggagauucaaucuucuggaauccauagccacuauggcucaagaucuccaaaccaagauccagauaaggaucuccaagccucaagauaagggucacuggugagccuuccaauuccggauuguaguucauuccaaauauugucaaguugacaaccaggaauagccacuacaccguccaacuugaagaaaacaauaaaagaucccccaugcucuguuucuuuugucugugauccaagcccuccccaaacuguguaaaagcccugucugauaaguuuguugcaaagugggagucuuaacauaagcacaggguaggugguggagugaaggguuugauaggggaaucuggaagaguauuggguggccuagggcaggccagcugcuguaagcauucagcauacacaccuauuauccccugcugugucuauucuuauccauauuucuacauguaagagacuuuucuguuaguuucuguaauuuguacauaguuuuuaaacuuugguaauaaaaaaguuuacuuacugaaagaauggaauauuggaacaugcuucccuccacccaaauucagaauagcuacagucacaguccuguagaauacauacuccuuuugcaaacaaaacaggcucagaaaccaaaaaaaauaacaaaaaauaacaaaacaaaaccccaguccacacagaucaauuuuaagaguacagaugucacagcaucuacuuuauuccuuacauggaauuuuaacuccagaagggaaggcaacauaaagugaaugaccaugcuguguggccuccuguggaagaagugacucgggcauuuccaggacuguuuauaaggaagguauucauaacaaagcugccugucacaguggggauuugcugcacaucucauaaaagucucuucuuggucaaaucccccuaaguucucccugauuuaauccuaagaaaagccuugagcuucagugcaagggacaaugauucaacccaagacagccaccaccaugcaugugacuaguagaggcuauccuaccuaugcaugccuuggaccuaaguagccaaaaguggcuuucacuguuucuccagaggggccagcuaagcaacugugaaucugaaccagcuacagcaaucuccagucccaguccucugcacuccuaaacguggaccugacugaaagaaaagauggggaaaaccuaacaacgauuccuuuguuuacuauuauugcugcuaacacaaucgcuauuguuuuuauucccagugaaggcccugggucuacacuguaauaagaaauaauauugaucucuuaucaauagcuaggcagcugucucagcaucucacuuaaacaac

SEQ ID NO: 2380 - RNA, 713 nt, Mus musculus
ugcagugaagaugucccaugcgucuccggcagccaagcccuccaacuccaagaaccugcaagucuucuuugacguggacaucggcggggagcgaguuggacgaauuguuuuagaauuguuugcagauacuguucccaaaacugcagaaaauuuucaugcauuguguacaggagaaaaaggaacuggguccacgaccaggaagccucuccauuuuaaaggaugcccuuuccaccgaauuauuaagaaauuuaugauucaggguggagacuucucaaaucagaaugggaaagguggcaaaaguauuuauggugaaaaauuugaagaugaaaauuuucauuauaagcaugaucgggaggguuugcugagcauggcaaaugcacgccccaauacgagugguucucaguucuuuaucacaacaguuccaacuccucauuuggaugggaaacaugugguauuuggucaagucauaaaaggacuagguguggcaaggaugcuugaaaauguagaagugaauggugaaaaaccugccaaacucuguguuauugcagaauguggagaauugaaagaaggggaugacuggggaauauuccccaaagauagcucuggugacagucaucuagacuuccccgaggaugcagauauagauuuaaaagauguagauaaaauuuuauugauaucugaagacuuaaaaaacauugguacauaccuuuaau

SEQ ID NO: 2381 - RNA, 7541 nt, Mus musculus
gagcgcgugccgggcaccagccccacccccccgguggcgugugcauacgucauaugggccgcccuccucccauuggcuccggcggccucaccagaccccgagcggacaggcgcgcggacagggcggggccgcuugaagacacgccccccagcagggcgcgcgggcggcggauaggcugggugaggucacguggcuccgguggcagccugccuuauaagcggaaaccgcgcggggccgcggccgcuccugggccguccgggcgcgguacguguagugucguggcguguaccuuccaugcugugccuggacgccgaugcccaggcugcacgaccacgucuggaacuauccaagcgcgggcgcugcgaggccguacagccucccgcgaggcaugauugcggcggccgcuuguccgcagggccccggaguccccgaacccgagcacgcgccccggggccagcgagcgggaaccacaggaugcagcgcgcggccgggcagcuggcaccacgacuuggugcagcggagccuagugcucuucucauuuggcgugguccuggcccuggugcucaaccugcugcagauccagcggaaugucacgcucuuccccgacgaggugauagccaccaucuucuccuccgccuggugggugcccccgugcuguggcacggcagcgggugagugccuuuccuuguucuuggggugggggagggggaugaagggacacgucagcuguuaaagucacccuuguuacaagaaaaggagaacggagaggguaggaaaccccagacguuggcgagcgacaggcggaaguuggagggacuagugauggagaugaggucaggagauaauuggcaguuuaaguggaggagucgcagcugucucguugagccagaagccaggauuggccgccuggagaacuggugagggcagcaccacgcagcuauuggcugccugagcaaacgugcuaccucgcuggauaacugaaaacaaaccaucacgugcgcucaagaggcaguugccaggggacagacuucucugccuucugcagauuguggcuaucagccaaaccuucuggaacuccgugcccaguagacuugggacaggaggaaaaaaggagccuuugggccuaagcacaccuauggugucaccucuuaggcccaacgaaacuuguaacagugccacagucuuuuuucuuuccuugaucauuuugcugcuuuuugccaaaaguguugaguaauuacaguccaacagauccugcauaguuuacaguguacagcguugauaaccauuugucaaguguuucuccccccucagcccugcuuguccuuguccuguccuguguaggugggcaguauuugcucaggugcaucuuuccuccaaucugcagccacaggacagcaggagcagugccugucugcuuugaagccagcuuuuauugacugccugccuaugcuuuauaugcugggcuugggugcugugcuguagcugagucauggguuaaauguaggaugcaggacacuuaacuguugauuuccaaggcugcuugcucucaggcucaccugcagcauuaugagggucagccacaugacaguugugugcuucuugguuguuuuggacuggggguggccucauucaugcuaggcaaaucaucugccaccaaacuacuauccccagcauuuaaaaguuccuuggggaauaagauggagauuugaauucucuuuuccuuacauaugaaaccuaaggcucuuugaauuugaaaguuuaucuucaacaugaagcaucauguuugugaugaaaguuuaagggaacccaguaaaccaguuucucaucugaauaugaggcuggacugguacugcuuucaccacugaggcugagugccuguguucacacuggacaaggugggacggcagccugacugaggucuugugcccuguguccaugagacugcucccacuuguacugcagacagucccucccuuccuggguuuuacucucuuugugucuucuggagugcccaacuucugcuguccaaauguuuuggaguccaaucuguguuugugacaguuccuaacucugagaaccacagaaccuucuuugcccuccacuuuacuuacauaauccucauuucacacaugcgaaaacaaacucgaggagaccuguccagccucucucccuucuugagacccuacccuccucacagugugagacuugucuucacuggggccaggucaaggcugagaaaaagagagcagugugggguggccuucccacagccuuuucuuacagguguauguaagguaauacuuugugcuacaggugacaaacugccgaggaaaauaagugguuuggauccuacuaauaaugaccacacaaggacugauuuucaccaguguauccuaauccuguuuuguuuuucuuuaaacagcuguugucgguuuacuguaucccuguauugacagucaccugggagaaccacacaaguucaagagagaaugggccagcguuaugcgcuguauugccguguucguuggcaucaaccacgccagugccguauccucaguuggugucugugcagagggucaucuggguuguggcaggguauauugacacugcucguccccucguuccugagcuucagaguaugacuuggcuuucacguggcaggaauuuugggguuccguuccuaggaccucuguacuaagaguagaagcagagguuuacuguggcucaguggacuuuuguccucucucuugccuucuaccccacugaugugcucugugguagugagagcccugucccuguucucugucacaggagcccaaggcuggucaggaggucccugcgggcuucuacuuuccauagcugacauuuugcccuucguguaggcugcugugguuuuaugcauuuucuaugaaaaugaccaauuugaugguaaacucuucaaaugcuaaguuucuagagcaacuuagaguaaaagaucuugugaaguugugucugcacuuggggccuuccuuuccugccagccagcucugagagugcucacugacaagcacugaaucaacuuaccuacuaccuaggggacacagagacaacauggagacagugcccgccugucuccacucacugaaaaguaaaggagggaggagagcauucuuagcaaucucccagcugucagaaaguuuacuauuagaagccagcgcucugacugguccucacugggggucuugggauuggucauguaccaucauuagaagcagacaguuacuauauagugauacacccuguacguaauucugggguuuagggguuuuuuuucuuaugauaaauuauaaaaugcuuccuuaacuuuuggaucacuagaaauuagauuuugccaauaauguccagcuguccuugacuuuagcagcccucucuuuggguuugugguggacauuugaucguucccgaagcggccuugggcuugggauuaccaucgccuuccuagcuacgcugaucacucaguuucuuguguauaauggugucuaccaguaaguucgaauuuagaauauuacuuugguuuuauaacaccuguuaaaauguaaauguuuuuuaugaaaaucuugaaaugcuuuuuuucaaugcauauugaaaacucaccacucagcuggguggauuaggggugauucaugccuuucaucccaguacucaggcagaggcaguaggaucucugaguucaaggugagccugguuuacagaaugaguuccaggauagucaagacuacacaaggggaaaaaaacaacaacaacucaccauuaauaaguugguaagaggaaagucuggugaccauaaaacaugacacauuugauaacuuuagcccacaauugucucccucacccacauuacaggauccuggaccacaagcugccugcguaguuaagucuguuuuguuuuucucccuagguacacguccccugauuuccucuauauccguucuuggcuccccuguauauuuuucucaggaggugucacagugggaaacauaggacgacaguuagcuaugguaagugcagcaguugcugucccuaggcacuugacacauaccuuguugaugcaugucuuacucagauucauuagcaacaguuguuaaauauaaaaugguaucuagcuggguccucccuaaguuaugauguauagauuuguaaacauugauucaugcuagaaagcaaccagaguuugagaaugucugcaugccuuggucuguguccugugguucuucuggguucauauagccauuagauaaggcagcacaguugucaggagcucccaagcaucuauuagcaaaaucaguggaugcaggcaauacugggggaguguuucuuaucuggacaaaccaacagcuugggucagcaaguacugcccuggcaaaagacaccgaaagccaugcacagguaaggaaccauccagagagcacuggaaggaacaacuguguaaaggaaccaucuugucugaguacuaugucucuucucccugggagagagaacagugcuuauaaccagggcuacuuucaaggcaacugggcagcugaauucagagucugguagcaagacucuucaucaggcagcaauugccacuuuagcacacuguaauuuuaaaaauaaacguggauguuauuucaagaugacuuuguuccaugggcugaaguaaagagagcuuuacagaaaggugacuagaaagagccacugugcacagaaaugagcgcuggggcuuucucucaaugcuguucucaguauuucagguuauuuuuaaauagucaugugacaugaaguuaaauuugaaggccacuuggauaucucaaaaaaugucagauguggugcaugccuuuaauccagaauuugagaaacagaaacauggaucucuuugaguucaagacaagccuggacuauacucaaaaucaggaagaagaaaaauacuuagauuacuuuaaguuugcuuagagacuuccuuaugucaacuuuuagggaagcccguuuucuagaaggcgugccacacucauagguggcuugacucagaucccauuucuauccaucacucauggguacaggaucuuaauguuauucucuaacaguggcugcugaauucggaacaccuggacagaacaaaaggucuuggcucccagaggaggugugaauugagguuucucucuccucauuggcagcuugugguuguucuguccaaucagcucugcccaggagacagcaaccucuacaugaucaguucugcaggccuagcagaagcagcgacuccuggcuugaccugacaggcuccagcaaaagccacuuaccuuuuccauaaguaaaucucauuuaaaacaguuccaccgggucagcucucuggugcaccuguccuaccuuggcguggguggcagugcuuugauagugcuguuuccuguggcuagaagcuuagucauguaguugucaucgucuggcuuguauauaacaggcuuuauaggaaggcauuagcagcaccagucucucugaggucgagauugguguaacuugauaggugcgugcuuggcagccugaagggcaauaguggggcucacccugagccugucaccgucugcacgcacgcaggcagucguuuagccccaacauuuaagcacugauuuuucuuucucuuuuccacacaggguguuccggaaaagccucacagugacugagcuucagcacaugguucagaguggaagcaggauguagagacacugguccugggugugaugaagaugaucuuuuucucaauguuccauuuaggcugggcugacgauaaaugacuccuaaagacauguucacuuagucuagacuagcaaauggaggcaaggacugcuuaccuaaaagucuuaccuugcucccccacccucacaccugucuucuuuggaacauuccaucccaggcuguaugugaaagucggguaaggggggcaguuucccgaguauuagaguucacucaucauucaaagcaaaugccauauuucaaagccuugaaucaaaaugaauuaccaacuagcaguuuugugucagugcccaaaggagggagguugauggugcuuaacagagaugaaguguguguaguaagaauauuuauccagaauuaaaauaaaggguuguguaaagagggguugagagcagcagugaguuggaggaagaucaucucccaguaggaccuauagugcagccauaucuccaggucacgcucaggcuggcgcucacguguggguuucaucagugugggaacgaugcuuuuuacugccgggagguuuguagacgacaaucucacugaaagccgagggcagcacaaagucaggguucugcacugcgaugcuggacuucucaccucaguuuaagagaaguuuuauccgagcucuggaccaucuaagagugagucgcugucugcuguuucagucauaaugagccgaaauugugucucugucacuccaggguggagaggacucuuccacagcccuguggagcuugcaaucugugauugcuucguaacagguugagugugcacgucacuguguuaauuacgcaguguccuaugugcguuggacagcauagaacacaacacgugggaccuaacuugcaaggauugggucuucaacuucaagugcaauguguaugaaaaccaaucugagccuuguauucucguaaauauuuauuuuguaauuuuuguuaccgcacgagcuauuccggagaaggguucucgggucauuucagaggugcguggaggcacacucagcaauacugugucagccgugacgucccucagucauacccuccacugcacacuaguccucugacauacuccagcuuugugaguucagugauuuuuacuuacaaauuuaccauuuuuguauuccaaaauguguuuguuuuaaguuauaugaaacugaccuccugacacagucguugguccccaggcggggcagaagcucuguaccuguggacaccuggguuuggguuaacccucgcagggcuccucauaggggguugcuuuuuuuuuuuuuuuuuuuuuuuuggagggaaauguuugaaguaaaccuuuguuuucugaaacuacuuuggcuaaaagaaaauggguugugcuagacuuugggacgguucuuaaaguuuccuggaaauaaaaacaaaugauugguauuuugaagacauucuucagcuaagacuggagugucuugcacaagcuacagugacuggaagaaaaauaagugaucuuggugaugcacuugauuguauacaaugagguuuuuuuuuuuuucucuuaaacuggaaauaaauguuagaaauaauguagccaaaaaaggugaaucugaaggaugcuuuugccaauaguuauagcaguuacaacaaaccaaagugacugaguuuguacaaaugguaacuaguaccaagcacacucacuuuccugaucugaacacccagcgagguucauguccgugcuaaguuugcagcauuguguucuuuugcauucuuuuuuuuuuuacuuuuauuaaagguucaaaaccagcu

SEQ ID NO: 2382 - RNA, 7541 nt, Mus musculus
agcugguuuugaaccuuuaauaaaaguaaaaaaaaaaagaaugcaaaagaacacaaugcugcaaacuuagcacggacaugaaccucgcuggguguucagaucaggaaagugagugugcuugguacuaguuaccauuuguacaaacucagucacuuugguuuguuguaacugcuauaacuauuggcaaaagcauccuucagauucaccuuuuuuggcuacauuauuucuaacauuuauuuccaguuuaagagaaaaaaaaaaaaaccucauuguauacaaucaagugcaucaccaagaucacuuauuuuucuuccagucacuguagcuugugcaagacacuccagucuuagcugaagaaugucuucaaaauaccaaucauuuguuuuuauuuccaggaaacuuuaagaaccgucccaaagucuagcacaacccauuuucuuuuagccaaaguaguuucagaaaacaaagguuuacuucaaacauuucccuccaaaaaaaaaaaaaaaaaaaaaaaagcaacccccuaugaggagcccugcgaggguuaacccaaacccagguguccacagguacagagcuucugccccgccuggggaccaacgacugugucaggaggucaguuucauauaacuuaaaacaaacacauuuuggaauacaaaaaugguaaauuuguaaguaaaaaucacugaacucacaaagcuggaguaugucagaggacuagugugcaguggaggguaugacugagggacgucacggcugacacaguauugcugagugugccuccacgcaccucugaaaugacccgagaacccuucuccggaauagcucgugcgguaacaaaaauuacaaaauaaauauuuacgagaauacaaggcucagauugguuuucauacacauugcacuugaaguugaagacccaauccuugcaaguuaggucccacguguuguguucuaugcuguccaacgcacauaggacacugcguaauuaacacagugacgugcacacucaaccuguuacgaagcaaucacagauugcaagcuccacagggcuguggaagaguccucuccacccuggagugacagagacacaauuucggcucauuaugacugaaacagcagacagcgacucacucuuagaugguccagagcucggauaaaacuucucuuaaacugaggugagaaguccagcaucgcagugcagaacccugacuuugugcugcccucggcuuucagugagauugucgucuacaaaccucccggcaguaaaaagcaucguucccacacugaugaaacccacacgugagcgccagccugagcgugaccuggagauauggcugcacuauagguccuacugggagaugaucuuccuccaacucacugcugcucucaaccccucuuuacacaacccuuuauuuuaauucuggauaaauauucuuacuacacacacuucaucucuguuaagcaccaucaaccucccuccuuugggcacugacacaaaacugcuaguugguaauucauuuugauucaaggcuuugaaauauggcauuugcuuugaaugaugagugaacucuaauacucgggaaacugccccccuuacccgacuuucacauacagccugggauggaauguuccaaagaagacaggugugagggugggggagcaagguaagacuuuuagguaagcaguccuugccuccauuugcuagucuagacuaagugaacaugucuuuaggagucauuuaucgucagcccagccuaaauggaacauugagaaaaagaucaucuucaucacacccaggaccagugucucuacauccugcuuccacucugaaccaugugcugaagcucagucacugugaggcuuuuccggaacacccuguguggaaaagagaaagaaaaaucagugcuuaaauguuggggcuaaacgacugccugcgugcgugcagacggugacaggcucagggugagccccacuauugcccuucaggcugccaagcacgcaccuaucaaguuacaccaaucucgaccucagagagacuggugcugcuaaugccuuccuauaaagccuguuauauacaagccagacgaugacaacuacaugacuaagcuucuagccacaggaaacagcacuaucaaagcacugccacccacgccaagguaggacaggugcaccagagagcugacccgguggaacuguuuuaaaugagauuuacuuauggaaaagguaaguggcuuuugcuggagccugucaggucaagccaggagucgcugcuucugcuaggccugcagaacugaucauguagagguugcugucuccugggcagagcugauuggacagaacaaccacaagcugccaaugaggagagagaaaccucaauucacaccuccucugggagccaagaccuuuuguucuguccagguguuccgaauucagcagccacuguuagagaauaacauuaagauccuguacccaugagugauggauagaaaugggaucugagucaagccaccuaugaguguggcacgccuucuagaaaacgggcuucccuaaaaguugacauaaggaagucucuaagcaaacuuaaaguaaucuaaguauuuuucuucuuccugauuuugaguauaguccaggcuugucuugaacucaaagagauccauguuucuguuucucaaauucuggauuaaaggcaugcaccacaucugacauuuuuugagauauccaaguggccuucaaauuuaacuucaugucacaugacuauuuaaaaauaaccugaaauacugagaacagcauugagagaaagccccagcgcucauuucugugcacaguggcucuuucuagucaccuuucuguaaagcucucuuuacuucagcccauggaacaaagucaucuugaaauaacauccacguuuauuuuuaaaauuacagugugcuaaaguggcaauugcugccugaugaagagucuugcuaccagacucugaauucagcugcccaguugccuugaaaguagcccugguuauaagcacuguucucucucccagggagaagagacauaguacucagacaagaugguuccuuuacacaguuguuccuuccagugcucucuggaugguuccuuaccugugcauggcuuucggugucuuuugccagggcaguacuugcugacccaagcuguugguuuguccagauaagaaacacucccccaguauugccugcauccacugauuuugcuaauagaugcuugggagcuccugacaacugugcugccuuaucuaauggcuauaugaacccagaagaaccacaggacacagaccaaggcaugcagacauucucaaacucugguugcuuucuagcaugaaucaauguuuacaaaucuauacaucauaacuuagggaggacccagcuagauaccauuuuauauuuaacaacuguugcuaaugaaucugaguaagacaugcaucaacaagguaugugucaagugccuagggacagcaacugcugcacuuaccauagcuaacugucguccuauguuucccacugugacaccuccugagaaaaauauacaggggagccaagaacggauauagaggaaaucaggggacguguaccuagggagaaaaacaaaacagacuuaacuacgcaggcagcuugugguccaggauccuguaaugugggugagggagacaauugugggcuaaaguuaucaaaugugucauguuuuauggucaccagacuuuccucuuaccaacuuauuaauggugaguuguuguuguuuuuuuccccuuguguagucuugacuauccuggaacucauucuguaaaccaggcucaccuugaacucagagauccuacugccucugccugaguacugggaugaaaggcaugaaucaccccuaauccacccagcugaguggugaguuuucaauaugcauugaaaaaaagcauuucaagauuuucauaaaaaacauuuacauuuuaacagguguuauaaaaccaaaguaauauucuaaauucgaacuuacugguagacaccauuauacacaagaaacugagugaucagcguagcuaggaaggcgaugguaaucccaagcccaaggccgcuucgggaacgaucaaauguccaccacaaacccaaagagagggcugcuaaagucaaggacagcuggacauuauuggcaaaaucuaauuucuagugauccaaaaguuaaggaagcauuuuauaauuuaucauaagaaaaaaaaccccuaaaccccagaauuacguacaggguguaucacuauauaguaacugucugcuucuaaugaugguacaugaccaaucccaagacccccagugaggaccagucagagcgcuggcuucuaauaguaaacuuucugacagcugggagauugcuaagaaugcucuccucccuccuuuacuuuucagugaguggagacaggcgggcacugucuccauguugucucuguguccccuagguaguagguaaguugauucagugcuugucagugagcacucucagagcuggcuggcaggaaaggaaggccccaagugcagacacaacuucacaagaucuuuuacucuaaguugcucuagaaacuuagcauuugaagaguuuaccaucaaauuggucauuuucauagaaaaugcauaaaaccacagcagccuacacgaagggcaaaaugucagcuauggaaaguagaagcccgcagggaccuccugaccagccuugggcuccugugacagagaacagggacagggcucucacuaccacagagcacaucagugggguagaaggcaagagagaggacaaaaguccacugagccacaguaaaccucugcuucuacucuuaguacagagguccuaggaacggaaccccaaaauuccugccacgugaaagccaagucauacucugaagcucaggaacgaggggacgagcagugucaauauacccugccacaacccagaugacccucugcacagacaccaacugaggauacggcacuggcgugguugaugccaacgaacacggcaauacagcgcauaacgcuggcccauucucucuugaacuugugugguucucccaggugacugucaauacagggauacaguaaaccgacaacagcuguuuaaagaaaaacaaaacaggauuaggauacacuggugaaaaucaguccuuguguggucauuauuaguaggauccaaaccacuuauuuuccucggcaguuugucaccuguagcacaaaguauuaccuuacauacaccuguaagaaaaggcugugggaaggccaccccacacugcucucuuuuucucagccuugaccuggccccagugaagacaagucucacacugugaggaggguagggucucaagaagggagagaggcuggacaggucuccucgaguuuguuuucgcaugugugaaaugaggauuauguaaguaaaguggagggcaaagaagguucugugguucucagaguuaggaacugucacaaacacagauuggacuccaaaacauuuggacagcagaaguugggcacuccagaagacacaaagagaguaaaacccaggaagggagggacugucugcaguacaagugggagcagucucauggacacagggcacaagaccucagucaggcugccgucccaccuuguccagugugaacacaggcacucagccucaguggugaaagcaguaccaguccagccucauauucagaugagaaacugguuuacuggguucccuuaaacuuucaucacaaacaugaugcuucauguugaagauaaacuuucaaauucaaagagccuuagguuucauauguaaggaaaagagaauucaaaucuccaucuuauuccccaaggaacuuuuaaaugcuggggauaguaguuugguggcagaugauuugccuagcaugaaugaggccacccccaguccaaaacaaccaagaagcacacaacugucauguggcugacccucauaaugcugcaggugagccugagagcaagcagccuuggaaaucaacaguuaaguguccugcauccuacauuuaacccaugacucagcuacagcacagcacccaagcccagcauauaaagcauaggcaggcagucaauaaaagcuggcuucaaagcagacaggcacugcuccugcuguccuguggcugcagauuggaggaaagaugcaccugagcaaauacugcccaccuacacaggacaggacaaggacaagcagggcugaggggggagaaacacuugacaaaugguuaucaacgcuguacacuguaaacuaugcaggaucuguuggacuguaauuacucaacacuuuuggcaaaaagcagcaaaaugaucaaggaaagaaaaaagacuguggcacuguuacaaguuucguugggccuaagaggugacaccauaggugugcuuaggcccaaaggcuccuuuuuuccuccugucccaagucuacugggcacggaguuccagaagguuuggcugauagccacaaucugcagaaggcagagaagucuguccccuggcaacugccucuugagcgcacgugaugguuuguuuucaguuauccagcgagguagcacguuugcucaggcagccaauagcugcguggugcugcccucaccaguucuccaggcggccaauccuggcuucuggcucaacgagacagcugcgacuccuccacuuaaacugccaauuaucuccugaccucaucuccaucacuagucccuccaacuuccgccugucgcucgccaacgucugggguuuccuacccucuccguucuccuuuucuuguaacaagggugacuuuaacagcugacgugucccuucaucccccucccccaccccaagaacaaggaaaggcacucacccgcugccgugccacagcacgggggcacccaccaggcggaggagaagaugguggcuaucaccucgucggggaagagcgugacauuccgcuggaucugcagcagguugagcaccagggccaggaccacgccaaaugagaagagcacuaggcuccgcugcaccaagucguggugccagcugcccggccgcgcgcugcauccugugguucccgcucgcuggccccggggcgcgugcucggguucggggacuccggggcccugcggacaagcggccgccgcaaucaugccucgcgggaggcuguacggccucgcagcgcccgcgcuuggauaguuccagacguggucgugcagccugggcaucggcguccaggcacagcauggaagguacacgccacgacacuacacguaccgcgcccggacggcccaggagcggccgcggccccgcgcgguuuccgcuuauaaggcaggcugccaccggagccacgugaccucacccagccuauccgccgcccgcgcgcccugcuggggggcgugucuucaagcggccccgcccuguccgcgcgccuguccgcucggggucuggugaggccgccggagccaaugggaggagggcggcccauaugacguaugcacacgccaccggggggguggggcuggugcccggcacgcgcuc

SEQ ID NO: 2383 - RNA, 158495 nt, Mus musculus
cgcuuccuugggaagcauuuuccagaagccacaggaugcccagccucaucccaagagucccuccaagguuuguacaagugagucaagaguagaaugaacgcucaggcauuguuuaguggaaucaaaaccgacaagaacugagaguaaccugagucugguuaaguaaauacagccacaccagcuagccaguggaguggacuacugaucaaacaugaaggaggaggaagaggaggagggggaagaagaggaggaggagggggaggaagaggaggaggaggaggagagggaggaggaggaggaagaggaggaggaggaggaggaggaggagaucaucuggacgcuauagaugggaaaauagccaaaguguaucauuaagcaaguuugcagucacuaugacaagcuacaaaaugcuuauguaugcucagggaauuccagaagaacuuuacccacagauguugcucaaagaacaacaggaagcagauccaaggaagagggggagaaaggcacagugcucugacaugccuuccuugcugcuuccaucuuucuucucaggaaguauacuucaaaagcuacugugaaggacaguuuccuggagcauuuacaggccaacugaccaguuggaguguuuuccagccugagacuuucagcauuuggcuuugaaguacucauucccaaggcauaugugagaacuuuguagaugggcaugccugaacuccgucuaugcucuguguucuagacagagguagguuaaucagugcuuuuaauuaacccaaccugggucugaaggaccacagggaaaaacaucuuguccuuugccugacucaccaucucuggcauuggagcauucuguuuuucuccuagaucaugcaccaaguugcccaaguuuuuccucauccucuuaugcgacuuccugccaucauccacugugagccccaggaacccaguaagcccucuccaugcuugggcugaaucucaccggaucaggcauuuggaugucaaaugugcuguccagagcugagagcagaucauaugaugucugaacaagucucucaccuuaggcccagugagguuuugcucuccuagagaccuugugauggggcacugccggaucuguuccugccguaacugcagacauuaaaccaaaccaaucacacacaugguugauggcaccaaacagauagcguguauccuggucaugccucuuugucucuucugcuagcagacucuugaucaaacaccacucuuuuccuuuuuuugagacagauucucaccauguguggcuggucuugaacuugcuaucagaggucacccuccaggcacagccuuugauucacaaggguuacacauauacuaccaucuguggguuuuauccuucauuauacuucaaugagaaucagucauugaaauuuacacuuaacauaaaaacuuuuuuaaaaaucagagucaggcggugguggcgcacgccuuuaaucccagcucuugggaggcagagguagguggauuucugaguucgaggccagccuggucuacagagugaguuccaagaccgccaaggcucacagagaaacccugucuugaaaaaaacuaccaaaaacaguaaacaaaaaaaucagagacagaugucaaagguagauguggaagaccccuccaugauucucugagccagcucaaguucuggguccaugcauuuccucugaucauuucuuaucaacaucagucacaaauccccacccgaaauuaaagcuucuuucuuucugucuaagcaucuuggcuuagagccagucuugauauauaacccacucaagcuuagaauuuucaaugcuauucuuguuacccuccagaguuacagguuacagacaugugccgccaugcaacauuuucagcauccuuuuuuuuuucuuagaaaacuaugaaccuuaugauacugacacauaccuauacaugcauacaauguuacaaaagucagucuacuuugcuugguucaucugaaggcugcuacuagaagacuuacuucagggcagcaagguugagggcauuuaagcccauucccacagugacacaccuacuucaacaaagccacaccuuuuaauagugccacucccugggccaaauauauacaaaccaacacagaggggagaaaaugggaggagccugguaguuuugcuguguauuuugcauggugaugaacgcaagauuuuuuucuuuuuucuuuuuucuuuuuuugauuuuucaagacaagguuucuccguauagcccuggcuguccuggaacucacccuggagaccagucuggccucaaacucagaaauccgucugccucuggcucccgagugcugggauuaaaggcgugcgcuaccacugccuggcuugaaugcaagauuuuauuucaucuacauuuuauuuauuuguguguguguguguguguaugccacagcaugcaacuggagaucucacuauguuaugcacgauagccucagaauaugcuuauuuaauucuuuauccaacaaagacucccagagcuacucuugugugucagauccuauauugugucaucaucagagcuacuuccucuugcaucagauggcagcaaauacaaagacccauuaugcagacauuaugcagagugagagaccuuggaacacuuggcccuaaagagaaggucuccaucagacccuucccucaggguucagagagccccgugaaagaggagguggaaagaguguaagagccagaggggauggaggacaguaggaaaauaagacccucuaaauuaacaagaucaauacacauauugacucacagagacugaggcagcgugcacagggccugcacagcugggguccuagagcagaaagaaguggaugcaugcucccaucccuaacccagaaacuaacuccaauugauagccacuuacaaaugaaaauuuaguuuccuccaagggagucucacuggagaaacaaacuccucuugagaggaggcugcaugccaagaaagugaccacagaaaaguaaaucaauguaucuuuggaguuucugugucucauaauguggcagaauuuaaaaaauuaccguauuuuuaaauuucuaguauauuauauauuuuuuccuccucucuuuuuacccuuuggguucuuugcauauauacuauggcuuccaguguaguguuuuuaugggauucuugaguauuagaacaagugggucucuguuucuugugauuuuucuugacuuguccaacucuuguguuagaguuuguuuuaucuuauuauauuauauuuuaucauuauuccuuagaagccuguuuguuuucuaaugaggcagaaaagggaguggaucuagagaauaaauauggagaggaacagggggaauggagggaaggaaacuguagucaagauauaucacugaaguggaaacuuaaggguucuuugggaagucaauuggaugguguuuugcuggggcaaacacgugaagaaacguuuuguucaaguggacacaggugugacagacuaaggcagacucgugaaggaacguuucacugaagcagacacaggagagaggaugcucugcuaaagcaagcaagugaagggauacgugaugaaggauucuuuguuaaugacacgcauguauucguucacuuuacauuguuuaguugagcggcauuuguuggaacuccauacagagaaaugcacugaaaaaccucuggugguggcugcggcuucugaggacuugggcugauuggaugcaugagcucaggcaagacaaguauugaggcaagacauguagaggacaugugauguuuggaggguauaaauaggacuccacggagugauggagacagagcuuggcuuguugguacagcuagcugugcaaugauugugggucuugagucuuugcugaucuucccuucccugagagaggcacagccaagaacuucuguugucccucccagucucuccugcucgcucaagcugaggcugaggccuggcugucucugcuagguugugauacugcugcugauuccuauuugcuauccugacucuacugaacuagacugcugguguauuugugaaguguuugagaguggauugagcuggaguggaucgagcugccacugcuaaccugugaacugaacugccgauuuccagacaacauaggugggaguugcuccaaagaaccuuucuaaacagguccauucucccccucgccccccuuauuguuucuuuuccacuaccucuggugggugguguguuauaagagaggauaaagcauuuaagaacugccauuaaaaauaagguuugaaauaauuaaaguuacauauuaugugagaaaaaucuauuuucaauaaaaggaaaaagaaauugcuuuauugcauauuuagcagauacauucugugcauuauacauaauguauaugacagaaagaguaccaauauaacagaguagaacccaacauuaguuuaaauaugcaccaucaccaucagaucuuuguagccacaaauaacccucaccuguuccugcucugacuccauuucugaugucauuguucccugcuuuucugguucgacugcacguuugccucaccaaaugacauauaaccuuguuaugcauuguucugaacuguauaaagagauucacaccuaauucccuguagcuuucuuuugcucaacauuuuguuuuauuagcgauggaccugcauugucacuugugguucuuuuugauggugauucuugguugccaacuugacuguaaguggaaugaacuacaauccagaaauggagggcacaccugugauccacaucuuucgucuagaagacacaggcuuuugauccagaucaugaggugggaggacauaucuuuaaucugggccacacuuucucuggacaauggaagaaggaagguucuauuuuuuguuugcuuguccucaccuuccuaacauauccauuccuucacuggcauuggagccuacuucuucaggauuccugcacauacagaggacuauuggagacacccagcauauacauaagacuaucggagacacccagcauauacauaagacuaucggagacacccagccuuguauggcuuuccauuuacaucuuuuacaauacuugaugauuaugcccuucuaauaaaaagcuuagaauacuuaguacuugguuuacaccucaccucacuugcuuuacgaaaacucucucuuuuuaggugauacaacucugucccucuagguguuaggagucucuugagccuucuuucuacucccaaccugugggagacucauaggaguggucuauuauuggccuuguuagagaaagucugucacuaggggucaggagugggcuuugaggcuucagaagcucaagcuaggcccaguguugcuccccugcugccugcugaucaggaugcagaacccucagcuaccucucuagcaccaugucugccuguaugcuaccauguuucccaccaugauaauggacuaaaucucugaacugugagccagaccugacuaaauguccucuauauuaguugcuguggucauaguguucucucacagcaauagaacccuaaggugguagggguuauugguacagacuuuuaacacaaaucuagucuguguaccucuuaucacaugggcagccuccaccuggauccaauacauagugauguguuagaauagccgcuugagucugaacacagcacaccaggccaaagcaguuccauguguuaagagguuuauugggagagagagggggaaggugucgguggaaagagaagagauugugugugugugugugugugugugugugugugugugugagagagagagagagagaagcauuccucauauauauggaugaugaugugcucacagguaaaggugggaggugaguucaauggauucugggaauauggugaauauggugguccuuaucuuggcaacagguguguagucgagcugaugccuaugggaugucacagguuuuggagguccugaugacaacacauaggcucugaauuaguauaguaagucucauggcuucauccuuaccugcuaccuagucucuaaacacagugaggucauaugacaacuauaagcagggugcuuggugacacuucccagagaaaaauucaaagcucuauaguggcucaaacaguuuuacagaacaacuguauuacaaauauuauuuucuaaaauguguguguguacucaugugccacaagguacaugugacaauuugugggaguuauuuuucucuucuaucaaaugaguacugggaauggaauucuggccauuaggccuagcaacaaauaccuuuaccuauuugaaacaucucacuggccaaauuaauuauuuuuaauugguguauguucauuguaugucauuauggauaucauaaaggcauuuuuucaaguaaauuuuuaucacuugcauuuccacgcacucuuccuuucuccuuucucucuggauaauccucuuuguuuccccagccuugcugcuacuuacaugucauaucuugcugaguuuggcauggacuugaguaugacaugguuuccugccccuggaacagaacuaguggggugugggucuucacaaguguugaugacugcuaugguuguaaggcucguuuguauaaaauuguacauauuuuucacauuccuuuuuuuugaggaauguucugccaaaguuaaugacucuaugauagcuagagacagcuugaguucaggaggugagggagugucagaacacugugaccuucaggauaacccuuaaggcucugggaaagaaugcugaaaacacgaguuugaaaauuuauaauuucuuaacuaugcaaaauauaaggauacaauaugaauuguauaaggagcuucacagaucuaaaggaacagaggcagcugcccuaugagccagacugucagaaacauacuaaggaaggagauagagauuuagagaguggugaucgcaaggcaagaucccacacagcuaaauuuuuugcuuaugcuuaugaguucaaggucagccucagacaaagcuaauuuagguccagguauagucagaaugguaauuucagagaagggucccacccagcuaucuuauuaucuugcggucccuaucuaagaaucaaggggcuggggucaggugguguugauucaagauauaaucaaaagggaaccugugauaaugacugaauugauguuuaaauaaaaaagagacuuugucugcaagagaugagcuauccagagaguuuuuuuuuguuuuuuuuguuuuuuuuaauaucaagagaaagcugucucaagcagagcagaauauagaauacaaucugaaaagcuaaagcagaacacacacacacacacacacacacacacacacacuauagagacaagagagggggccgggaaggagagggagggggagggggagggggagggagaacgcuagugagcaaucuggaaagccaaagcuguuuugagcagaacacaggaugucagucuggacucacacuuugacuuugagucauuugcuuugcagcucucaaauaccccuucucucagaaccccucuccaagccgaggcugguccuuggcaauguaaguauaugacauauacauauguaauauuuuagguauaaauauaaaacccauggucugcaaaugaguacaaaacaugccacaucugucuuugucuuauaagagggauguggggaaagggugguucaguagcagaagugaugggaugucuaacuccagcuugcuugagacuucuuuuuacugggugcuggaaucacuaggggucacaggaagagcaagcucuaaggcacaggccuucucccaacacugucaucauuuugauuuucccacuggcuggagcgaguuacacaaucagggccagauucaggguaagugguucucacuggaagauaagcaaagccagagaacagagaugugggccaaugugcugaagaggucagcauaggaacuuugggaaggucaugaaacaaucaccccuccaggagaggcuaauuagcauuuuucagaccacaggguggaaccaaaccgaggguggggacacauucagcaggacugaccauugcucaccuucagacaagggaagaccuugucaccucauucccuaaagaccaaucaguuuaaagggugcacuguucugccaaucauauugugccuaguugcugaugcucuguucugccccuggaaaccauauaaaaagucgcugaacuagugcugggggucgucaccucuccuucgggucugggacgaucccagugcacuggaacaauaaauuccgauugcgccaggugugguggcgcaugccuuuggucccagcacucaggaggcagaggcaggcggauuucugaguucgaggccagccuggucuacagagugaguuccaggacauccaaggcuacacagagaaacccugucucgaaaaacaaacaaacaaaauaaauaaauaaauuccacgugguucacucaggggguccucgguaagcuaaggcucccuggagucuuacagugcuuggcaggggagugguguccauuuuugaaguugguuaucuuggcuaaguuuaaaagugccaaagaaaaugaaacaaauaaaacugaaugaaagcuggguaagcuuccaugaauagcccugcaacagaaauguaaggguuuaaaugguugcaguauucaauuggaaagaugugaaauacuuucuggaauaucugccccagagcuacacaccucaaaagcugauguguuuauccuuugauuuggacagauuagcccaggaaucauccagaucaguucagguggguauuuaaccuagcucccagaacgcgguuguccaggaaaaaggucuuuuuccuuguucuuuagggcugagacauuuaaagacacgucaaaggcaaacugguuugaauucagacacguuguugcugacugaugagccugcuguaucgggaacacacgcugggagcaagacucagguuccccaggcucuucuaccaaaugaacccagaaucaaaauugcaaauaauccuuuuaauuccagcuguuuuggcccaggccuuuaaucaugacuccccggaagcagaggcagucggaucucuugaguuucaggacaaccaggacugcauagagaacccugucuagaaaauccaaaucaaccaaccaaauacuccuuuaaauuccaauuuuaaaacaaaaauugcauaaugaagggaaauggcuguguuggcauacuuagucgugccucauaucaagggcguuguuuaaggccuacagaggaucauuaaccaucagagcccaucuucagaccugggggcccuaggcuaucucaguucuccaggacagcggcucuccuaucuccgcagaggcagaaggacuucagagugcuaagcugcaacggcuuucccgcuuugcacuugcuugggagagaaauuuuccguaguaggcccuaggucuuuaagguuggucgagcccagugcuaaacucagauucugagaacaaggguggagcaaggcgugauccaaaagccccggggugauccaaaagcuucaauaaacaagugagggcgggugcaccugugcccggaucuccaaaucccguucgcaccagggcuuccgccucuagaccucauccccugccuggagcuucggcccgcccuuacucugggcaaugacuaacaaggcuggaccacaacacuucaggcccagcuccgagauuuauguccugcugcagcacgcgucagaaggccacuucaguccaggacccuaaaaaccccgcccccguuccuccagucucucuccaaggcgccuagcgaccuucggcccagcgccccacgcgcagaggcgcucuucucugacguacggcgcucucagagugacgcacaagucccgccccgaccucaagccccgcccaggcuguggccauuccccgccucuuguaucuugaaccgcuucucccugagcucaggcggcguuuuccgauccugcugcggucuagguggcguuucuguccggccacgagagacuguauagccccgccgcccgcgggcaauggugcggcggagcgcgcagacgcgggcggcccugcgguggguaugaaaggaggauggaagggcaggacgaggugucggcgcgggagcagcacuuccacagccaagugcgagaguccacggugcguggucgggcgguucccuggugcugcgccgcgcguuggacccaggagcgcagcguagaccagcacggucccauaguuucuucccggacccuucacgcauguuggccuuccagcaccccacugggucugcugcagacugacuccgacgccccgcaucacuugagacccguucaccugcuccccaucuucucaccucugucaccuccugcucugucacccuacugcucucuccucuuguaggucucccucgcgccaccagcguucucuccccuccuuucuguccucuccuuaccuauguucccuccccuucauucuaacuuccuaucuuucuccugucaccuuuauacccacccaccaccccguaccuaugucuuccuuccgcugcgucaccugugcuccucccuuucccugagcucccuccuaucauuucugcccgcuuccagucaccugugcccaccucuggucaccugaguucggcucuccucccaacacuuguagcccgucaucaucggaccuccucagucaccuacacuuaaccugcguccauuucuccuauacucucccuaugcguccauucaacucaucugcaccuuuaucaucugcuucaccaucuucaccugaguuuaucccgcaucuccugcuaacugaggguauagggugauggguggcugccucuuuucuucuagccgggcgugguaccugguaucugggcugagcuugcuguggcucagcuguaaguacagacaccuggcuucccaagcuuccagcccugcaguggcucuggccucccacccgcaucucccuauacucacacccucucuaaaccccucuauccaggacagaguuaaaaacuucccgaggaguguagacaagucuuucguaggaagggcgagagcaggaaccuacagugcugucaaacaacugcucuggaaaggauggaccccuuucauccugcuguuucuagcaggucaggaagccagcuuggcucccuaaggucucuuuugaugagugccuuucaggaugcccuacacuauuguaaaagaauuaguuuguguccccauaacucugcaaaguauguucaaguuacauauuugcauucaccucucuucuaguucacguuccccucucagucacacccuugguuugagggaaacauucugguucaguuugugcaguuacugauuuugaaaacugagaacuggcuugccgagucauacugaaguaagaggagaugcauuaaaucugaguugauagaguuuaguacaauguaguugguuaauuuuuauuuuuauuacuucuuugauuauuucauacaauguauuuugagcacauucaucccuccccagccccucccggaccucucuccacauucccaacuucaugacuuuuuuuuuuuuaaaccauuugaaucaaauuugugcugccuuuccaugcuugggugugugggcauuuaucggagguuaugguugaccuaugaguagcgcacuuuaaaaaaaaaacugacucuuuuuuagcagcugucaguugucaauaacuccucagauaggggugggucuucauguuuacuucuuucuucauacugagauuuuugacugacuugggcuugcccagguuuuguaugcauuguuaaaaaccacccucaguucauuuguauagcugccauaacuggaaacccugucauaacuggaaaacacugguucuauauggacauccacugcuucuggcucuuacaaucguuuugcccccucuuccacaauuguuuuaaaucucaggaagaggggaaugauacagaauuccuauuuagggcugagcauucauucuguagccucauauucuuuguaccuuggccauuuugggucucuacacagaaagcaucucugaugaaggugaaaagaugcacuaaucucuggguuuaacaauaagucauuaggaguuaguuuaauaugguuuucaguuagcaauauaguaguagguauagauauagguucuguccuagggucuaugacucuuuacacacagagucuugucuccaauuacagugccagguaugagguucauuuuguggaguggaccuuaaagccaaucagaaaguauuuggcuacucccacaaauuaugcuauuaggaaggaaucuauaauuuuaaguaugcccuagauacauuuucuacaaaacauacuugacuaaucaugguuucagaugcagaaauagaauuuugcuaccuugccagagacccaggcuuucucaacaguuguaacuuuuaucuucucuaaguguaacugcugcucugguuucuaaggcuauagguuaauuuuguuuuauuuuaaaaauucuuuuauauguaugaguguuuguuuguacuuauaucuguauaucauguaugugcaugaugcccauggaguccagaagagggcaucagaucuuuggaacuggaguuaacaaauaguugugaauugucauguggcuacugggaacugaaucuggguccucuaccauugaacuacaaugucagcccagagaaguggcagguuuacucauuccucugugccuggugcaucuggcgguggacuucugcuaguuucugaaaguuuucucagggugggucugcucugacacacucaggaaucugaaauauguaugacugcuaugguaauacaaguguauccuuuuuaaguucugagagcuguuuuugggaaauccuagugagcacaaguagaucucucacaauucuuggaaaugggcuggaauaccuguauuacuccuuguuuuuagcauauuuaagguggaugucuaauuauuucaacaacauacauuaucuuccucauuguauuguccuugugcuuugugaaagaucaguuagcuguauuauaugguuauaauucuagcauuccuauucuguuccauuggucaguacuucauugauuauuauuauuuuuauuuuugauuuuucgagacaggguuucucuguauagcccuggcuguccuggaacucacuuuguagaccaggcuggccucgaacucagaaauccaccugccucugccucccaagugcugggaucaaaggcgugcaccaccaccgccuggcuacuucauugauuauuuaagcuuuauuuuuacuuuacaagagcccuuugauuauauucuuucucuucagauugugcugauuauucuggguuuugauucucugcauagacuuuagaaucagcuuguuuauaucuacaaaguaacuugcuuggguuuugguugagauugcauucaguuuguagaucaaauagggagaacuugcaucucccuguucaugaacaugggcuaucucccauuuauuaaaguuauuuuuagauguuuucaucagaguuuuaugguuuucuuauguauauuuuaaauauguuuuguuagauuucugcauacucuguuaacauuacauuuuuuggcaugcuaguguaaaugauguguguuuuauauuccaguuucacuuguuccugggcugguagcacacacuuuuuaaaguaauuaauuaauucacaucucgaucaauugaagcugcuucucccuccuuuccucccaggcccucccucucccugcccaccucuccucccuccaucaccaccccuccaucuucuccgagaaagggaggccuccuauugauauuaacuugccuuggcaaaucaaaucuaggacuaggcacaucuucuauugagccuagacaaggcaucccaguuaggguaaagggauccagaggcagacaguagagucaaagagagccccugcucuagucuuuagggaucccauaggaagacuaagcuucauaucugcugcauauguguaggaggcauagguaugccccuuacauccucuuuggauggugguucagucucugugaccccuccuaugggcccagguuaguugauucuguagguuuucuuguauuuucuuugacuccucuggcucccucaguccuaucucccacuccuccauaagaugcccugagcucugccuaauguuugacugugggucucugcaucuguuuccaucagcuuuuggaugaagccucucaggggacaguuacacuagguucccguuugcacgugucaguaaugguggggucucaaguugggccagccguagguugaccuuuucugcaaugccugcuccaucuuuaucacugacaucuuguaggugggacgaauugugguucgaggguuuuguggcugaauugguauuccauuccuccauuggaagucuugccuggcuagguguucgguucagauuggugucacauacuuuuauucccagaaucuccauagguagagacaggcaggucuaugucauuuuagggcuacucuggucuauaugaugagcuucaugucagucagggcuaagggcaguauagugauacucugucucaaaacaaaaagcaugcaaacaacaacaaaacccugacauaaaaacugagaccaagcuaaaacaaaaauuucacuuguccauugcuggcauauaggaaaagugauugacuucaguauuuuaaucuugugaccuucacucuugauauaauuauauauaaguucuaggucuuucuguguauucauucauuuuuuuuaaauuagauaauacaaccaucuguguauaaaggcaguuuuacuuguuaauuucaauccuuuuucuuguuuucuugcauuaaauaggauucuuagaacugcguugaagaaugagaaagggugccuuugccuuguuguaggucuuagagaagcuuugcuuuucucauuuccuuccuuucuuucuuucuuucuuucuuucuuucuuucuuuccuuucuuuccuuucuuuccuuucuuuccuuucuuuccuuucuuuccuuucuuuccuuucuuuccuuucuuuccuuucuuucuuucuuucccucugcuugcucugguuggcccgacucagaccggcugccuccagucaacuccacucgcuuagucucugcuugcucuggcccaaagauuucuuugggccagagcauaaguacacuguacuuauacauaauacagauacuuauacauaauacacuguacuuauacauaauacagauacauaaguacacuguagcugacuucagaugcaccagaagagggugucagaucucauuagaggugguagugagccaccaugugguugcugggauuugaacucaggaccuucagaagaacaguuagugcucuuacccgcugagccaucucacuagccccugccuuucucauuauuaaguauguuaguuuuugaugcuuuguagauagguauucuuuagcugcugaggaaggccucuaaucuuagguuguuuuaaaauucacauuuuuucuuauguauuuggcuuagguuuacuuuuucauucaugaugaauuaaugucaccuagcuaaaguaguguuuuauuuauauuucuaaauaaaguugauacauuuagaaaugauguauuuauuuaaauauuuauuaauuuuauguauaugaguguuuuggcucuaugcuuuuuuuuaacuauaugaugauacaucacaguuauuucuuccuuuuggguuacaucauuuaaaauaaaguacucuagugacucuuuuucuuugugagagacagggucucauauaggcuggguuagcuuugaacucucauuguauuacugaagaugaacucuuguucuuccauuucucaaguguugauaauauaggugaaugccaucauucauggguuagaauaugcacauuaauuauaccagugauuggauuuuacugugacauuucuauguauucauauauccucauuugauuccuucucccuuuuguucuccucuuauauaccucaugguccuuuuacccucaaaacagcuucaucuuccuuuauagcugaguaauucuccacuguguguauguaccauaucuuuuuggcucagucaucugucaauagacuauuguguagcaguaauuuuagcuacuccccuuuggcuuccagccagagcucccacucaggagcucuuuggaucugcaaaugaaagacagacagacagacacacacacacaaguuuauuuuugaaaugccuuggcuacgcaaaggcugggccauucuaauccucccucaacuagcauacuuuucccuccaguacuccugacucaacaccuucuaaauccaccuauaacuuugcugcccuguuaccuucugugaggcuuauugguuuaugcugcccaagaugccucugggcugcccuuccaggggccacuuucccuucccaacuacauuuuggaugaucuucccccuguggcucuaaaucugagcugucucuugauucugcaucuccuccucacuccugucuccuugcccacaggaaccuagaagucccaccucucccucuuugccuagccauuggcuguuggcguuauugauucaucaaaacccaacuggggacaaggaccuaaagguuuggacacacagauuuccauuaagucaaaguggccuauugugucaauaggucacugugauaaacacaggagugcagauccugugcaggagcgguauaacugaacuauauauaggucuguuuguaguuguuuuuuuuuuuuugaaucuccguuuuuauaauggcuguacugauucacauauaucuucuaauguauauaaagguuccuuuuuguucagaucuucagcagcauuuuguauaagaacuguuuggcugagugaaaucuugauucccauucccugauagcuaagaauguugaacauuagccauuuguguuuccuucuuuccuuccuuuguuucaugagaaguaucuguuuagaucauuugucauuuauugacuggauuauuuguucuuuugcuguuaagguuggaguuaaaauauucugguuauucucuuucagaugaauagcugucaaagauuuucucuaacucugggguaacacuucauauuauaguuucguuugcuccucagaaguguuuuaauuuaguguaauuucgucugucaguucuugcuuuuauuucuugagcuauuggaguccuaccagguuccucugugcuucccuuuaguaguuucaagucuucgacuaagaucuuugaucuauuucuuaguugauguuuguguagggugagagggagcugguuucagccuucuaccuguggcuauuaaguuucucaguacuauuuguaugagauggugcguuuucuucauugucuauuuuuggaagauuuguuaagaaccauauagcuguagauguauaguuuauuucuugguccauuauucauugcuuuacauauuugcuuuuauucugcauacaugcugauuuugcuagugauuuuguuggugcgguauuguauuuugaagucaagaauugaucauugugguacccccccccauuaaacccuuuuuuuuuuuaauuuuuguuuuuuuuauuggggucuuuaugacuccaaauaauguuuugcuugcugucuuagucaggguuucuauuccugcacaaacaucaugaccaagaagcaaauuggggaggaaaggguuuauucggcuuacacuuccauacuguuguucaucaccaaaggaagucaggacuggaacucaagcaggucagaaagcaggagcugaugcagaggccauggagggauguucuuuacuggcuugcuuccccuggcuugcucagccugcucucuuauagaaccaagacuaccagcccagagauggccccacccacaaggggcccucccaccuugaucacuaauugagaaaaugccuuacaguuggaucucauggaggcauuuccucaacugaagcuccuuucucugugauaacuccagcugugucaaguugacacaaaacuagcuaguacaguugaccccuugucaacuugacacacaaacacaucacugguaagccucaacccuuaguuucuuauucauccccaagaucuaaauaacuuuaaaagucccacagucuuuacauauugaaaguucaguccuuuuaaaauaucuaauaucuuuuaaaauccaaagucuuucuacaauuaaaagucucuuaacugugggauccacuaaaauauuuucuuucuucaagagggaaaaauaucagggcacagucacaaugaaaagcaaaaauuaaacuccaacuguccaaugaucacgauccucuggucuuccaagggcuugggucacuucuccagccacgcccuuuguagcacacgcgucguccucuaggcuccagaugcuccaccucugcugcucuugguggucaucucaugguacuggcaucuccaaaacacugcaugaccccuucaguccugggcugucaauugcaacugaggcugcaccuucaccaauggccuuccauggccuuucacagugccgagccucaggcuucucugcgugaccccuugaugccuucaaaaccaguaccaccuggguaacucuuacacauuacaaguccagccacagcacaagguacaaccuugguuaucucuggaacauaaccucugugcucucaaacacuucccagaagaugucaccucaaugaugcuggucucuucuuaaucaccgcuaauuucuuagcuccagcuaaccagcaucaauagucccaguaaaguuuuugcuuuaguaguucugguaucuuguuaaucacagcugauucgucagccuuagcuaaccugaacuacagaaucuucacaaucaaacuagcaauagcccugaaaagagucuuuaauuuuccuucugaaauuucacaagccaggccuccaucuucuacacuguucucaacauuaucuuccaagcuccuacacaacaucucacagaguucuuaacagcgaauggaucuucuggaccaaaguuccaaaguccucccacaguccuccccaaaacauggucagguugucacaggaauaccccacuaugcugauaccaauuugucuuagucaggguuucuauuccugcacaaacaucauggccaagaagcaguuggggaggaaaggauuuauucagcuuacacuuccauacugcuguucaucaccaaaggaagugaggacuagaacucaaacaggucaggaagcaggagcugaugcagaggccauggagggauguucauuacuggcuugcuuccccuggcuugcucagccugcucucuuauagaaucaagacuaccagcccagagauggucccacccacaaggggccuuucccccuugaucacuaauugagaaaaugccuuacaguuggaucucguggaggcauuuccucaacugaagcuccuuucucugugauaacuccagcugugucaaauugacacaaaacuagccaguacacuuacuuuuuauaguuuugugaaagauguuaguauuuugauuaggugcauuggacuuguagauugcuucgguaguaugccauuuuaauaguauuaauucuuuuagcccaugaacacuggaagucuuucuaucuucuagugucuucuucagguuuugagugcuauagaguuuucguuguagaugucuuuaauacuuuugguuacauuuguucuuaccuaauuuuuuuuauaucucuuaccccuuaccuuuccucuugccaaguucuucaauauacuuuuucuugcuuucuuucacauuuauggccucuuuugucauuaauuguuguggcgguuugagugacagugggcauauagguucauauauuuggaugcuugguacuuaguuggugaaacugggaagaauuaggagccuuauuggagcagauauguuauuggggagugcuuugagguuucagaagcccaugcugcucccaguuagugugcgcgcgcucucucucucugccuuguguuuguggaucaggauguacgcuuucagcuacuguuggaaccucgugccugaaugcugccaugcacucugccauaaugaguauggacucaccaucugagacuguuaacucccaauaaacuguuucuuuuuuuuuuuaauuuauuuuuauuuauuuauuuauuuauuuuuguuuuuucgagacaggguuucucuguauagcccuagcuguccuggaacucacuuuguagaccaggcuggccucaaacucagaaauccaccugccucugccuccugagugcugggauuaaaggcgugugccaccacgccuggcuaaacuguuuuuucuauacauagccuuauugaagucaugguuccucuucacagcaauagaaaacuaagacagaaguugguaccagggaguggaagaguugugagacaaaggaugagagauucagacauuugagaguuggcauagaggcagagacaauagugauuccaagggucugaugugggauggcucuggugugcucaaaugaagagaacauaggaggugagagcagagaucaguggagcugcccucuuuuucuucauuucccuccuucaggcuuacuccuuucucuuucuagcuuuucccagaaucuacuucagccaggcuuuugucucacuguuucagaaaacaucucuuguuaaaguugcagugacucucaugcugccuaauccucuugucaauugcaccagcauccuuauuauggucuuuuccucgauauucucuuccccccacucauuuccugucccuugauucacuuacagaaagauuuucugugagucccucagcuguauaguuauuucagcacuacuccauuuccuucuucucuuacaccgccugcuggauuauucuuucuucuuucaguagcuuuucucacuuuuaaaaaaguuucuugacuuugaauuccucuucacaacuccuuuguuuucugauagcucuaaggaagaacucugcuuacauuucucuuuccagcacuucugggaauccaauugagcuaggcuuuugucuucauuuuuccagaaaaacaacucuugucuagguugcagugacuuccagggcaccagauccuguugucaauccuguccucaucuuguuuggccugucagcaguauuugacacuguuguaaaguccucuuuccuucaugugggucaggaaaugugcaagcccuagguguuuugcccuuggugauugcuugccuggcagucucugaacaccugagagcucugcucuguuuuuagacuuaucuucucugccugcuuuugcaccauagccuuaggacauugucaucugcugauuguucuuuguuuuuuuaaucuguagucuagccuuuccccugaacaguauagaguuauauaaagaccuacucacucagcuuuccaccuuugaguguauaucucaaacucagcaaagcccacuccuccucugaaccauuuuguuuuguaaucuucccgacucagggcuuugcaacucagucuuuccaguuucucaggacuagaacuuuguguuuguuuuuacaaguccuagcaggcuugcuuugaaaacacccauaacucaaucauuucuuaauguuucacucuacaggucugagugauaucucuccugccuuguuuuguguucaguucuuuuaugguuucugcuucuguucugguacauauauacauacaaacauacauauaacguguguguguguguguguguguguguguguguauguguguauauguguguccccuagcaauuggggugaguuucuuccuugagucuggucaugccaccucucuguuccgacucuuacauggauuccuaucucccucagggucagagccacgaguaaguacuagcaccuguaacaaagucuucugugcccuggacuccuaucaaucccuacauuucaucuguuauuuuuuccuuucauuugaacacaccagagcugucuugcuucaggucuuugacauuacuauuaugucugcaucacauacugcuggucgugcuucucuuguccuccuggcaagauaagcccccacugcuaaugguacccccuguugucuuaggcccacacuauccucaaacaccccguaauguaauugucuguuauauauuuauauuuauuguuacugcucuuucugaaaugugucacaaggguacaccuuugcucacuaaugcccccaguguuagaauagguuucuagauauaguaagcccacaacaaacaacuuacuaaaugaaucaacuuaggacuccucugcuagccaucugacauuuuauuuuaacuuuaggauucauuguuuuacugccaaguuugcuugcucauggagccugacauccauuauuuuguagacuucuauuucuauuauguuucuuuaccagcguuugguuuuucuguugacccauuugcugugcuccagaggauuucaagagaagguuguaacucuacuaacauccucuuguuaaccauuuuuuuuucuuuuguuuugagacagguuuucucuguguaacccuggcugucuuggaacuugcucuguagaccagcuggccuugaacucacagagaucugucugcuucuaccuccucgagugcuggaauuaaaagagugaaccaccaccaccugacuuagccagcauuguugacaucuuuaggcuuccagaacagauguugggacuguguuucaucagucucccacaugcuuucugaggauggugacacucaguuugucgugcuccucuccauuucauuguuguuuucuaagggauggcuuagacagggaugacuaccaaccaagucuggagucuuuuugauuacauguccaccaacucauacugagaaguccgugcucagagugaucacuagauuucagcagguugaaagucagguuuuuuuucaacaugcuccauaagcuugagugaggcuuuauuuuuagcauuuggucuuugguggauaucuuguuucuugaccuucccugauggaaauaaagugccauguacacauaugacccaaauaaaaauggguagacuuggguggacauuucucaaaaggagauauacaaauauacaacagauauaugaaaaugaucuuagaauucuuugucauagagaaauggaagauucaccucguaucugugguaacggcugcuucuguagaacaagagagaaguucuguugaggauguggaaugaaaggaagccuuguguaccacuggcaccagaacagcaugauauguccuccagaaugcaaagcagauaugcaaagugcucuaccucuuccauuccggauccacagucaaaggaaaugaguugguuuaugagagacacugugcucaggguucaccaugucauguuauagacacaacugaugugugugugccaguauagauaaauagguaaagaaaaugugguaauccugauguguaccauucagccuuaaggaaauugugccauguaggcaucaagggauaaucugggggaaauucugccaaguaaagucuacauauacagaaaaacuaaacaacuugugcucauagaaguagagaguauacgagaaaggggacuguggguugauguguggccagugagugccaaaguucauaagagugaguuuaguaggccuacugauauaauaauguugugaagaacagugcucuguauguuaaaauccuugagaguauauuguaaguucuaaucaguagugauaagcuggugagcuccuuccuccauuaacuaguacagugaggggggcauugccacgcguggagaguagagccucaggccacacacaguaauccugucuuuauuagacaaaguaaguggaauuuauuguuaagacuuaaaccccaguugaauaaagaauuuuaauuuuagcauguaguauauuuacugaaguuauuuuuuacuccacauugaucugugaugcuucuuuuaugcuaaaguuccaugugacugaaucugucaaguuguggugccaguacauccgccacauauuacugcagcucuuagcaugcuuuccuuuucagaaggacagcgugggcccauuaauuucgguuuuuagaauuguugaugaugguuggcucuuuacacuuccacaugacuuugaaaaacauuuucucaacuuaugagaagagaaacuuuaaacugggauuucucaccaaaauaguauuaaguagaauaaucgaccaguucacauauuaauauuuuuuaucaaaauguuacauuugugaaauuuacguaaguuuuacuuuucaguaguuauagauccuucauuuccuuuaaauaccaaagauguaucucuuguugguuauaaaaaugacaggcaaaaauguaaaugaccuauuaaauuucuuuguuucagauauguuuucuucucuuugccauucucuacaucguuuccuacuucaucauuauaagauacaagagaaaauccgguaaguagaaagagauauguuaacaguuuuccucagagcugcguaucuggggugguauaugggcucuucccacacauugcagccaugcugaauaugccgauggcugaaguaaacaguugccugguccuaagaauacuaaaaauaacucccaggaaacccgacuacacucagccacccauccagcccagaccagaguccuugcuuaucauaacucucauucguaacuaagaauaguuguuggcuauuuacuaccuaggaaauuccagaguuuaugaggguguuugguucuuugugacugguucuaacugagcguccuuaucaucccagauccuuucauuuucucacuacagaauugucuugucugucuuuccuucccucuuucccucccucccuccuucccuccuucccucccuccuuccuuccccccuccuuucuuuccuuccuuccuuuuuuccuuccuuccuucucucugauuuccuuuuuuucagaaagauguauuuauuuacuuauuuuuauuuuaugugcuauaguguuuugccugcaugcguauuuuugcacuauaugcaugccucaugucugcagaggccagaagaggguguugcauccccaggaacuggaguuaaaaauggccuccauauaauugcugggaaucaaacuugagaccuccgcaggagcagcgagugcucuuaaguguugaaccaucucuccagccucuguuuuccuucuaaagcaauauaaaauuuagaguacccauacuuguacuggcauucaguuguauacucuccuguauuaucucauuuuguucugaguuaaucggaggguuuuucuauuuuuuugguuuuucgggacaggguuucucuguguagcccuggcuguccuggaacucacuuuguagaccaggcuggccucgaacucagaaauccgccugccucugccuuccgagugcugggauuaaaggcgugcaccaucaugccuggcauaucuuuacuuuuuaauggauuggugaauccacacauuuuuggauuaguauuuuauauguauuccagcacauuccuuacuaccuuuugcuaauucucagcuuuuuuuuuuaaucauaguauuuucuaucuguaauguugcacuaauaauggucaaugcuguauuauacuuguauuaaagaucucauauauuaacgauucuuugauauaauaucuuaucaaacgagagaaauaaaaggaacagcucuaguugcaguauguugcuuuagagccaucaccugucucugugacuguuuggaaguauuccuuggauccuuaauccgccaagaaugugaagaucugaagagucaagauaguuccucaguuguuuuaaagauaccuggucacauuguuuuauagauuagacacauagaaggaaagagaggauaggguacaagugaaaaacaugaauacauuguuuaaggggaaguuaagggugcuaugcaggaaaacuguagauuuagaugaucuuuagguuaacccaguaguugcagggaaugagaaagacuguggaccuugcugguuggauagaaugacggaucuggauaaggagacaguggaccuuuucuccagacuuggugauggauuagguguggagguagcaggauaaaaauuaaucauguaugugauuuuguggugccuuugacuguaaaguuauuuugggaagccuguaauuuaggacagacacugcaaagaacggcuaagacacaccacugacauggaggcuagagagauccagagacucaaggacaugaggcagaugaagagcuggaaggacugggaggguuuugcaguauuuguguauuuacauauucccuuuagcugguaaguuuaugaaugaaagaagacaaaagagaugguguauaggaagccugagagaggaagaggggguaaagaagauauccugaugaaaucugccugcuacuuacaaagauagggaaaaugauauuuuucugucuguaacuuggacugugcuuuugaauuuguugagaugcugucuaagguugucuuuguuaggauuuuacugcugugaacagacaccaugaccaaggcaacucuuauaagaaccuuuaauugggguuggcuuauagguugggauguuaucaucaagggaggaacauggcagcauccagguaggcauggugagagugcuacaucuucaucugaaggcugcuagcagauacucacuuccaggcagcuaggaugaggaucuuaaagcccacacucacagugacacaccuacuccaacagggccacaccuuuuuaauagugccacucccugagccgagcauauacaaacuaucacaaaguaguuuaggaugguuuaagaagaucuuaucauuuccuuuacuuauaaaaacucaaggagaaguggauaaguucuauuuuauaauagaaauggcugcuggucauuaguaacccaaauacuucauucauaggcaucuuauccugacauugucuaccuacauuucacaaugguucugugguucacaguuuuauuuucuugagacuagguauuuguaaaauuuuaauuuacauguaccaaucaguuaagcagcauuucucaaaagaaaaucacaacucacauaguuaucaacacuccauauguuauaaugaaaucuacagcuggguuuuuguugaagucaacaaaaugcucuaugaaagucuuuuccauucagcaaugaauuuuuaaaacuugguaauuuugguauauuuuuagauaaauucaugaaacauuuuguuggagauaaaauaguaacacuauaaacauuuuugcagaugaacaagaagaugaggaugcuguagucaacaggauaucguauguauucuaaaauuuaauuguucuguuuauaguguugaaguuagagucugaaggaaguaacugucuaauguacuaauccuuaucaaauucuuuuuuuuucuuuucuuuuuuugguuuuuugagacaggguuucucaguauaguccuggcugaccucgaacucagaaauccgccugccucugccucccuuaucauauucuuaaaaagcacauguaaauaaguacacaugguuaauucagaacugauugucucuugcuaaaaugugcuuauucaagcugagcguggcacaagucuguaaugguaagggggguguaggaugcugaggaguucaagucuagccuaggcuacaugagaucauauucccuuucucugcuaugugcuuauuuuuaaaaaauggcauauuucaucuucaggagauuuaaugaggaacagggcuuaaaggaggaacaguuguuuaagaaagaccuaguauggcacagaggguaccagcuuguagucucagcauccuagagguagaagcaagaagguugaggguuugaggacagauugggcaacauagaaagagccugagaaagaggguaaacucucaagcuguacuggcugguuuugugugucaccuugucauaagcuggaguuaucacagagaaaggagccuccuuugaggaaaugccucuaugagauccagcuguaaggcauuuucucaauuagugaucaagggugggagggcccauuguggguggugccaucccuggguaguccuggguucuauaagagagcaggcugagcaagccaggggaauuaagucaguaagcagcaucccuccaugugucagcuccuaccuccagguuuauacccugugugaguucuaguccugacuuuccuuggugaugaccagcagcauggaaguguaagcugacuaaacccuuuccuccccaacuugugucuuggucauguuuuguguaggaauagaaaccuugacuaagacacaagcugucagcuguuuguaaauucucugaacagugaacaaauagacuuucugguuagagugacacauuugcucaauugccuuauagguuucuuauuugugaggggagauaugauagaaauggacuucaauuuuuuuaauguaucaaacugaauagcaaacaguuaaguucuuucuauuagauuuuucuuaccugcaagacccccugaacagagacccucacucaagucucaggauggugcgacgccugagaacucaggagagaccaaucuugaugcaaacagcaagagguuuaaccgggaaaggccagugcacuggggaugacucauaucccaugcagggguagaggagucgaccccgagcucaaggguaaaggguuuauagaggcagaaaccacaaacaccuggcauugggcgcuagcauuuggcaagcauaacggguucaaggaacaguuggaguauucuguacaaacauccugaaacaauggagcaaguuaaacuuccacuuugugguuaguacauccuggaacaauggggcgaguuaaacuuuuacucucugccauuaguggggucuauuuuggacacaagucuaggggcuuacauaauuuuucacucccucucaggaucuuucauacuaaaaugugaagucugggccuggagagaugacuuaguaguuagaagcacuggcugcucuugcagagggucuggguuggguucucaccaucaacaugguggcucacaaccaccccaacuccaguuucagagaaucuggcagggugacaaggucuccaugaaagugucaaugucaccauaagugaauagagacaaagggagggccuaccaggaguguugggagcugaguugaggaaggaggguuucugagugucaggacaguucaauccagaaugggaagcuaugcaaauaagaagauauuuaucuguauagagcugggaucaguauggaaggaaauuggugacuucuaauggugaagaggcuugauuaaggucaauugaaccaaaaauuaaguuuacaauaacaacaacaacaacaacaacaacaacaaaugacuauugaguuguugguuaccaguugggguguuauugugaauaccuaacagaaguagaacugcaguauaaaagugaguguggccauguguuugcucauuccucagcuuugccuauacaguaguuugaauaugcuuggcccggaguguggcccuguucuaguagauauggccuuguuggaggaagugugucacugugggcauggucuuuaagacucuuguccuagcugccuggaaguuagucuucuccuguuugcuuuuggaacaagauacagaacucucagccacaaagucuuccauauuccuauuaggauggcccauuaagcuccacuuaaagcauucuauugcuuuccaaauccagucuguaaaucuacauuuuuccaaacaaaaagauggucaggccuaucacagcaauacccaaguucuugguaacaacuucugucuuaguuaggguuuuacaacugugagcagacaccaugacuaaggcaacucucauuaggacaaaauuuauuauuuuuuauuaaauuggauauuuuauuuauuuacauuucaaauguuaucuccuuuccugguuuccccucuacaaacccccuaucccaucuccccuuacucugcuucuaugagggugcucccccacccaccuaaccacuccugccuuccugcucuagcauuccucuacacuggggcaucaagccuuuacaggaccaagggccuccccucccauugaugacagagaaggccccuccagcuccuucagaaagacaacuggcuuacagguucagagguucaauccaucaucaucaaggcaggagguuggcagccuccaggcaggcguggugcaggagaugcugaaaguucuacaucuucauucaaaggcaaaaaguugaagcugacuuccaggcagcuaagaugagggucuucaagcccacacccacagugacacaccaggacucuuaaagacuaauagaaggacuggauagggaaagguccauguuaauuuuguauuuuacuuguacagaauauaagaaaguaagaauuauugggauauuuuaaaggaaacaguccuuuaaggcuuuucuuaccaaauuggggacaauuuaaacaucagaguaaguaauuauuguaauggauuugaagguacugcaagaguccauccugauagaaaccaguagaugaauagauuagaaauuugacaagaauaggguucucuuguaguuucaaucucaucuuccuauaaaauacuaacugaaagucagaguaucuuaagcguggaacauccugguagucacugccuugaccugggaccaagaagauggggucaguagagagucaguaaccccaagucaccuguggccugcuuagaaauucucagagcugcagcuugugguauuccugccuuguggacaccaaacuacacuggucuaagacagaauuccucaucgccauauucagccugccuucuguagaucaugagacaccagccucucacuuuaugccccuggccuuucaguuaguugucuuugccuccuucccagcuuuuugucaggaguuguguuguucugcguucagucugacuugucugaccauuggcacugugguuuuccuugcucauuguauuuucugcagcaccuaccaccuuuaguauauuaugcaguuaccuaguaaauauuugccguuuauugugugaugcucucauagcauuaagugaugcuuauagaagcccugugaaggcaaaaaaggaugucugucuuacuguucaaacaugccaaguauagugcuggcucagaauccaguguuugugaauaucuguuuagugucugagcaucacccagagauucccuggauaugugugauaugugcacucgcagaagccccuuccaguguuuuuuugugggugauccugauaauaaucauucugaugcucccacugguuacgaaccucugaucagagugagugcuugaggacugaauucacaaagcgugcuuuuuauugauuagccagguaaagauugggacaguuacuuuucucaucacugacaagaugccagucaggagcaaagguuuacuuuuacucccaguccacacuguuggcaguguauguuaguguuuuguuacuugcagauggaccagaaaauagagcaagugugcaggcuggauccagaggugggugaaaccuagugaccaauuuuugccagccaggcugugcuucauggaaacauagcaauuuucaagugguaccauagauuguggcuguguccucaaaacauaaggauguggcaacauuucagauucaaaccaaaacacuuaagaugauagucgggagcagcagcggucgccaucuugguccgggacccgccgaacuuaggaaauuagucugaacaggugagagggugcgccagagaaccugacagcuucuggaacaggcggaagcacagaggcgcugaggcagcacccuuugugggccggggacagccggccaccuuccgaaccggaggacaggugcccgcccggcuggggaggcggccuaagccacagcagcaucggucgccaucuugguccgagacccgccgaacuuaggaaauuagucugaacaggugagagggugcgccagagaaccugacagcuucuggaacaggcagaagcacagaggcgcugaggcagcacccugugugggccggggacagccggccaccuuccggaccggaggacaagugcccacccggcuggggaggcggccuaagccacagcagcagcgaucgccaucuugguccgggacccgccgaacuuaggaaauuagucugaacaggugagagggugcgccagagaaccugacagcuucuggaacaggcggaagcacagaggcgcugaggcagcacccugugugggccggggacagccagccaccuuccggaccggaggacaggugcccgcccggcuggggaggcagccuaagccacagcagcagcggucgccaucuugguccgggacccgccgaacuuaggaaauuagucugaacaggugagagggugcgccagagaaccugacagcuucuggaacaggcagaagcacagaggcacugaggcagcacccugugugggccggggacagccggccaccuuccggaccagaggaccggugcccgcccggcuggggaggcggccuaagccacagcagcagcggucgccaucuugguccgggacccgccgaacuuaggaaauuagucugaacaggugagagggugcgccagagaaccugacagccucuggaacaggcugaagcacagaggggcugaggcagcacccugugugggccggggacagccggccaccuuccggaccggaggacaggugcccgcccggcuggggaggcgaccuaagccacagcagcagcggucgccaucuugguccgggacccgccgaacuuaggaaauuagucugaacaggugagagggugcgccagagaaccugacagcggucgccaucuuggucccgggacuccaaggaacuuaggaauuuagucugcuuaggugagagucuguaccaccugggaacugccaaagcaacacagugucugagaaagguccuguuuugggccuucuucuucggccaggaggagguccaaauacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauucuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggugugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaacuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggugaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguacgggggucuuuugguauagcauuggaaauguaaaugagcuaaauaccuaauaaaaaauggaaaaaaaaaagaugauagucggaacauuucaguguguaguuaggaaggagggagugcugauuucaguguguaguuaggaaggagggagugcuggagaaaggguaugagaauuucaagaaggaagugcuuauccauuugaaauacccaagguccagcauuugagguccuguuugcuaccuggaaguguguggcagguuugcugaaguaauuuaaggugguuuugaugcauuugucaccaccccaugaagcuacuuuacacugugaccuagagauuauggcuuuuugagauauaggugacauuuagcauuccagugaaguuugcauacccuuaaggagauggucacaaaugccagauagucaagaaaauauuuuuguuguauuacuaccaaaaucacaaaaggaacaauagucugcaaagauaauauuuuuacuacucuauuuuagaagaugacauuucugaaaggguguguuuuaugguuguacuagcaaugucuauacuuuuucaacuuggggcuuuauuuuaaagacccuuugucaguugaggggcucuuugugggcagcagaagugguuuucugcucucuggguaggucuaucacaguaacagaguguggaguggaggcuccaauagcuguugaaaagcagcauuauaguaaugaugaccauauaugcuggauugucugggccacuugugacuugcugacuuaucccucugucucauaagugaauuccacuuaggucacagguuccaguauuggauuugguaguaauguuuccugguguguggucagagcauuaugggaacuaagaggaaagaugagcugauucuacugagaggaauaagaagguaggaauugagggacacacgacaggcaaguggcauuugagaucugucuugcuauuuagguacauuugccucgugcacuguuguaaggacaccguagaguuaagagagcagucugugggcagaggccuggaacucauaagauccguuugaggguuaggaggaguaaaucuaagaugaaauguguccuacugaggggccuaguguguugggauggcugugcaguccuugggauggugaguauuuggauuugaccuugguuuugacauuggcagaggugaugcuaaucagggugaugguccuuucugggcuggaguuggccaucaagcugagcaacuuuugaauacuuuucuaggacaucugcucuucauucuacuggaucaauuaaugaugcugcuucuguguuugagcugaauuguguuuggaguguuccauugaccuucauuaaauaguuggcuuuugacuaacugaacccaggauuuuccaggauacuuguggcuguguagacaugcacuucugcuguuugccacaggauggcauuaaaugagggauuacuugauuaaaugcaugauaggacauuuacucuuacuuaaauuuuuucuuacauuuguuuucacauucuuucaguauuaacuuuaacaugauugauacucaaguuuuaucuuuaaugcuaauuaaguuuccuuugccacuacugcugcagucucugcuugccugccuucuuucuuccuccuuuccccuuucccuccuccccuuucaucccccucuccuccucuuuauucuuccuuccuuucccuccucauauccccucccuccccuuccucauccuccccucuucuuucuuacuguguugcccuggcuggccugacgcucccuauguagaccaggcuggccuuggacucaacagacaucuacucuuuugccuugucauuuacuuuuuaaaaaaucuuuugcaaaauuagguguguguuaugaaagaauuuaaaacuuuucagaaaucuguaacugagaagugaaaguuccucaugauuauagucucuguccuguggguuguuagaaaugaugauagauuuugaaguaacauauuuccugauaauauguaagcguuuuuuuuguuuuuuuuuuuuuuuuuuuuuggugugaauagagagccuacuuuguauuuacugucaauauuuuucuucaguuuguuuuguugacuuaauaaauaaagguucuuuuuauauauugaagcuguauuaucuaagaaguauugaaguaguguuugaaauauugauuagcauuauaguauuguuuacugcuucucugcuauuuacuacuauaauuuaaacuuaaugagacuaucaggggcugaugagaugacucagugugucaggaagguauuuguuaugugugcuuggagaccugaguucaauauuggagucuuguguaaagguagaaggagaaaacagacuucacauaguuguccucugaccuuagacguaugccauagcaccccacuccacugccuuuauacacaggcaugcacacacauacacacacacacacacacacccaccaaugguaaugaaaauucuuaaaacugugcagcacucucuuaaguauauagaucuuuuagggccacuuuuuaggaauuuggccugguugcacuuuccaggucuuccgcaugcuguuuguaccucaguugaauaccuguacugggauucguaccuaagacccuggcugguguuuucacguucacugcuuugccgaacgcaguaacgaugccucuucuuuugcagguuguuucugagcaccuucacucuagccgugucagcuggcgcgguuuugcuuuuacccuucucaaucaucagcaaugagauccugcuugcuuuuccucacaacuacuauauucaguggcugaauggcucccucauccacgguuaguauacauuacuuuaggauuguuuuuuuguuuguuuauuuauuuuuuucugcuguguaaguuauaggguuuucuuaguuuccuucacaaguuauaacaucuuccaguaaacuauugucuuagugaugguuacuugcugugauaagacaccaugauuaaagcaaccuguggaggaaaggguuuauuucagcuuauauuuccacgucauagucucuacaucacugagggcagucagggugggauccuggaggcacuggcuaauauagaggccauggaggaguucugcuuacuggcuuucuucucaaagcuugcucagccugcuuucuuauguacuugaguacuaccugcuuagggggugucacuaacuauauuagacugggcccacccaugucaguuacuaaucaaaaaaauuccccacagacuugcccauuuaguggaggaauuuuuuuaauuaagauucccuuuucccggauaugucuagguugugucaaguugacaaaaaaaaaaacuaaccaguacaacuauugaaguccucagugaagucagaaaccagcuuuuccuuaccaugucuaauuggcuaucauccuuuacuuagucaagaaacaguuuuauacuuccuguaaguuuugcacguguguguguguguguguguguguuugugaugucaguuagccauguggaugugguaugaaauaaugucucacgcuauacccuuaacuggccuggaauucacuguguaggucuugaacucauggcaguucucagcuucagccuuuugagugugggauuauagauuaugagcuauuagccuggggauuuacugugauuuuguuucauugaaauguuuuaggaaaagacuuuuugguucaucugauuauaucagaggacuuuaguuucuacugaagacuaaggcuauaguugcuacuuuguuuucuucgccauuuuaaaacaugauugaauaaaacacaagugccaaguuuaaauuuuagugugauuuaaaagguaaugaugguaguuggguaugguggcacauacuuuuaaucccugugcugaaagacagguaugcaaaucucugugaaucucagaucaucuaggacuacauggagaggccaugcuucaagauuaaaaaacaaaaaccaaaaaaauaaaacaaacaaauaaacaaaacgugacaguguagaccacaagaucauuucccuucaagugauguagaucuauagugcaacuucggcucaucuguuuucuaccacacuuaggcacuauugucugucucagguuacugcuuucuuaaguagaauagauaguaaaacauaccuuguaggcuugcuuuuaggaauguuucuaauagagaauaucugccucuuaacagguauuuaguauguaugaauuuaguguguguguacugaacuguucuuugcuagaacaguucuuuauaguaucuguuagacuggguuauggcucuuggguacauagauggcuuucuuauuacucuuccuguucauacuauuucuauuuucuuaguguugauuuuguggcuaguguuauuaauuauaucauuaauuacugguauuauuaguaucaagcuaauuuuauuauguuuauauaauuuuauaguuauauggaagguuagauauauuguuuauaaacaccaaaagcaguaaaauuggguuaccucacugugagauauuuuuguauggacacaaaucauuuccuuuauacgaaugaagagguguuuuauaauagagaauacagucuaugaaacaauaucuugaagaguagucauugacaaguacuuauuauuuuuuauucauaaaaaauauuuuuuauucauccccuuccuccuuucuuuucagucccagccuccuaaaucccuccccucacugccccuugccaccuucucagagaagggagucccccauugaguaccacccuacccuggggcaucuaguccuagcaagacuagguucauccucucccacugagguccagucagacacuccagguagggggaaggggauccaauggcagggaacagagacaaagauagccccuauuccacuuguuacagcacccacaugaagaccaagcagcacauuuguuacaaauguguaggggggguauaggcccagcuccugcaugcucccugguugguaacccaggcuccacgagccuccauagucccagguuaguugacucuuuggguauucuugaaguguccucgauaccucugacuuagucacuucuaucccccacucuuccacaagacuccccaggcucugccugacguuuggcuauggguuucuguauuugccuccaucugcugcaggauaaagccuuuccauagguuccuaucuccaagcauagcagaguaucauuaauggugucagggguuggcuuucucacaugggaugggucucaaguugggacagucauugguuggcuguacccccagccucugcuccaucuuuaacccuucauaucuuguaggcaagacagauuuuggguugaaaguuuuuuggguggguuuaugucccccucauuccucuggaaauccuguguggcuacaggagguggccacuuuagucuuucuauuccccucugguaggaaucucagcuagggucacacccuucagcucccuguaugcuuaggcucccaggucuccagcuagucaccagagauuccccaccccccaaugccaauuuccauucucacucccagaccucuuucccccccgcccauacuugauugucauucccauuccccuccucaccuucucuccuacucaguucccuucccucauuuauuuccuaugacuacuuaguaguuuccccugagugagauuuguacagcuucccuugggacuuccuuauuacccaguuacuuugggucuguggauuguagcaugguuguccugcacuuuauggcuaauguccacuuauaacugaguacaugccguaugugucauucugguuaucccauguuccaucuauuugccugcagaauuuaugauuucuuuguuuuuaauagcugaauaguaucccauuguguagauguaccacauuuucuuuauccauuuuucuguugagggacaucuagguuauuucuaguuucuggcuauuacaaauaaagcugguaugaacauaguugagcaaguauaccugggguauagugggggcaccuuuugauuauauaccuagaaguagaauagcugggacuugagugagagcuguuccuaguuuucugagaaaccaccaaacugguuuccaaagugguuguacaaguuagcacuccgucagcaguggaggaguguucccuuuacuccacauccucaccagcaugugcugucacuugaguuuuugaucuuagcuauucuuaugauauaagaaaggauuucagggucauuuugauuuauauuuuccagaugacuaaggauauugaguauauuuuuuaagugcuuugcugucauuuaagauuucuguggagaauucucuguuuagcuuuguaccccauuuuuuaauuggauuacuuggauuguugguaucugauuugaguucuuuauaaauuuagauauuaacccucccauggcuguaggacuggugaagauccuuucccaaccaaucaguaggcugcuguuuuguccuauugaugguagccuuugcuuuucaguuucaugagaucacauuuaucaauuguugaucuuagagccugagccacugguguucuguuuaggauauugucuccuguaccaaugaguucagggcaaucuugcaaaccaaauuuaaacaguaucuuuccucuaauccagcccuacagaggauacuagaagaaagguagcuagauccaagaaaacauuagaaauuaauaauuucacagcaaaagcaaaagaagaggaacacacacacacagauaucaaaaucacaggaaccaacaaucauuggucauuaauaucucucaacaugaauggauucaacugaccaauaaaaagacauaggcuaacagaguggauauguaaacaggauccgucauucugcugcauacaagaaacagaccucagcaacaaauauauauguuaccucuuuguaaagggcuagaaaaaagguuuucuaagcaaaaggauccaagaagcaagcuggaguagccauuuuaauauacaguaaaauagacuuucaaucaauaguaauaaaaagagauggagaagguuacuucauacucaucaaaggaaaaauccacuaagaugacaucccaaucugaaccucuaugccacagauucaagagcaucuguauucauaagagagacauuacuaaagcuaagucacacacugaacaccacacauuaauagugggagacuucagcaucccacuuccacccauggacaugucgucggaacagaaauuaaaccaagaaauaaugaaacuaacagaaguuaugaaucaaauggaccuaauagauaucuauagaacauuucaccuaaacacaaaagaauauacuuucuucucagcaccuuguggaaccuuuuccaaaauugacuauguacucggucacaaagcaaggcuuaauagauacaaaaagauugaaauaaucccuugcauuuaugagauugccauggauuaaagcuggacuucauccauuacagaaacaauaggaagcuuacaaacucauggaaucugaacaacucuauucaaugaccacugggucaaaggagaaauaaagaaaucagagacuuucuagaauucaaugaaaauaaaggcacaacauacccagacuuaugggacacaaugaaagcagugcuaagaggaaaguucauaggacuaaaugccuucauaaaaaaauuggagaguucucauacuauugauuuaaaaguaaacccgaaagcucuaggggguggggggggggaaaggaagcaaacacacucaagaguagauaaucaggaaauaaacucagggcuaaaaucaauccauuagaaacaaagagaacaauacaaagaaucaacaaaaccaagagcugguucuuugagaaaaauaaacaagauagacaaacucuuagccaaacuaacuaaaagucaggcaguauccaaauuaacaaaaucagaaaugaaagggagaaguaacaacagacacugaggaaauuaaaaaaaaauuagguuuuacuucaaaagcuuauacucaacacagcuggaaaaucuagaagaaauggaugauuuucuagauagauaccacuuaccaaaauuaaaucaugaccagguaaacuauuuaaauaguccuauaaugcucaaggaaauagaagcaguuauuagaagucucccacacccaaaaaauccaggaccagauguuuuuuagugcagaauucuaucugacuuccaaagaagagcuaauacuaauacuccucaaacuauuccacaaaauagaaacagaaagaccauugccaaacucauucaaugagaccauagucaccuugauacuuaaacuacacaaagacucaacaaaaaaagaauuucagaccaauuuccugugaacauugaugccaaaauacucaauaaaaugcuuacaaacugaauucaagaacacaucaaagauuuuccaccaugauuuaguaggcaucauccuaggaaugcagggaugguucaauauacaaaaagaauccaucaauguaaucaaacaaacaaacuggaaggaaaaaaaaaccuaaugaucaucucauuagaugcugaaaaagucuuugacaaaaauccaaacuccuucauuuacaaauaaugagaucagagauauaaaggugcauuccuaaacauaauaaaagcaauauacagcaauccaauagccaacaucaaauuaaauggaaagaaacuuaaagcaauuccacuaauaucaggaacaagacaaggcugcccacucucuuccuagcuauucaauauuguaauugaaguucuggcuaauucaaguucaaguggaucaaagacauuaagacaacuaaaggagaucaaggggauacaaacuggaaaagaagucaaaauauuguuagcauauauaggugauaugauaguauacauaauaagugaccccaaaaauucuucuggagaacuacuguagcgaaugaacaccuucagcaaaguggcuggauacaaaauuugaaaucaguagcccucauuuacacaaaugauaaacagagugagaaggaagguaggcagacaacacccuuuacaauagcuacaaauaguauaaaauaucuugguguaaauguaaccaaucaagugagugaccuauaugacaagaacuucaagucucugaagaaagaaacugaggaagauaugagaagauggaaaaaucuuacaugcucaugaauuauuaggauuaacauagugaaaauggccaucuuaccaaagggaauguacagauucaaugcaauucccaucaacauuccaacacaauucuuuacagaccuugaaagagaaauucacaacuucauauggaaaaaaaaauucaggguagcugaaacagucaugaacaauaaaagaacuucuggagguaucaccuuggucuugaucucaagcuguacuacagaguaauaguaauaaaaacugcauaguguugguauaggaacggacaaguuaaucagugaaauugaauccaagacccugaaauaaacccauacaccuaggaacacuugauuuuuggcaaagcaggcaaaacuguacaauggaaaaaaaagaaagcaucuucaacaaauggugcuggucuaccuauauguagaagaaugcaaauagauccauauuuaucacucugcacaaaauucaaguccaaguggaucaaagaccucaaccugauacacacaucaaaugcaaugugggguauuuauuguuuuuuaagcuaaaagauuuuagauuuuuuuuucuaauuugugagcugccuuuugaguuaaugguaaaauaucuucuucaauaaaaauucugugacuugcucauuuggcuuagaaaaaguuguauucauugagugguggugcuguaugcuuuuaauccagcacuugggaggcagauccaggggaucucuaauuuucagaacagccagggucacucagaaacccugucucuaaaaaccacacugcaccacaccacaccaugccacaccacaccacaccacaccacaccacaccacaccacaccacaccacaccacaccaccaccaccaaaaacaaaaacaaaaacaaaaggcggaggugguggaggagggaaggagaggaggagugggggaggaggaggaggaggagugggggaggaggagugggggaggaggaggaggaggaagaggaggaggaggaggagugggggaggaggagugggggaggaggaggaggaagaggaggaggagacaacgaugaugacuauguauccaggguaccuuguuuguauuaaauaguuuggggucucugguugacaauugagaaguggacuuacucuuguagccuuuacugaugcuggcugcugggaaagccucacuguguugccugugaaagcugcuuuuucauuugcuguagugauauuuguguucaagccucuagagagcaacagugagucugaagugauuaucagguuccuguggauguugugaaauugaauccaauucaaguuguuccucuauaaguaucuuucugagugacauaggaguaagcuuuaucucuucuguuuuugugaaagcacaggagccauuauugcugagaagaugcaaggaggggcagccauauugccagcuguaacuuuauugagcacaucaauaguacaugcuuacucuagaaugaacaggaauaucaaaacauacaaagcagaaaauggcauuggcuuuuuuuuguaguacauauauguaccauguguuuauagcacauguaauuugaaucuuucaagcacugaauuugugcugauaauuuuucuguucuucauagucauugaaaacauuuuuagugccuguaucagcucuuaccuuacugcuuucagaagugagaccacuucuccagugacuucugacagcugugaugugggggcugaguauucccagguacagagcagcuuucugucuucucaggacucuuacuuaacugucuucuguuggguuuccaggggauuuuucacagugacuugaguuucuacaauuugcauagauaauuaugauggaaaucauuagaguaauaaguaucauuggcauacuauuuuuuagaaguucuucugacagaugauauaggugccuuuguuucuaacauaaacccaguagcaucaaauacugauaucuuuguugccaaagaugugacuaagaaauagcuucccugauuaucauuagaaaaauuagugaucuuucaauuuuaauucguuuauagacaucgaguacauauauaauuugucacgaacucccccuuuuuguaucaaacuauuugguuucuuuaaaacuaaaccccuauaaauguuuauuuauaguugcuauuuugacuuuugauuuuguaugcucuuuggggaccuggaguuuuuauauuuuuguaucaaguggucuuuuuccccccuuuggcuuugguuucucuuaauuuuuuuuuuuuuccaagacaggguuucucuguauagcccuggcuguucuggaacucacuuuguagaccaggcuggccucgaacucagaaaucugcuugccucugccucccaagugcugggauuaaaggcgugcgucaccacgcccagcucucuuaauuguuucucugugaagaagauccucuuccaccaugaauguaggaaacacuaacuuucuucuugucagcaguuuuguuuguucuugcacguuuauuccaucaggaguuuacagaguaguuuuguacgucacucuucaaagcucacugucuuuuauuuuauuuuagaaguucucccaugagggccuguuuuuugacuuuggagucagcuagccuagcuuagaauuucaguucucugucuuacuguuagggacccugaacaaacuguuaaaaaugucaagucaguguuuuaucugcagaaugaauagaacaagaacaaguggguuggguuuuuaugugagaagcguagaauguauguaaaaaaguaccugcucaucuaaugacugcaccagaguaagaugaaguaaacagcauauuuucauggacccacuggguccucagcuccccaguguccuuuuggauuaucgugucuucuuuauccucuucucuguuuaagccuccucuguccagggacacuuuggugaguauucccaugggauauaggcaucuuacuuuuuuuuuuuuuuuaaagauuuauuuauuuauuauauguaaguacacugcagcugucuucagacacaccagaagagggcgucagaucuuguuacagaugguugugagccaccaugugguugcugggauuugaacuccggaccuuuggaagaacagucgggugcucuuacccacugagccaucucaccagcccggcaucuuacuuuuuuauuauuguccugagaggucuguagagcgagagccacccaauaaacuagacaaggggccccucuucaaaaucaacaagagggagccuugaguauuuggggcacuucuucauggaaucacuuuguucuauuagggcuuaugcugggccacacauagaucauuuuuauuugaugauacacaguacuuuugugcaugccuagcauuuuggaguaggagcucaggccuaucauaacugcaaggucaaagugcuuauacuuggugaaagcccgguaucaggccaagagcaguuuuucaaaggcaaguaguuaucugaagagaguaaucuccacugugauucuuugacugagcaugccauacaguuuaagcuguaaugaagaggcagaggugucaaagucuguacuggcugguuuugggugucaacuugacacagcuggaguuaucacagagaaaggagcuucaguugaggaaaugccuccaugagauccaacuguaaggcauuuucucaauuagugaucaaggagggcgguccccuugugggugggaccaucucugggcugguagucuugguucuauaagagagcaggcugagcaagaaacccugacuaagacaaaguggcaucauuggcauaagcaaaauaggaguaaaagggggacagagaaauuccuuuguagugucaucuuuugugucuuggcacuguuaauuuuuuauuuuggaaguucccaagauucuuacuuugcagugacuacuuuuccgccauguguacuuaaaauuaaaagccaauaaugguaaaaauuugaaggagagaaugauagaauuaaguucuagucuuaagucugggcauaauucucugguuuuggagguguuuuucuccaguggugccuaguguuugcgucaguuguguuugcugguguggagcuauacauuggcaagugaaaugucuaguuucaguucagguuguuagcgugagcccuggugagcuggcuaaucucucugaggacuuucuuuugaugccaaugaauauaucuuguuaaaugaaggguacuuacaggcauaugugccucuacgucaccauuuguuuuacagcauaaaggcucaaaccgagggagugugcucacuguuuuuuuuuuguuguuuguuuuuuuuuguuuguuuguuuuugugaaucuaucagaucgacagaggcucuaaacucgagguucucucaacaugaguuguauguuguauuuugaacuauuuugugauaccagcagguggcaguagaagauaacucuauggugagccaguaauuuggucuuguguuugaaccucaaacugaacuguauuuugggacugggcauuggcuacuaauccaguggcuugcuguggauacugacucuggcaaacuaccuuucuuaaguuuugcaaucuauugaagaauauaauuuuaguuuuuugaagcggagaaauuugacaacuuuuauauuauaaauuaagguaaauauauagaauaaaauauguguaaaguugguaacaauuuucaauuguauuagaauuguagaaugcuuuuaagggaaaguccacaaauuuauugaguuuugaaaaguugacaagccacuuugcaaugcauauugaauacacauauuucccccugccccaaaggacuagccuuaagucagugccuugccuccaccucccaagugcugucauuagagaugugccaccacuccugauaguuugaggggaaugaguuuggguucucaugcuugugcaacaaacacuucauugaccauauuagcuuccuagcccuaucuuaguuuuaaauaagugaauugguuaauaauaauaauaauaauaauaauaauaauaauaauaauaauuauuauuuuuugaucugugaguuuuugccuaaggcaaguuuuacuuuuuugacuuuuggucugcagagaauauuuugaauuucuuguucugcaaauauauaugugcacaaaucaauaauaagcauguaaggucucagcugggcggugguggcacaugccuuuaaucccagcacuugggaggcaaaggcagggggauuucugaguucgaggcuagccuggucuuauagacugaguuccaggacagccagggauacacaaaaaaacccugucuaaaaaacaaaacaaaacaaaacaacaaaacaauuaaaaaaaagcccaaaaaaggauguaaggucucuuuuaugcuaaaaauggcagucuauuuucuguuuaugaaaauauagcaaacauuaguauucauauauuuguauuugguaguuuuucugaggcugauguuugaaugguguggagaguguagcuagaaguggagagccuggcuugcgucuccagcucagcucaguucucuuuuaaugaacuuuaugggugaaacauaugugauacagaggucuggagauuuaggcaugucacaaaggugcuuaaauauacacuuaugauuuuuuagaguacuccugugccacuuaggcuaugcaaagagguagaaaggaagaagaaugcucuacucugcuauauuuguguuguuaaagaaguugugucucucuuggcaauuuauuuugugcuuaguuuaaaaaauacuuguuuuauauguaucuauguaugugugugugugugugcgcuauguguguguugugucauacauucuccugaucacauaaaugugagagccagagcauuauacuagaugucuuccuuuaucaucuuucaucuuauuuccuugagacaggguuucucacugaacuggaagugcaacuguuuggguggcugggcaggaagugcuugagaugccccugucucugugccccagugccuggcuucuugucugggugcuugcauucaaacucaaguccucaugcuugcagaguaagugugcuuacacagugagcccguuucccaauucugcugagguuuuugucacuguuauuuuuaaugucauguauaguuuuuuuuuuuuuuuaauuguaagccuuguugaguaaaauuaaugagaaugguaaggaaagaguugagcuaguuucagcuauaauucacaccauuuuuuuuuuguucuuguuuugccugagugauggugaauuagaauuauuuauuuauuuauuuauuauaugugaguacacuguagcugucuucagacacuccagaagagggcucauuauggaugguugugagccaccuugugguuggugggauuugaacucaagaccuuuggaagaauagucagugcucuuaaccacugagccaucuuucuggcgcacccccccccccaauauuuuuuaaagauuuguuuaaaaacuugggugucguuucucuucuguucuugguaagggcagaguuguaacccauuaaacaggagauagcccauugauagaguugaaguuuuuccaaggucaugacagcuaaacuauggcagauguaaaaugcuucucacucaacugcuguaaaggugguuaaucuccuuuaaauuacagagagggggaauaccugauuuuuggccaagacaauauagugcacuggguauguagaauauaucuaauauguuggguuauuaaaauugaauuuauaaaguguuuuggugugugugcgcuuauguauauguguguggguauguguacacaugcauacauguggaggucagaggucagcuucaggugguaguauucaagaaccauccacuuugcuuuuuaaaaacagaaucuuuaauugacuugcgucucacuaguuaagauaggcugguuacuggccaguaagucgucuccaccuccccagcucugggauuacaaacauauuccaucccaccugcauuuuuaugugggugcuggggacugaucucagguccucaugcuuguaaaacaagcacauuaccaaagcaguuguuuccccagcuccuugaaauugauuuuuaaaaacuuucugcaccuugaagguguuuuaaggaggcuuucuguguguauguaaauaugcuuguauguacacuacuaaaaagauaacuguaguauugcuuuguccuguuuaauuggcuuaaugaucaugggcucauuuaagccaauagacagacuuagugggcuaauauauccaauauggcuggaauaaaaugguacugauguguucuuuugguagauaaaguaauuaaguuuauugaugcccuuuucacacaaaauaguaauuuugagaugacauagaguaguagagagagagaggccuggagucaaguuccuggugugucauugugaauuagggauuugugugugaggggaauuuaucaaaacucuuuaaacaaaacauaauuugcuuuugggugagauaauuuucuccuacaaauuucuauguuauuuuuggaguuauuguaaauauuuuauuuuugguuucuuaacaagugguucauguauuuuguguaaggauucuagugagacagugaucuuuguugaguccauuagaagcaggaguagcuguccuuucaguuuaaaacauuucuuugucuuaagaagauagaaaacaugaaucuuuucuaaguaauuuucuuccccaagaaugaauaccaguagcaggcauuggauauucauaggacccuggcccaagggaggcuuggcagccauucauuguuaugucugagaucuuauagcucccugauaucuucaaagcucugccuucagaugucaucacacugggaacuaggguuccaguuugugaguuugguuacauuuuuguccaugauaauguuuuuuuauuagauauguucuucauuuacauuucaaaugcuauccccaaaguccccuauauccccccccuccaaugauaauguuaauaggcuagucuucccucucauuaauuuauagauuuaacacaaugccagucaaaaucccaauaggcauuuuaaaaaauauuuauuuauuuauauuuauaugaguacacuguagcuauuuucaaauauacaccaaaagugcauugaaucccauugcgauugugagccaccaugugguugcuggguauugaacucaggaccucuggaagaguugccagugcucuuaaccgcugagccaucucuccaguccccaauagauauuuuuuuaaaaugaaaauugauaaauuuaccuaaaauucagaugagauuucagugaauuuucaauggucugaacaacguugaagagaacgaguuuggaggacuuucuacauaaagaaguuuuucagucuguaaugaucaagacaguguggugacagcauaaggacagagcaguauucaaucuagcaggguauugaguccaagaacauacacauauguauugcugauugacuuuugacaaagguaaaaagaugaaauuuagugaguaaaggauauuuuuaacaaauagaauuagaacaguuugauaaucacaggcaaaaauugaccuuuagucuauaccugguaccacaugaaauagcuuagagagucacagagguaaauguaaagccacagaaggaauagaagcaaacaguagaaucucugagacacugggcuacaccaccuugucucauacaauaccaacaucaggauuaaugaaagaaaagcuucauaaauuuggcuuuguuacaugugaaaaacuauucuuugauuagaaaaagaaaccauggacugggaaagagaaccugcagaucucauagcuguuaaagaauuuguuuucagggcaugugaagaacuuuauuuuucuggugggaauggaaaauauaaccaauuaggaagauauugucaauuuucuaaaaauacaaacacacagcucucaucuucugcuaucuucugcugcauacuuacucaaaaugaaagccuguauccauugcaaagucugaacaugcaugguuaauaacagcuucauauguaacagccacaagguaggaguaacucagaugcugacagaugagacaauaagggcuguuauggucugugauacagucacagaacacagugacagaaaucagaccaaaacgaaacaaacaaaaaaagccaacacaaacuacaugaucuaguuacauagaacuuguaaaaaauucugucuuuuggaaguaaagaauuagugguuggcuggaguggguaaagggauaaagauagcaggaagcacagauucuauagggguuuguggaaaugucuggggcaaagaugugaugguuuguauauucuuggaccagggaguggcaccauuuggagguguggccuuguuggaauaggugugaccugguuggaguagguguaucacugugagugugggcuuaagacucucaccccaguugccuggaagucagucuuccacuagcagccuuuggaugaagacguagaacucucagcucugccugugccaugacagccuggaugaugccaugcucucaccuugaugauaauggacugaaccuaugaaccuguaagcuagucccaauuaaauguuguuuuuuauaagacuugcguuggucauggugucuguucacagcaguaaagcccuaauaagacagaaauugguacugggagugggguauuucugugauaggcuugaccaugcuuuuauuugaaagaauguggauuuuuggacuuuggauuuggaaagcaguggaaugcuuuaaguggggcuuaaugggucauccuaguaggaauauggaagacuuuguugcugggaguaauuugaacuguguagaccuggcacaaaagauuucaaaggagaagaauuucaauauguggcauaaagacuguuuuugugguauuuuggugaagaauguggcuacuuuuugcccuugucugaaaagucugucugaggcuaaggugaagagacuuggauuaauugcauugacaaaggaaguuucaaaaaagcccagcagagacuuuguucgcugguuaagucucacaaagaggaguuugaacgagcauggcaagcuuagaaaggcaaaauauaaaauauauuguucgaguauuaaaggcauaccaggaagugaaauggagcaaaauccuguguucuaggaaauaacagauuaagggagugggaccuuggggcaagauccuacccagcuaaauuuagauccaggcauggugguacauaccuuaaaucccaggagacaggcaugcugaccucuucguucaaggccaaucuacagagcaagacccaggauagccaagcuuaggcagugaaggauuuggaaaacagaaagccagugacaaugcaguaguacaagagggucauguucuaauuccuaccagcagcagaacuccucggcagcuucagccauguggcucuggcucuagaguuaagaauggaaggaacuacugggacaauugaugcugguuagcuggagcuaagaaauuagcagugauuaugaagagaccagcaucacugaggugaaaucuucugggaaguguuuucugggagcacaaagaagcuguguuccaaagauagccaagguuguaucucgugcuacagcuggacuugguaauguguaagaauuacccaggugguacugguuuugaaggcaugaaggugucaugaagaacagcugaggcuuggcacugugagaggucauggaaagccauuggagaagguauagccucagcuguaguugauggcccaggacagaaggggucaugcaaaggauuugaggcuuggcaccaugaagugagccuaugagaggcuauuggugaagccuaguuggaauggaaaaccccaguguauuggagaugucaguaccaugggaugaucaccaagaacagcagccguaguggaguggaucaaccugagcuuagagugcuacagagggcagagcuggagaagugaugccagcccuuagaaggaguccaaaagaucaaguggaaucccagacacugaaacaagaagcuguaacauugaaauugccuuggagacucaaagauguuaaagaugccagagccaugguauacaugcugaggaaagcugcuaacagcaaguggaaccagcccaggagaaagcaguuuguugcagucaacaaagaugaaacaggaauggagaucugaagacugcuuugacaucagccauggaaaugcagaguuuggaguuuguccagcugguuuccugccuugcuuuggagauuacaguuaaucucccaugcucccacccugaugauaauggacugaaccucugaaccuguaagcuagccccaguuaaaugauguuuuuuauaagccuugccuuggucauggugucuguucacagcaguaaaacccuaacuaagacagauguguucacuaucuguggguacagaguaaacacucgacaaagcuguacacuuuuguuuagucagauuuauguugcuguaauaacaucugagguugggacuuugggaagaaguguuugccuuacaguucuggcaguucaggaguagggucaccacaugaauguccuaguccuaaucccaccuaccagagaaguagcugugugugugcugaauguacuacagucauggaguggccucauuuacacugaguuucuggguugguuuguuuguuuuuguucuugagacaggauuucucuguguagcccuggcuguccuggaacucacuccuuagacuaggagauccaccugccucugcuuccugagugcuggcauuaaaggagugagucacuaccaucuggcuacaaugacuuucuuuaagaaugaggauguauuuccaugaaaaaauuauuaaucccuucaccucacucuaaccaucuuucaugagaccaugucucuaaaagauuccaacucuucagcauugcuacacuggacaccaggcuucucagacugggcaugugggguggcacauugaaacuguaccugaaccagagcacuguguguaauuuacugcacaauggggcuauugaggugaacauguuuuaauuuuuuguacacaucacaauuucuucauuuuucauugacaauaaaauuuauucuaaggcuggaguugggaacccaaaugaugaagagcaauugaugcaauacagagcuuggaugugggaauuucucauuauaaaauuacuguagaauuacuacuggagggcugguuagauggcucaacgguuaagagcacugacugcucuuccuaaggucuugaguucaaaucccagcaaccacaugguggcucauaaucaucgguaaugagauuugacgccccgucugaagacagcuaacaguguacuuacauauaacaauaaauaaaucuagaaaaaaaagaauuuauuaagaaaggacagaaccaacucaagcaagauauccucugaccuucacauguacccagacacauaaauacauguaaucaauaagaaauaaauguaauuaaaaaaaaaagaauuacuacuggaaguuuagagacuugaauucauucauuaggaagugaagcauagcuguuuucugacuuuagaucugacauuucuuucaguuuuucuuuucuuuuuuuuuuuaaaugagcuauuuuacuaauuuuaaaauuuaaacauaaaaaauuguguuuugucuacauuuuuaucuaugcaccaugugugugccuugugcccacagaagcuagaguggggggugucuuagaucuccuggcacuaaaguuauagaugguugugagcuaccauguggaugaugggaauugaaccuguguucucugcaagagcaguaagugcucuuaacugcugagccaucuuucuagcccugaccuggcauuuuugaaccugagguugauuauagaacaaaggcccuuugucagaaggauuggacauugcccuauagugcuuuagagggucuuaauagacacacagauaguuucuuuuuuaaaauaugguuuucugaaaggggugugugucaucuaauuggauaaaaacuguuuccucuaaguugaguaugauccuugacacaaugaugucuucuuauaauacagguuauuuagaauugcuguuuuccaccauaccuaaaaccaagcacaucaucuguccuagucaggguuucuauuccugcacaaacaucaugacuaagaaacaaguuggggaggaaaggauuuauucagcuuacacuuccauacugacugcuguucaucaccaaggaagucagaacuggaacucaaacaggucaggaagcaggagcugaugcagagaccauggagggauguuccuuacuggcuugccucccuggcuugcucagccugcucucuuauagaacccaagacuaccagcccagagaugguuccacccacaaggggccugaaacccuugaucacuaauugagaaaaugcccuacaguuggaucucauggaggcauuuccccaacugaagcuccuuucucugugauaacuccagcugugucaaguugacacaaaacuagccaguacaucaucuuaacacuugaugaugugucucuaggauauaauaauucacauaacaggaauuacuguucuauuucuuauaucuggaaaaccuuaaggaaaauaauguugaacaguugaaauagggagcagagaccacacacaaauguuuguacuggacaugaugcacugcuuugauccaggccuauacaguuccugaaaaguugugucuuggacccccucacucagagcacguuaggcauggggagacuggauggacacaugaagauuucgaguaaagaaaaccaggaccugguauaccugggucgggucggggaaacgaaacaggaaaggaaaaggcagaaaguguugagccuagcaugcuagcagcuaacaguccugcaaauuaguugccucaggggaagugaugguuaauaaaagcagaaaagcauaaaguacuuguucuguggugcugguucagaugucagccauuccuucuuucacuuaguacuuguucuguggugcugguucagaugucagccauuccuucuuucacuuaguacuaaugauguccauacauagagcauuucacaggggaggaacccggaaccuagcaagcuugccacagccuaguuugagccuuaggugugcacauuuauuuaucccucauucuacaagcccugccugcuaauuguaauuauugcuugucaguaaaaaaaggaauaaagcuuuuuuccuuuuuuugaaggcaaaauuuucuaaguuauccuagucagacuugaguacuuuagugguuuuccugguauaggggguuagaaguguguuuggccuuaacuuuuuauuuuaaauaucagaacauauuaaaguauuuuaaagcaaguuuuuacuuuauauaauaggaauuauaucuagaaaacuuuaaagaaaauaauguugaacauuauuuuaauuuaauuuuaagcuuuaaauguuuaaauucguuuaccacuaaaagauguuaagacaggagccugaggauguagcucaguugguagagcccuuguauaauaugcaugagagagacccuggguuccaauccaguacuggauaaaucagguguggugauauaugccuuuaaacccagaacucaggagguacagguagaaggaucaagaguucaaggucaucuuuggcuacauagagaauucaagaccagucugggauguaugugauguaguuucaaaaaagaaaagaaaacgauauuaaaacguugauuuuaacuuauuuuuuugucuugaaaagauuaaaugugcauuaugugaguaucagaucucuagauuucuggauaagaaacuaugaauugauguuguuaucuuaccuauuaaauuaaaugacugucuuuagauaagugauacaaguguucaggggucuuccacacugaucuaggagcauuaaaacacaaguuaacucaugucauagcauacugcuuuguuaagagaacagugcacugugugugucugacucugugucucuaaaugauguaagcaugaccuugaaggaaagauguggaaagaacaguuuuuaccuguuuuuuaaauugcaugcaauacucugagugcauugguauagcuuuucacuuugacuccauuuuaagcauuacagccaucauuuuagagcucaauuuugaauuuuaguguguuuuuuucuuuucuuuucucuucuuucuuccuuucuuucuuuuuuuuuuugaaucauuuauuuaaaggacaaugaggaaagugauguugacaaaagcacaagggacucauagucaguuacuauccugaaacaugaaacgagcauuugauaagaauuaugaauacuggaucauagaagcaaacuuaacaucuguaggcaaauuuauaggauaaagaacaugcugucuuaguggcucaguuugucaaauacaguuuuaaguauaauucaugugaauuucuucauuugauuuaaauauacagaauacugccaguuuuauuagacauuuugaaggcuauaguacacaucuuuaacucaauuccuuuuguaauggaauuugcugucuccaugaaucguuacacaacauauucuucuggcuugcacacuuguagcccuggcugucugggaacucacucuguaguuuaauucaggcuggccucgaacucagaaauccgccugccucugccuccgaagugcugggauuaaaagcaugcgccaccacugcccaccacugccugguguuuguguguuuucuauuuuaaaaaauagguguugggucaaacacucugccugugacauaccugaccguauaccuuauuuuuguugucaucuauugugucauaacuuggccaaaagggaaauggcucugugagcuugcccaccugggucacaguuucuuucucacuuggaauucuuuguuagaacuccugugacaugguuuuuagauuccagguagucugccccaauacccacaugcucugcagcuuggcaagugacaguugcugccugcucagggacuccuaugucuaaaaaugaguucauagaaugucuguaaggcacuuugagcaauguuuggcucauggaguucaggaagugcuaguuuccucuagacuaucuuaggguauguauaugaaacacuuagcuugguccugguuuuuacuaacugacaaguagaugcuaguggcucuaauuaaaauauuucagugaugauaugucuaaagagcugugucuuuggaucgcugccuauaagauaucuuuaccuaauuuacuugaggggggagugagggaaaguaaacaguuucuauauuggcuuuauucaauagauaaaaauuauagauaaaauauuuaaaggucaaauaaaauuuaaauuuaauaauaauaaucaaauaauaaauuuauuuaaaguuuaaauaaauauuaaaauacaaucauuuucuaauagucaaauuuagauagucauuucaaauagguauugauuuuuauuaguaaaauacagaucuuggugagcaucauaauuuaguaacuuugaaauaaugugucagugucuaaccugauuuucuuaauucuucuuauugucaucuuuauagguuuguggaaucuugcuucuuuauuuuccaaucuuuguuuauuuguguugaugcccuuugccuuuuucuuucuggaaucagaagguuuugcaggccugaaaaagguaaguaaauugaguuuggauuaaauuuauuaagugacuuauauugaucuaggaguugauauaaacaaacaguugaauuacuaauuaauuaugucgacauacuguugauaauauuaauaauauugcacagugacuaccuugugcacucaauccgggagcacguuuaugguacacauucaccuggaggagugucuccuguggcacggacaaccugccaucacagccauuaguuaggccuuccagggaggccucaucuacuucagagcccaauaggacacauuuaaaguacagacauuuucagguuaguaauacauuauaaaaucaaguacucugcaguagauagaccucaugguauugagaaaggcucuucuuacuuacacagcuguggaagccuuaggagugaguaaacacacugagaagcucuuccagggcaucugaaagcagcaugguucuauaguagagggugacugacugacuuggauacagaguguccagccacaaacuuuuggaauguaaguuuggaauauaaugaaaagauuuagguaauuagcacuugacagagugagcuaguguuacaauagaagcaucuuacgacauucucaauuuuacuucuauuccuauuguaauauaaggagugaauuaugcuuaucuaucuaaugugaaauuguaaacuggauuguugccuguuucccccucuuuuuguauguggcacaugaacauuuugauguguguguuugcauaugcuuuugcagguccauguacguguauagggcagagaacaaaaucggcugucuuucucaauuuucuuucauuguuauuuuuuugagacuguccucgaugaaucuagaacucauuaauuuagcucagcuggcugaccaaugagcuccaaggaucuucaugucucugccucucuaacacuggaguuacagauauauaccccuguaccagcuucuacaugagcguuaaggguuugaacucagguccucauucuuucauggcaaauacuuuacugaagucucaugaauuugugugucauuuuugcccagggcaugcugaugacuuugcgguuucaguuuuaguugugcugccaaaagagcacuguuaugugggaacagucugagugacacuggggaaaggcccaugaggggucaggcauuucuguggacuaaccuuguuacuucagaugugagcacuguaggugaaagcuagcagcucacuuccuguuuaguaaauguacagagaugagaauggcuggugcuuugcuuucaagcuucacauugagaaaacuggcuuuuguauguuggaauuguuuuauauucucuugucuuaggauuaacaauuaaauuauguaauaaaaaauaguuacuuuguuuuaauuuagaaagcugcuguagcugggugugguggguagugcaugccuuuaguucuagcacuuggaagguaagagacagguggaucucugaguuuggggcuggccugguuaacagagugaguuccaggacagccggggauuaacagagaaacccugucuugaaaaaccaaacaaacaaaaaagaaagcugcuuuacuauuuauaguuucuagaaggaauuauggcuaaagccaaggcucaaagguauuaaauacuguuaacuugucugaagacccuguguauagaguagcaguggcaugacacaugacauucccagaggcauugcucucuuuguagucccacacuggaaagcacaaggaagccagcaagcagaugagagauagucaaggacagaauguggaaagggaagacaagacaaaugcugacagcagagcagcuaugcugcuagagaguguaaauaaaagggaggcauccugaaacucaaggccagagggcuucuagaacaaguauagacuacacagcuugacagagugcugcagagaaccgacagccugagggggaggccacuggaaacuuaagauguuaguuucuguggaaguuuggagcuagaguuuuucauagauagcugucuguucaucagaaacuuaguaaacagcucuaugugcaaguuacugaguccuuaaaggagcuugcuagggcugcucaugaagagcucagacucuucacucaaggucagacaguggggauaaucaaugaugcacacaaagaagccauagcuugccauauacuaaggaacugugggagccacugacagaaauggugacuagcuggaauggggcugagccuggcggcugagcagggcuuggaagaguaaauuucaaugcuugcccuuggucuugaguucugauugaauugaugaaugcuagaggauggggagcgguuggggugggaugcgguacagggagccucaggauaagguucuggaggguucagcucuggcagguaguuuagauuugaugcuguagacaauagggagcuggaaagagguucucuggaguguuucugcaccuaccguuucauuuaaguguagugauaauucugcauuucaguguuucucauuugccaccaaggagacgagugcccuuggagcacguguucuaucuagugccaagugcuguuggggagggagucaugcaggcagcagugcacagauauaugguguagauguguagacucacugaaagcacuggcuagugucugcuguaugcauaacuccuccucuuccuaacccugccuggguuauugcuucccuguuacucuuguuuggugucccaggcauaucuguucaaugcacacuccuuaugaacauguaguuguuagugagauagaucaugacuuaaggcaaccuuggacaguccuugccucugcuuugucugcacugaccagccaguaaagggacucaguuauagcuugugaggcauaauugacaacaggcucuggaauuaagacucagaggcaaaacccaggaauaaucaccucuuguguuagaccaguggguuucaaacuuccuaaugcugcaacgcuguaauacacuucaucauguuguagugaccccaaccauaaaauuauuuuaauugcuacuccauaacuguaacuuugcuacugcuaugaauuguaauguaaguaucuguguuuucugauggucuuaggcaaccccuaugaaagggucacuuaacccuaaaagagguuuugacccacaggcugagaaccacucccuuagaccucacaucagcagggagaaacagcugagcaguggcccaagagacaagcaucacaucucauguccacauuuauacaacucuuguuguuaauuauuuuuacucauaacuuuucuuuuuuuucuuuuucuuuuucuuagauauugucuuaguuaggguuuuacugcugugaucagacaccaagaccaaggcaagucuuauaaaaaaacaacaacauuuaauuggggcuggcuuacagguucagagguucaguccauuaucaucaaggugagagcauggcaguauccaggcaggcauggcacaggaggagcugagaguucuauaucuucauccaaaggcugcuaguggaagacugacuuccaggcaacuagggugaggauuuuauacccacacccacagugacacacccauuccaaccuggucacaccuauuucaacaaggccacaccuucagauggugccacucccugguccaaggauauacaaaccaucacagauaucuucuuuauuuacauuucaaauguuauccccuuuccugguuucccuucugaaaacccuccccccucaccaccccaccuacucccacuuccuugucuuggcauuccccuacacuggggcauugagacuuauaggaccaagggccucucuucccauugauguccaacaaggccauccuuugcugcauaugcagcuggagccauggguuccuccuuguguacucuuugguuggugguuuagucccugggagcucuggggguacuaauugguucauauuguuguuccuccuauggggcugcagaccccuucagcuccuuggguucucucuagcuccuccauuggggaccuuguacucaguccaaugguuggcagagagcauccaccucuguguuugucagucacuggcagagccucucaggagacuccuaucaggcuccugucagcaagcacuuguuggcauccacaauauuuucuggguuuggugacuauauauggaauggauccccagguggggcagucccuggauagucuuuccuucagucucugcuucacacuuugucucuguaucuccucccaugguguacuggcuaguuuugugucaacuugacacagcuggaguuaucacagagaaaggagcuucaguugaggaaaugccuccaugagauccaacuguaaggcauuuucucaauuagugaucaagggggaaaggccccuuguaggugggacuaucccugggcugguagucuugggggucuauaagagagcaggcugagcaagccaggggaagcaagccaguaaugaacauccaucccuccauggccucugcaucagcuucugcuuucugaccugcuugaguuccaguccugacugccuuggugaugaacagcaguauggaaguuuaagcugaauaaaccuuuuccuccccaacuugcuucuuggucaugauguuugugcaggaauagaaacccugacuaagacacauggguauuuuguuuccucuucuaagaaggaccaaaguauccauacuuuggucuuccuucuucuugagcuucaugucgucugugaauuguaucuuggguauucugagcuauugggcuaauauccacuuaccagugagugcauaucauguguguucauuugugauuggguuaccucacuuagggugauauuuuacaguuccauccauuugccuaagaauuucaugaauucauuguuuuuaauagcugaguaguauuccauuguguacauguaccacauuuucgguauccauucuuuuguagagggacaucuggguucuuuugagcuucuggcuaugauaauggagcauguguccuuauuacaugguggaacaucuucuggguauaugcccaggagugguauagcuggguccucagguaguacuuuguccaauuuucugaggaaccaccagacugauuucaagagugguuguaccagcuugcaaucccaccaacaauggaggaguguuccucuuucuccacauucuugccagcaucugcuguaaccugaguuuuugaucuuagccauucugacuggugugagguggaaucucaggguuguuuugauuuacauuucccugaugauuaagguuguugaacauuucuuuaggugcaucucagccauucgguauuccuugguugagaauucuuuguuuagcucuguaccccauuuuuuaauaggauuauuugguucucuggagucuaauuuuugaauucuuuguauauauuggauauuagccuucuguuggguguaggguugguaaagaucuuuccccaauuuguugguugcuguuuuguccauacauggcuuuaaaaauccuuguccuaagcacauauuuaagcaugcuugucucucgaaacccuucgcgggucaccauguccuuuuucgucuuucauggcacugaaguguugacuguuuggacagugcaguccacaucaucagaugcuggaugcugguuccuggucacaaggggguuaacguuugucagcagguagaggccaggaagucgaguucagcagguaguggcuguggugaccaccauugcucugacuugggaagcuaggggaugaaugggugucauaaaaaaccaguauaaauaauuuguuuguuaaugcuaaggaugggaaaagauggcugugguuuggagguagagugggguccaagaauuaaugguguccaagaagccugacuucgcuggcacaccaagaagaagggaccagggaagggagaucugaggguucauuggguauuaacaugagauuacaggccugugucugucuacgucugucucucugauguguucguuugaugacuaaaugagguaauuuauguaaaggcacagcuuaggacuuauuacauuccccccccccuuuuuuuucuguuuucaaaaccauuuauauauauauuuuuagaccugcaauuuauaaggagaauagugaggagauggcccuaagaaaauagcagcuucaccauaguaaaaagacagauggcgcugacaagaugauucagcuugcugccaagacugaugacuuaagguuaguccucagaaccauaugguagaaggagagaacugacuccugcaaguuguccaguggucccucaugugcccugugccacaggcucuccccccacccccaacaaacaagcaaauagauauauucaauuaaaaauaaaagagagaugaaagagccugaaaggacacugaaagcccuggagaccuuaagugugcuguugugcguagcacagugauuuaauuaagauguguguagucugugaaugcacuuggcuaaugagcauguugaucgaaagcacuggccaguccugaguaaugucagauuaucaggugcucuaacauucuaaauuauuuucugcacuuugaaguagagaguguagaagcaaaacaagccaguuuaagcauuagggguugcauccuuugacaaaagcuacuggaagguaagguguguuacagagccuacagaaaugguuucagauuaaguggucaauguuauuuuaaagugcaugcauauauauucaguuuuaaaaucaguuacaggaaagcuacaaagggugcuagcauuguacaauaaauauauaucucuucagugucuugaaaucugguaugacaugugacuccugggggcuaucugcacagguucucaguguuucuccagcagcagcagucucuggcuucuguggcuauauuagaacagugaacuauacuauacuaugaggcugcucuucgugcugugguugacugcagucaucacaguguuuacaaagauggcugaugaguauacgugcucauguaugcuccugccugacuguuugcugauugacuucaucaggcauaucuguuucugacuaauacuggagagagaguagaaacuuucuuaguguaaagguacccagugacuugagucaugacaaacucacagucugccuaguuccauuucccuuuccccugugauacccuccugggguguuuuacugaguuuacaucugguauauucucuaaguggcacauggcucccaugcaucuauggauuccccugggcaauugauuuuaaaacagcuccuugcauguugugcagagauguggaaauuggcuacuggcugcaggaugaaugcacagcuugaauugaaaaucuagcgaagcagaauucucuacuuacagcuguguuaauucaaauaggacauuuuaggccuagagagcuggucacaucuucuaagggcuguaaguagccuuucuuacaugggggugaguugcuuuuucuuuaggaccaucuagucacuuuuuuuuuuuaaaugaauucucaaguauaagagaacauaguuuugaaaagugaaaagugauuuuuuuuuaauaguaagaagcuugcuuuuguuguagggauuuuacuuccucguguagugagguuucuuagguguauacuauugugcagccauucacuugcacugucauaggcauugggcgguguguguuugaacaugauuuugugcuuggaucuuaauucaacuugauuggaaaugcccaugucugcccaugaguuuguuuugaccucagucauucaauggcaugagagaguuaguggucugagggacuggagucaucuuagaggagaacacagugcugugacugucacuuuuguucguggcauagugcuuucuuccucuucuguucagaaaagaccucuugguuauugauaguaacucugggugauguuuucugauuucauaaugaacuccagagggcaauguacuggccaguguuaaaugagaguaauauaucagauuuauuuuguauguuaccaucauauuuugaauuaaaaccuuauagagacaaaauuaacuuaaugaaaguggggaaaauaucucaccauaugauuguuuuguaaguguaauguaaauaugacgacagauuaauucauaaagcccaggacuuuuucugguagcagauuuauauugcccuuuacuuuaaugccuaucuuugauuugaaguccuggcauaaaacuuaacauaaugacagcaacauccugaccaauuauccaaaccauccagccauccuagaguguccagaaccucacacaugaucuauaggauuaagagguuagcuccuguaacuucaaacaaaguacuuucauaauaaaaguaaaaugcacaaaaucugaggucacuuccucucuuaauuaguugcacugaccagguggaggcgaagcacuuugcugggcucaggcuguccauaaagccaagcaacaugacagcacaauagaggaggaacuaagaucguuuuaauauguuucuauccugugucacaguuugagauuguccugguuuaugucgcuuuuggcaaacuuacauaaaagugaccuuguacuguauuuuaugaccagaugacuuuuccccucaguggcuaauuugucucaggccuccaucuuaaagagaagagaguaggaaguccagccugggacuccaugagcguucauuggauucuuucauuauuuuugcuuguuuuuuuugccacugaugauccauaaauuguuggaaaugagcgauucaggaagugcugcuuaguguuaguggcaaaugcgcaaacucagucugguucugcugggugaaaggaaaucacaggcaagaggaaggcuccugcugggaaccuugcaaggaaauuugacuugggcauguuuugaucuuggcauuuauuacagaaaaugaagucauaucucacuaacuguugcuauguguuaauuugauucucccaacaccugcaagaaaaagauguagucauguauuaaucagaacucucugcucucccccacuagggagcacugguuucuuuccagaaauaguaaggacaggaucggccguuuucaagccacgguagcgcuguucuucugugacgggugggugugcgguuucuugaacuuugcacaucuggaaugcaugcaggaacucaggggaacugaucacaaggaaaagaacaugugacauuucauuugaugauuguucagauuuacaaagauugugacuuaaacucaaacuuaagcuucuaaaggagugagguaaaugaaaugaguaaauagaaauaagucuguugccaccuucuuaguaccaugcgugugugugagggaguuaaacccuucuuaguaaggugcauaugugagggacuaauuacaucucuggcuaugcuguuugcuuuuguugccacccgucuuaguauccguguguguaugugagggagguaauuacauauuuaguuacacugucugguuuuguuggugguauuugguuuuguuacaucacucagcuuucaggcacuaugguucuuugaucucaucugcagaguauuauguuaauuuucucuguaccuauaaagaauaagggauuucuacauauaaggcuaaauugucucuuuauuugaauaauaaugaguuuuggacucaaguccagacucuccuuaccuacugugccucagauauauuucucaagaguguuucugugaagcuugcugcccucaccuguguugguaacaugccaaagugugcugggagcacaguuauguuuaguguucacacgugucuaguauaagggauugcuaaugagacaucaggaguguugugagcauuacuuuuucacaccauagcccaggaaucuuguauugagucagguaggggcauacacguguaauugcagcaguugggcagcugaaggaggauugcaaggauucggcuagcuugaucuacaagguaugaagccaggucucauggcauuguauugucauggggcacuuuuguugaucucucuugaauuauaaggucuguuuuauuuagaaaaguacagaucauaaaagaugggcugugcuguuuucauagggaaccaaaccucaggcucauuuaauaggaugaugaaauuaacuaacaucucugaauaucucauaguucaguccucuguuaagugagaagagcuuuaugagggaagaaauaaaaagcuacuagcuucacauuugaaagcaauaugcuuuuaauuaccaugcucccaaugcuuacauucagaaaacaaucuuauagaaauaaucauuacuaauuaaaaacuuuccccuaguuuuuuguggugagucaggggggagaauugaaaacuaucuacuuuuagguuaaaaugaauuuucuuugcaagugagguuagaugucauauuuaaugcugcuggagguuucuuaggguacaguacuccagaccgacuggaugacucaccauacccuaugcaguuugaguuguagaucugugucuauuuggcauuuaaacucauaugcacuugccuauaaaaucauuguucaguauguugcucugguagcaauuugcagugucugugaaauauuagccaaugacucugugaaucuacacagcugaaacugucuggcugaaacuuggugcagcauauuaacugacagcccauuauguaguuuguaucccaggaauagaagugacagugggacuguuugacagcuuaguauaaguggcaucucaaguugugaugaacuauuccagucacugacuaugacaccaccucagacagccucugugcacaccuucaauuaaaagaaaacucuagacuuaaauaaauacugcagugaugaauuuuaaacagcagacauauuaaacuacacauguguauguaucuucuuagugguaaaguaagaucagcagguaaaaacugaaaaaaagaggggugcauuuauaacuaaaacauuaaauauauaaaaaugaucacuuuuacaaaaagaguucccuuuauuucuuggaauauacugaaauaagaaaguugaaaugacuuuuuuuuaaaaaaagauuuauuuauuuauuauguguaaguacacuguaguuaucuuccagacacgacauaagaggacauuaaaucuuguuacggaugguugugagccaccaugugguugcugggauuugaacucaguaccuuuggaagagcaguuggugcucuuaaccacugagccaucuuucuagccccugaaaugauuuuuauaacaguagauuuaaauauuuauacuuucuuauucuaacagggauuaccuauuaauguuuucauuauauaauaaugagccuuaaauucuauaagcagccgguuuuagaauagauuuaugaauggcuuacauuuaaaaaagauuuauucuauuuuaugugugugaauguuuugccuacaugcuuguauguuuacuacauguguaccugguacccaaggaagagggugucauuaguuccuuuugaacucacagagcucugccugccucuacuucuuuugugcugggguuaauggagugcgccagcacaccuagcaaacguuuauuucuuuguuaggaaaaaaugaaagacuuccuuauguugugguaagagcacauugcauuagauaacuuuauaauacuuugauuccagagaagaauugucucuucuuucugcugguucuccuuacugauuguucacuuggagauuccaacaacuguuuuuuucuggagcuagacucccuucuacuuuuguuuucuuagagauacaacugcuuguauaacuaacuuucaugaaaauuuggguggccucucaugacuaacaaaccuauucaaacuugcauuguaugucuuacauacacagugcucuaaaagcuugacugauuuuuaguuuguuagauuuauuuauauuuuauuuuauauauguguaugugugugugcuugauguccacagaggagagacauuagcuccguuugagcuacaacuacaggagaguaauuaugagccacuguauagcagaugagaaccagaucccgaugcuggacaagggcagcaaguguuuuuaagccgcuguucccauucggcacaccugcucauccuguguuacccuuguugaacuugucccugccuggagccuguguucccuuucccagcuuggaguccaagcccacacagugcugucucugacuggaaguagucccucucucucuuaucugccagauuccugguuuuggcugauuccucagggucuccuagugcuccucagggacuuuauuuacuuguaacugcuagggucucccucaguaggguuacauugugauuguuuguugaugugcuuuugacacaaguacuugggacacuaaguuuaugagaaggcccaggagugcucuauacauccccaugucuuuaguaguugguuuaaaggagguaaacaagcugaugccaucauuaaauaugguuaaguaaaacaacuuaauucuguagcaagcauuguguaucauuaaguguauaguucucaagaaagcaacaaaaaucucuaggaauuugagcaacaacaacagagaaagaacaaagcccacaaccuccucaggggaaagagaugauggaaguccacugagcauggaggaggcggcagaaugcauucuugugagaaguccucagccacacggaaaauagauguaaagugaaggugugccucaggacgccuuucagacccaguucugacagaaagacaucucccugggaguuuaucccuccacuuguaucucccaagaauuuggaguuuaguauucuaucaguguuauuagaaaacucuaagucaaggaacuaguauaaaaguuacugaaaaguauuaaaauauuaucuaacauauaaacuaacugaacauauaauacuacaguggcuuauauaauguauauuuaaggcagauuuuggguguuucuuugauauaauguaaaauucauacuguucaguacaguuaacuugguccuacuugugcugucuacugucccuuaaaucaauugugguugaaaacucaggacaugacaauaagcagacagagcguucuuucugacuuuucuguaucuguauuguuagcuucuuucuugguaauuugauaguugacuuagcucuaaaaaugcuguuuuccuuucaaagcagguguguauucuauuucaguuauuuacuuuuuccaugaguucuguaaggaucuaauauuuauaucuauuuuagcuaauuuuguagagugauuuaaagagcaaauuauaguuuuuauuuauauuacuguccaguuuuccuauaaacauuuauacgucacuccugacuuuuauuucuuaauguuaaauucuuauucauauuaagacauauuuugaggcucuuggcucauaagcuuagaacauuaggaaucaucacuaacucuuuuuucuuuucuuuucuuuuuuuuuuuuucuuuuagucuaugauuuccuggcauuuuuccacaaacucauucccaucuacuuuuugucucuccgggcuguuauauuuuuuccaggcauaaugagauagaugcaguucagacuacugacugcucauacagaugcugcauucagggcugaaaaaggguagaguaauugguucuaugcuguguauuuucuccccuuuaguguguguguguguguguguguguguguguguguguguguguguguguuaucaucccaaagcugcaccucugguuccuuuuuaucucuugcuuggaguacuauuggucuuuaucugggacaugacagccauaauuccaugcuaacuuuuguguucuguccuuguuucugacucagaaaagauucauguccucuauuugaaucugcucagauuucuccuccaaagauggguauaggguuuuuuccaucucuuucccuuuuuuacugcuuuggcaucucaugaccuuacuacucucuuuaaggaaaggguuuuuaaucuacucauaacugcugagacuccaaaaugacacacuauagagcaaguucuuccugagugcaccugggcuucagagccuucagguucacuucccuugugcuguuuggcuuccuuggacacacucacaaagcaaaugguuuuagauaguucucuuguacauauugacaaaugucuuguuuccguuaauauuuuauuuuuuaggcaauauucucaaacacacaauucugcuucagcauuuuaggugcuaggauuacaggccucugguacaucugagaacauuuuaauuuaaaugcuuuauagaaagucaguuaaauuauguuucaugucauucauuguauuuguguuacuguacguugguuaguagugugagaauauaucauuugucuuccccacuguggaaguuugaacaagaaugaccuccuuaggcucauauaguugaaugcuuagucaucagggaguggcaauacuuaagaaagauuaggaaggguggccuuguugggucgauguguccuuguuggaggaagugugucauuaggguggcuuugagguuucagaugcucaggguuagggcaagauagucuguacagagaagcaagcccugaucccauuagauccaccaacaccagagcuaagagauaguaaagagaguaaaccgcuaaucagaacuuaauauugaguuuuuucccuuacuccagccagaacaaauaugauuaagagaaaaaaccaaaacaaaacaaguacuguugagaaugagaggaaaggggaacgcuuauauaauacugaugagaauuuaguuaggcuagccacucugaacauuaguauacauuuuccucaaaaugaucuaucaaacuauuauaugaucuaacaacaauucuccuggaacccaaaggcucuagguugcugagacacuucauuuucauuguagauuugaugauucuccaggacuguggaaaugcaccuuuagguguaucuuuugaggauguuugcagaaagguuuaacugaaaaggaaaacugccuuauaugggaacgggaagauuagugggaagggcugcagaagaaagguaaugaaaaugucuuggugaaguccauagcuacauacaaugaauauacaccaagaaaacugaaagccaacaggauaaguguuuauaaauacauagauaaauaaaacaagcauuugagaaaauccaccuagcaagcuuuauaucaccuucacgcaugguagagcagugguucucaacuugugggucauggccugaggauuagaugacccuuucacagggguugccuaaaaccuuuggaaaacacagauauuuucuuuuuuuuuuaacauuuuuaaaaaauaauuuauuuuuugagauuaugauauaguuacauuauuucucccuuccugauucuucuuccaaacccucccauauaccccuccuugcccuguuucaacuucauagccuccuuuauauuaaguguuguugcauacauacauacauacauacauacgcgugcgcacacacacacacacacaaacacacacugcuaaaugcauaaauauaaccugcauagucuauauacuguuacuuuucaguauguuuucaaggcugaccaguugguauuugcuaauuuuuuuuuaauuagguauuuuccucguuuacauuuucaaugcuaucccaaaggucccccauacccacccccccccaauccccugcccacccacucccccuuuuuggcucuggcguuccccuguacuggggcauauaaaguuugcaaguccaaugggccucucuuugcagugauggccgacuaggcuaucuuuugauacauaugcagcucgagacaagagcuccgggguacugguuaguucauauuguuguuccaccuauaggguugcaguucccauuagcuccuuggguaauucauuaugauucagaacacuggcaaaauuauaguuaugaaguaguaacaaauaauuuuaugguuggggucaccauaaaacuaggaaguguauuaaagagucauagcauuaggaaguuugagaaacacuguguuagaguaaucugaaaggagagaacuacaauugagaaaaugccuucauaaaaucaugcuauaggggaauaucuuaauuacugauuguuaggggagggcccagccuauuguggguaguagcaucucugggcuggugguccuggguuguauaagaaagcaaguuguggugguuugaauaugcuuggcucagggaguggcacuauuaggagguguggccuuguuggaggacauuuaucauugugggcauggacuuugagacuccuuugcuaguugucuggaagccaguuuucuccuguuugucuauggaacaaaaauguagaacucuuagcuuuuucagugccaugccugccuagaugcugucauguuccugcuuugaugagcuaugaugauaguggacugaaaugcugaacuuguaagccagccccuauuaaauauuguccuuuacaaaaguugccuuggucaugguguuucuucacagcaaugaaacucuaagacagaaguugguagagggagugggauauugcugugauaggccugaccauguuuuuguuuggaggaagguggauuuugggacuuuggauuugguaagaaguggaaugcuguaaguggggcuuaauggacuguccuaguaggaaucuggaagacauugguacugagggugauuugaacugugcagaccuggcacaagagguuucaauggagaacagcauuagugugugaucuccuugaacacaggauucaguuccguuacacuuccugguaucccuuuaucacuucaacuaugcauaucauauucuuccuuucucagcuugcuccuuuucauuuaaauuuaauuuaagccuagagucuguuuuuguaauauuuuggugaagaacauggcuauauuuugcauuguccgaagaguuugccugagguggagggauuuagcuuaauuucucugacaaaggaagucucaaaauagccugauauaaauuccauuguguguugguuacuaauguucauucuuuuuuuuuuucuuccauuuuuuauuagguauuuagcucauuuacauuuccaaugcuauaccaaaagucccccauacccacccacccccacuccccuacccacccacucccacuucuuggcccuggcacuccccuguacuggggcauacaaaguuuacguguccaaugggccucucuuuccagugauggcugauuaggccaucuuuuguuacauaugcagcuagagucaagagcuccgggguacugguuaguucauaauguuguuccaccuauaggguugcagaucccuuuagcuccuuggguucuuucucuagcuccuccauugggagcccugugauccauccauuagcugacugugagcauccacuucuguguuugcuaggccccggcauagucucacaagagauagcuacaucuggguccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaauucuaaggaggggcauaguguccacacuucagucuucauucuucuugaguuucauguguuuagcaaauuguaccuuauaucuugggaauccuagguuuggggcuaauauccacuuaucagugaguacauauugugugaguuccuuugugaauguguuaccucacucaggaugaugcccuccagguccauccauuuggcuaggaauuucauaaauucauucuucuaauguucauucuuaugaaguacauuuaaugaaaaggagcaagcugagaaaggaagaauaugauaugcauaguucaagugauaaagggauaccaggaaguguaauggaacugaauccuguguucaaggagauaaacagguuaagggaguggugaucucaggguaagagccaaccuaguuaaguuuauucuuuguguuuguaguugaacagugaauuguuaugucauguuagguguuaugaccugaauuguuuucauuuggaguuuuaauuuggaaugaacuauaauccagaaaugaggggcacacuugccauccagaccuugagucuggaagacacaggcuuuuuugauccagaucuugaggaaucauggccaugaaaagcuuugggccaggcaaacagaucucugaguucaaggccugucugggacagagcagguuccagguaaagggaagcuuaaguccagucauggugguacauaucuuuacucccagcauucaggagaaagaaucauacagaucucugaauucaagaucaaucuauguagcaaguuucaggacagccacgcuuagacaguuagagcauuagaaaacagaaagcuggugguaaauuaaaaaaaacaaacaggccauguuccagcuccaguaagcaacagaacuuggcaacuucggccauguggcucuggcuuuagaaucaggaguagaaggagacuacugggacaauuggugaugcugguuagcuggaucuaagaaauuaguggugauuaagaagaaaccagcgccgggcaguggucgcacacgccuuuaaucccagcacuugggaggcagaggcagguggauuucugaguucgaggccagccuggucuacaaagugaguuccaggacagccagggcuacacagagaaacccugucucaaaacaaaaacacaaaagaagaaaccagcaucacugagguaaaauuuucugggaaguguuuucugagagcacagagaagauauguuccagagauaucuaagguuguaccucaugcugcauggaaauguguaacaaucacugagguugguacugcuuuugaagacaugaaggggucagugaggacagcugagagguuugguacugugagaggccaggaaaguccauugguggaaggugcagccuuaguuacaguugacagcccaggacugaagggaucaugcaaagaaguugagacuuugcaccaagaagggagccuaugagaggugaaacauaguugcacuagaagaccucaggguacuggagaugcuaguaccaugggaaaaccaccaagaacagcagcauaaguaguguggagucaaccagagugcuacagagggcagagcuggaguggugacccaggccuguggaggagcccagaagaucaugaaacaagaucauuggaacaagaaacugugacauugaaguugccuuugcauacuccaagguguucuagaugccagagacaucagauaccugccaaagaaagcugcuaacagagagaggauccagccaaagagaaagaauuguguuguaacaauucuuuguaaucaacaaagaugaaaggaguuggacaucugaagagaauuuuaacaucagacacagagaugcugauuuuagaguuugcccagcugguuguuggucuuacuuugguucaguauuuccucacuguggaguuuuggaaugguaauauguaucuuguaauguuggagcuaugugaucuucuuuuugauuuugauuuuaagugauuuaagugauuggaugaaucucagaagaaacuuugaacuuuggacuucuaacauuguugcgacuguuacagauuaugggacuuuugaaguuguacuaaauguauuuugcauuaugcuauggcuagguauggccccuauagacucacuugauugaacuaaccuaugggggccagggagucaaguguggugguuugaauacgcuuggcccagggaguggugcuauuaggagauauggccuuguuggcuuugcuggaugaagugugucauuguaggugugggcuuugagacccuucuagcuaucuggaugccagucuucuccugcuugccuguggaacaagauguagaacucucagcuccucagucauaccccaggcucuaaagcugcaacacaacauugccaccaucagauuggacucauucugguaaauuagcauaaugcucuucaccaaguaguuggucuuuugaauauuuaucucccuugcuauauucuguuguccuauuuuuguggcuuugugcauccaccaugauaaccauuguaauuguugaccagcuucuaggacagcugacaccaaucccuuccaaucuugggggauaacccuauucuuuguagucaaaguauuuaacauuucuuuaacaaauggagaguguaagcuauacaauacuagagacucuuuaagaugcuuuagaucuagcauuucuguuagaugcuagguuauuucauuauaggcagaagcaucaucauuauuagcagguauuaugcuuuuuaauuguuuuuuuuuuuuuuuugguauacauucuagacaacaguccucuguuagauguacacauggcaaagacuuauucuguaggccagcuuuucaacuaauucaguuuucuugcagaacagaagucuuuacuuucacuaaauuacauuuguugauuauauuuauuuccugugugacuggaguccuauucacaaagugaauauucucacucuuauagaagcuucauaucuaacauuugacucauugagaguugauugguggguaggauaagaaagaaggaucugguuucaauuuguguagaaauccaauuuaaccaacacuauuuguuaaaaauguagucuguguuuaguaucuucgucaaaaaucaggugccuauagguauaugaacuuauaucaggguuuuugauucuaguccacugagccuuugugccacuaucacacauuuuuauuuuauuuauuauuuauuuauuuuuuacuuuggaggcucuauaguauaucuugagaucaggagguaccagcagcauugguuuauuuauuuauuuauuuauuuauuuauuuuuguuuuguuuuguuuugaaugcuuucuuuuuuuuuauuagauauuuucuucauuuacauuucaaaugcuaucuggaaagucuccuauacucugcccccgccagcagcauugcuuuuauuguucaaaacuagacuuuuugggauauuuuguguuuuuauaugaauuuuaaaguucauuuuucaaguucuuuuauugggauuacauuaaaauuguagauuguuuuugguaggauaguuauuuucacaauauuaauucuaccagguuuuucugucuucugaugucuuucuucaguguuuuaaaguuuucauuguauaggucuuugaauuccuugguuagguuuauuuuaagguauuucauuuuuuugauacuauugugaauaggauugucucccugguuucuuucucagucuguuuguuauugguguauaggaaagcuauugauaugggcauguuaauuuuguaccuugccacuuugcuaaaaguguuuacuagcucugggaguuuccugguggagucuuuggugcuucuuugguuagaaucaugucaacugcagagauacauuggcuucuuccauuuuuauuuauaucccuuuuauuuccuugucuugccuuauugcucuagcuaggacuucagacauuauauaagagcaaugaaaaugaacaccuuuguuuuguuccugauguuaguagaaauacacuccauuuaacacuagcuauguuguuaucauguuguauguucccuccauccauaaucaauccagaguuuuuaucaugaaggaauauuggauuuucucaaagcccuucuuuaugaauugaacugauucugugauuucugcccuuaaguccauuuauguggugaauuauguuuguuaauuuauauauguugaaccauuccaggacucuuggaaugaaguaagcuugaucaucggaaauaaucuuauggauguggucuugaauaugaauugaaaauauuuuauugaucauuuuugugucuguguucauuaggaagguugguuuauaguucuucuuuuccuccuuguuguuggauguuuaucugguuuugguaucagguaaauacauaaaaauauuuuggaaguguuauuuuucuaugucauggaacaaugugaguuuuaguguuaauucuuugaaagucuggugcugaauccuucaagacuuggccuuuuuuaguugggagauuuuuauuuauugcuuuugucuaauuaguuacuauagaucuguuuagugacuucauuuugguuuaacuuugguaggucauagacaucuuuucuaucauaucuaccuauuguauuuuucaaauaaaaaugugguagaauauaaaguuuuuaaaaugcccucugauuuucuagcauagucacauucaaagcccagugccacuugugugcuaugccucagugccugggcucuuuagguguuauagcauucucauuuuuuuuuaaaggucugaugcuugcuuauauggaucuauaucuuagacauuuuucuccuugauguguuuauagauuuguaauagaaaaguaugcuuuuggauacauguggagcuuuccuaauggauggggagacacagagagggagaaacaggacucagugugauuuauagucacauaguauacucagaagaccugguuccaaggcucaggguguauguuuggggcuggaggagcuauaggaaaggauaugacauugauauuuccagguguugacauaaacaacaaaguagauaaugaugccauuaguccauguuacugaagggagacgagauaaagcauacaaaacugugaguuuagaauaaaguucaugccacuuuugugaugauaucuuagggguuuauggaucuuggccacaguaggauaaucugcucuaaaaugugcucuucaauguuguuggguaugugacaaggucaggguagcuuaaggaguacuaagcguuuugcugggcucuguccucaggggcaggggagcuguccuuuuggggaugaugcuccagaccuugcagcccuugguaauuuugaugcauguuuacauuucagaggcucuuauacagacuggagccggccaccguccggaccagaggacaggugucugccuggcucggagacugugagaagacugaucauguaaaauugaguugcgggguuuaaaaaaaauaaaaauggagacaaguugcgauguagaagagcaacugagggaaucauaggccacucaguuaugucuaccuacuguagaggugguaucaaugguagcugugaaguggaagaagaugaaaaguuagcaaacaccauggaacagcuauagguaaccagaggucaguguacagacugucgaggcucagugcaggcccaaugcaggauucagcagagauuucuugugcuucucugaauaguuccuuagggucagcgggcauuccgaacuuuugggcuaauauccacuuaucagugaguacauaacauguguguucuuuugugacugaguuaccucacucugggugauauuuucaaguuucauccauuugccagugaauuucaugaagucauuguuuuuaauagcugaguaguauuccaugguguaccacauuuucuguauccauuucucugagaagggacaucuggguuguuuccaccuucuggcuauuauaaauaaggcugcuaugaacauaguggagcauguguccuuauuacauguuggagcaucuucuggguauaugcccaggggagguauagcuggguccucuaguaguacuauguccaguuuucugaggaacugccaagcugauuuccagagugguuguaccagcuugcaaucccaccagcaguggaggaguguuccccuuucuccacauccucgccagcaucugcucucaccugaguuuuugaucuuagccauucugacuggugugagguggaaucucaggguuguuuugauuuacauuucccugaugacuaagguuguugagcauuucuuuaugugcuucucagcccuuugaguuuccucaguuaagauucuauguuuagcucuguuccccauuuuucaguaggguuauuugguucucuggagucuaacuucuugaguucuuuguauauauuggauauuagcccucuaugugauguaggguugguaaagauauuuccccaauuuguugguugcuguuuuguccuauugacagugucuuuugucuuacagaagcuuugcaauuuuaugaggucccauuuguugauucuugaucuuagagcauaagacauuguuguucuguucaggaacuuguccccugugcccauguguuugagacuuuuccuuacuuucucuucuauuagauucaguguaucugguuuuauguggagguccuugauacacuuggacuugaacuuuguacagggagauaagaauggaucaauuuacauucuucuacauguugaccacuaguugaaccaucaccauuuguugaaaaugcugucuuuuuuuccacugguugguuuuagcuccuuugucaaagaugaagugaccguaggugugugggcucauuucuggguuuucaauucuaguccauugaucuaccugccugucacuguaccaaugccaugcaguuuuuaucacuauugcucuguaguacagcuugaggucagggaugguuauucccacagaguucuuuuauuauugagaagaguuuuugcuauccuggguuucuuguuauuccaaaggaauuugagacuugcucuuucuaacucuaugaagaauugagcuggaauuuugauggagauuauauugaaucuguagauugcuuuuggcaagauggacacuuuuacuauauuaauccugucaauccacgagcacgggggaucuuuccaucuucugagaucuucgauuucuuucuucagagacuugaaguucuuguaauacagaucuuucauuguuugguuagagucacgccaagauauuuucuguuguuugugacuguugugaagggugcuguuucucuaauuucuuucucaguguaucuuuuguauagagaaaggccacugauuuguuugaguuaauuuuauauccugcuacguugcugaaguuguuuaucagcuguaggaguucucugguggaguuuuuggggucacuuauauauacuaucauaucaucugcaaaaugauauuuugacuucuuccuuuccaauuuguaucccuuugaccuccuuaucuaauuugucuagguagaacuucaaguacuauauucaauagauagggagagggagggcagccuuaucuagucccugauuuuagugggauugcuucaagguucucuccuuuuagcuugauguuggcuacugguuuucuguauauugcuuuuacuauguuuagguaugggccuugaauuccugaucuuuccaagacuuuuaacaugaagggaugcugaauuuugucaaaugcuuuuucagcaucuaaugaaaugagcauguuuguuguuuuuuuuuccccauugaguuuguuuauguaguggauuacauugauggauuucccuauauugaaguauaccugcaucccuggaauaaggccuaccugaucauggugaaugaucguuuugaugaguucuuggauuugguuugcaagaauuguauugagaacuuuucauuacuauucauaagggaaauuggucuacaauucuuuuuguugggucuuugugagguuuugguaucagcauaacugugguuucauagaacaaauuggguaguauuccuucuguuucuauuuuguggaauaguuugaagaguauuaggucuucuuugaaggucugauagaauucuucacuuugauugggagaauuuuaaugacuguuuaaugacuucuauuucuuuaagaguuaugggacuguuuagaugguuuaucugaucuugauuugauuuuaguauuugguaucugucuagaaaauuguuuauuucauccagauuuuccaguuuuguugaguuuauccuuuuguaguaggaucugaugauuuuuaaaaaauuuccucaguuucuguuguuauaucuccauuuucauuucugauuuugcuaaucuagauacuaucucugugcccucuuguuaguuuggcuaaggguucaucuaucuuguugauuuucucaaagaacuagcuccugguuuuguugauucuuuguacaguucuuuuuguuucuauuuaguugauuucagcccugaguuugaugccgucuacucuucuucgauguauuugcuucuuuuuuguucuagagcuuucaggugugcuguuaagcugguaguguaugcucucuccaguuucuuuuuggaggcacucagagcuaugaguuuuucucuuaggaaugcuuucauugugucccauaaguuugcauauguugugccuucauuuucauuaauucuaaaaugucuuuaauuuuuuucuuuauuucuuccuugaccaagucaucauugaguacaguguuguucagccuuuauguguaggcuuucuuuuguuuuuguugcuauugaagaccgccagccuuaguccuaugugaucugaauauguaugggauuaauuaaaucuugugucuguugaggccuguuuugugagcaauuauauggucaguuuuggagaagguaccaugaggugcugagaagaagguauaaccuuuugauuuaggaugaaauguuuuaugaaauguuuauauauaucuguuaaauccauuugacccauaacuucuguuaguuucacugugucucuguuuaguuaguguuucuauauucuguccuuugaugagaguagcuuguugaagucucccacuauuauugugagcaaugugugcuuuaaacuuuaguaaaguuuguuuuaugaauguuuguacccuuguacuuggagcauagauguucagaauugaagcuucuuauuggaaaaauugaaauuuuuccuuugaugaguaugaaguguccuuccuuauccuuuuugauaacuuucaguugaaaguugauuucauuccauauuagaaugacuacuccagacuguuuguugggaccauuugcuuggaaaauuguuuuccagcccuuuacucugagguagugucugccuuuucacuguguguuuccuguaugcagcaaaauucuggguccuguuuauguagccagucuguuagucuaugucuuuuuuaaaaaauuuuuauguuaauuagguauuuucuucauuuacauuuccaaugcuaucccaaaagucccccauaccccccccacuccccuacccacccacucccacuucuuggcccuggccuccccucuacugaggcauauaaaguuugcaagaucaaugggccucucuuuccacugauggccuagucggccaucuucugauacauaugcagcuagagacacgagcucugggggguacugguuaguucauauuguuguuccaccuauaggguugcagaccccuuuagcuccuuggguacuuucucuagcuccuccauugggggcccugugguccauccaauagcugacugugagcauccacuucuguguuugcuaggccccagcauagccucacaagagacagcucuaucuggguccuuucagcaaaaucuugcuuguguaugcaauggugucagcguuuggaggcugauuaugggauggauccccggguauggcagacucuagaugggccauccuuucgucucagcuccaaacuuuguaacuccuuccauggguguuuuuucccccaauucuaagaagaggcaaaguguccacacuuuggucuucauucuucuugaguuucauguguuuugcaaauuauaucuuauaucuuggguauucuaaguuucugggcuaauauucacuuaucagugaguacauaucaugugaguucuuuugugauuggguuaccucacucaggaugaugcccuccagguccauccauuugccuaggaauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcaugugcccuucuuaccgguuggaacaucuucuggauauaugcccaggagagguauugcuggauccuccgguaguaauauguccaauuuucugaggaaccgccagacugauuuccagagugguuguacaagcuuggcuugugcuguaagaucaagaaucgacaaaugggacuucauaaaauugcaaagcuucuguaaggcaaaagacaccgucaguaagacaaaaaggccaccaagagauugggaaaggaucuuuaccuauccuaaaucagauaggugacuaauauccaauauauauaaagaacucaagaagguagacuccagaacaucaaauaaccccauuaaaaauggggcucagagcuaaauaaagaauucuuaccugaggaauacugaauggcugagaagcaccugaaaaaauguucagcauccuuaaucaucggggaaaugcaaaucaaaacaacccugagauuccaucucacaccagucagaauggcuaagaucaaaaacucaggugacagcagaugcuggcgaggauguggagaaagaggaacacuccuccacuguuggugggacugaagucuaugucuuuucauuugagaauugaguccauugauguuaggagauauuaaggagucaugauuguugcuuucuguuauuuuuuaugauauuuuuauguuuguguggauaacuucuuugggguuuacugaaagaagauuucuugcuuuuuauaggguguaguuucccucccuguguuagaguuuuacauuuauuagccuuuguagggcuggauuuauggaaagauauuguguaaauuuguuuuuggaaugucuucguuucuccaucuguaguaauugagaguuugcuggguauccucugcaucugagauucucuccucuguuucuuguauucucuuggugccuccugauuucuuuccuagguuuucuaucuccagguugccucccuuugugauuucuuuauuguuucuauuuuuagauccuggaugauuuuuuucaauuccuucaccuguuugguuguguuuuccuguaauucuuuaagggauuuuuguguuuccucuuuaagggcuucuagcuguuuaccuguguucuccuguauuucuuuaagggaauuacuuauguccuucguaaaguccucuaucaucaucgugagaugugauuauaaaucagauucuugcuuuuccgguuuguuggggauccggagcucacuguggcggugaugaugccaaguaaccuugguuucuguugcuuauguucuugcccuugccucuccccacguaguuauugcugguuuugcuaugucugacugugauuuguuccuccugugcucacaaacuugccugcacucuuggcuggccagguguuuccuggcaguauuuggguauggagaacuguggugcaggauaaguucugggugcagauggaaacccaaauucaauuuuuucaauacagaauuucacuauguaacucaggauggccucgaacuugccuucugucccauugugguguugagcugugucuuuuagggaaucugaucauuccugcuccaggcuucugagagcugggauuguagucaugggaacucaugcucaccuuaucuuuccauuucuucuuucuuggaauagcugcuuuauuagagcucauguguuaaaauaugagccucaguccuuuugcuucaguggacucuuugacaugcacacuaggaguggugacacaucugagcaaguguguaaagccugcagcagauggugacacuguuuaaggauagguagggagaagacuguacucuuauagcagcacauugagcuagggcauuucuucuuuguauuguguucaggauuuuggagaugugaugucaguuuucccugugccugacccucagguguuagcuaagaucagcuaacucuuuguuuuuuuuuuuuuuuguuguuguuguuguuuuuguuugucuguuauuuuuuuccgaggcaggguuucuguguauagcucuggcuguccuggaacucacucuguagaucaggcuggcuuugaacucagaaauccgccugccucugccuccugagugcugggaugaaaggggugugacacugcugccuggagugucugggucuuuguaacuuagaucuuuaaaccauucucaguaugagaugcacaaauuccagaauccuaagaaaaaaggcacacuuauaaguuuguuguuagaagucagaggcgcagggauguaaaucuuugaacuuacagaaacaaacugccuuugccuaauaguuuccaaguugacaagucuggucuuugagucuuuucaaggucagaaucuguuuuauguuaaaauauucaugaguuuuguauuauagucaagucucauaacuggcagcauucucauuuuauaugaaaaaacaaaacaaaacaaaacaaaaacgaaugcaauuuguguauuaccaguagaguucuuaguagugcugucccgcaagcaguucuccaguuggccacuagaggacuccagaggcugcuaggugcccuuccugauuauagaugucaguuuccuagcccaguguccccagugucaaacagccugccauaccuugauuagaaccacaaaucaagauggaaauccacaaauguagucuucugggaacuacuaggaaaguaauaguuaaaaaaguuucugaaaaauacuggaaugauugauuuucuuuugugugugcuuuauuucaaguuuaauauuuuugaaaaauauaauuuaaaagucacucuaaacauaaaccaaaaauaucuagugcuuucuccaaaucaacauagauuuauauaaaaacauaauguaaaguuuuuaagcacguauacauuuuuuucccuucccuauagccagcuuuaugcuuucagguagaaaccugguuguucaugagaugauguaaaguauuaaaaugcuguugcuguuguguuuuaagggaauccgagcccgcauuuuggaaacucugguuaugcugcugcuucuugcguugcugauucuugggaugguguggguggcuuccgcccugauugacagugaugcugccaguauggagucuuuauaugguaccugauuauuguuuuagcuaguuccuaugaugggcaccugaguuugggauauaguuauaucuguuuuguuuuguuugagacaagauuucuugguauaacagcuuuggcuguccuguaacuugcuuuguagaccaggcuggccucaaacucaaaggagaucggccugccauugccuuuggaaugcugggauuaaauguguuuaccuccaugcccagcauguuuuauauacuuuaaaauaaaucuuugugugaugaacuuucuguuaacuuacagaauuuagaugucuuuagagauacuuaaagcagugaauauuauucauuuguucaacauacuaugcaguguuugauauauauuuaauuaauuguuuuuuguucuuaaaauuucauggagcauuuucucccuuugaaacauuucucaaaaggguuauuuauuauuuucuuacuuuagaucuuuuuauucuacaauuuagaaacuagacugcuuaauuuacuuaaauaggcaauuacaguguucaucauauauuucuacuuauuaagauaaagcagacuauuuuaaugugccacgcuuucacuuacuaaaaugugcugauauuuuuacagaucucugggaauucuacuugcccuauuuguauucuugcauuucgcugaugggaugcuugcugcuucucuguaaguacucuucagugugacacugacaggaaagggaguuugucuuggacccuggaaaauugugccaguuuccuaauugaaacuccuuaaugaugggggcuguuuuucgaguuggccuuuuuuuauuguucuagauagauuuuauuaagcagaacugugaaauaauuggauaguuuguucacuaagccuuuugcacuggguugaagacacacacacacacacacauauacacgcaccacagaacucuuuaacaguaucccaugucccccucccuccaugucuccaccauguacacauucuuuacgucuacuucuaguccaaauauuaacacuagaucacuuuaaauggcaagaauacaauucuacuugaugaauuuguagucuuuauuucaaaaucuguuugguuuuacugaagacgccacacucgaucuuagggauaguuuaaguugucaaacaguucaaaggacuugugacuguagcugucacucuuagauacucucuuugggcucucaguccucacaggugacauggucugugugcuuuuucugggucuauuuaguuuguuuuaagcagagaguguucauccucuaggaucuugaccauuauagccacuguuuauucucaccuucccugugauaugcuugccccccacacugccugagcuccucccugggggaggugaagggccuccugacagaggaccuggagaaagcuaagcucaagaugagaguggaccuaagauguuccuuagguugcuuugccugucucucugcaugcugagaaccucuuucuuaccagucaccucauuucuacaguguguacuccaguuggccugucccguauguucacagucaugggucaguugcuggugaagccagcgguaaguauuuuauuuguguuugcuaaauacucaugcuuauauuuuugauuauguaaaaauauuuaaaaagcugaggacaauauuuuuguuaguuuaucauucaaauuuuuuuucaaauuuuuaacuuuuuaaauuaaguuuuuaaaucuuggaaagaaagucuauuuuuccuuuugaaaguacuaagcacaugcauuuaaguagaguuuguauagaaaaaucucaaggcagaauuuucaggcaucuguaaguauuuguguguucaccacccugcauccaacugugaugguaucuguuucaaaguugaucacauagcugaccagguuguggaugccucugauucuacaauaggagaggccuggggauugugaguucaugacuauuugggacacagagugagagcugucuacagcuaaaacaaauaaaucaaccagauucccuaaacacacauaaaacaggaacaaaaccaaaauugcccauauuuaugcuucaauuuauagaccaguuucugaaaauauguacauuguguuugaauuauaucuuaccucucagaaauguuauauauuuauuuuaaaaugacuuuuaguggauaguaauaucuguuccuguuuuuuggucuuugaacuauuuuacagaucauagcuucuuagcuaccgcuagaaaaucuguccuuuaaauugcuccccugaauccccauugccuacacacccagucucagcugucuacauguuuaggguuucccagcgucacaugcugcccccacuucugcuccuucacagacugucauaacagcuugaagcugccuugcugcuguccacagggauguucaggcaccacuguagucaccguugugugccuucuccacaauuacugguguuaguggcuuguaccuggccagaaauacuugcugagccauuugacugugugucuguccucccuuugugaugauuucauuaaauggggacauacugaggcaauauugcgauagaugaucuuucgguaaacucuuguuugauuuugaaaguuacauucucucauuuaguucccucuaaaagagguuuuguaauacugaauuuauuuaguuuuuuucuacuucucauuuuuuccuuuuuucuguagacaaguuuucaauucccauucuuggucuaagauuuuguuuuuacuuugcccugugcucuggaccuucucugucaccugcaccucuucuacagauggcagugagaaaauaaggaagcuacuuacagucugccaagugcuguugacuuagcucagcacuucgagcuccaccuccucauuuguaaagcaaagugcuucugagucaccugccccagacggccguauuaacagcacuuccacaauuuuaguugucuuuacuuuuuccuaacacccagugacaguggcucauugcugaauucaucugccccaugcugguucuaagugcuacaugugacacucaguuucauuucaucuugaugacaagccacguguugggugaugcuagucugauuuucuaggaacguaguccagggaggccgagcagcuggucacagagccuaguaaacauaaguuugaacccggaacccaggcucagaccacugucuucuaguccuucaugaguucaagacuggccauuucuuccacaugaucuugccuucucucuaccucuguguuggcacguggcuuccucugccugcagugccugucaccucuuguaguuuuggcugucagucagcuguuguacuauagccaccagaaacauuggggagcauucucucuccucaccuggagguacuuuuuccuucugaucuuggcuaacauuuuauuuaagccucaguuuugacauuuauuuuaaucucaaaguuacuguguggaauucuugucuugguugcugucuccaugggugcccaugucuaguuuccuguuaguccacaguaggaaugagccaagaaccugaaggcacuuggaguuucuccaugaaguuuuugcuucuuaggcuaggaaguggcgaagaugcugggauacucagaggcacauggcauccuguugccauuagcuaugguuagcauuaucaaucauuuauccucuaaaaggaaaauccuuaaaguguuaggcuuuagaauggggaacaugaucauuuuaaauccaaacaguggaaagugauaggaaauaagagagaguacuugucccuacccccaagaguaacagucuuggguuacucucuguucguuauccaggugaccucaucauagcucaugccugcugaugaccucaugcuuucuagcauaucgugcuucuuagccuuggugaggucuccugagagguuuccuuccccgucguccucucaugugaugguuauucugugccuuuguuuauuaucuacuuuuucuuauuuuuuuuguuuuuaucguuuuauuacucccaguguggaucuagcggcacaucuauuuuauagaagcucagugucaggcugaagggaccauagaaacuugugaaaggauuggaaaacaguggauuguuuuaugaauguuuucagauggggaucacauaauuuuagagcaacuugucaggugggcaggugcacagaaacaguuauaccauccuuacuuuccuccagcaacucucaccuuuuuauugcuuugcuggaaucaguaacuugagcuugagcgagagggagcaaugcuauuagcuuuuauacuuccuucagagccaggaagacaagaguauuuucuuaggacagcagguuaacaaggccagagcugaauagaaguuuuagguuuugucaguuuugagacagugaagacacuaucccacuagggggugaaugaugagugccuguuuguaaacacgcuacuucucuagggcuuugucucgaaggauuuuaugauuugagcuucccauacucaauggaaguacuuacuauaucuaguuuaaaaccaaaccaaaccaggaugucuugugcaucucugaugcaguuuaggggguuuugauuuuuuguuuuaauuuuaagauaggguccuacuguguauucuagcuagucugcaacuugccauguagaugaagcuacucuacaugugguugugaguuggcuuguccugaugcuaauccaacccaggcucucagaaagagcaucucgugcucauaauuacugagccagcucuccggccuccaccuuacaggguuuuuuuuuuuuuuuuuuuuuuuuuuuugguuuuucgagacaggguuucucuguguagcccuggcuguccuggaacucacucuguagaccaggcuggccucgcacucagaaauccaccugcuucuuccucccaggugcugggauuaaaggcguggccaccaugcccagcacagauuuuugauugagaaaguaaguaaaacaacaacaacaacaaaaaaaaaccacaagggagacaaauauacuagaugaucucuuccuuguagcuguaaaauaauagccugugcauaaagauauauuugcugugugugucucucucuguuuaaaauucaugcuuccguagucccugagaaugcuacaaaguguaaucccuuaagccuuaaaauauccaauuuagaugcauguuauaucaaguuguaaaguauuuuguuaauacuaaaauagaaaaauauaaauguauuuaaaaacaaaguauauaaaauauacuaaaauuuucauaaguuaaaauuuaauuuuugggucuuaguuauuagagucaauacaugguccuaaaaaugauagguugcagagccugaggugucauaaaugugagugugucacacugcauuauugagcaguuuauuuuucaauuuagauucuugaagaccuggaugaacaaauuuauaugauuacucuagaagaagaagcacuccagagaagacuacaugguauguguguuacauacuuagaugagguagaacacuuguuuaguucaacagagacagauaauugaagaauggaaauauaacccucuccgaggcuuacaagugacaaaggaccuuccugacacaggagucugugaaaauuagagggaggugggugggucaaggccagagggcuagcuccccagcagacuuccacagugcuccuuggacaucugcaguuaaaagggcugcacacuuacccacugacuggggccugauuguuuucuuucugcugggaguagucuuucuuaggagauccucaggaacacuguuggcucaggugauuuuuauaucaguccaauggugauuguaucuguucuaguuggcaaguugccuuuaaaauuauuuuagggaaacucuuugauaguguguugccaugauuggccacugcagucuauuucagauggaaacuagcaggcugaaauuauuuauuauauaaaugauucuaggaccaaguugacauuugacuguauuaagaauuguaagcuucuguagcuuauugguuaacauccauagaguggaagaagcaaggagaaaagaacaguuuaugauuugcuauuuuaaacuuuaaaaaaauauuuauuuuauauauggguauuuugccugcauguguaucugugcaccccauacauauaguaaguagaugacagaagaaggcauugaucccuuggaacuaaagauggugugagccauuauuugggugcuaaaaaucaaaccugggucuucuagaagaacaaguagugcuuuuaaccacugagcuaucuccuaccacaaggauuugcuaauuuuagaaaaaaauagaaguaggccuuuaguaagguaagccuaacccuuauggauuuuauuaaauaugguuguacuggcuaguuuugugucaacuugacacagcuggaguuaucacagagaaaggagcuuuaguugaggaaaugccuccaugagauccagcuguaagucauuuucucaauuagugaucaaguggggagguccccuugugggugggaccaucucugggcugguagucuugguucuagaagagagcaggcugagcaagccaggggaaucaagccaguaaagaacaucccuccauggccucugcaucagcuccugcuuucugaccugcuugaguuccaguccugacuuccuuggugaugaacagcaguauggaaguguaagccgaauaaacccuuuccuccccaacuugcuucuuggucaugauuguacaggaauagaaacccugacuaaggcauaugguauaaugcuaaaugcauuuuguuguugcaguucuuuuauguuuuaaauuauaaagccaaaguauguuuuacccuugcucugggaagaauuauagaacagcaagaacaucagacucuaaaaauaugcucuugcugcugcuguguggaauugauaguggccuuuuacuaauggugcauuagugugcggucugugggguauuauuacaggcagcucugggguauguguuuucuccagugcauccuacagugcucuagggagacccuauaguugccugguauaagaaggccuuugcuguggugcuagcacuucuuucaccuugaagguagcauguuguagccagcacucuguaguugcauggauucccaugucuuuuuaaaugcauuaguguagcugaaacaugggacgccuaauuguggcuucuccaguguucuccgauacuugacugugcugccguauaaacuguugagugguuuuguucucuuucauaagccuugcgaaugaaauagcaaaacugugcuuggguacagggucagugcccugaggaagccauccuguccucagccuguccacuuucucaagcccaaccgugguuuuacauuagauauggugcagaugaauuaagacuauuucaagaugauacacuaguuaacugauggagaagaaagaaagaaagaaaaaaagaaagaaagaaagaaagaaagaaagaaagaaagaaagaaaagaagaaagaaagaaagaaagaaagaggagggagggaaagagaaagaaagagaaagagggagggaggagagaaaggagggagagagggggaggguggaagggagggagauagagagagagagagagagagagauagagagagagaauaaauaugaaaaaggcuuaguguccaaacacauaagagcguaggagggaucuacagaguucuacacagagaucugaauuccaugcuauccuggcagaacuuugacuccuccuguuccucccauagccuccgucgaauucuugcuggaggcucaaggcaaaggauguccuuagcccucauucucugugacaggugacaacagaugagucccgugucuggacucgugcuucuguguuucuaagugucuuauuucugacugggcuuucauguucccgagcuccuguaacuuuccaugugccgcuuauaucugaacaucaauccacuuuugacuccugcacccucaaccuccucuuuuugcucucuccagugccagcgcuguuguauccccagcaccuuuggguggugacuaucuucucagagccuagcuuugcucugggggagggugguacgucauguagcacaguugaacucuuuucuacauacuauccuuuuucugggggcccugcuuauuccucuucucuucuccagcacuuugaccucuuguaguccugucauuucugcuaccaggucguuucauaguagcuucuuguucccuagaacucucuuuucugauggcucuuucugaucugugauuuuucuaugccuguuauagccuuuccaauuuugggaagcgucuuggccuucuguucugguauucuaucugucuguaacgucuuggccuuguucucuacagugaucugaugcuugcacaucucacacucaggcauccacacucuuagcuaauccucuuauuucuucaacucuuuucuugucauccuccaguuuccacaguucuucaauagagacuuaguaugccacucucucaguagccuucaucccuguacgugcaguccuauaaccaaacccuuuugcucaagccauauugacugguggauuagaaauggagccugccagagugcuuucucagguucuugccuguguuccagggcuguauccagugaagcccaagcccuaccugcuuuuccuaauguuugugcuuaccccugauuguccugcuugcucuuccuucuaauaugugaccguuccuuaagucugcuuuaaagucuuuggaugacuuuucuuuuuaguucguucucucucucucucucucucucucucucucucucucucucacauuaugacccuuuuccucuuuccuuucauugcuccaaguccucccauauacccuccuuguucucucucaaauucauggcugcuuuuccauuaauuguacauguguguauauaaccugcucagucuauauaauguuacuuauauguauguuucaggguuaaucauuugguguuggauaaccaguuagcaugcgcuucucuggggaagacuauuucuucuacucucagcauuacuuaguuguauugcaggauauuugaucacacugugaacccugagauuguguuauuuaccgaaaaagaaaacuuuuucuaguugugguguggcucagccuguagcacacacuuuuaaucccucuggcuagaauacagauacaaccuuagugcauaguuuuaauuguaaauaaugaagaugaaguuagguuguagaaggacaugcuugaaaggauguuuaauugagcagcaaagugacuaaucagggaaagaauuaacagacaaggauuuccaacucucaucgaaagaguuaggaaagguaagcuaccuaagagagcggugcagagggggaaggaagcgguuuuaccaggacaguuacacacaaugcuuucauagagaggacaagcuggacagaugaagacagaaugagccagagaaugagaaggagccagaagauuagaguauagugccaaaguuagucucaggccaagcagacaaauuuaggagaggccaaaagagagacaccagagugaaucagucagcuuggagaggagcuuaagccagaacagcugaguuguaucaggcaaggagagaucagaaagagcuagaaaggaugcgcuuauucaucaguagaucucagaggcugaaaacauucuaggccuagauaggauuguaagaaggcuagaggcuuccagugcuaguacuagguuagugguaagccuuggagaugacaaucacccaggugaaucaaaguuucuuuuacauaguugccuauuauuuuuguguagaguugaggccuauggaacaauaaguaaagacaaguaaauuuaagcuaguccugaucugugggcagggguggggcaugggagagugggacaacaagagccccugggccuaguguaggcuuuugaaaccucaaaccccacaccccagugacacacuuuauucaacaaggcuacacuuccuaauccuucuaauuuuuaaaaauaguuccacucccugguggcuaaggauucaaauauauuagccuauaugggguauucuuauucaaaccuccacacuccuauucacaauagucucaaaaggagauaaacaaaccucaccaagguaguaaaggaccucggcaaugaaaaauuuaaaucucugaagaaagagauagagaaagacacuagaaaaacugaacaacaucccaugcucauggauuugguagaauuaauauugugaaaauaucuauuuuuaguuaaagcuauuuauagauucaaugcaaucccaaacaaaaucaucucauucuucauagaaauaaaaauaacugucuuacaauucauauggaaugaacaaaaaaggacaaugcugaagagaucaccauuccagauuuaagaucaguaacaaaaccguaggaauacaaacaguaugguacugucacagaaguagacagaccaaugcaauaaaauccaagauccaaacauauguaacuucagccauuuaauauuugacaaagaugucaaaaagauaagcuggagaaaugaaagcauauucaauaaauggugcugggaaaacuggauguccaccagcgagaagagcuguaucuaucaaucaucucgcacaaaaacuaacuccaaauggagcaaaggacuaaacuugaaaccugaaacacugaagcugcuauaagaaaacacaggaaauaccauccauuauauagguguaggagaggacuuccugaauaggacuucauuugccaaagaaacuaaacagcgucugcacaccuaaagaaaccaucaaccaugugaagaagaagccuguagagugggagagcaaccuugccaacuauagacccaacagaagaugauauccagaaaaaaaauauguauguguauauauauguauguguguguauauauauauauauauauacauauauauauauauauacauauauacauauauauauauauauccuucaaacacagagucaaaaaacaaacuauuuguuuuuuuuuaaaaagggagggaaacauggcugggacaugaacagagaguucugaaauuaaaaaaaaggguuauaaaauaucucaaaacaauguucauauuccuuagcaauuagggaaaugcaaaucaaaacagcuuugagauuuuaccccagucagaaugacaaagaucaacaaagcaauugacaacaaaugcugggugcagugugauggaaaaggaguccuuauucacuguuggugggauugcagacugguacaggcauuauggaaaucaauguagagaauucucaaaaagcugcaaauaaauuuaccaugaccccguucugccacucauugccauuugcccaaaagacucaauaucguacuauacagauacuugcucagccacauucauugcugcccuguucauaacagcuaggucaccuuuucuuugcucagauaucccugacuaccucagcugcugaccuuguuuccuguuacuugaggaaacagaagcaacuaugaagaagauguaccugcugcucccuuccaccaagcuugucacugcccauuaccugacugugcagccucaucucuuggccccaugccuggcuugacuuugcucuggggcaaguccaccuugcucagaugccagcccucgucucuguccaccgacccagggacuuagcugcugccauucugccuccucuccaagggcugcaugaagacauuuccaccugcaugaagacaacuauacauuuuuuuaaaaaauuguuuuuuauuauccauacaaaaaugcucacuucuauacgaggacaggaggacagaggucauguguaucaggcgcuacaugccagcccuuccccaguccugcaucuggcuuccugagggaacacugugcauagugaaggcccuggucuggggcacuggccacaucccuaugaauuguaccucugucuggccucugucaggccugugguacuuguagaaacuauaguccucugucaugacuuugacauaguaugagacccaacuugaaggcugaugcuaauacuucggugggguacuagagacugagaaaggacuacugggaaaaaaaaagagaugaugcucagagguacgaggucucggaggagcagugcugugagcuagugcacugcacggagggcacagguuaauaaugaggacagggcuggcaaggauguugggauacagggacacuuguucacuuuuggggaaacacaagcuggugcagccacuguguaaaucaguauggacacuguucacaaagauggaaguagaucugccacaugauccagcucuaccacuccaugacagauaagcaaaggacucucuaucccccuauaaagauaccugcugaccagugcucacugcuauucuaucacaauaaccaggagguagaaacuuccuagaugcccaucaacugcugaauggcuaaagaaaacaugauacauuuacacaauggaaauuuguuuaguuaaguggaauuacgacauuuacagauaauaaauagaucugguucaucagucauuaacccagauucagaaagaugagcaucacauuuucucuuauuuauggauguuaaagauucaaaguauaaaugagagaaaauaugugauacauacauacccauacauaaaaaguuuuaaugggcuuuuggucggcgccagcuccgggucaccuugggcacaaacucgguggacggucccauggauccuagaggacucuccaccgaucuuagcaucacuggugaguggaacacaacaucuguuccaaaccaauugugacaggccagugccagcagcagggaugcaggaaaccagccugaucagggggcucaagucccuucuggucggcgccagcucugggucaccuugggcacaaacucggcggauggaacuuggggcucuagcugcauauguagcagaggauggccuagucaguauucaaugagaggagaggcucuugguccugugaagguucuaugccccaguauaggggaaugcuaggaccaggaaugggaguggguggguuggggaguagggggagggggaaggagauaggggauuuucggaggggaaauuaggaaaggggauaacauuugaaauguaaauaaagaaaauaucuaauaaaaaaaaguuuuaauggagcuauccuguaauagggcaacaaucuacuaaauaccaugggcuaacaaaaacacagugcagguuggauuaucucuuugugaguuguuggcuggugaagucccauagaucccuaaacauuacagacuauugccaaugcuuuugguuacccuuccaaacuugacaguaaggcccaauugcugaagauuggacaugcaugcagaaaucaaacaguucaaaucaggaagcuucauuucuacuggcuagcuuucauagugcaggaaggcgguguacaagcuacuggggaagaaaaggaaucagguauuacccaguugugaacacugggagcuacaguagcaaguggccugacagaacauaauuaugauaggaaaguagauuugcuucuuuguucuaggucuugaccucaaagcuccucaugcaggacuugccauucuugugagugccgcaaguauuaguccuacauccucaaguccaccuccacugcacacugccccuccucaccugcuuuauuucucuacagucuuuccacucugugacacgccugucucuccacaguggacagagcuucucagggcagggagccucguaagugugcccugcugugcaagguacaggcuggguauaaagacuauauguaucccaugguuguucguuccauugguggguagauaaaaaucaaauaaaaacaccaaacaaacccaagguagagcauuaagaaggcaggcagggaaagugaaacucaaugggaggacagaaaacagaauccuggugacauguuuaggaagggugacacaggcacaguaaacagccgagguugggcagguggagaucagggauuucccacuguuguacccacacagucugugcaagcagaacuguuuacuuccagggcucggcagugaggacccauuacaguaaucaggagaaaaucauuuauagcucuucccaguguuaagaggcugcauauaccauaacaugcuuaacuguuuaaguaaugcagcagcauuaauugaaauaauuagauuuugugcguguauagcccauggguguacuggauaacuuuagaaguucuauaaugaauagaaauuauuuuuuuuuguuugaguucaaaacauuuacagcucuuuuaagguaauuuauuuuuaaacuauuaaagucuuugaacuauaauucaauucuguuaggcacuauuuucaucuuugugauaaaaauuuguauaucacuuuuggaggaguggcaguuucuugcuuguuuuauucuaaguaaguuuuuuuuuuuuuccaguacuggagauugaacacugggccuucuuuguacaugcuagccaggcccucuaccacugagcucucgccagccucuugauccuaaucuuuuuuuuuuucuuucuuuuuuuuaaggcuguucacauuaaaauuuacauuaacucuuuauucagagcacagaagcaguagcaguuuuuucuagguuuuaauaccguuggguucugaaaaacaaaggggcugaggagaacaagcugugccugugcagccucucuucccggaccucggggaccucggccagcuucugugucauugucaguauuugauucuugcuacuuagaaguugaguuucaggguuuugugaagauacugaaacucaggauuuaucuguggcugcuuugucauagugcuuucugucaggcacuuguguuaccgcuguacugcaggcaguuaggauauugcuuaucuaaugucauuuauagauggcgaacacaauagcuuucuuaaucaaugaguaaagaauaccucuuugaauagggauauaagcaccauaugucaaguacuauaguaggcuauauguauaaauuacuguauuuguuugccuacacaucacacacacacacacacacacacacacacacaccucuagggaaauauuuuggacuucaacucugggauucuaugcaaaguguuugggcauagucagacagccuagacuugauaguguaucuucagaaggcauuuguauaaauagggaugaaacagugacagaagucaaaauuuauuuggcuucuuggucccuuugagucacuuucauauaauaaaauguaguucaaacaaauuauuugcugcaagagugacugagggaagcauaaacuaaaagggccauuuugggaaacaaagccgaagacuguggaucaugugucauacauaguccuuggaauuaggaagagaaguuguauuauaaaacucacacucaaaaaaucggaaugugauuccauauauuucagcuuucuuucaaccacaucugugugaaugcugguguuaccauauuugauggcagaauaaaauaugaaggauaaaggguggucuuaacaucuugucuacuucaagaucuauagugcuugugucugaaauagaaaaaagaccaaagcauuuuuucauuguaucuaacauuacauaauauuuuuaaagcugguugucuuaauauuuuugcccuugcuugcaguuauuaguagugaaaguagguuugcauagccaccguuuuugaacauuugaaguccuauaauaccgggaucauagucaugugacaucagaagccaaaagauacaauaauguuaauagcauagaggugguuugucugugucugugugucugugugugcaugugucugugucucuucuacaggcaaccucaguguuaguacacaaacaacagaucuacuggagauuuggacaugaggcuucagcaucuggaugccucaaacacaugugguuucucuggggacaguccuuuugcucaguccuaaggagccuuggguuugaacaaucacuuuucuauuacuugaaauaauuaucacaacuugaaaaaucucucauucuuagagauggaauugcuggugaaauuuaaaguuguaaccaguuaaaauuuuauaguuacuuggaucaaaauuuuaaucuaccccuuuuguuuauaugcuaaauuaaaaaauauaaagagaauugguuuauacuacuuuugaauaauuuaguacccugauugauuuaagguacagaauuguuguggaaauaacuuuauugcaucaagcuauuuuaauuguaugcaugccuaguucaaauguauguuuguuuaaaaauacauuguauauuuaauaucuguccuugaacaucugauguccuugaacagcugagacugucuuguccauuggauaaacucagauguugaagaaaugcuggaguuugggaaauucuguuaucuugggagcaaaauauuuucaguaccacaccaguuuuucgacuuaagaauaaaguugggaagaaugccuucagcuauuaguuuuccugaauccaaagacauggguggggcaggaucaaaaauacucauuugaucaaaguuauuggcucugaagguauucuuaccuguguaaggaagaugaaagguguuguuuuuauugcaugcuaguaacaguguaauuuugaacuaauugguguugaacugccaaucaccuggggggaaugcaaauagauacacuuacaauuuccuuugagguagugaaaucuuaugucagagcuggaagaaaaacaguaaauugaccuuaaaugagcugcuuugugguuuucuuggagaaucccuuuuuauuuuuuuggacuuguccaaacagguuuuugucugcgauuugacuuauugacuagacaaugcugacacugaacauuuuggguuuguuuugaaauaaaauaaugauaguauaguuuuuaggauguuuucauuuuuugcacaacuuaaauuuauauaaugguugaguguuuguuuacagugugucauauauccucauacuggccauuauugaguuuugaucauuuguaaugaaagauucugucccccaaagcuugauuuuuguuugaguauuaauauauuagcauguaaugaaggaagggaaugaccugaaaacucauuuugagugacuuuuuggaggacaguaggaauguggucuugguuuucauggaaggucgcaucaccucucauguccugggaguuagucaccugagguaaagagcccauccagaagcgcgacuucagaggauuggagagacggcucacugauugcucuaccagaggaccuggguuuaauucucagcacacacaauaguuuacaaccaucuauaaccccagucacagggagucugacacccucuucuggccucugagggcacugcaugcaugugguucacagacauaaacauuuagggaacacaccguagacauaaaauaaaaauuucaaauaucucuuguuauuuuucucugaagaaacaugcauucaguguucuagacauuuguacuaagccuuguagacguaccaugagguaggcugcuacucucuucacuuaauuucagauugacaccagaaauacuguccugguagccauucuuuuccaaaguucagaauaguuaucaauuguucuccaggcuuaaaaaugauuaauaucacuguuagauauuuuacaguuugauuuaaagguauuuagcagucuuacaauccugugcuguccccugcaagucuucguuucuucuuucccuuggagaugccuacuaacuuuguguccuaauugcuucccuuuugcuuugguugcuagaaccugaaaacuaaauuuguagcuaaacuguaguaguuuugggucacagugcuugaauaucuguguacuugauguguaguccuacucuuguauaaauaaaaguugaauauuaaugaauaaaauaaugaagccaaggcauccuggagacacauagaacuuucagccaacagguggcacuagaucucuauuuuuagugaugugaggaaauaaggggacacaaaugggaaacuuaggaucugugacucuaggaucuuaaaaaagaaggcuaauauccacuuaucagugagcacauaucaugugaguucuuuugugauuggguuaccucacucaggaugaugcccuccagauccauccauuugccuaggaauuucauaaauucguuguuuuuaauagcugaguaguacuccauuguguaaauguaccacauuuucuguauccauuccucugcugagggacaucuggguucuuuccagcuucuggcuauuauaaauaaggcugcuaugaauauaguggagcauguguccuucuuaccgguuagaacaucuucuggauauauguccaggagagguauugcgggauccuccgguaguacuauguccaauuuucugaggaaucgccagacugauuuccagagugguuguacaaacuugcaaucccaccaacaauggaggagugcuccucuuucuccacauccuugccaucaucugcugucaccugaauuuuugaucuuagccauucugacuggugugagguggaaucucaggguuguuuugauuugcauuucccugaugauuaaggauguugaacauuuuuucaggugcuucucagccauucgaucagccaccaaacgcagacacuauugcauacaccagcaagauuuugcugaaaggacccugauauagcugucucuugugaggcuaugucagugccuggcaaauacagaaguggaugcucauagucagcuauuggauggaacauaaugguggagcuagagaaaguacccaaggagcugaagguguggaacccuauagguggaacaacaauaugaacuaaccaguaccgcagagcucgugucucuagcugcauauguaucagaagauggccuagucggccaucauugggaagagaggccccuugauauugcaaauuuuauaugccccaguacaggggaacaccauggccaagaagcgggaguggguggguagggggguguggggcgggggacggagggcggggaggguacaggggacuuuugggauagcauuugaaauguaaaugaagaaaauaccuaauaaaaauuaaaagaaaaaggcauuugaauuuccacaguggcccauagugaaccuauguggcccaauacuccuuggcaucuuugcuugaaaaugaucacuguuugccucuacuagucagguuagcuuucuuucuucugauucaguucuuuuggcuucuugcucuuuaguccccaagaagaccaagccuuggcgaacuuccagcuguuugaaguaccaucugcccuaauuagguaugaaggaagcagcgguaaagacagaaaacagaagcaggggcacucauuuagggccagugcaccuagcaagugagacuuauuuaagaguaaauuggggagacaggaaagaauuuguacaagauagaauuuguaccuauccuccaaauguaacaagaugggucaaggagauguaugagaaaagaaaacaaaacuaucuagagcuuaaaaaaaaaaaagcaguaaaaagugaugacccaaagaugcccauuucuaaucuccagaaccugugaaugugguacuuugcaaauaugguuagaauaaaggacuugauauucaugggcauacaggguaucugguaggugcaguguaagacugcaggaggauggccaaagaauggaaaagacaauggaagcauaagugggagugguuugaaaaaggucugagagccaagguaugcaauuagccuugaagugcuagaaaagacaaagguugacucucucccagaaugcccuagggaccaucuugcugacaucuugaugguaggacuauagacaucaagaacuacaagacaauaaauaaaaggcuuaugguaauuugguccagcaccauuaggaaguuaauaucgucuuucugaaaaauuaaucaccuggcugauugugguagaaaaaaucuugugaaucacagaccagacuauaggagaaaaccauugaugaaauaauaauuauggaccacugagguaagguccuaauguaagcacauauauagauggaaagaaacuaacaaggaagaaaagguggucaaguaaauaacagggaaaguucaucaggcugacgccgagugcagauucaaagccauagaggcucacaggagagauuaccacauggacauugauaucucugcuauuguaugccuuuucucuaaacagggauuuaaaacacugaaauuuauccuacugacuuccagauaugauguaguugagcuggugccuaacuagagucuucaccccuccugacuaguauacaugguaccagaagguacugaguuugcuacuagagaagaaagguaacuaccagcucagcuauaaagucuucugaucugcaacagugaccuaucugugugauaugcugguauaauaguggcacagacauugugggaguagccagcuacucugauuuaaggcccacuccaggaguuggaaccuaugcaucacacugcuuugguagccaagaacccgagacuagauaggucuugggucuaggguaaaauaaaauacuauuguccuguuaaaggaacauagcaauaaaaugacauauauguauguauauauucguguguauauacucauguguauacacacacacacacacacauucugcaauacaccauugcucagccaucuuccauauuuagguggguacuacuacagaaaccuacaacugaacaauuaaugaagaaugagagauuucugaauauugaguuccaaaugggaugucuucaucaaacccuuccucucagggaucagggaacuaugcagaagaggagguggaaagauuguuagagccagaagagauggaugacucuaaggaaacagugucuuccauacauauacagaauugaugcacauacaaauuuagagacauucacaggaucugcacagguucaagccaggggagggggaggauauucaggagcugcgaggagaauuguagacaugaucugcucaagaagccaucuccaauugacaaaccacuugcaaagaaaaauuguuuuuuuccaaugggguuucauuggguauauuaaccacacuuaagaguaggccccauguccuguaguagguggucagcaaaaaauaaaaaaugaauccaaugguauuuuuuguagacuuuuugucucauauugcucuguuugaacacaguuacuggucucuuauauauuaugguuucuauauuuuuuuuuguuuuuauggguuuuguuugccugcuuucugaagagagauaaaaagaaaggaaagaaaauguagaauugggaggguaaggggaguggggaggaucugggaggaguugggggagaggaaauugucaucagaauauauuguaugaaaaauuauuuuugauaaaaaacauuaaaaaaaagaguugugucaaacuuaccaucugcagcuugcaguugugaagaguuacacauguuacuuauugacuaggccccgccccccccccaaaaaaaaaguagucuugguauauuccuuugacauuucugcauuggcaccugcauugacaccagacacuaaucuaacuacugcacagaaugaaaaauguaacaguacugaaauaauauuuaagcaagaugaggauuuggaagaagggguggggagcagugaggaaaugguuagcuaaugugaguuucaccaugacacggaaugcuuuacagacuagcaggcugacucaguaggagugacacaagugagaagguaagcacuggaauacgcaggaacaguccacacauuugcccugcacggagggaaagugccagucuguacacaucaaucuagugugugggaggcacaguuuagucccuugaugucacuguugagcugcuggaaaaccaugcggaagcuuacucuggcucuggcucuggcuccuaacuucuaauuauuugaaacuauuuccuuauuuuuaaaauuucuuugauuuugagacuuaguggaaagcauccugaugaguacaugccaucccaugggugagaacagagagaaucauaaaccuagggcgucaggaaauuccacgggaaaaccaccauaauaacuuagaauucagcagacaagaaaauguuagaauuagccagauuaacagaacaaaaggaguuuauuccuaagucuuuauuuauacuuuagaaucccccaaagucacaaagggacaccaccagauaagguagcaugagcuaagaaagggaggacuuguuaaaaagcugucacgaaguagcuuaauugcuacauucuuugcuuccauccaagguaccaggcacuugccuccugucugucuuagaagaagcguaaacauuucuuucuguguaaaacagagggucucuggccugguaggguaggagugcuugcagacaaaguacauagauuccguccuucuccuuuugcauagcugaacuuuaauuugagaaggaagucaggguuuuucucaggaacgugcccagcuuaagaagaaagcucuguagcuccagcaauagggaaucacuggauuguuaggugugaaacucaucuugucaagauccuccagaugucugaaguucaaauuggcauuuauuccucauggcuucauuaaaacacaagaacacaaucaaaacucuggugacugaagaaagccucuugugugaacacaaguagacaugggcauguggauguggggcacauggaagaauagcuaaagaugagccacccgucacgccuuguauauucaagaaggccgcuuucaugagaaaggccaaggcuccaccaucugggacauccgguuaacagaaagagcucuugaaacucagagauaagaaaaugauccagaaugacaagagugagcaagucuuagagguaaaaauguuccagaccuguacagccagccucuagcuaacaccccuuccacacaggguuaagagagagaauaugguggggaaaaaaaaggaucaagaaauugcucuaaucugauacgugaauuuggggauugaaaaugcucacguguguccaguggaugugucacugcacagacauguauucacagcaagaacacugggagcaaagauccuguacaguuuacaguggcacugacaagaagacauuccugggguaagacugagaauugcuccagacuucauaaaaacaguauugcaacuguagacuuaaaggcuuaucuccagcuuguggugcuauuuugcacaaugguucucaaccuuccuaaugcugugacccuuuaauauaguucuugauguuggggugacuccuaaaccauaaaauuauuuccacuguuacuucauagcaguaauuuugcucccauuaugaauuggaauguaaauauguuuuccgaugggguuaggugaccucugugaaagagucauuugacuccuaaaaggguugcggcccacagguugagaaccacuccauuagaaggugcaucuuagcagccagaagcuggaggcauguccuugaaggauauccugucuguagucccuucccuucucucugcuuccuggacaccuugagauuugagaaaccaggaaagcaccucagggugagguguuaucagggagaagcaccucagggugaggugguaucagggagaagggggcauugacacagguccaagggguuuugacacuaagcuuugugcacacuucauucugauaaggguaagacguaaaagucaaugaaaacuaagacaaauaguguggaaaguugauguucuauauuuuacugaauguaauuaggguaaauugacgguaaagacagaaugaaugagugugggcuacuuagaacaucaucuuauucuagguccuccuugucuuuucucugauaaagccaaagcuuuguaucuuuccuuuccuagcugaaguaggaagcacuccaaagcuuuccauucugagucuagugacuuaaaggcccugaugauuggggugaccucuuccugcugugcugugcucaccaaggcuccagaagcagaucuuggggaagggguucucuaacauucuuaccucuucugcuucccuuuucuugucauucucaccuauuauuucuaagucucgaugugaauuuccaguuccuguuguuauaucuccauuuucauuucugauucugcuaauuuggauacugucucugugcucucugcuuaguccagguaaggguucaucuaucuuguugauuuucucaaagaaccagcuccugguuuuguugcuucuuuguacaguucuuuuuguuucuacuugguugacuucaggcuugaguuuauuuccugcuguguacuccucuuggguguauuugcuucuuuuuguucuagagcuuucaggugugcugucaagcugcuaguguaugcucucuccaguuucuuuuggggccacucagagcugaguuuuucucuuagcacugcuuuugugucccauaaguuuggguauguugugccuucauuuccauuaaauucuaaaaagucuuuaauuucuucuuccuugaccaaguuaucauugaguaggcguuguucagcuuccauguguaugugggcuuucuguuguuuucguugcuauugaccaccagccuuaguccuaugggauuugaauguguaugggauuauuuaaaucuucuuguaucuguugagggcuguuuugugagugauuauauggucaguuuuggagaagguaccaugaggugcugagaagaagguauauucuuuugauuuaggaugaaauauuccauagauauguuaaauccauuugguucauaacuucuguuaauuucacugugucuuuguuuaguuucuguuagcaugacaccugcccagugcugagaguggaguguugaaguuucccacuauuauugugugacgugcaaugugugcuuugagcuuuaguaaaguuucuuuuaugaaugugggugcccuugcauuuggagcauagauguucauaauugagaguuuuucuugguagauauuuccuuugauaaguaugccguguccuuccuuacccuuuuugauaacuuuuauauggaagucaacuuuauuugauauuagaaugccuacuccagcuuguuucuucagaccguuugcuuggaaaauuguuuuccagcucuuuacucugagguagugugacacugagguguguuuccuguaugcugcaaaaugcuggguccuguuuacauauccagucuguuaguccaugucuuuuuauuggggaauugagucuauugauguuaagagauaauaaggaaaagugauuguugcuuccuguuguuuuugauguuauuuuuauguuuguguggcuaucuucuuuaggguuuguugaaagauuacuuucuuggcccuggcguuccccuguacuggggcauauaaaguuugcguguccaaugggccucucuuuccagugauggccgccuaggccaucuuuugauacauaugcagcuagagucaagagcuccgggguacuggucaguucauaauguuguuccaccuauaggguugcagaucccuuuagcuucuuggguacuuucucuagcuccuucauugggggccaugugauccauccaauagccgacugugagcauccacuucuauguuugcuagacccaggcauacucugacaagagacagcuauaucaggguccuuucagcauaaucuugcuaguguaugcaauggugucagcauuuggaagcugauuaugggauggauccccggauauggcagucucuacaugguccaucuuuuuaucucagcuccaaacuuugucucuguaccuccuuccaaggguguuuuguucccacuucuaaggaggggcauaguguccacacuucagucuucauuuuucuugaguuucauguguuuaggaaauuguaucuuauaucuuggauauccuagguuuugggcuaauauccacuuaucagugaguacauauuguuugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguuccuuccagcuucuggcuauuauaaauaaggcugcuaugaacauaguggagcauguguccuucuuaccaguuggggcaucuucuggauauaugcccaggagagguauugcuggauccuccgguaguacuagaggcccauuggacacgcaaacuuuauaugccccaguacgggggaacgccagggccaaaaaaaaggggaguggguggguaggggaguggggguggguggcuaugggggacuuuugguauagcauuggaaauguaaaugagcuaaauaccuaauaaaaaauggaaaaaaaaaagauuacuuucuugcuuuuccuagggaguaguuucucuccuuguagugcuguauuuguggaaagauauuguauaaaguuggcuuugucauggaauacuuugguuucuccaucuaugguaauugagaguuuugcuuggaauaguagccugggcuggcauuuguguucucuuagggucuguaugacaucugcccaggaucuucuagcuuucauagucucuggugugaagucugguguaauucugauaggucugccuuuauauguuacuugacuuuuuucccuuacugcuuuuaauauucuuucuuuguuuugugcauuugguguuuugacuuuuaugugacgggaggaauuuguuuucuaguccaaucuauuuggacuuuuguaggcuucuuguauguucaugggcauuucuuucuuuagguuagggauguuuucuucuauaauucuguugaagauauuuucuggcccuuuaaguugggaaucuucacucucuucuauaucuauuauccuuagguuuggucuucucauugaguccuggauuucauggauauuuuggguuaggaacuuuuugcauuuugcauuuucuuugacuguugugucaacauuuuuuuaugguaucuucugcacuugagauucuucuaucucuuguauucuguuagugaugcaucuaugacuucugaucucuuuccuagguuuucuaucuccaugguugucuuacuugugauuucucuauuguuuuuauuuccauuuuuugauccuggaugauuuuguucaauuccuuuaccuguuugguuguguuuuccuguaauucuuuaagggauuuuuguguuuugucuuuaagggcuucuagcuguuuaccuguguucuccuguauuucuuuaagggaguuauuuauguccuucuuaaaguccucuaucaucauccugagaugugauuuuuaaaucaaacucuugcuuuuccaguguguuggggauccagggcuugcugugguucuaugguucugaugaugccaaguaaccuugguuucuguugcuuauguucuuccccuuaccucucaccaucugguuaucucugguguuagcuggucuugcugucucugccuguggcuugucccuccagcaaggcugugugucaguacuccugggagaccaguccucucuggcaggaauuuggguaugaagagcuguggcacagggucagcuccugggugcagagggaaaccugaaggauccuguccccagcuguucuugguucuuuugucugguggcucugggcaggucccucuugggccaggaauuugaacagaagugguggucuuaccuguauucacaaauauguccacacuccugggagaccagcucuaucccugcaguauuuggauauggagcuuuguggcauagaaucagcucugggcgcuguggcacaggauuagcuccggaugcagacaguaacuggaaggaucuugucccaggcuguuccucaguuacuuuguccugagaucuccaggcaggucgcucugagcagaaguagugguuuuaccuguacucacaggugugucugcacuucugggagaacaacucucucccgguaguauuuggguaucaccaaugaauucuuaacugauagagauuagcuagaugaugauuucagugaaacaaaugcacaaucauggcaaguaaaacccaaaaaugaauaaaaauguaaaaguugucaaaauauaauuuaggaaaauggucauuaugaaaugauaaaauguaugcuguacauuacuuauacguaacaguccuagagauacaauaagggagacccucagcagucaaacacacacccacaaugaaaaccauuccuuaccagcagagaaagccuaaccuggcacauugcugucuggggguuucaauucaucuguuucagaauuuaagagaucaagcagaaagaagaggaagauacuguacuuagaucauugcagaaguaagcagaaaguaggaauggaagaaauccacaugagaaacaggagaugugaucuguugcauuuaggaaaauguauauuuaaguagcucaucgcuuugacaaaaauucaaccauuggugauacccagugcuaaugaugauauauaaauaggaguuuucaaaagcuauugauaguagucagacuuauuauaauuugaauuaucaugguacauaagaucauuuggggaauguaaacuuaaaaaguuccuaaaccuguaauggcccccacuagucugaaguuuggaaaucuguuuuacagcaguaauagaagcaaaugaauuggauauguuaauauacacuagaauauugacaaaugaaguaauaauucugaguuagguuauaguaauccagauugugguuugcacacucagcuguuaggaaauauuuauugauaggcaacagcaaacagcuaaugugccuggcuugauauuaguauaagaauuugcaugagagagaaaauccauaugugagacagaauucaaauaugaaugugaagaaagcuauggaagcaccagccacauuggugauaauugucaucccagggaggcaaaauggagagggaagguaugguaagcacaugaaaacaagaguaauauaacugagcaagucagggaaggcaucuuccuaagaaacaugguuuucaguuaucaagagcaugaaugcucgagagcagugguccuuaccuucccaaugcugucaccuuuuaauacacauucgugguauggugaccccaaccacuuuauaacuguaauuuaaguguuguuaugaauugugauauaaauaucugauacaagauaccuaauaugcaaacccuaugaaagagccguuuaacccccacugggguuguggcccacagguugagaaccacugcucuaaauagugaguuuuuacauaacucacaacagcgucuguuccucccagcuaucagugaguaccaaauguuuuguauauuaacuaaugcucugccuguucuccaagcuuuccacugcuacacuuaaugcuuuugcuuuaauagggcuaucuucaucgguggaguacaauguaauggaauuggagcaagaacuugagaauguaaagauccuuaagacaaaauuagguauuguacuuuuuucuugguuuauuuguugguuuuaguuaguuauuaagauuguaaauuaguccuaaaauauuugaaaauuuaugaaaauuuuguguuaaaaacuuacugugcucagagucauugucuuucuuuugggagagguuaaguauauauuuuugaaauuacuuuuaaggcuuauuuauuuuuuuauguguauaaauguuuugccugaaugucuguguauucccuagaacuggaguaccaaugguggugaaccaccuuggaguauguggggaaugaacccgggucuucugcaagaggagcaaaugcucuaagccaccgaggcaucccuccagcccuuaaaguuacuuuucaaauauacuaauauucaaagaugauguguuuuuggcucuugacuugaguagauuuuuccuguauguggguacacacaugccacauacacaguggaugugcaggucagaaaacaaccuguaguaaaagguucuuuccguacaucauguggguuuccaggauuggacauaaguugucaggcugguggcagguacccuuagucacacagagucuuguuagccccacuugcauuguuuuugagaaaaaaaaaauauaaacaacuccucugucaaugugauuuuaauuauuuuuuuuauuguuuuauuagauguuuucuucauuuacauugaaaauguccccuuuccucauuuccccuccaaaaagcccccuaucccaaccucccuccccuugcucacuagcccucccacucccuguccuggcauuccccuacacuggggcaucgagccuucacaagaccaagggccucuccucuccuugaugucaaugugauuuuaaaaaacgugcuucuaagauuuuuuuuaacaacugauauaagguaguuugauuaugacaugccuuaaugugguuuucuuggucuuuaguucaucaaguuucauggauguaggaauuacacuugucauauaucuuagagauauuuugcuuuaauuucuccacauauuuuuauuuucuacuuguguuacccuugugaggaacuucaguuauuugcagauuggcugaagcuccuggcugacgcuuuuuuuaacuccuuucucucuguguuuggcuuuggauuucuguugcuauguuucaaucgucucaaccuuuuuucuguaggucugaucugucucuuaccccaacugcuguauuuuggucucagagacuggguuuuccauuuugcuugggccaauuaucaucaugcugcuaauugacauugcuaaaucuguuuccuuuaccuuuguggggggaaauaauauaguuaugagagcacucugagugugugugcucacauacaugugcauuuguaugccagaaauuaauggcagguuuauucuuuuauugcuuuccacuuuguuuuuucuuccuuucuuccuuucuuucuuuuuuucuuuucauugaauuuguagcuuacuacuuagccagcagucuucagagauguuucuuucucugccuucccagcccuggaauuccaugcuugugccauuauaccagacuuucucauguggauucuggugaucaaacucagguuuucaugcuugaaccgcagguauuuuaccaacugagccauuucuacaccccucugagaacugugcuggcugucuagugucaaugugacacaagcuagaacaguaguucucaacuuaccuaguacaguuccucauauuguaaugacccccccaaccauaaaauuauuuuuguugcuacuucauaacugauguuacuauuaucaaucauaauguaaauaucgacguuuuccagugguuuuaggagaccccagugaaagggucauucaacccauaaaacgcucaaccacagguugagaaccacggagcuagagucauuuuggguggaaccacucuuggagauaugguccugaguugucuaagaaauggggcugaacuugccauuaggagcaagcuaguaagcaauauuccucuguagccucugcuucauguccugauuccacacuccuguccugaguuacuguccugacuucucuuuaugacaauggacuacaauuguaagcugaaauaaauccccuuucucccuagguuacuuuuggucaugguguaugucacagcaauacaaacccuaacaaagacaagaauacuucuaauauuuuugccuaugaauucugacaucuuuguuaguccugauaaguuucaaauuauugguuuuauaguauuguuuuaauugugugcuucuuugcaugcuuggcaauuuuuggugggaaaauagggauuuuuggauucugauguuuuuugcaucccugagaggaagaaacuaugguuuggaaugcugacagcugauucaguaaccuagaaucucaguagguuggaucagagcacuggugcuccagggcaccggcaaccaucaugugucaucuauccuuguggcccaugcaacuguggggaacucuucccucaugcuugucuucagccaugaauuguuucguguugccguugacuaucugaggugacccuugggagauuuuuguguucuuucuuuguccugacgucucaucucugaagacuuacuaguuguuuuccucagacucacauuucauguuuucaggaugagaaugagcagaacuuuucuuaguuccuucucucagcagcauggccuggaaacucaagaugauaagcugggucauuuagguucauacuguucucuguccccaaaggccauugcauuucccuugaccagaaguccagggucugagcauuuuugugugugugugcgugcgcgugugcauggacacacacacaugccuacuugcuugcacuuuucucuuuucuuucuuuuguggcuguggcuugauaauuucauuauuugaaacauuguuggucauuaucuuaacaauuuuuaucugucucauuuucuuugauuucuucagauuccaguuaaacacacacuagacuuuccccauucuucuaucaccuuucuguacccuaaccucucaugcugucuucuaguuuguuucccacuguaauaucucccaguugugccuugacuguuguuuaagguuuuuguugaauucuuuagucacaguaucucucagcucugggauuucaucuggcuguuuucauugguucagauuucuuugucaguuugcuguuuugccacuucuuuaguugacugucaacuaagucuguguguguacuaagagagggucugucccuguugucucuuuuuccucuuugccuccugguaauguuugacuucuggauauuucuuacacaaaacuguagaaacuguaagacacuuucuucuuuuggguugccucuuagaguguccaugucugucugucugucuuuauuccuaggggauacauugguccugauggaaaaccuggguguuuugacugcuuccuagugaacucuugguuggguuuggcagcauugcugaacuccaagccucucagcuacaucuccauuccuuuuuguagcuuuucuauuacugaggccuuaaggaggaaggaaucaucauagcaggccuacuucuuuaucuguuccuuauuucugagauucugcccucucaauuucuagcugcguugcuagcuccaagcucugugcuuugucuucuugccucuguuagguuuccugagaguuuugccucagcauugcugcuuuugccucuuuuacaaaaauaaaggggaaccauccuguguuugugugaguaugugugcauacauagcuucuugacuauaugugugccacaugugugcagaugcccucagaaccccggggagcuggaguuacagguaguugugagccacacaauguuugcuaacaaccaaauccagguccucuggaugaggagcaggugcucuuacggcugagucacuccaggcccuugccguugucucuugauuuccacuugauuucucagacuuuagaacccaugccagcuccauauugaaaaaugccuugcugggacaggaugcucacaggaaggguucuccucugucacaucacacagugucagccuuuccuaaucuauugcuuuccuucucuuguugcucuaauacaucuggagacuguuuugaaguuuaaguuuucuuucccaguguggaagaaaaauuaaacuucuaugcuucuuccuaucauggggaggguguggcacaaaguggcuuguuuuagcuugaagguaaaguuccuuuauaguccuuggaaaacaaaguguucauucagccuuggggccugaaacuagaagggauuaggauucacacgucuuuauaugcucaaauaucugccuauaucaguauauacauguguaucaagugcacauagucuuauccuaaaagugagcuauucauuaaugauauauuccuuuaagagcaagauugccuuuaccgagcugaaauguaagccucaugggauugagcuuuuaauguaguaagcugguuuuaaguggauuuuuauaguuuguagaagauaauuaaaaacaauuuaucuuauaaucuacauuuuucagaaaguaaaaaauaauguuuacuaguugaaauauaaucagguauauaaaaauaugaaccuggaaagaauuuuuggaaauugcugaaauuuuuauuuuauuuucuuucuaauagagaggaggaaaaaggcuucagcuugggagagaaauuugguguauccugcuguuaugguucuccuucuuauugaaacaguaagaagcuauuugacagcuugagcacaguguauugucuuuuguguuucccuuagccaggcuguuuccaggaaacuguguuucuguuaacagaaucaaaaucugccuguuucucaauuuguaaaaauucagcagagcaaaaauggaaaugaaugacaauuagauaagucgucauaagucgucaagguuuaacuuccucaugcagcaggaacuucaagcuuacuucagaauuaggaaaacacaaagcacggcugcugcuccagagucuuccuuucuaagaugggcugugggaaagcucacugcagcacggucugggacgcuauggcucucucagcugacaugucuacauauuguuaucuucuaucaugagccuugaaauuauaauuuacagaauacuuggaauuugucuuggaguucuuauauauacuguguagaguauauauacucauuacaggacuucccccauucugaaagacacauguuauguguguugucaaaaguaguguuugaaacugagaccugacaguaccauuucuguugcaguccauuucaguccuccugguggcgugcaauauucuuugccugcugguugaugagacugcaaugccaaagggaacaaggguaaaguuaaaugcauucaaaagucuuucuucuagaugugugucugaauauuuuguguaagcuuauggaaacaucuuucuggauguaagcauuucaagcccaugaauuucucugaagaaaaagcuuuuacaaacauguucauaaguauauauauacauauauauguguguguguauguauguauauguauauauauacacacauauaauuuuauauauaaauauaaaauaucuuauguauaugguauauauguauuuguguguguguguucuucuguguguguguaugugcgcauguaugugugcuuuuguuucuagggcauuucuuucaaguaucuggguuauuuauagacuuccgugucagacuugauguugauuuuuacugaaauuuuuauuuguaguucuugaaagaaaaugcaugauguauaaaagauagaucagcuagaccucacaaacuuauauguuggaaaaguaaagggaauuuuuuaugagaaguaucaaacauuuaaaaugcacuuaaacugugugguuauuagaggauagucuagauaaacuuuuuucaugaguugauuuuuaucugguuuaaagauugaugauucuacuguucauggcacaugcauacaguccuaccaccuaaaggacugaauguuuugaguuugaguuuaagaucaaccugggcuacauguuaagacugucucaaaaauaauuccaaacaaaaaauauugaugcuauuacuagagucuggcaguuacccuauuuuaccuagauguuauguuaggaagauguucaucauugaauacuuauacuugacuuacagucuuuugucugcaaugcucuugccucagccuccuaagugcugagguuacagguuuguaccaccauaucuaccuugcaacacuuuccagguccuauaaaguuuggaaacaccccucuucugcuguuggugcacaggcauacacacauacauguacauacucaugugcauguguaaacacauguuuugggacaggaugacaugucacucagccuggccucagacuccuuagggacccaaggguuaccuugagcuucugauccuccugcuccuaccuccuaagugccaggauacagguaugggccaccaaacguagcggcuuuccaggccucauaguagugacauugaaacccuccugacuuacccugucauguuucucucuaaggcagauguugucagucucugucuuaauuccuuuccuuccaccugagaugaagauaugcugcuuugaauuucuucagccauuuuugugacuuucauaagcagcagcaugugugagcgcuccuccaccuuucucaccuugcuucccccgcucucccuggaggccuugcuucugcaguccuggcuuugccuuuuucuuuuauuguagucccagaucaggaggcugcuccugugacugagcugacucucacugcacuguaauguagcagaagagcaggguguauucugugccauccccucagugcacacuacagugacuuguacuucuaggcucucuguaugcuugucuaaaugugugagcaccucuuuaucuuccugucauugcuuuugauacagugaauauuccagaacauuuuuuuuuccaucuugccaguaucccuuuguagggaggaaaguaggaucuuuuccuuacccagcacaggguucaugauggagguccuaguagcaaaagacagauuaaugagagaaaaguggaugaaauuauuuaauauaaaauuuauggaagcuuagcuuccauuuguugggaagaguggugggcaugcugggucaugauggugugguuggugcacugcucuugaacucuaugcuccacugcuucuggauccugccuauagagagagggagucucagccccuuaaaaagggugcuaauuugggauuaaauuaaguugaauuggaaccugagcacuuaccccuggguaagucucaugugcucacucugcucacgucuggaacuacugccauggguuagucuuucuccuuuauguccagaucagagugugcauauaaugugugugauauuagcuauucucuucuauuuuguuugcugacgauguuuugcuuuaucucugcuguuguaauuuaagacaacuaggggaauggugauguguauuuagagauuauccuuucaucucuagcaguaagcuuugaaaauguuguuccuacuuuaguggacugauguuugcugucaguuaucaguaucugaacguuauuuguucuauuuugccuaaguaaagguaggucucgagauuagauaauauuuauuaaaauguauguauuacuuucuguuuuguuaaaauuacuuuuuuuuuuaaaaaauaagugcuauuagucacauuuuuguaacugaauuaucaaggaaaauuugggaaaaggaaauuggauauauugcuuuauuuguaaacauagcuuaaauuggcaagguuuauaguauaauuuuuauaugugcuucugcauuaauuauauauuauucuauuaaaaaaaaaaaacaaccaaaaaccuccccagugagcaguaccuuaccugggcagcauaguagaacuagcuagguaguugggacacaggugagcugucccucgggguaugaucuugggagagcuagcccugccccuagcucugcagcaugugagagcuggccuggagggcaugagagcuugagagcaagugagcuggcccuguccccuugccaguugcagaacucaagaaagugggccuugccccuugcuucggcaguacuggagagcuguaaacugaccaacuuagcuaccacccaggccccgauccagggcuuugaguuagccuaccccaauaucuacuuugucuaugaacuguuggaacacacgaaggggccaguauugcagauccuaagcugcaggaucuccaugacacagggcaacagcaagauaucugagaggagucccaguaaggauccaguauugaaaguauagcagaagccagagaccucaaacuagaccaaugccucauugcaacaaacauuugcaugaaaagcucuuugggcaaaaggguauacugugugacauaccauagcacaccucagcuuccauagugagauuuuuuuucccccuuuucugugggagguuuggggaaaugagagggauagugaggcaugcuggaaaauuuacaaauaaucaguaaaaaguuaaaaaaaaaaaaaaagaaagaaaacuccccagaaaauucaauguauuuuucucagauagcagaucaucccauuuuauagcagucauaaugauaucauuuuggcaaaugucuuaaaaguacauuugaggcaaaccagguuauauuugaaccugcuaaaauuaauagucuuuggaggauucauacuaucuuaagguguuaaauguguaauggcaucacugaauucugaggcguguuuuccuugcagggccccggcauaggaagugccucucuuuccacuuuuggcuuugugggagcugcacuugaaaucauucugauuuuguauccuuucuucaacugaauguuaugucuguuaacaaguuuucugucuaguuucugggacaauaguaauuuacuaaaacacuuguuuggaaagaaaaacaacgcaguccucugcaagccucgguggcuguuuguuuugguuugcuuuuccuaugggcuuuagacuuugggaagugugcauucucuuggagaguuuuuccuucauucucacagcuaucucauggugucuucuguuguugguuucuauagccucagauuuuuuggaaacuuuacacccaagaaggaugacacaacuaugacaaagguaagguaaagucuuagaugccauggcuuuucuuuugcuuccaagauaaacaagugcuuuagucaguaagcacccugaauagcucaucuuggcugagagguauuuguaaguagcggacacacaaaggaagguuuucagaaugcugagugagugggagaggaugugcucuguguaaauuggacugcauccauucacuuguaaaugcauagaaccacgcacuugguaacuaguuguggaagucuccugaaagaaagaacccuuguuuuucuuaaagaaaacauauugcuaaugaguaacuugggcuguguuaacuguacuucaggagcuuguuugaaaucugaagagcuuaguugcuacaaguggcagagaaaaaguauuucaauucugaauaauuaaagugagaaggaauagcucuguucagagacaguguggugugaggcuaauuugauacaguguugucacuggcaccauagcaauaaagccuguuauauuacauaauaaauggaucuuuguaaaauaauuucacaggcugccuaaggggaauggcuaaaagcugcuggucuuucccauuuuuauuauauaagucuauauuuacaucccacaaguguguggguacacacacacaaugaaccccauugauaauauauauuacauauauugaaauuuauguacccauccacccagauguaucauacuaaagguuucuuucguuuuguuuuguuuuguuuuucgagacaggguuucucuguguaguucuggcuguccuggaacucacucuguagaccaggcuggccucgaacucagagauccaccugccucugccucccaagugcugggauuaaaggcgugcgccaccaccgccuggcauacuaaagguuucuuaaagucagcuaaguagccaguguccaguugaggugguuauaaauacuaaucgauguuuucagugccucuuauuggaggagaaucaguaacuagaagauacauugcaaaugaauuacuagauuuagauguuuuuguuucuaguguuuucaaaucccagaauugaugcuuauaaugguuauauaggccagaguagauguuauauaagaacuugacagcaauuagccuuuaagauuuagucagaaguccaaagguauucucuuguuaauuucauaggcaaagcuuucaaauuacuaacuacauuaaaauaauauaaaauguauaugauuuauauagucuaugacuauaugcuugcaccuauacucuguguuuuguggaauucauaaauauaauuuuaaagggaaaggcuuauuauguuuaaauucuacucugauaguguuguuaagaaguugccgggugcuccggguaucugcucugcacugcccucccaagagugcuugagggguucuuugccuccugcugucuccuugcaagccauccuuucuuuccacagaucauugggaauugugugucaaucuuagucuugagcucugcuuugccugugauguccagaacacuggguaaguuugacuaagaaaugcucaguaaaguccaugguuuuauagauaacuuuuuaaaaucucuuuaacuuuuuugcuuuguaaauucuuuuuuuuaauuaccuuuaaaauauaauauuauauuauucuauaguucaauuguguauaggggcauaccaaagcaaacaaagaccuuuuuuuuaagcacuuaaacauuccuuucccaaacaauagacuuuuuuuuucuuacuucauucauaaguugggcuuuugaaucuucuagugaggaaacugugacuuuaaaaaaacacuucagugccuagaaaauauuaaaaaaagauccauguaugaauauauuuccaaauguauaguguaaugugugcuuuuaaaaaauagaaacuuguaaacuuguuuuaagcuguuuugagcucaugaaaauagagcugagcaugguguugugcagucccugggagcauacaccacaggacaguuuuuaguccugucaucucuguuugccugccaaucauaauauuuccuuaaauuaucaauguacaggcaggguuuacugucuuuuaaaaguaaaagagaauucuauuuuaucggugacauaguugacucauaagucagucauuuguccuuuauaaugcacuauucuagacuguguucuuggcuaaauauuauuucagacagauguuucuuuuaggcaguuccauauaauucucuagacuuauguuuuaacuuuguaaauuaauguuagaaaaagaccagacagaguauaucugugaacucugucccuggcuucauuggcaguguaggccaggggcuugcucugcuccaaaacugccuccugaggguucaugccaucaguguugcagcugugucagaaagcgggagcuuuguaguagucuugugugcuuugauaaccaguagaauuaaaguauaaguguaaaagaacuucucuuccacaggcuauuuauuuagugagugugucucuuucauguuugauugguaggacacaucugcuuauggugagcuaauacugaaacaugaaacaugcacauuagugccaccauuugaagcuaaaugcuacaucuguuaggacaguccagcagauacugggagugaccagccaccuuuccauuuugaaccuuugaaaaucuuauuuauugugcuuuguuauuuaaaaguaauugauaaucaugaauguauuucgauuuugagggagaaaaucaccugcugaguauaggcuuacuacaaacaaaacaaauuaauggcaaaauuuacuuuuugaagccugacaaauuaaauuccugaguaguuugccauagagauaaauaaaaagaaaaaaaaaaaaaacaacgauggaacaauuaaaaugcagcugagaagcucuuggacccagcuguccaaacaggauuaguggagugugcugcgguacagugagucauguggcgcuguggaagacagcgguaugcacugcaguacguguuaugcccaguggcacugaauagaugaaaagaguaaauacguuaaacagauucauggaggcuuucugcaguauuaaaacagcaaaguucuagacuagagauaaagccuuauuuuaguauuaugggaaaugcaaacuagagaguuacuguguaaucugcuaaugcuuuaggauugagucuuugauuuuaagaaggugagauacugaugagugugccccugcugaagagcaggauugugaugcaccagcugaaaagcuugcgaacagaauaaaggacgcauuuaccacaucccuagcugugaaaauuucucucucuccucagcucucacaaggagaucugaccucaacuugaucuccuuugcuccugugagaucaguccacagcaucugucauuaggagaaaugggcacacagcagaacagaauauaggaccugacaucugagugauguuugcugaagaggagaauuuuaauuaugaauuuaaaguacacugauuccagaauaccauagugaauuugaugauacaguuguuuaaggaaaugaaaauguccaauagcuguuuucuuuuaaaaaucaucagcugcuauuguugaugaagucuauagcucgagguuuaagugcaugaugugacuaacauggccauugaagcauuacucucagauagcuuacuacauuugaaugggggaaguggauucauugaaaaaugugcgcuaaauaacuuaauaagcuuaucacuugcuacaaagaaguugugaggguuauuuugaacaggcauuuuaagucaaugaaaugaauguaguuuauuguauguaguaaauguaagauuuuuuugcauucaacccuuuaaaaccuguaagagcauugcugugccucccgagagcugacacauuguucugguguguggucagacuuugguuauaaagaaucccuauuuuggcauaguggaugcucuucuuuuaaguaauagaucacuguuuaauuuaauacaugccaaguauaaugagaggagaugguugcgacagguuggaaucagagcaguuaaucaguucccugcagaugcucagccauguguuuugaagaacaucucagauacugacagugugcuguucacuucuuggcugggaagacaagugagguuuuuuucaucacucuucaucugaagccccagagagguuuuccuucaaguucaggcaacaguuuuugaaauauguuugcuaguuauguuuuaaaacuauuuuuaucuuagaaaccauuucugcacuuuauaacuaacuaguuaugcaaggccaaaaugcugacuuacaaaaguaugauacuaaaacaaaaguagucuuucagaucagcuuguauauaguuuagguaucuccauuuguuugguuuuuuuguuuguuuuucgagacaggauuucucuguguagcccuggcuguccuggaacucacucuguagaccaggccggccucgaacucagaaaucugccugccucugccucccgagugcugggauuaaaggcgugugccaccacugccaggcucaguuuuauuaaagacaacaaauaagauguuuuaauuaacuuauguuugaacacuaaaucuguauaucugguuaggauuucuaagaauaaggaauugcugcaacucuccugcauuccaugugagagucagaagagccgcuggugauaguccuuagcucaggccucccuggccaugcucuucagugcuaugcgggcauggcagucaaaauguagccugcugauguaguuccuaagcuguagucuguaugaaaguaauuccauuugggauuaucuggugagaagacgccuucagagucuacuuuaacaugugaagugaaggugcuguuguccgagcucuauacuagagagccuuuaccuacccaagugaguaucuccaguggaaugcaugcuuugagacaagggacaggccaucucaguuguaggauauuuuuaaaaugaauuauauacauaaauacauaaauagacuguauuuauaagaguuagauugggcugaaguggcuucuggaccuggagggcaucauccugagugagguagcacaaucacaaaagaacucaaaugauauguacucacugauaaguggauauuagcccagaaacuuaguauagcgagauauaagguacaauuugcaaaacacaugaaacugaagaagaacgaaggccaaagugugaacacuuugccccuucuuagaauuggaaacaaucacccauggaaggaguuacagagacaaaguuuggagcugagacaaaaggaugaaccaucuagagacugccauauccagggauccaucccauaauuagccuccaaaugaugacaccauugcauacacuagcaagcguuuguugcagggacugcgauauagccgucucuugugaaacuaggucggggccuagcaaacacggaaguggaugcucacagucaacuauuggauggaucacagggcccccaauggaggagcuagagaaaguauccaaguugcuaaagagaucugcaacccuauagguggaacaacacuaugaacuaaccaguaccccggagcucuugucuuuagcugcauauguaucaaaagguggccuagucggccaucacuggaaagagaggcccauuggacuugcaaacuuuauaugccccaguacaggggaacgccagggccaaaaauugggaaugguuggguaggggaguugggggggagggugugggggaacuuuugggauagcauugaaaauguaauugaggaaaauauguaauaaaaaaaauucaagauaccauuuucauuaauuuuugagacuaucauguuuacauacaaugugcuuuaauaauauucacccuacucccuuuaacaccucccagucuccucucaacuuugugucauuuuaaaaguccacugaugcuuauucguguugcccauagucuugggcccucuaguggagcauggucuacguaccuagggucauauuauuaaagaaaacuguucucccuccccagaagucaucagcuucaaaagcuucccaaccaagguggguggggcucaugagcccuuccauacuggaaugcugccugacucuguacggugcaggucuugugcaggcaaccacagcugcugugaggucauguguucagaaaacaugguuugauucaagugcuccccaaccucuggcucuuguaaucuuucugcccccucuuuguugaugagauccgagccuugguugggagcugugauacagauguuuucauuguggcugagcacugauauauuuaguuuuugcauuuugaucaauugugaguuucuauguuaacuacugucuacuucgcaaagaaaauuccuugaugaggcccgauagcugcacuaaucuacaaguauuagagauagugaauuuaggggacagauugauauauccagcucuccaaccauggauuccuggucagauuuguaguaugaggcauauauuuccuuugguggagcaggucucaaaucuaaucagaaaguaauugguugcucccauaacacucaugccaguuugcccccauaugcuugccucaugguuguuauguuguucacaaggcucacagcugagucagacuguucaugacccucucucccccagcacccuguagcaccuucuaguauugugagagccagaaggaaggacauuuucgguugaguaccagcuggauuucucuaugugcuguggccagaguuuguggucuggccaugcuuucaguccuaguucuuucuucuguuuccagaagccacuuuguucaguuuuucagauuuuuauuuuccuggaggugagugcauguacucaauaggaaacccagguaauugcaccuggguauuacuuuguuucaaaaucuuuuguuggcuuugcuguucuuucugaauucccuuaacucucugauucccaaugggaauuaagaaagguuuugaacucacuuccucugucagcacucagccaucugaaaaugaauuucaaaccaaauuagaauuaggucucucugcaggccgcugcugacuccugggucgccucaugcugugguauuuggcaguugugaucucaccagugaaucucuucuuuauuuauuaacacccuuucccccuguuuuuccccuucuuugucaaucccuugacucucuccuuaauugcucccacuaguuacuuauuggaaaauccacagcucucaucccucaucccuccacuugccccaugcuaaccaacgaccagccuaacucugggcugcucugggcucccacuugauacugcacaggccauugccaaagcagagcucauugcugucucauuagucuucaggauacuuccacccaagacucuagccaaaucagaaaccccuucccacccaucuuguuuaccuccugaacaacugagaggaaucugugugugacaagugggcucuaggccuucuuguucuuuuuuuauuuugaggagaguaggguaagaagauuugagcucaaaccaaaagagagaaaaugucucugagagacgcuggacccccucugaagacuccgucugcuuaagggcccagauguuuguuucuaucuuugaaagaaucgguucuuucuugagcucugguguucuccauccuuguauuuaguugauauuuagcuucacauaaugaacuucaccuggcuacuuaauuaaaucaccuucaauuagaacaaagugaguuuguaucaaauacagucaugaaaaaugauaauuccagacacauuucucuaccucuaagguuuaguuucauguuccugaagccuucugccuuugaccuuucuuuacuguccaaagacuccuacuuguuuacacuugcuuauuggaauugauguuuauuuauuauuaaucauuuuauucaucuacauuucaagugauaucccccuuccgggucugcacccucccaaccccccacucccaaugaauugauguucuuaagaaacuuuacauuccuuaaagggcaagagcccacuuccugcaucuugucuugcagagccuuagcucauaagcuccugugaucccagagaaacuccucauugaggagggcuguucucagugcagaugaaauaauuuccauguaccuugucucaauuuuccaugucgucuuucauucuuugagcuuguuugacgaaguauuauuucaaaagcccuuuacaacaauagccaaaagguggaaguagccugcugucagaugauaggccaagcaaauugucguauacacaucaaauggaauguuacuuagccauggaagccaguccaaagagacaaacucugugggguucugauucuaagaggaauugcaguagucuagucuauaaagacagggauagguagugcuuaccagaguccucgggagggaggauggagagaguaguuugggaauaguuucagauuugcaagauaagggaguuuugugguaaugguuguaaauaaugugacuauuauuaauaguaccaagccaugcauuaaaauaaaauuguuauacugguacaauuuauguuacaugucuuuuaccacaauuaaaaacgaaggaaaggaagucuauaugauacaagguugauggaauuuggaaacaugucauaugacagagccuauauagaaauggccaaaugcugugcgauuccaaagauagggauagggaugaugagagagucucaagagaagcugccuuguggauuuggaguuucccauuggagagcuacacuuguguucaaacuggggagaagguauuuaaggcccucgaauuguuugucuaaagugauuaugugaugugacauucaccuuaguuauuuaaaaggaaaacccauuacucaauaaugugcacauuauuuuccuguccccugccauggcacuguacugaauguggaagccuuacugcuuggccauucaguuuccuuugagugucucagcugcuuuccaauaauaugacccagauggaguuggagggaacggguaagaaggacaccacagguggccaaggugcuacaaguagugcccacucuagcacaccaacuccaacuccaacuuucuuuguucauuucccccacucucuucuuuucucccccccccccccccccccccgccucccaaucuuggcagugcuggggauuggaccuaagaucuguauucaugcaaggccaaugcucuacacuuaccaagcuaaagccccaucaguccucugaugauauacacuggcagggaggguuuaggcuguugucugcuuauugauguguuuauuguggcugccuucuacuauguucaguaugucccuuucuuucccugcuuugcuggaauucuuaugcagaugguugguggauuuugccaaaugccuuuuauguguauacugaaacaaccacacacuuuuaaaaagucucuaaguauguugaauuacauuuauucucaaaugcuaauuagccugcuguuucuugggugagcuccaugugucaugauauauuaucuuuuuuggguugaauauggugaaaauuggcuaaagacuuuuucuucaguguuuuugaugacauuguucugugguucuccucccauccccuauuuuuauuuuuauuuuucgauuuugauguauguguaaugcuuuccucacuacaaguguucagaaaccgacucuucaguucccugggugguuuuuguagacuuguuucuuauccucagugcaccauugcuuacugaugauaccauuugguuugaaauuuauuuuuuggaaaggauuuggcaacaguucaguuucuuuuauggaaagagcccuacucagccgggacaagcuuuguuaaugucaucaacagugucaggucuguggguagcgaccuuagcuacuagaagaaguagagacuuagcacuuacagaucuuuugugcuuucuaccucuuuaccugagcugugugcucauguauugauuuauugauccucucacagaagcagcauucauugcauuuuuuuuucuaguuuacugauuuagaccuugggaguaacauuuucuaacugcaauuggagcuaaggucacugaacuuuaaggucauuuucuucuuuugaucugagugguuaacugcgugcacuccuuguccagcuguuaccucccugugcugccccuccccacuacauaguuauagcauccuuguuuaugaaucuacaaaccuuccauauagagcauguuaauuuuuauuuugucaaaaaaaaaaaaaaaaaaaaaggacauuugcuucaucugugugccaugcuugucaguguuaguuccgcugucugcagguguccucaugcccucuagauccuuagguucacuuguuuagacugcuguugagaggaccgugaagcacuggcuacaacugugagccucucucuccuguucuucaccaguuugcauugauucuuuaaagcuuggguaccaguugcauaagcguggggucccaggugaacccuuguaauuaugguaguggggaaucguuguuuaacugguaauucuucucugaagucuccuuugagucauguuaaaauagucguuuuaccuuccuuaugauacuuuucaauucucauacuauaaaccugugucuuuauguuaaauagcuauguaagccugucuggauucggauauuuagaguauucauaucaauuuaacuccuggugugauccuaucuguugccuguuuccauccauaccauuuucucccuuguugcccugucugcuucaucugcauucuuagagauaaacuaauccuuuuuuuggucuauagacauaacucuaagaaguaacuugccaaguuacuucaaggcuuaugcaguauuacuuuugugaauugggcaguggcagugauguucauagucuaucaauuguaagcugccuguauuccuuugaauauauaaguagaagggauacugcuggaucauauagaaauuaaguuuugauuuuuuuuuuuuuuuugagaaaccaccauacugauuuccauaguggcuauaacagcuuacauucuaaccagcagugaauagguuucuucccacccccugccccauuuucaccagaauuuguugcuuuuuguuguuucuuugauaaaagcaguucuggcugggguaagaugaaucuugguggcauuuugauggcuaaauguuagauuuuuuuuacauguauuuaauagucauuuuaaaaauugcuuuugagaacuguucaguuuguuuauugaauuauuucucauuugguguuuuauuuuuugaguuaaaauagucuauguauuaaucuccuguuagaugaauagaugccacagauuguuucccuuucuguaugcucuuuaauucucuugucaucauauagauuguuagucugacacagucccauuugucuucucuugcuguugucuuccugaguuguggguuccuguccagaaauccugugcuuguaccuuguaaauuuuuuuuuuaacuuuuaguuuaguaguuucaaaguguuaggcacacugcagguuuuuguuuuguuuuuuaaaauuguuuuauuuauuuacauucuaaauguugcuccccuuucuuggucccccuccaagaguucgucaccccauccucccucauccacccaccccaacuacuccccucacccacccagagacugagccaccaaccaaagaacauauacaggaugguaugaggccccagcacauauguagcagaggacugccuucacuauuuuuuauuucugucauuacuaaucucuuuggauuuucuauuucauuuaaugcuuuucuucucauuuugucucaauuuauuauuuucugcuugcuucauauuuauaaaccuuauuaaagcucuaaaauaucuacuaauuuucuuuuuuuacacuucagauuugauuccccuccccauacaugcucugacugagccacaucccauaccucuucucugaucccgucuccaugaggauaccccuccccgcccccaccuuaaacucccuggggccuccagucucuugaggguuaggugcaucuucucugacugaacccagaccugucaguccucugcuguauguguguuggggaccucauaucagcugguauaugcugccugguuguugauucagugucugagagaucuuggggguucagguuaauugagacugcugguccuccuaugggguugcccuccucagcuucuuccaacuugucccuaauucagccacaagggucagcagcuuccguccauugguugggugcagauaucugcaucugacucuuucagcugcuuguugggucuuucagagggcaguaaugauaguggagucuuuuugugagcgcucuguagccucaguaauagugucaggccuugggaccucccuuugagcuggaucccacuuggggccuuucacuggaccuucuuuucccucaggcucuucuccauuucuaucucugcaguucuuucagacaggaacaauuauaggucagaguuuugacuuugggauagcaaccccaucccucacuugaugcccugucuuucugcuggagguggguucuacaaguucccucuccccacuguagggcauuucaucuaagguccucucuuugaguccugagagucucucaccucccaggucucugguacauucuggggcgguccucccaaccuccuaacuccugagguugccuguuucuauuuuuucugcuggcccucagggcuucaguccuuuuuccccaccuaguaccaaaucauguuccccucuccccaccuuccuguccccuuccccucccacaucccuccuuccucccccccuugugguugcuuucuucucccucccaagugggacugaggcauccucacuugaccuuuuugaguucuguggacuguaucuuggguauucuguacuuuuuuuuuuuuuuuuuuggcuaauauccacuuauuagugaguauauaccaugcauguccuuuagggucggaguuaccucacucaggaugauauuuucuaguuccauccauuugcuggcaaaacucaggauguccucauucuuaauagcugaguaguacuccauuguguaaaugaaccacauuuucuguauccauucuuuuguugugggacaucuggguuguuuccagcuucuggcuaucacaaauaagaccacuaugaacauaguggaacacgugccccuguggcaugguggggcauguuuuggguacauuuccaggagugguauaagcugggucuucagguagaucuauuuccaguuuucugaggaaccuccaguuugauuuccagagugauuguaccaguuugcaauccuaccagcaauagaggaguguguuccucuuucuccacauccucgccagcaucugcugacaccugagguuuugaucuuagccauucugauugguguaagguggaaucucagggucauuuugauuagcauuucuccgaucacuaaggacuuugaacuuuucuuuagguguuccucagccauucaagauuccucuguugugaauucuccguuuaguucuauaccccauuuuuugguuggguuguuuguuuuuuuuuugguaguuagcuucuugaguucuuuauauauuuuggauauuagcccucuaucggauguggaauuagugaagauuuuuuuucccaaucuguagguugccgauuuguuuuauugacuauguauguccuuugccuuacagaagcuuuccagagucaugaagucccauuuauccauucuugaucuuagagcaugagccauuggaguucuguuuaggaaauuucucccugugccaaugaauucaagggucuuucccacuuucucuucuauuagauucaguguaucgguuuuauguugagguccuucauccacuuggacuugagcuuugugcaaggugacaaauaugaaucuauuuucauuuuucuacaugcagaccgccaguuagaccagcaccauuuauugaagauucuuuguuuuuuccauuguauauuuuuggcuucuuuguuuaaagaucaagugugcuuaagugugugguuuaauuucuggccuccaguucuaguccauugaucaaccugucugucucuguaucuauaccaugcaguuuuuacugaaguuuuuaaucuucugaacugauuuuugugcagaggcaggaucugguuuugguucuuaguguagauaaacaggcuuuguggcacacuuguuaaugaggcugucuuucucuaguacuuuuguuuccuuugucaagagucagauagcuguagcuuucuucugugucuucuacaucaauagcacaugugacuacuucugugccagugccaugcuguuuuuguuacuacagcucugugaucuaguuugagaccuaguauagcauucuuggaauacaagucugcugcuaauaaaucccaggcuauuuggaugucuaagauagcucuauucugccuuacuuuagaagauauucuuagacaugagaauuuagauuauuuucucuuaaacuuucaaaauagucuugcaucauuuccccuuugcagugcaaacuuugguaaaaaaaacuuucuuugguaaucauuucuguucuuuucuuucucguggaaagcuuggcaguuugauuaaugcaugcuuaagcaguauccuacucagauuuuuuacuuuguguugauuauucauaugugucaucaaauuuggucuauuucuaguugauaauccuugagccaauauuuuuuucaaggaauuuaucuuuuuaaucuuguagggauugugugugugugugcccuuguguguacauguauguguuugauaugugugguauguauacgucuguaugugguguguguguaugggcuuguguugauguuuauguacaugugugggugugaguacagucucacacaaggucaauuucaugugucaucaggcuccgucuaccuugauuuuccauacuggguuucuaauaggcugugaacucaucugaguagaauagucuggcugggugaccagcagcacccagggauugauguuauguuuucauagauuuugggaauugaacuuaggucauuguacuuacauaggaagaacuuuacuggccaagcaucacuagcuagagugaguguaucaucagacacuuggagucagcuuaguucauuaacacugguacuugacuuguucuguuuugugucccaagaagggacuaagagcauuaagcaugaggacagcuuagggagcagagaguugcuuggagugaggccuagcaaagaacugagcagaaaacccagaaaugacuguuuccaauggccacagccuuuccuaaaguacagaagguagagaaagagacugaacuuacuaaauacguacacagaguuuuaaaagccugaaguuggcauauaaaggaaaaguacaauguaaaugggaaaagcauucuugauaggauaagagcugguuagauacuacagaaaucggaaaacuuaaagauagccaaaucauuauuugauuuuaguuuauuuuuuuaauauaauuuuauuaauaaauuuaauaagaacacauguuguuuuggcaccuuuacauuaaaaucuuggguguuuugggucagauguuuguguacuaggccaaguuguguaauuuacugauaacaucacucucaggucuuuugugucccacccuuuacaaaggcucugaauggccucaugcagcuccaccaacaugaacaugcuugcucagagcagaaguugacucaggugggcuaaagaacaggaguucuauugacuuauccuguggguggggcaacaugcuccuucuuagaguugguuguauucugugcaccaguucuuuuaaaaaaugugaauagagaacagguuguuuuugaaggaauuacucauucucauuugaguccuugugggagaagcagugcauugcuuguuaugaaguguucuacugaggucacaugacccugugccucacugcugucuaaugaaguuacuuuguguauguguugcuucccuuuuaacagugaugggaugggugaagauauuugaccaaagauauuuaauaguuuaaucuuguacuuuaaaacugucuuaauaccauguuaucuuuguccagaaguuuagaaguauuauacauuuauauaauauacauuacaucaguacuuuuuuucuuaagugucaauaauuucuaauuaaaaaaagacguuuuuuuauuuaauuguugcugggacaaaagccaccuagccauaauuucagagaaaugauuguuuuuuguuuuuugguuuuuuuuuuuuuuugcuucuaaguaaagaguuauuuaugucuacucagaauaaucuuuugguugaucaagaucagucagauuuuuucuaaagugcaagugaaacaauagugucuuuugacccaagccugugaacuagcauuuuuguuccucuuggguuucuguauaugucugccuggaacaaaacuuuuuuaaguaagagacugcccuuugccuaaacauccuguuguauccaguggaguccauuucuaggguguaugacuaccccucucacugucuagaauuucuauguucagugcgacugauuugaacccccucccccgacucugcuuuuuuguggacagugcaaagcuaucuacaggcauacaacagggguccccaaugguaucuguauacccacacagguucauuaacgagaagagaauauggaccuuguauuuguauugcuguuaaggugauucuguacauagaguaauggaucaucaaaugcacacauuaaacacaugauccacguguuaaaacccuaucagccugcucuuuuugcucuuacccagugcaguagacaucauccaggauacacccagguucuccuuugggagccuuauagaugcagaagcuugaguguaccuuucucacgggauaacuauagcuuuugauggacucauauggagaacuuuggaucuugggaucaauucaguugccaguauggggucucagugacgccuugagguuuguguugguaggaccauaacuguuuauauagcuacuaacaucaauuaaauguucugauuugaaaaguaaaguaucugauuaggcuuccauuucauuuaacaaaguccuuucuuuuaggcuuagcacugagagacuaaggcaaaguugucaguauuuuaaaguaauacaggacaggcacuaaaggccuuuuucugguaucuggguuuaaaacuuuuuuuuugguaagguauuaucaaaugucuucauuaaucuucagcuauuuuaaaaauucuuugccaauaucuuucaaacuuacaugcauugguuccaggugggagugacuauggggcuaaauuugaauuucccuguucauacuacacuguuugcauaggaagauuucugccguucaugagcuucucugggaggcuccccguaguguuugauagaauuguguuggaucauggcugaaagccaaauucaaaagucaguugaugaugugauauugagucaaaguuauuuuugaaaucacccauaaaauccuuaaauagucuauagcuguacuggcugguuuugugugucaacuugacauaggcuggaguuaucacagagaaaggagcaucaguugaggaaaugccuccacgagauccagcugcaaggcauuuucucaauuagugaucaaggugggagggccccuugugggugggaccaucucugggcugguaguuuugguucuauaagagagcaggcugagcaagccaggggaagcaagccaguaaguaacaucccuccaaggccucugcaucagcuccugcuuucugaccugcuugacuacuagaccugacuuccuuugaguuccaauccugacuuccucggugaugaacagcaauguggaaguguaagcugaauaaacccuuuccuacugucuuagucaggguuucuauucuugcacaaacaucaugaccaggaagcaaguuggggaggaaaggguuuauucagcuuacacuuccauacugcuguccaucaccaaggaagucaggauuggaacucaaaggaagucaggucuaguagucaagcaggucaggaagcaggagguuaugcagaggccauggagggauguucuuuacuggcuugcuuccccuggcuugcucagccugcucucuuauagaaccaaaacuaccagcccagagauggucccacccacaaggggcccucccaccuugaucacuaauugagaaaaugccuugcagcuggaucucguggaggcauuuccucaacugaagcuccuuucacugugauaacuccagcugugucaaguugacacaaaacuagccaguacaauugaccccuugucaacuugacacacaaacacaucacuaguaagccucaacccuuuccuccccaacugcuuuuuggucaugauguuugugcaggaauagaaauccugacuaagacaauagcauaugcaguacauagcuguguuuguacaguccuacaggaaguaucuauugcaucuuguaacucugauauacagccucauguagcccuucagugucuccgagacucuaccacaccccccuucucacuacacucaaccacaugacuuguaggauuuauauaccuaucuauagucagaaaauccuacuacucauguccagggacacagacucagggaacaaauuuaaacauucuuucaguuaaaaagucuuuaaauuguauaugugagugaauuuaaguaaauccauguaugaugcaagcaucacacauucccagcuucccacucuuauucuauaaauuuguaguauuuuggaacuggucuuguuuauucaguuaugugaugagcguuaggaauggguaaaguguugccacuggaaaugagauguagaaguggaauagacaucauauauauguaaguaguggggaagaacagguucuagugaauggcaccuaagcuuggucuuuaauguaggcaugaugggguacucaugccagucacacaugcaagugacuggcaugugaaggucagggauggcuuggguugcccugcuaggaagcagucguaugcuucauggcagagucuuaccacagaacucuacaaaccucugaggcagucuguggagucuggccuaaucccaacugcauuuguuacagguauggacacaccccacuuuaguaagaacucuauuuuuauuuuuuaauaggaaucacuagauucgaucuacuuggagacuuuggaagauuuaauuggcugggaaauuucuauauuguauuauccuacaauuuacucuucgccaucaugacaacauuguguuugaucagaaaauucacaucagcaguacgagaagaacuuuucaaggcccuagguaaucuugagauuuauagacauuuuucucuacuaaucaugacuuuaauauuugucucucuauuuaguuucuaagugugcauggcugucagucccauccuugacucauguguuggugggucuggaucagaacuuugucacuguacugcaggaccucaucuguaaggugugugaguaggaacugugguuguucugauggggccucaggacagggcggaggacaugauaagaacuuuaggauggcagucagcccuuucuguuuaucauuguaucauugugucauuguaucauugugucauuguaucauugugucauugugacauugugucauugucucauuguaucauuguagugaggaggaagacuugguguugcaggcuugguuuuuaucaugguaccuuuuaccauuauuuacuugaaguuuuaggaggacuuggauuuccuaagugaaaaagcaauauauaauucucgccaguaagccauauaacucuggaaaacaauguuagcauucuugguauggacaggauaggguguuugcuuucaugucuccaucauuuguauugugguaaagagccugcucaagugauaugucuuugcugcauuacuccuacacacaugcugaacauaguccuggguuuguacuuuaggguaagcagcacuccaaaagcuucccaggcagucauguagcauuuacuccauagcaguaaagaaagguggugguuccuguaggaaacccuagcauuggcucauuugccugauaccacuugaauguuuaugcuccauauagguuguaguuuuagcuauuucaagaggcaacauauugauagaucuauugcggccccagcuucagaaagcuuaaacuauagagguagcaauaaagcuucuccuagcaccaaccuuaugauccugguguuugaaaggaugaccuuugaagaagcaaacaccagguuacaguuccacauguauuuuauuuguaacaugcacucugagaauauagcugguugaaauacugcccuaggaugaaaagcuaugucucauuucaacuaaaacaccagauaauuuaugaauuuuagugucauaguaucaaacacauuaaaaauaggcagaugcauuagaaucaagaaacccucaaucacgugucuaguugaaacauuuuuagcuaggaucucagaucaauuccagcuuggcuauaaccaagauggcugcaguguaucaguguuggcauuuugcuguguagcuucuguaaaaguuauaagucaaccugccagaggccagagagaggcccugugcaucaguuugaccauagacauaguguaguuuucaagaguuaugugaaacucaagaguuguguuuauuuuucaaauauuuucuauuaucuuuuuauauauuacuuaggggcaauucccuguauagaaaagauccuuuuuaaauauauguucaaauggcccaagguguuaagucugacuuuaauaaccaauuucauuucuaacaguuuucagagaacaucugcugcacaguagcaacaguagugauguuaaccaagccagacuguuuugggagaggucuacagaugacauuuuugcaguuuuaucaguacugugucauacccaaauuuaagaagugaaccuacuuaagucuuaaaaguguaguuccugggucaacaaugugucucagugguagaaugcuugucuaccauguauaagguccuggguuugaccuccagcauugcagccuacacaggaaagcuguccugcugcuaagcaugucuuuucuggucaccccauuccuuagcacugcuccuuucucaccuuuauccuaauuuuucuacaggacuucacaaacuucacuugucagauaccucaagggauucagaaacuacaaagccuucugcaaaugggcaucagaaagcacugugagaccugacugccucaguagcacucuacagcaagucccgacaacugauucaugacauucccauagacaguguucauucuggugggucuggacccagcugacagugcccuuucgcauaagcacuuacaacuuagcacuagucaucugugucuccugggaguuuucugauuggccggauaugacagcuuuugguuaaacccugagucuugagacugaggaaaagcugugugucuauagcaggaacuaccuggaugagaggugaagacucggacgcccuuaggcuuuugcuuuacaccaugagaagcuugguucugcaggcagaagccugccugaaagucaucuggugccccaaagcauuuucacaagguccuggaaacuguuguacaaguaacaaacuacauuuuuauuuaaaaaaccaaaagcagauuuucugauucaucuuacagaaucuucauuagacuuugagccaguggaacauacuagauucuuuaaacaccugagccuuggugggcagccccaggacuauuuuuuugugguaagcugcaguaugaagcacaugcgauuguagauuuggacaguguguguaccugauaauacuuuucacagcacagugccaguguuguacacaccuuagacuuugccuuauaggcuguauguacauucauuuuuuaaaaccuuuuuuucaaaaacuacuccacucugugcuuguuguauguguguaacccaaagacagaaauugcuuuuucaggcuucggugccucucauacaccaccuuaagucuccaccccaggaagguuaccagugugauacccagaacuuacaggucagggucuccacagaagggcaggugcagcaggugcagcucauaacuaauaugagcucauaacuacuuaguuguuuaguuuaauuguuggaaugguuucucaacuccugagucuacugauuuaaaaaaaaaaaaaaaaacugagcgcaugcuauuguuguuccuagguagcacacauuucacagaaauauagugaugcucacaugcacuguauggaugacauaacaggauuuguguucagaaaaagaaguaaagcacuuuuuucucaaauuguugaauuuaguuucuuuuggagacauauaugaaaggcuguaucugaccuuuauuuaaucuuagaaaaccaagaagauuuagcucuauguuuauaagccauugaguccacaucuuuauuuacaccauggcauccccugauacuccagguuaguuuuaaggaaacuuggugcuguggcucugagugggucaguguguaccuccagugaguauugauagauucccgagugugagcuccugcgcuagcacagugcgaguuggcuauuuccgauuuaccuggucauuaaugacaggcucugaagcagagcaagucagggagaggucagaguuuucugcugcagucacuucggugcacaccauuugccaacaaccaaacagagcucugcaagguaaggugucugaaaauuuucauaaaauacugaacuuuucaaugucugucucuaauuuucuuaaugagugucuauaugugaggggggagggagggaaagagagacagacgggcagauagacagaaacaugggggcaggcauuaaugaguaaagaucuaaaggacagcuuucaguagucagcucuuuccuuucacaugugugauucagguaccuuuaccugcugagcaaguccuaaacuucuuauucauuuggagguucuuaauuugaagaugggauccagguuuggacugacuggagauauuuggugaugagauggaagugggcuuuaaggauugucuuaccuugauucuugggccuucugugguugaugcacugcguggucaccacccuuugagggucacuggucacucaccugagaguugccuggagggagggacugguuccaggugccaucacuucacugggcaugugcuagaggcuggcugauacagaacuucacgaaaggacagcagcaugcugaggcuucauauuccaaguucgugaagacaguuauaugcaggaguccugcauugcagugcuguuuuacagagugcagaaagcucugcagacaagagcucccauucacacuagucauggcacucuaguuuugacuagaugagguugcaccagugacucuguugaguaguccuuuuguucucuuaccuugaauguccucuuuaaacgggcaugaaacugggcaugguaguguuuuccuuauagcacucaaguggcagaggcagaaggaucccuaagaauuugaaccagacuagguuacauagugaguuccaggcaagccagugcuacauagugaaacugucucucaaaagaaacaaacauacaaacgaaagcaaaaagaggaaaugaggguuggagguggaauggcuggagagauggcucagcaguuaaagagcacuagcuuugcuuucagaggacucagauuugguucuuagcauccacauggugguucacagucaucagugacucuagucccaggggauuaaauacccuuucagaccuccaugggcacugacugcaggcacauggugaaggaaaaacacuuccauacauaaaaauaauuacuacaauuuaagcuaaaagggcaccaaacacuuuauagaucuugaugagaggcuauaucaaauuuuauacauugugacaccgguuuuuuauagauuuucuagcauauauuuuagaucuauuuaucaucuaucuaucuaucuaucuaucuaucuuucuaucaucuaucuuauauaaaauaaagucugaccuaaauaugagacccuguaugguugucuaaaaacauacuguuagcuccuucagucacaccuguuuggggcuggcuggugaaucagaaggaaccuuguugggucugcugcucaccaccuauggggcugugggcaugguggcagcagcaguuguugccacuucugcuuuggccaagcacaguaggugauccugauagucagcagcacagauucccauugauucuagucuauguauuugcuuaugguugguacaauauuuaauguauauaggcagaaguauuauagggucuuuaaauaugugaacauauguagcacugcuuuuaaacuuaaaacggauaugauauuuuucauaugucaagacacacugguaaauuucuguuacauauuguuuucaaguuuucuguuagucuuguuucuaugagguacuuuuauuguaacuuaaaauucuuagaaauuaaaguucugagaaaaaccuuau

SEQ ID NO: 2384 - RNA, 1069 nt, Mus musculus
uucaggaacauacccuguaacgaucagauucuacuccuuuaacugugcucucugccauauuuaccuacccauuugcacgaaaagguuucucuggauugaguagauuaagaaguuugcaggaugaaaccaggcagaugccucuguugcugggaugaccagaucuuucaugggaauguucucuacagacuagagccagaaugcaguuucccagcucuaguccuaaaaaauaacagguuuguauugggugccagagccugugcagggccauuguucugagacacaguugaagaaaugcugcuccagcaagacaggcuuacccugagcaagaggucugaguuagccucaugaccucguucacgugccauggcugcaagacuguguuaugucuaucuauaaaaucuugugguccaucaguaucuagucauaauuaauguguauaucacucaugugcuauugacuaugguaggcuaccuuuacaaagugaugcccggacuggugagauggcucaguggguaagaguacccgacugcuuuuccaaagguccggaguucaaaucccagcaaccacaggguggcucacaaccaucuguaaugagaucugacacccucuucuggugugucugaagacagcuacaguguacuuacauauaauaaauaaauaaauaaauaaauaaauaaauaaauaaauaaaucuuaaaaacaaaacaaaacaaaaaaaccccaaaaugaugcccaugagcuauaggagaaggucuuacucuuucuaguagaacauugaucauacuggaccuagaucaaauucugacauaggagauagcagccugacagcugacauggcaggucccuaccaagccugugucuuaacugccuuccucucccagguuugagaaacugaggcaugaguuggaaguagccacaacccaagaagaaagaguccugcagaaugaguugcugccucaggagcccccugcagagccccauccgcagcaaccacucaauuccguggaugaaucuuccucauaguuugcuuccuuagggucagggcccuaaguuuaggcagccagugaacc

SEQ ID NO: 2385 - RNA, 17571 nt, Mus musculus
uuagucaaguucaccgcauuugagagaaagcaaacuuuaaggcuauaaagaggacucauggaagccaugcauccuucuucagucugugagcccaugcuacccuuaccuaacacaaucauguuaucuguucuuuuuuuaaaaaaaagauuuauuuauuuuauguguaugaguacacuguagcuguagagaugguugugagccuucauguaguuguugggaauugaauuuaggaccuccacuugcucugguuggcuccgcuugaucuggucaacccugcucacuuaagagccugcucgcucugguccaaagauuuauuuauuuauuauuauacauaaguacacuguagcugucuucagacacaccagaagagggcguuagaucucauuacgggugguugugagccaccaugagguugcugggauaugaaacucaggaccuuuugaagagcaguccgagcucuuaccagcugagccaucuugccagcuccuuaucucuguucuuuuuugucucuucuucccaaguacucaauaccuaccugaagugagugggauuucggagugggagauaucagagccuaagcaccacacuuucuuaaggcauuagaacuuuuuuuuuuuuuuuuuuuuugagauaggucacacaauuuacucuggcuguccuagaacucacuauguagaccaggcuggccuggaacucagagaucugccugccccugcuuccccgagugcuagaaugaaagacacgugccaccaugugcccaguuuuuaaacuuuuaaccaacauuuuagaagauaaaaaauagucaucaauuuauggucccaacccucuccucauggcuuaaucuuuucucccccuuuccccugaccugcuauauacauacauauacauuugaaguacauaauacucuaaaaaucugaaaauacaauauuuaaacccugacaaagcauggcauaauccuccuguucuuagaggcaggacugccuugaauucacaaaccacaucucuuggucaaaugcucccuauacucuggcuacauucucaggauggcuuugcccuguaaagacuuagaugcaaggccagccuucucucucagcagacuggcuuccucagcacucuggugagccugugugugcuucaguaagaaguggccaaugaagagcuucaggccuucucgcaacauucccagcuuuggguugucagacacucugaaaggaaauuggagacaagggucagggagaagcuugucuuugagagcccggugccucaagaagcaagacaaaacccacuuuuaggcauuuguuuucuggaugauuguguaaaacccagggucuuguauaagacagacaacuguccugcuacugagacuccaauccuguggcuuauugaagaaaaucucuguauuuuuaggcagaaccuuacuauagugucuaagcuauccuugaacaccuggacucaaagaaucauccuuggcucagucucuagaaaagguguaaccacaagaaugucauuauaccuggcuucuguuuuuaaaggagaggguaacccaggguggcgcuaaauuugugacccuacugacucagucucugaggugcuaggauuacuagcauaggcugcauaacuaguugcacccagaauccauccauccaucccgaauccacccaccuacauaucuagcuaucuagcuaauuugugguucugcuuuuuucuaagacaagguuucucugcccuggcuguccuggacuugcucuguagccuuggcuggccucgaacucagagauuuaccugcuuaacgccuccugagugcugggauuaaaggugugcgcuaccaccuagcuccagcuucuuucaaaguaggauucuuuguuaagaauuuuugucaggugugguggugcaggucuuuaauccuagcaaaggcugggcagaccugugaguucaaggccagccuguucauacuagccagggauauauagugggaaccugucucaaaaauauagaaaccaacaaaauaaaaauucuuuuuuuuuuuuuuuuuuuuuuuuuuuuuuuuuuuuuugagacagagucucacuguguuauucuggccuaaaauucacuggguaugccagucuggcccugagcuuguagcaauucuccugccucaguuucuuaaacucugggauuaaaguuaugaaccacagugcccacuuuuaucuuucugagggcuagggauaagacucagugguagaagugguggaucaauaagccaauuccaguauuuuaaaagauucauccuuguauuucuguuacucuagaaccacuccugguaccaacuucuguauuagucaggguucucuagagucacagaacuuauggauagucucuagauaguaaaggaauuuauugaugacuuacagucggcagcccaauucccaacaauuguuuagucgcagcugugaauggaaguccaaggaucuagcaguuacucagucucacgcagcaagcaggcgaaggagcaagagcaagaagucuuccuacguucaaucagggaacacuaggcacauaccuugaaaaaauuacagccaagucgucgucuucaguuuccaucaacagugcagucaacacccuccguaggaagugaacucuggguuuauccaauucacugaauucaacuaccuaagggucaggggguaggaaagcaucaccaugcugauucaguacaugguuuguggcccuucuuacucucuacaacacuggcugucaggaaccaacugcuggcaaugacagaguacuuacuacuggcaaggugggcugguuccuaggcugugagcuacaaugcaguggggaucauagcuauaggguauauacacuccaaacccaggguuggaguccucuguccucugaaguaguuacucuuuaguuacaacuccacauagaaaauuagguuaacacacacacauauuauguguuucuuagaaaagcaucaaaaacugagcaaagcaucucauuuuuagcaguacgauaaacauauuauacauagacaaccacaaacaccaacauggagaaaacacaaacucaaguugaauuugaagggagcuuaacaguaugcuuuccuuagcaugcugggcuuuucuuccuccaacacaucccaucacaaaggauguuuugucuugugucuguccuccaugcuagcuuaaauggcauggucauuuuucuuucucuucuccagcuacagcuugccuguagucuuuuucccuuuuaaaaugcuaauaaacugaccuucaucuuauuuggaaaaaaagaaaagaaaaaggaagaaagaaaagcugcaagaagacaggguauggugacaagguccuacccagagaggcuugagcaaugcuccauaugcucaccuugcagauacaggaauaggaaaaagccuuugaacaggauaaauacuauauuaaagaguagcuuuccugagaagaguugagggguacaaacaagagcccaagaacaaggucagggaugugcucggugauggcuacuccuagcugucaacuugacuacaucuggaauuaacuaaaauuccaaaauggagggcucaccugugagggauuuuuuuugcuuaauuugaaguaggaagauccacuucuuuuuuuuuuuuuuaaagauuuauuuauuuauuauauguaaguacacuguagcucuucagaaacuccaguagagggugucagaucucauuacagaugguugugagccaucaugugguugcugggauuugaacucaggaccucuggaagagcaguuggugcuuuuaaccacugagccaucucuccagcccgaagauccacuucuaauuagaaucauacuucaccuuuuguuugaagccuauguaaggacaagagaggagggaucuuuuguuuuuugccuucuugcccuguccugcuagcaaguccauuccuucacuggcauuagagacuacuucuucaggauuucaguguauacugaagaccagcugagacauuuagccuuguggacuuuuuguccacagauagccacuguuggguuagcuauaaaccccuuucuauguaucgauucauucuguaagucuguuacucuggagaacccuaguacaagcccuaccauacacaacuggcuccugccuaauucucaaggucaccaagaaauugugagcagaaacguugaugaagcaggaggcaaaugcacaggaugcugccuuacagacuagcaauguuauagaaagacauggaacuuaguuagcaucuugacuuaugucuacuguuuaucuccuuuagucuggucagaaggucagcaauccccaccuccugugcuucugucuucuguacuggugucucaaggcuuugaaggccccaagugcagggguggugagcuacagcuucaugguauuuugcagugaagguccacaauugcaucuuuauaaggaaagucuguccugucuaguuuuaugucaauuucacacaagcuagaaucaucugagaggagggaagcuuaauugagaaaugucccuauaagauggacuguagugccuaucucaagaaaaggagagagaaaaggaugggcuguagugacugauguagaaagggcucagcccauuguaggugaggccaucuuaggcugguuguccuggggucuauaaaaaagugggcugagaggaauaccuucagggcuucugcaucauguccugaccugacuucccuuggugauggacuguuacuuggaagcauaagugaaaugaaccccuuucuccucaagcugcuuuuaguuguuuuguuuuaccacugcaauaguaacccugaaagcaaaguucuacuucacucuuugcucccagaugagcuagcugugaaaagcacaugcaagcccauauacauaagcgcucucgcacacacgcacacacgcacacacacacacacaaaauaaauuaauguaaagcagaacaaaacaaacaaaaaccaaucuaaaccuauaauuggacauuaauucucuaaguaaauuuauagaauggguauuuucugugauggcuauuauaauuaaaaccuuucauagcugguguauguguacugaccucuaaucucagcacuugggaggcagaagcaggcagaucucugaguucaaagccagccuggucuacagagagaguuccaggacagccaagacuaauagagaaaccuugccgcucucuucccugccaacccucaaauuucagaauuucagaaaaugcaucuuaaaauauaccaaauaaaauaauuuauacuaucuuagaugcuuauacuaagcacuauacaaaccuuuagaacagaaaguggaagugauuuuguccucaacaagugugccagcagaugaaccagauuugagaacuuagugucuggcaaauuuucuaagucccgaaauuugucccauaugcugaacuggaaagucaucugguuaacaguaaagaagaaaaacguuaaaaugcaacaagucauuggaacaacuuaccggaaauguacgcuagagguacucuauuccuuagucacuuguugucaauaacccagugcauggaaauaggaacaacuucacugccucuuccugacaccaucauagaagucaauuuugaaguuuugucccacacuucaacacacagcuuugaagaaagguuguuagugccuuaaaacacuacagaggcauccagccagaagaccacaaucauuccagcugugacagaccagcugccuugggcuagauccuuguuaccuugccccacuguucuaucuucucuccaaugcagguaggucuggcugcuagcauggacaugacacaugauggggacacagaacuccugguaaugagccagacagauguacugguggucuuauaaguuaccuggaaucuccuuucauagucacagaauuugcuggccaggaaagcauagaaaggguuguagguuuucucuugcagacagcaauccaugaggauaugaacuaucucucucuccugcugguccuucaguccaagccuauggacaaacagccaacuaagaauagauucuuucgaucuuuaacguuuuauugauucuuugugaauuucaugucauguaccccaaucccauucauuuccucauuccuuuguaccucuccuuacaaucaccccuccaaaagaaaagaagguagaauuaaaacaaauauucuuguggugagggcugcagugugagggcugcagugugucauggucugucacacacuauauaauuuuuuguccaaacaucuuuacuuacaaauauucauugcaaugugccacuggucugguuugaggccucuggcuucugcuauauuaucaauacuggauccucauggggauccucuuaaucuguuguuguccugugucauggagauccugcagcuuuggaucuguaggacuggacccuucaugugcuccagcaguucauagaugggguagaugguggguggauggggcaacucaaagcccuggaucugggcccaggagguggcugaguuggucagcccaccagcucuccuacacccaauaccaccagggcaagcuuuucagcacugcucugacuagcucacccaaugaaccagcuggcaagggcgggggccuguucuucuguucuuggggcuggcucacaugugucuuagucacuaggaucagcucuacugcgcugcacaggugagguacagggucuacucuucaggguguugaggcccaugaggcagggccagcucuccugccuggugcagauggugaggccugauuucaauuuuuauagcaaaaucaguuccucccugucugaggaauccaguagcauaugaguguucaagaugauaguggcagccacauacugggccacaguccaguuuuguuccuagcuucuuugggccucaguuuuuuuuuuaauaacauggcccaauguguaaggcacaacacaacucccaaguuacaaagcugaggacugguuuauauuguuaugcagcuguggagcucaagagcagcuugagcuguauagggagaacuaucucaaacccccaacauaccccuucuccagguaaaacucaaagcaauauccauccccauccuguucuuuguauaguccugugaguguggacagucccagugucugguagcaaccaccacagugggaacauaggaagaucacagccacuaaaccuccuuccuaguuuuuuguuuuuguuuuuuuggagcaggcacuuuucuugaaacagaggcuaccaaggaugcauuuucugagccucuaggucuguuauauaaacaugccaacagucaugaagucaagacugacuccuuguccugggcagagaauccuuuagaaccaccugugcugauguuagccuuggugcucaaacuucuguggagcugacugacaaguaucccaggcaccaagaggacccccuuagauggugucuacccaauaguggaaugaguuuuuggcaauuaaaagcaacugauuugucuuucuucuucuugugucagcaggagggaggcauauuaagaguagaacuaacuacccugugcaugccauacagcccuguacaugcuaggcaaacccucugccacugagucaugucccuaaccccaacugacugcacgcugaguucaauggcuggagacaaaggcucgagacucaggagaaaacagcaaccaaacccaacugaagcagcaugcugcucaagguguaugugggcuauccaaacaaccaguuucauuucagcuccaucaaucagcuuaaucaauccauggaguuaaauauccacaagaacagacagugauuaaauaaaauaagacaaaacugcaaugcuggagugcuagacuccagggccucacacuacugaguuauagucccagcuuggcuaaugauuuucaugaauagaaguugagugggcagggagccgcggcuaagucugguaugccuuuucuuuuguauccuagcuggccuggaaguaugauucuucagcuuuagccuuacaagugcuaggguaacaaguugcacuaccaugccagcacugacuagaagacucggugcuaccuacauucagcaauacaguaagguuucaaaaacagaagcaagcuugagguuuucauaucaacaaggcucaguucagaaaccuaaucaucaaacuugcaguuauuucuaaguuugaaccagauaaagaaagggguuaauauucgauaguuuuagaaauacuuugcaagccgggugugguggcgcacgccuuuaaucucagcacuagggaggcagaggcagaggcagaggcaggcggauuucugaguucgaggccagccuggucuacaaagugaguuccaggacagccagggcuacauagagaaaucuugucucggaaaaaaaccgaaaauccaaccuccccccccccccccaacaauaaaaagaaauacuuuguaaaauuuauaacuaauuauagaaaauauauuguaaguuuuauaucaagagucugaaagacagagauaacaauucucaaaaacugacagcccuaacagacuaaucugguagcugguuaccuaauacugccagucaaacucucaaaucuuggcacuauacagcaccauuuaccaaggacauauaagcagggcucaauguguuaugagggucauguggaaccugaagcucagguaagagggcaguaacagggaagacucaguuguucaaauuauccaaaagcuaaaacagagaucaauuauuucugucacaucuauuaaauaaaaaucaaaauguuuccaccaaugcuuacuucagcagcuuuucaaaggcauccaagaaguccucacuugucauuaaagugcagaauaugauccuccugacaucaguguucauucucugcuuccucgcaagcuccagcaucuuagagcuagccugaaaagagaaagaucagugcccacacuguuccauuaucccaacgaaagcagucuccucagagaagggacacuguucuagaaugugucuaaacuugaauuucugaagaguaacagucacuauugaagaagugacuguaaacuguguguacauguaugcauguaaauaccaagucuguauucuuggguaaaucugcaaaaggagaaaagcucagugggagccuucuaaggaggaggaucagaucugugcaucagaugaagaccaaguucagauacaagcugcugccagagucugggagccacaacuaccaagugagaugagggcucccgggcaggaaagacaaggacauuggaguuacaauuugaauccacaguaggaacuagaaccuauacuuccugggaacagcauacugcugaguuccaacaacagcuccuaucaaaugaguuuuguuuucacaccucucacauucaguuucuagauuuugucugaauugggguugaaacuuuuaaaaauucuuaagaaacugaauuaaucauaggcucacaugagcuauuucuaugaagcuuccugauaauccuuugugggacauuucaagaacacccaggauuaacagggagcugcuuuaagcagaacagacuucugaugcaccaggguguccauagccaggcagccaacauagacuucauaccaugccugcaaguggcuucugaaguuguaugugaugacuguugucaaucauuggggucccacuccaugcagaccccacaauccaccagcgaccagucugcucugcauucaagaugccaucccaggagaugcgaagccgagucucagaaccugagccagcauuucgaaccugauuaaaagaaaaggcuucaugaaguguuucagcugauucacaccugcacuucugucacgcuuuguuugacaguggcaguuuugguguacgacuauggcaaugaaucacccacaacugauugaaaaaugcuagaaagagccaucaccucucaguguucuaugugugaagucuguggguccgcaauucaaaugugugugaccugggaucugcaccaauggugcauaugugacuagagacucggaaugacucucuugugcuggcaggacgacaggcugaacaucugaggaaagcuuccucguuccagauggggucuggccuucugagugcgaacagaggaagccaucauacagucuaaaucuagcaccucagaagauucaaaguugaguacucaaugaauucgauggaaucaucacuacugauacgcaguccccucuucccaucucugucccuccuccucuucuucuucuuccucccucuuccuccuccuccucuguguagccuugacuguccuggaacucacucuguagaccaggcuggccucaaacucagagauccaccuugcuucugccuccagagggcugggcuuaaagguauaugccauucauauguagcagaugugcagcuuggucuucauguaggguccccaauaacuggagcaggggcugucccugaaucugcugacuaccuguggauccuguuccccugagacaccuuguauggccucaguggagaggauacgcuuaguccuacagugugacuugauguguuaggguggggugaucucagggaggccuaauucucagaggaaaaggggaugaggggacaggggaggagcugugugaggggaaaccaggaggaagaaggggcuaaaauuggaauguaaaguaauaaaugauuaaaaaaaaauuaaaaaaaaaaggcauaugccauuacgaccuggacagauuuacaguuucaaacacuugugcagaacauagccugaaccauugucaugauggcuccauaauggcauggagguucaggacaaaccagaauagggugucacucaccagaguucuuuguaacuucuucaguuuuuccacaggcucaggauuauaaccagggauuuuacgcaggucauuguucuucagagccagcauuguuuccaacauaaaccguaccuuaaggguaaagaaauccaccgauacuuaucacugauagucacugaugauugagcuugguaagaaauacaucucagcuacgcagagaggcaacaaugaugagaacacugacagcuggaggcagucuguguuaccuucaacacugcuuucagggauacaguuuuuaaaacaguagacucucaaaccuuagcacuauccacgggccuucccuccuccacucccacaagcccagcccugguaugagggugacccuguauccuucaugacaaacccuccgucaagacuuaaucuagaugccaacuugacuauucagaagcagggucaucuucccuuccagucuucccuuucccaaacucccaucacaugaaaguuacuucugacuccuaaggcuacauccacugccaccacacucauacaugcuacuuuuguuucaagauuccugaagccuuucccugaucaggccaccucccaucauucuacacuggggucaaagcggccagcaaaguacaggaucugccagucaacuaucuaggcagaucuuccucuauccaagaaaaaacccuggcucccugggcccauguguggcuuugguccuaucuucuuucugccaaaggccccaggcucccacacuggugcucuucaauaggucacuuucuccuuucuuuuugagggccucucagguaccauucuauccccucacacgaggcaggaccuauuuuacaggagggaaacuggcuaguaagacccaagucucugcugcucagaagcagugccacacauccaacccaggcugacacccaagccucuugggaaacaacuucugagaggacaaacauuguaaucauaaaauaugcaugaguucuuaaugaagaaacaagguucaagcagcauauggugguacacacauguaagcccaacacucagaagaggaucacgaguuugaggcuagccugggcuacauagugagacuccaucucaaaaauucaaggaaacacccccccccccccccccccgcccaaaaccaaagucaguuugcagacuaagggcaaagccacaguagcagaugaggcagaagaaaacagagaacauuagggcacaaacacuaguguucagccagacacucauuuacauucugccgucugugcuucauggauacucagcaggucaagcaacacuccuacccuguucugguccugaaacuuguugccugcaccacuggccugggucugggcuucugugaucaguuccuuaagugacaaggcgucaucuuuucucaaugcaaagcccacauuuuucagcaucaacaggaucagcucaaugucuuuuuccguaaaaguuccaacaagcuucuuuaaaaugucaaagaugaggauagacuguaccacguggaaguuguacaaaugggcaaucaugguaaagagguuguccaguucuuuccccucaccuccaucucuauagauagcaucaaacuucuuuaccacagcuucaaggaagcaagcaccaaccugaaggagauggaacaaacaucaugucacucugggacccugccuuaaaaacggcaacaugaauacaggugggaaaaaaucugacaggggugcugguaacuaacaaugcaggcuucacauauagaugagaagauucuauauaacaagcaguacugagugcuugacucagcagacaaaucuuuucuguaaagauauuuucauuucuuuagaauuaacaacaaagugguuuuuagccagucguuacugugacucccuggaaaauuuucuuuaaaaaaugugcuagugagauagcuuggcauagaggagcuugcuuccaaccugacaacuugaguuuaaugucagaaucugugugaagaugauaaccagggaacagcaccaggccaagaacuagcagaggccuggugaaguugaacaaggccacuauggcaguccucuugcuguuuuggaacauucaauuuauaacuccuacauguguuuuggggaagcaggaggccaagguuugaaucuguggugguucugaacaaaagcagugaauccugaaagcagaaauuauagugacugacccuccugcugguagcauuaucuugcgacuauuuccuuuugcaggacauccagcugggagaugagugaggcaacugugauagaugggggaagaaaggcugcuuacauaaugaucugggacagacuggcagggacuaucaauggguaugauucccagcauuuggccugggacucuaggaacuagacaaggguaagguguuggcagcuguucaaaaccugguuuagugucaguagauacuagauacuagaguuacuguaaaauucagauuagguugacacauagacaaaggagggcugaugagauccagucagcucaaaguauaaugggcaaguccacacaggauuguuaagacuguaaaacaacgaagcuaaagaaucaagaaagacacagcacacuggcaaugguaauacugauuucugaaagcuaaacuaaagacugaggcuugauuccuaguucagguuuucucauuuuagaaaaaccuaagcaugcccucacagagcaguacaucaucucaugcucauauacaguguuaacaaagacaggauucuucagagagcaagaaacacucagacacuaauucagguauguuuucagcacacaaauagguccaauuaugcaacaggccaaaauuuaaauucuauuaucucuuuaaaguuaagcacauuaauauaauuuagaaauaugaacaauuaucauguuguuaguacugauucuaugugacuuucagcacaaaucugcaaaggccugaauguuaaaugcuugaggggagacacacaguagcugaggacauuuuuuuuuccuuccauaaguucuugggaguuuuuucucagcacaguuuaauggaaaccagcauccugaaagcauagcauaucuggcacaagcuucagugaaugccauuagcuaaaguacuauaaugacuuccccuugaacaagucaucucauuguucuucaugcuauuagcaaagguuuaaaugggaagcaggaccaauaauuucagguuuucaaaucaaguaaauuccugaugugcuguggugguuaaaucuacgacuuuuaaaauaauucacugaaaugcuguucgcacuaaaaccacuuugauuaagucugcugaacugucccagugugguauaggaugggggaagcaccauagcagccacagaacagugucaauuacugugauuauggggcacaaggaaagcuguccagggcauccauuaugcuuuguaauggcaagaaaauggacucagacauucacauguaaaaauaaguauagcccuugguggagagaugaucauagaagcacaauuccuaagguagccaggguagucuugcacagcagggcuuuugagguaguugggccacuguccucuguccuuagcuucucaagucuuuuacuucucaaacucacugacuccagacuggaauauuauuccagaugacauagucaggauauggagaaaagguguaguuguaccucuauuccgaccgugugguggaggaugcugacuaagaagacaugcuccaucaucagucugcugggcauggcugaggcagugacacaggcauccaugagggcaguggucaggguaucguucauguccuuccugcugugggccauguacagcuccucuagcugcccacuuauagaagccauguuuggcucacucaaccugcaguggaauaugagcaaaguguuaccaaugcauauacuauuuuauguguauuucugguucagaaaccacuccgaaaccuggugcauacugcucagauaacacucuaaauccugaaauaaugucaguuaucuuuuauacaauaauugaaaaaaugauuuuagcagagcacagucacuaaagcauauccugggauccucccuuagucuguacauaugcccacagguagucugaucuaacauccccuagagucaguaaucacuccuaggugguaaguuaagaaaaaaccauggacuuguuucaucucuuagaugacacaaacacacucaguuucuaaauucauuguguaccagugcuuaaaccugaaccugcugucaaaacaacagguaaugguaaaguuacaggauauuaugggcuuuaaugaaaaagaaauaaaagcacacaggagagaaaaggagaugugacagaacagccaugcaucuuuuuuguuuguuuguuuguuuuuucaagacaggguuucucuguauagcccuggcuguccuggaacucacucuguagaccaggcuggccuugaacucagaaauccgucugccuccgccucccaagugcugggauuaaaggugugcgccaccacgcccagcucaugcaucuugauaucaguagcagucaccuaaaucuucaaacaacaaaacugcacagaaucggucucagucucucucuuccuucugaguccugggauuacaggcacguaccaccaccucuaguuuauguggucuggcaagcaagggagggcuucaggcuuuguucauguuagaugaauacucuaccaacuuagccacaccacuagcugucucuguuuuuaacuguaaucuagccuggaagugaucccucuaaggaccucccuacucugucuuuguaauucccagugaucuacaauaacaaguuaagccacaaaagaacaauacauaguugaaaugugacaaaauuggguuaggugcuagaggccaggacaguggucaucuuuggggcuuggaagaggcccugaaugaggcugagugagggacacaaaacaaguggagaagguuuuagacaagugauuccaauuuauuuguuaagauuagagagccaacaagggaagguaagugacaaauucccacccauguggcuuccaaugaaccuucugaugcuuuauucuuaaaauggacaauuaaaaacagacggugccucaagggcugaagacccugcuuaccacuagaugaguucacuucugcaggcuagaccugcagacuucggccaggccgcuccuaggacagagucauguccuguuccuuucugcuucucagaaugacccuguggguuguuuucaaacacggaaagggcaauaucaaacaguugagcauccuaccuguucaaauuuaagucccguuaugucaaccaagaacaaggauccaaaacacuguauaguccuagccuccaucauuggcuuuucagauaguuucuacaacuaagugauagugugucauauuucuguaagguuaccuguuaauuaggccuuuaacauguuucuugagccugucuagcucuucuuucuuguggacaucuauuaccuccucguuccucagccgaggagggauguacuuuucaccacuuucaacagagugacucuccuugaaaacaggaauaaaauuguaaacaaaaauguacaguggaaaauccgguaucuuuuguuguuguuguuguuacuuacuccaaacacuaaccccaugagaacuuggagcaggguacugcuauuuaacgaagugaagcucuaugauugccuagaauggccugggucagccugucccucagcaggcuguggcugcuacuguguuagugcaaauacuguucuguacucugccccucacuccguuuggaaugacagcccagagggccuacaggcuguucgugacauaccugcuguucuaugucaucuuccgaagagcuucugcucuuuucuacaacuucugcaaaacgcacuuucuuagucccuuuauuuccccgagucccacuuucugcuucuccucuccuuuucgaguuuacaucuuccugauccuccugcagcacuugccagucuggguccuccucacuuucuuuagaauugcucucuaggucacucuccaagacugucuguccagucuccaacuuuucuuccuccucuuccucgcugcuuucguacaggccgccgccgcucccacauuccagggcccccaggauguaguccagaccgucgcgcgcgaagcugagcggcaccgagcuaccaucgcccuucuucuuacgcuuguggaggccgaggcaccguuccagcuuucggaucucucgguccuccuccucguuggccgcuagaagugcccgcuuccgggcgguggcgguggcgggaccaggcuuuccaggagcaccuuuagccuuggccuucggcugggccgccgaggccuugguguuaguggagggggcacuggccuuggcagggguugcuguggccuuggcgggcgucggucucaccucagugggcggucgucgagucuccgggccaucguuaaggccgacauuccccccuugguccccugacccggagccuacuguccucugcaggcgccgcgcuuuccucaggugucgcuucuccuuacgaagcuccuugcggcucuuucggccgccgggccgggagcgcgccacagcgcugcggcucucgcaggcuucgcucucggagguaguccgcacgaagucuuccacggccagccgcagccguuucaggggacccucccugccgcccagaccgcggcggacgccgcuacguuucaagagagcaugugccauugcucuacaccacaacucacaagccccaugccuauagacgccguuaacuuccgggacguuccgcggcaucacuuccggaagggg

SEQ ID NO: 2386 - RNA, 4975 nt, Mus musculus
ggguggggugaggauuuaaaugucuauuuauuuauacaggagcuuauugauuuauugagacaggagcuuauugugggaucugauguccuucucggguguguccgaagacaguacauucacauacaaaaaguaaauacaucuuuaaaauaaccguguuugaaaucuagacccuggauucagcacugcgaguugguaaugaugaggccucucacgguucacucuaagucgggccugcuuguugggucggccgaaccucgggaccacaauucuccaaguccauaggagugugagucauacuacgcuaucagguccuuaucuccgaauccacugugucagaggcugugagcguccuuccucccagccugcuuccgggcaaacgcaggcuccuugguucggcuacagucgccucaggcuuuagagcccuccaggcacagagcuugcgcaaggggacgcuucccgcccuauucagccaccuucgccuauguaaacccuccagaaucccaccguccucagcuccgagaaucuuccggaacgcuagaccagcgcuaucaaguccgacgcgcacggaggcugcugcgcacguuagcuucagggccgggcggaagucgacgucgccgggccgcgccgccaccgcgugacgcacuuccuguuuguuguuggagaaaagaagagaaaggaaagcgcgaggagacgccgccgccgccaccgccaccagcgcagcugugccacagccgcgaggagaccggccgccugacuucccuccucgcuggccgccguguccucggugaggguccgcgagccgcggcgaaaagcaggguugacuacggcgggaggggaaggccugcgaaugggcuaacccgcuuggcucccggaauacgggugcaggaaccgggucgacaguggggccgguacugcucacaaggccgaacggguuccagucuaggcuguagucuugugucuaggucuggggcuuaagguguuccuggucugggccgguuguagauugggucuguggagagcguuugccguucuuggucaggccuagcucggggcuuagcugcgguccgcuucccuaguucucuggucgaagguggcgguuggguccggcacgcgcuaggucggccgcagagcuccaggaguaggcaaggcuggugucacccaguccuggcguccucacugcauucugcaagcaaggggucagguggccugcgaagagcaggacucccauggaaggcgcaaucaccggcccaggccuccaggcagcgaagggggccgggugggaaggccaaggcgguuuccagggacuguugggaaguuugcuaggcgacccgccuggcucagcuuacuuuuaaaacuaguuugauguuggccucgaagguugcuuugcugugguuuacguaacaaaguuuauguaacuggaguuuacacuaagucuuaauuuacuucgguuguguugacaaggaacucugcacugcaaacuaaaaggucuuaaaaacuuuggagauggaguuuuuuuuuuuuuuuuuaaacaggagggguuugucaaguuuuaaaagcuuuguuaccgaagaaguuguaugugaaccguugaaagggaaugguggggauggucccaccuucuaagguggggagugccugcccagugcagccacuuugguuuuuuuguaacgucuuuauuugaaccuuagauuugugguuaggguuuacgcauucuaggccguagaaucucaggacgcucagcuugcuagggaagugauaccaacuuuaaggcaacuguuuuaguagaaauauuggacauaaaagccagaggagggaacaaccuaaagaacaagcgcccugauauuugaacuuagucuguucuuguuuguaaaguaaaccccacaguagacuuacugauuccuggaaggacuccuuuguuguacuuugggauaucgccaccacaggccgaauugcccuccggugugugauuacggugucaucaguacacacacuuggguggagcuuuggaauuaggaagaacaugaaagaaauaugggaagaaaugcugccuuuuguagguaugguugacuuggaaguuucagucuucucuucacucuugcccaggcagaccaugccugucuuuuuguuuguuuguuuguuuguuuuugagacaggguuucucuguagcccuggcugucccugaacucacuuuguagaccaggcuggccuugaacucaaaucuaccugccucugccucccaagugcugggauuaaaggcgugugccaccacgcccggcuugcaaacuuuuuugguauuguuuuguguaccccuggcuguccuggaacucacuuugaauagcagccugauaccaaacacagaacucugccuccugcugggauuaaaaaaaggugugcacccucugcaccagccacaucuuuagaauuguaaagaaggcacuuuguuaucccuguccacuauuggugugauagcgugugccuuuuacauuauuuaauacucaaggaugugcguguacuuuuagaccuugucugaugccuuucuaaagaacaagcaaauagaacagaauuguccuuucgacuugguucugcuuugcaggauucuuaaaaacugacacuuugaaaaugauuguauguuaagucuuaaauuuacccaggacaccaucugguagugaagggccuacaguuaaaggcaggauuuuguaggagggauuagaguggcaaauuaauauuauuuucauguauagaguuuaagagaguaacuuugggaauaaagucacagugagcuguguaguguuguguggguccuugauaccaguaauucaagagggugagguagaauuuuagguagaggccaucuuggccuguaaagugagacucuacuucaagcaguaagccugagguuaaccagaaacgagcuggugagaacaagacggaaauguuacuguuguaauugggcuggugaggugguuaaacaccuaaagcauaggaagaaggccugaggacuagaguuggaacccaaauaaggauggcaggagggcauugacucaaaguugucguguggacuccacaggugugccccuccccuaaugagcgugggagggagaaauggaccauuuucuccugaagccacaguguacuguuucugagugcuccccaagcauguuuaagucugcuaaaaauccuuuuuuuggagguggugguggugggggagccuggagacugacuuaguagauaagccagcuaguagcuaguuggauuuguuuguuucuucagagacagggucucuguagcccuggcuguccuugguugaacagccuggccuggccucacaaauauccuccaguuucugccucccaagagcugggauuaaaggaaugcaccaccaugucuggucuaggaauuucguuuuuauuagauagaccuauggauaaaguguucugucaaacucuaauuuugagagcuggguguggucaugcacaccuuuaaucccagcacucgggaggcagaggcagguggauuucugaguucgaggccagccuggucuacaaaaugaguuccaagacagcuagagcuacacagagaaaccccgccucgaaaaaacaaacaaacaaacaaaacaaaacaaaacaaaacuccauaauuuuggaugaccaaggaagagcacaugacuauuuucauauguugcuccuaccugagagugcaaaaugcuaaaauacuuuuuaucuccuaggguuacagguucaucuaaagaggauuuuguuccauguacuucaguuggcuauaggguaguuuucucuuaaaaguacucucuaauccaagucauaaagaccuuuucaggcauugugaauaaaugccauugauucuggcuucaacugcuuaacugugauguauuaaauaauaguauuaaaugcuagggucuucagaaagguuccuuuaugaaacacgugauuuuuguccccuguaaaauuuuguauuuuggggggaaaggggaugauauugaaccugaaaaaaguugcaugugagguauagguguguguaugugaggguguguauguguguguguauguguaugugaggguauguguaugugaggguguccuagugcuuuuggaggccagggguggccauuggguguccucauugcuuucacaccucccccccccccaauagagguuucccacugaauccaggggcucaccaaauggcuacauuggcuguugagauguaucacacagauuugccuccagcccuccugcucuggcuaaaugugggugguggugaucuggaucuguuguaacugcuugcuuugcaggcacuuuacugcuaccacagccugcucucaaccccaggguuuuucucaguaguaaguuuugagucagggugucacugaauuguucagacuggucucaguacuuguuccuagcaggcuugugguugugcacaccuuugggaggcacacaggcaggcaggcaaggcgaaucucuaguucagaagcuaaucuggucuacacagagaaacccuguuucaaaacaaaacaacaaacuaaaccaaaacaaaaguugucccuaauccuagcuaaaauucucuuaacccucaaagguauguauuuguguauuguguauccccucacccacucaggcagauuugacagauguuuagucuguggagguuggagaacaauuaguaggaguuuuuccauuugggcccuggggauugaauugaggcuuggagacaagugcugaggucugaguauauuuaauauauuuugggaauucauaagaugaugaugaugaaaacaaugauacuggacuuauaauuuauuuccuuccaaguuaauuuguuacugcuuugaccauugaaguuuuuguuaauauuuccaugguuuggaauuuuauuacuaccucugcccccuagcuagcuuuuuguaggacugccucaccuggccugguucucuucacauuuguuuccugcuuccauu

SEQ ID NO: 2387 - RNA, 1074 nt, Mus musculus
uguucagcgcaguuuccccgaaguaaguuugccaguuuucugucuuauacugagguucgccgggucauggugccagccugacugagaagaggacgcucccgggaaacgaaugaggaaccaccuccuccugcuguucaaguacaggggccuggugcgcaaagggaagaaaagcaaaagaugaaaauggcuaaauuuaagauccauucagccacugccucugacugcagugacauccugagacugaucaaggaacuggcuaaauaugaauacauagaagaucaagucauuuuaacugagaaagaucuccuagaggaugguuuuggagaacaccacuucuaccacugccugguugcagaagugccuaaagagcacuggaacccugaaggacauagcauuguuggguucagcauguacuauuuuaccugugacccauggauuggcaaguuacuguaucuugaagacuucuucgugaugagugauuacagaggcuuugguauaggaucagaaauuuugaagaaucuaagccagguugccaugaagugucgcugcaacaguaugcacuucuugguagcagaauggaaugaaccaucuaucaucaacuucuacaaaagaagaggugcuucggaucuguccagugaagagggauagaggcucuucaagauugacaaagaguacuugcuaaaaauggcagcagaggagugaggcgugccaguguagacaaugacaaccuccauugugcuuuagaauaauucucagcuucccuugcuuucuaucuuguguguagugaaauaauagaucaagcacccauuccaaagcuuuauuaccagugacguuguugcauguuugaaauucagucuguuuaaaguggcagucauguaugugguuuggaggcagaauucuugaacaucuuuugaugaagaacaaggugguaugaucuuacuauauaagaaaaacaaaacuucauucuugugagucauuuaaauguguacaauguacacacugguacuuagaguuucuguuuugauucuuuuuuuaaaaauaaacuacucuuugauuaaagaaaaagaaaagaau

SEQ ID NO: 2388 - RNA, 817 nt, Mus musculus
uauguaguuuguccuauaggggggaauaaaaagaaaccaccuuuaaaaaugauaugccauauacccuugguuuucauuuugcauuauuuugacauggguuuucuuuugugaagaaaaaguaauaaaaaucugauagucuaagacuccauuauuuaaaagccuaauuacuuuuaaacuaugcauacuuucaaaccuuuuaccaaaacacacaaccgcugaagcauucacuucucuauggaaguaugcauaucggugucaguuucuuuguacagguaaacuuagauauuuuuuaugauuuuuaaauaaauguauuuuauacacuuccguugacauagaacacuuagaauuaaucugguauuuuuugauuucucgaaguuaaaaucauagauuuuuuuuagguuugauaugguugugucauaaucaucuuguaauugacaauuuugcuuuuuggcaauaaaagaaaguugggauaucuuugaacuguaaaaccuaguuuaauucuucucuuucuagacuuuugauagauuggauaauuaaacaguaccccaagaaacuaaagaaaugggcauuuuaauugcuuacuuacguuacauuuaagugaauacuacucacgacaguuuuacaaagcggaagugcuuacugauuccaguaacugcaauuucuuuuucagcuagaugagugaugggaaauuuuuuguugcauuucaaaaucuaaauaaacuacagacuuuauccuuauaccacgaauguuuuuuuauauauguauacuuugucuuaaaauaauacagcaugauacaauaaauagugcuuauacauau

SEQ ID NO: 2389 - RNA, 4749 nt, Mus musculus
ucugucaauuucucuuuauuacuuuaaacacuucaugcuaaaaugucuagcacacaaggacacauaaacuaucaguucaaagccaaacaaacucauuuaguccuauuucauuuacauucuuccugacaguuaaguaugugcaugaagcugggcauuguaguacacagacacuggggcaauaguguugagaauuucaggcagcaugggccacauagcaagaccugccucaauaaucauaacuaugauaguaucauguguguguguacuagaaagccaagccaaugaauaauagggaucauagcacuauagagucuaaauuucauuggcuuuucuuaucaacaguaagggugucuaaaggcagaauugauguaugucauggagacuuuuuauguccaaaauucucaguccuccugucucuccuguuuaucagauucagguucacagcaaggccacugguacaggcaauuuuugaagugggaaaagcaacaugcuuugccuauggacaaacaggcagugggaagacacacacaguggguggagaccugucugguaaaagucagaacacauccaaagggaucuacacaaugguuucucgggaugucuuccuucugaagaaucagucuccauacuggaacuuaaaccuggaaguuuaugugacauucuucgugaucuacaaugggaagguguuugaucuccucaacaaacaggccaaauuauaugugcuggaggacagcaggcagcaggugcaggcugugagcaggugcaggcugugggacugcaggaguaucuggcuaccugugcugaugaugucgucaagaugaucaacaugggcagagccugcaggacuucuggacaaacauuugccaacuccaauuccuccugcucccaugccugcuuccagauucuucuucgagcucaagggagauuacauggcaaauucucuuugguggaucuggcauggaaugaaugaggggcugacacuucuaucgcugaccggcagacucacauggagagugcagaaauuaacaagucucuccuggcucugaaggaauguauccgggcucugggaaagaacaaggcucauacaccguucugugagagcaaguugacacagcugcugagggccucguucacuggggagaacucaaggaccugcaugaccacuaugaucucaccaggcauaagcuccuaugaauacauguugaacaugcugagauacacagacagagucaaggagcuaagcccccacagugggcccaguggagagcagucgguucagauggaaacagaagugauggaagccagcucuaaugggacuucucuggcuggcaaugaagaggaggagcugucuucccagauguccagcuuuaaugaagccaugacucagaucagggagcuggaagagagggcccuggaagagcucagggagaucacacagcaaggaccaagcuggcuugagcucucugagaugacggaucagccagacuaugacuuggagaccuuggugaacaaggcagaaucugcccugacacagcaggcuaagcaggcuaagcacuucucaggccuucgagaagucaucaaggccugcgccuagccaugcaacuggaagaacaggcuagcaaacaaauaaacagcaagaaacggcaccaaugaugacuucaaauaaagaucuguuucauaacacacuagccucuuccccucccccucaaaacuuugggcaccuucuggcuuugguuaggaacuggguuggacagauuggguaaaugucagguucggggcaucaugcccaggaaagcuugggagagacuauguucuuuuccuugguuuggggcagaaagaaagaguuuuaaugacugcuuccucuucgccucccugucaaaggagagugccguuuggguggcuccccuguagagcauccagcugcugauagaaacacuguuaggugcaggcucuggaagagaagcugugcuugucugccuccugcugccucuggccuugcagcaucacccuuggucugagcacucucaugguuuuauacuuccagaaaaauuuuaaagaccucuuuggguuuuguuuuuguuuuuucuuuuuugaagcuuuuuauguucuuuuuauguucuuuuuauauuuauauguuguaccuaacaauaaagaaagaagaaaaaaaaauauagcuuacauuaguuauaaauaucccaaacacaaacacuuuaaacuuuaucaagacaagauuaaaugcauauuuuaauaaaauuaaaucuaaaggauuuaaaauauuuaucuacuuuaugaauaucuguuauaauaaaucuguacuaauuaacauuuuaaauaucuuuuaauacauuaauguaacagcagcuauauuagcaauaacauagugaucacauuuuauaugacauuugaacuguucucuucuguucaugccugucuuagucaggguuucuauuccugcacaaacaucaugaccaagaagcaaguugggggaggaaaggguuuauucggcuuacacuuccauacugcuugcuauucaucaccaaggaagucaggacuggaacucaaacaggucagaaagcaggagcugaugcagaggccauggagggauguucuuuacugccuugcuuccccuggcuugcucagccugcucucuuauaaaaccaagacuaccagcccagagauggucccacccacaaagggccuuucccccuugaucacuaauugagaaaaugccuuacagcuggaucucauggaggcauuuccucaacugaagcuccuuucucugugauaacuccagcuguguuaaguugacacaaaacuagccaguacaaugccccauuuaacaaacagaacuugaaauacaguauguauauuuaccauugauauugcagcucuccccagagaaauugccacuaacuucuggaaggaccuucacuuuucuacuaugugauuuucaucccugucagagauuuagucuuauucuguucauuugauaacaguucuuaauccuauuaagcagauauuuugagauuaagaaauuuuaguagcacuuaaaaugaaacacuagagggcagguugggcacauaacaaugaccuuaucuacuuuauacaaauguggguggguuuguggguuuuuuucccauuaauuuauuuauucacuuuacaucccaauaucagcgucccccaccucuccuucuagucgaucucucacacagauccucccccaaccccccuuuccuucuccugggagggguguuguuuugagacaguuucacuagguaggcuaaucuggaacucccuauaaaggccaggcuggcugcaaacucauaaagauuggccggccucuaccucuggagugcugggauuaaauguacgugcuaaucuugacagacaacaaaugugguuuuauuguuugugaucuuuuuugaccagaauccuuuugaacucauaugcaggcaaagaugacguagaacucugauucucuuccauuccccagucuccauuucagagacagccuguagguuguucccuuggcucaucaauuacagucggaucuuagcaguuaaauucuagaucuugaggcaaauaguaauaacgguuaauagguugguuuuccaagagaaggacaacgaaaacagaaaaguuuuccuggccuacacaccauuuuaggagaaaggaauuaagcuagaugguaauguuuagaaaacaguaguuuacauuaacauuugcaccucaggcaucuggaaaaagaauggcaaccuggugcuuaaauucccacaggaccaaaucaguguuguggaggauguugauucauuguguuuguuuguuugcuuguuugaacuaccuaguucuuucuccucugggcucuaguucucagcccucagcaguuagagauguuccaugcaucccuucuaucauucagauggaagacaagauacccauggucucuuccugucuguccccaaacuguuccucucauucuucucuuuguccucugccauguccugcuccaaaacuaauauagucccugaggcgcucuuucuauccccucaccccugagucuauccaucuucaagucucacucucauuuauauuuuuagaaauaugauuuuuaaguuugucaaaguaucauuuauucuccuguuguaauuaggcuucuugccuccaucugcuaaccuaggccuaaguccucuaaauaaucauaacgaggccuagaauguuuucagccucugaggcuuacugcuaaauaugcucaccuuuuaaaaaauuagauauuuauuuauuuacauuucaaauguuauccccuuuccuaguuuccucucugaaaaucccuuauccucucccaucucccucugcuccccaacccaccaacuccugcuuccugacccuggcauuccccuauacuggggcauagaaccuucacaggcugacuaagggccucuccucccauugaugaccgacuaggcagcuggagccaugagucccaccauguguuuucuuugguuggugguuuagucucagggagcucuggagacacugguuaguuugguccugugugaaguucguacccauaaacaaacuuuaacaagcuugugauaggcgggcggcauucgcaacucugagcugccacacgcugacauaccuggcuugccacugcuguccuccuuggaagagccgagcucucccaaccucuggccuguagucuagcgauccgaauugucauuuuucugagacucuggguuccggacgccu

SEQ ID NO: 2390 - RNA, 1470 nt, Mus musculus
agcaagaccugccucaauaaucauaacuaugauaguaucauguguguguguacuagaaagccaagccaaugaauaauagggaucauagcacuauagagucuaaauuucauuggcuuuucuuaucaacaguaagggugucuaaaggcagaauugauguaugucauggagacuuuuuauguccaaaauucucaguccuccugucucuccuguuuaucagauucagguucacagcaaggccacugguacaggcaauuuuugaagugggaaaagcaacaugcuuugccuauggacaaacaggcagugggaagacacacacaguggguggagaccugucugguaaaagucagaacacauccaaagggaucuacacaaugguuucucgggaugucuuccuucugaagaaucagucuccauacuggaacuuaaaccuggaaguuuaugugacauucuucgugaucuacaaugggaagguguuugaucuccucaacaaacaggccaaauuauaugugcuggaggacagcaggcagcaggugcaggcugugagcaggugcaggcugugggacugcaggaguaucuggcuaccugugcugaugaugucgucaagaugaucaacaugggcagagccugcaggacuucuggacaaacauuugccaacuccaauuccuccugcucccaugccugcuuccagauucuucuucgagcucaagggagauuacauggcaaauucucuuugguggaucuggcauggaaugaaugaggggcugacacuucuaucgcugaccggcagacucacauggagagugcagaaauuaacaagucucuccuggcucugaaggaauguauccgggcucugggaaagaacaaggcucauacaccguucugugagagcaaguugacacagcugcugagggccucguucacuggggagaacucaaggaccugcaugaccacuaugaucucaccaggcauaagcuccuaugaauacauguugaacaugcugagauacacagacagagucaaggagcuaagcccccacagugggcccaguggagagcagucgguucagauggaaacagaagugauggaagccagcucuaaugggacuucucuggcuggcaaugaagaggaggagcugucuucccagauguccagcuuuaaugaagccaugacucagaucagggagcuggaagagagggcccuggaagagcucagggagaucacacagcaaggaccaagcuggcuugagcucucugagaugacggaucagccagacuaugacuuggagaccuuggugaacaaggcagaaucugcccugacacagcaggcuaagcaggcuaagcacuucucaggccuucgagaagucaucaaggccugcgccuagccaugcaacuggaagaacaggcuagcaaacaaauaaacagcaagaaacggcaccaaugaugacuucaaauaaagaucuguuucauaaca

SEQ ID NO: 2391 - RNA, 36861 nt, Mus musculus
ugucuucucacaguuguuuaaugaaaccucaaggaauauggaaauaaaggcuagacccuggaguggugaaagaguagggcccuggguguuggcugauucuuucugugaaaggccaugaggaccaaggaugugucucuaaagcagggaaggacucuagaaugguauguguagauacacaagggggcagucuucacuguggccuguaaaacccuauccucucgcaauaaucuuuuucuugacacaggguuccuugaacucacagaaauccaccugccaccacuaggcugcucgaguaauuuuuaucagagcccacaucugugugcuugcagggaagacccagaaaucaaagcucaaugccacugaggucugguguaacugcagcucugccagcuccugagacacccucaguugcaaguagacgccugggcuuggccuuugugcaugugaucaguucuuugccuucuggccaucugaaaaugcauuugagaugaccaacuuuaggguuggucuucccagcagugaacugcagguauucaguggagccaggugggcgccgucugccagucccagugggaguacuugaagcacuuccacauggaacagagcacagugacccggaugggacccaaauuagguuccauauccacuuagugacucagugggacccagggaggcgcccggcacuauuuauauagcuaggcccugcuucucccagagugagaacucucaccgagggacagagguaggacaaacugaggucacagaagcgagaugggcugaucuguggguauccauccuuugcauaacucucagaagccaggaugagcaugccaagaagaacguguacaauggcacagugaggaagugguuggggaaaggaguaucuuucgcauccugguacaccacaccucuacuguccccacucucccgaccaggcagcccagccaaggcacucaggcagucaagcauaaggcaugggcacagagucuguuuucugacauuacaaucccugucuaaagcagcugcccgacaucucccagcccgucuaugcuccacugcacaggcuuccuuacugaaggggaggcucaaacacaaggguagacagaagaaaacaggccaguccggcagaggcacaaaguccggauuuuauuguuauccuguguuuggcuuggugcaaaaaaugcccuuaccacugccaggccccacuggccucugggaaggcacaggcagcagguguucuggguuacucuuagcuguugauuugggucucaggcagggcuugcaaaagaagcacaguggggcucccccuuaacaugaagugcaaacaguuaauucacagucagacuucaccaggaggaagagcgggccagggcagaaggcacucugauggaggagcaagcccaaggcuagccuuggucuuuuuccugcuuccugauaauuuggacagcacagcugagaagcggcacugccaggucuggguuagugcauggugggguagggugggagggccugucacugguagaacuucuugcuagaguuguuagcguggucgaggagcagcuggcaugggguaaacuguguuccauaggcagacucguacuuccguagccgguccacuaccuucugagcaccauacagauccacaaagcggaagggcccugagcagagacagacuuuuuagugaaagagacuguaacuugcacaaggauaaaggaaggcaacuucccggccugcacacugaccuccgagacaagggggaaagccaagcccaaagacagcuccgaugucucccucugccgguguggccaggaucccuuccuguaggcacaggacugccucguucacgaaccuuguuaucacacgguauuggacgucuucaucagaggagcugaggaagagaagggagcaggaaggagaacuuagcuagagaaagaaagggaggagccagagcacagcacguggggugcgggugaguucuagggaggccaguggccaggguguacuacaccauccucaaagaucaaaguccuuucucuucccuauccaaugugaacugagcaccuaaacagggccuggcacaggagagaugacugucacaucugaaggaucagcaacagcagcacauucccaaagguaaccaacagugaggaggguacaggcgccuccacaacccaccucccaccuucacaggcuggagcaggcaggguguccacaggcuuggcccacucucaccuggauacugaaacugggcucaugugcagggaauuuagcuguacaguguuuugccagcuuugggucauaaauagaauagaaaaggggccaaggagcuuugagcuacuaagauaaacauuauuuucgggcaaauagucacucaaaucaacuuacaccucgggcuuggcaggcagccucagauuugccaagauauuauccauuucagaauucaaacucuuauucuuugagcccuccugauagauguaaaagcccuucccagacuugcgaccugagagaauaaagagacuguguuagucauugccuuuuaccccagcagcaaacccugucucugcuggaugcugugagcuucuagcacuccacugcaccccuaagcuccugcaugcagccaacugagccauuuaacccuugucagaugaugggcagaggagaaagcucuggugcauggaaaucugagucugcauaagaaaggccacgcccacgcccacgcccaauuuuaauguacaaaugaaagucccagguccuaaaggagauuucacugcagccucaauuguauguucuguauguuggacacagguagccagaccucagggccugguggauauagaacuugcuccugaccgugcaggaggaggaugcugguuucucuggcauacacggcaccgacugccuuuccccagccuaggagauucccuaugucuagggaccuguguucuggaaucuuuccccucuacccucucuauucucaggcaccugcucagagcucuguaacuagcagcuaacucuuguguccuggaguuacucaccuaagaagcccuuggagaccaucuguuucagcaguucuacgcugccaccuccaaaucgcuccccaaaggcuuugccuagaucuucugcuacgugcugugcuacauccacacccacuucgucugccagcguggcagcacccacagggaagccgaaaccuguggucaaggcguccagcuucuuagggucaacuccuuccugaacgggaaguaaagcaagggccucagggcacagccaucccaggucccccacacaagggcugccugcauaagcugcaggcacaaccuugugcagagcccacuucuuuucuuggacaucaccuggccagaugcagaacuagcgcuucauccaggaaagcacaagggaaacccugcagcuaucccacaggcacuccgaucacagaguuccuucucgcuggugacuccgaaucucaggacuaaguagaugcuauggcuaccaggacacacacacacacacacacacacucacucucucucucuguguguguguguguguguguguguguguguguguguguguguguguggugugauacaaugguagucaggccauucugggaggcucuggcuccugcaaugcugggggagcaaccagcagaguuaacacucugccuguugggcacagucuuagucccaggacauccuguuucagugugagagggagacacaaaagggccucuggagaaaagcaguaguacauucuuggggaacuugucccucaucuggacaucuuuagcuuggaggacagaaaaagauaugacaaggccucagacauuccauagaacaguacccaccuggaggauucgcaugacuucagacaucaugggugcaagacaccuggugguguagaagccggguccguccugccaagggagaggaagggagcuuacagccuugcuuugcugcccacgaccacauccaguauuccuuucccagacaucauucacagcuuuagcugacuuaagcucucaucagaaugcucaauguuauacuggagaagaagccaccucgaacagucuggguuucaugucaucucugaggucuggagucaccagugaggaucugccagagcccagacacuccugcuauccuacuucagcaggacagucaccacuacuguccguuuuggagacaaccuaguggacagaguuuuggaggcugguauccccuuccccugccccccaccacagaagaguuauaauaagucuggaggcucaagaaaucauguuugaacuuucauagccugcuucugcuucugaccuuaccuugaccacaaugaugaccuucccuugccugagccccacggccacggcagaggccguuguguccuuggagguuuugucaguggugaugauuucuaggagcugcaucuuguccacgggggagaaguagugcaugccgaucaccugugagggagccauaaccagcacauuaccagugccggggagggaaacacuggagagaaaggccugugggcagaacugcugaucuaggcagaggguuggguccauggucucuugccaccccugggcucaccuccaucaggccccacaucacaucccuggaccagugugcuaggaaagguagacuguucugcagccacacaccauaggagggggaagagucaggcuugggugguuuggagacacaggccuaguauuagcaacuguagcugcuuagaaauuuuguuguuguuauuucuagucucucuggcugcucaguugaagcagguauccuccagagaagugaggcuuuuuuccccucuuuaaaugacuacauucuuuaugaaucugcuuaagcaaagauaacuuucuagacagcauugcaaauacucagugaaaguacuucuaaguuuaguacuuucagauccuggguagagguugagggugaggcuguaggucccccagcccugaccuuccaggcuggauuggagucuuacccagccuaggcaggcaccacacugcacuacagcugaacagcacacugcuuccugguuuagggccuagcccucaguaucugguucuaauguaaguaacuuuaauaguccacauuugagaacuagccgccacgagggaugcacaccagucaccauccuacaccuguagagaguggcgcucaguuuucugugaccacuuuggggaagcaccccauccacuuuauacucuacacuggucuuuuccugguucauauacuaaaauuucagccagugagucugaagcagucugccguuugaggguuucugucggguuuaccuucucaggccuuuugcugacagcagcaauuugauugauugggagagcagauguguugcuggcaaagauacaguguucuggagucaccugcaggggaaagcauguaagaaucugucaggugggccuagagaugacagccacugcacagcucagugauacucgagcccagccuccucuccaauccauacuuacccagacucugugacucaccuaaaagcuuuuguguugaccuugcucucucuuuuuguuuuguuuugucuuuucaagacaggguuucucuguguagcccuggcuguccuggaacucacucuguagaccagacuggccucaaacucagaaauccaccugccucugccucugccucccaagugcugggauuaaaggugugcgccaccacugcccagcgaccuugcucucuuaauugagccauccucuacugacggccuguccugcccuggagaccacaucucagcacuuggguaaacgugguaccuuacauaaaugccacaaggaugaguugaauuagguuucggucaaaguggggcauggguguugaccccucuugguauuuagaugugcucucaagucuggaagauuacaccauucuguacccucgcucacccuuccuaagucagaaaguguauacuuccuucauccuaacugagccaccgaagggcaguguccacuguaauuaugcgugcagcaaacaaauacgaccaacuguuagcuuuaguugccugucugcacugucccuaacacaggaugcgcagucuucuggcucuaaucucaacuuauucaaguuuucugacacggguaaaaauauggaagaugugucuguuaaaucugcacaaauuuggcacagacagaaugcaaacauaagauuagaaucaagguugaagacacauuuaacacauugaaaaguugaguacaaaacguuaauuauaacagacaaaagugaaucguuaggauuaaaaaggcagaagaaaguauaggcauuugaggaaagggccuggcugugaggaggauccuaugauuuuuaaccaaccagaguggacugugagcugacgguguggugugacucagagugaacauacucucuuagcugcuaguaugguaucaagggugagggaaagggccucuugggcuagagauguagcucaguagguagagugcucgccucacaugcaggaagcccugggcugguucuccaggacugcauaaacugggcacagugcugcaugcuaguaaucccagcacuucggaagaggcagcaggaucugaaacucaagguuauccuuggcuacauagugaguucaaggccagccugggagguauauuuaucuucuacucuaggagagcaaauacuuaucucccaagauggcuggcaacacucucgcugcuccuuggucaugcaugccuuucuuccuaggaagaaggagucuauuucccacgcucuaaaucagggcuggccauggcuugguuuuaccaacagaagcauggccguuggucuugggccuugcugcaguucugcagcuaccucuuuugcucuuagagaaccuugcuauggagacauuuuggccaugggaggaauaggcccugaaaggcuugguguuuagggcgcugugguguucaagagaugcuucucagcaauguguacgcugagaugugagcuaaugaccgagacagaaagacagggaagcaucuacaaacuguuccacgggcugcagagauggcucagugguuaagagcacugacugcucuuccagagguccugaguucaguucccagcaaccacaugguguggcucacaaccauauguaaugggauccaaugcucucuucuagucugugucugaagacagcugcaguauacucauauaaauaaaaaaauaaaauaaacaaaucuuuagagacugucccgugaagaaugucaggaacagucuguuuaguuccauaggggguaagagacgacugauuuaaacugaaccauucguagacucagcuugggaguuuucuuaaaagcagcaaaaggucaggucucucgagaggaugggcaggaugcugugcuggaggucuuccucgugccuuggauuuucccucucuuuauaaagaugucuuuauuuauguauuaaguggccaggcugcauguacaccugcucaccagaagagggcaucagaucccauuauggauggccgugagacaccacuuagguggccuuaguaauccugccugcuucaccacagcuugcaaagacagccaccaguguugccagcucaguaucauuucccuagucuagucuagcugugcucuuucucacucuuggacuacagccauuucuccuuuucuaaaccuuucuuucuaucacccacaugagguacguauuuuguucacugucaucucaagaaugggcuuuuagaacacuugagcagguccaaaggagcgccaccacagauaaccauccaaaacagccuggagaaagcucccuugguucccuuugcuaccgagauaugaaaucaccugauuauggcucacagccaacaacaagaaauccccaagacaccuguguacccaugaggcuauuuagauggcugguaaccuccccauuuccacuccaauauggcuaaugagcccugggcuuaggagcauaggguacuuaauuaauuuucuucccacaggauucauaccugagcuuucugauauacacagcauguguacacucacauacaaacuuacauuugaggccucaaaauugcuuaguggguaaagguacuuacuuacuugcugucaagccugacaaccuggauuugaucccugggacccacauggugagaggagagaaaugaguccugcaaguuacccucugacugccacacaugcucuauggcaugcgucuccccuccgacaagaccccucugcuuggugcccuccgggauucaagugcaacagcccuuacuuacgcuuuccacuuccuuuaacacuuugugcuuuacaccgagguccucaaacacagccucaaucaccaugucggccuucucaaagccuuuguaauccagcugcccaaucaaguugcugaagauggaaucccuuucaaaugaugugagagcuuucuucuucacuuugucguucagccuagaaagaacacacucuuagaacagaacagcagaagacagcugcuguguggcuuuaggcacccugcgacacccugugugucauuacccccauuuugaagaggucgaguucaaagggacuuggugcuaagcggcuaaugaggaaggugauagcaucugaugucaccuuggaccccaggcacacaggcuuucuaccacaagaugacugcacauggcuguauuacucauaagacaguugggagugccagcaagaggugagucaugacccaaggaggagacuggcaagcacagagcauggcucuugccaccgugucccagaccagcgaguguuaacugcacccuuuacgcugcucucuaacacugucccccucuccccacuacccaacaaccccagcucgggucucaaacccagggccuuagugagcacucuuacacugagcgacaucuccagaccaagguuguuuuucaggcugucaaucuacuuucacucaguacacaagucucacacugaacuugucuuuuuccagggagaacuacaaaggagucuuguuauaacuggaucauuucaucgccaaggaauacgagauuucuuuuagguucaucuuaaccauacuuuucagaauaaauaagagaauuuuccucugaauugaaaacccauucacuaacucccuuaaggaaaagaaaaacuaaagucgcagcuaaguucacagaacuauccaauaagggacuggagaaaugacugagcaauucagagcacugguugcucucccaaaggaccuggguucaauuccuagcacacucuuggcaguucacaacugucuauaacucuaguuccagagaauccaacacucuuacacagacauacaugcaggcaaaauaccaaugcauaaaaaaauauuuuuuuucaauaaaggcuuuaaaaccaugggcugccuuccuacagcuagcuacaacaggcugucuaagugccaacagcagugacugacucaaugccgagugacaguuucugagaagggaaagaaaacauguccuaagacagcaguauggugauuggcauucaccaggccuaagaugagaaagggaguaucuagaagaagucagggaugaggcuaucuauccuauggcaacagcucuucgugcuggugauugcaggagaugcuggaaggggaggccuagguguuggugcugggacaguguugcuguauacgcugcugcccccuccuuuuuauuuuccauuauaaucuggcaauaucaccaaucugccaguccuggccaguaguguagugguagcgcacacacuccuccguagcugagggaggacagugagcucaagccacauaauccacuuaggacacacaugcccucacucagcacaaagucccacgaaggacagucugaugcagccagcuaauccgucaugucugugcagaacacugggcuaaaaacagccucaguguggcugagcugacuccauuuccacucagccuaacuggcggccuccgugugagacggggcugugagccauccuugguuuucauuuuaagacguuuguuuuaccuuuacuuugccauguacuuugcauguggguguucugcugcagauguggagcuggucggcaggccucgggcaucuggcucacuggcaggggcucuccucugccagcacugccuccaccuacuuggucggcacauguucucacacacccucccucagcccugccaagagcugugcagguuccauaauccauuccacgggggcaacuccaugcaaaccuugccaaaccugacaguuacuaguaucauaccaaaggauggaauaaaugguauuuagaauaucuaguaauaaggaaacauucaaaggccaauguccuaugacauaaucaagaaaaagaguugaaagaauaauuaguauuucucaaaaaaaaaaaaucaaaggaaacuuugguaaaacuauagaguguggggcuauguucaggcaaaaggacccugugaugaaaaacaagacaaaaccaaacccacucccggccccacacaguccaccuccuggcaccaacaggccacuuacccuuugaacacuugcugcuguccccggcccagccccgucacuguggugucuuuaagaagaguuuucagucccuuauccacagagaccugggcaaugccagcccccaucagcccugcgccaaggauggcuagcugccuggagggacaggaucgaacaguucuggugaacaccucaggcacugauuagcugggaaacacuacccacacugugagccaauaaaccaaccgccagccacaaguauaagagcuuuucaugaugucuaucuacaauacauuuuugauuuuuaaagauaaauguaaaacucacuaggcccaaaaacuugguuuuuccaugaaggcagaacuaaaccaacucucaauugcccaaagcgugggaaaccaagccuaaucuaaaucuagguuauguccgaagacuagucuguuugauaauuucauagugauuuuagcauuuuucugucauuucccuuucucucaagauuuaccauccuauccagaguacuucagucuccuuacuaguagcuucugggugcucuuuuuucuucugagacaggucuuauguagccgaggcuggccuuggacucaccgugaagagggugacuuugaacucacccucaugagugcagggcuaagagucuguuuuuuguuuuguuuuguuuaaagauuccagccccagggucuuauauggucuuauaucaccauaccuggguugugugguacugccaacugaacucggaguuccuguaugccaggcaaguauuuaccacaggagccgaguuauagcuuuggucugagaugugagaccuaaaccagacugccagggaguuauuccgagauaagaaagcucuauaaaggugcuagaagggccuagggaggacucagaggaucugaacacaagaauguacuggaauaaaggcucggcuguccagggcagaagaggcugaggcuaaucuaguucucuggcuucuugacccugcacaguugcugcaaagcaaauucucaggcuuuuaggcagggcagcuuacugaacguucuucuguggugcuccaaauuuauuuuucuugcacaggaccuggccguuauaaagccccaucagggccuucgauucuuuggucaaugcaagcucuccaaauuucugaaagguaaaaagaaaaagggaaagguggaacucugggguccugguaaugggacucguuugucacuugcucugcacagcagagggaacaccccgugccuuaguucacaggugcugcagcugggcuuccaccugcaacugguguccucuucacuguccucugaaggacgucucaccacugcuuugagggagguuugguguuuuguuuaauuuguuaauuuaaaaaaauuuaaaacaaacaaacaaacaaacaagguuucucuguaucucuggcuguccuggaacucacucuauagaccaggcuggccucgaacucagaaaucuaccugccucugcuaccacaccuggccuugaagaagguuuuaaugugacagcucucagacucuuacagcagaggagugauaaccuuugccugugauugagagucucaggcccagauggauuuuuaccauuccuccaauaacuggcuaugguggaggacugagaggaggaccagauauuaguuagggccaucuugccuaaggcagaacuugagcaggguccuagagacuucaguuuucuucccacugcagcagguggaccagcaccauucccacugccacuuuaaaagcgucuuagcaucaaggaugagucccuugguuuagugguucccagcauaaaagcugggaucucacuuucacacagcuggguuugcacccuggucuugccuuucccuacugucaagcuuucuucacuauuuaaaugggaaaauggaugccuaguucauagugcuguuacaaggaauaacaagaacacuaguaaaaacgacuggacucuccuugcuagcuacuauuaacacuguuagcacacacuggcauaauuaugggguuacaaauagcauuacaaagaaagacucugauaacauugcuuauucacauuaacagcaugaaauaaugcuacauuuaaucuggaaauagcauguucuauuugguauccuauggauuucaaauuauggauaaagaucuaucaggucaugaauucaauagguuuugauaagugguuuauauaaaaaguauauauacaugcauauauguaaaaauacacacacacacacacacacauacauaaaaugucaaguauagccacucccuggaauccaugcaaacacuggucuuaggaccuuagaagagacauaaugcacaaauucucaaguucuuuacauaaaauaauacaguacgugcacauccucuguauuucaaguugacucuagauuaacuauaauaccuaauacaagguaaauauuauauauauauguguauguguguauauauauauauauauauauauauauaugauaaauaacaacaagaaucuauauauucaggacaaugcaauuuuaaagcuuagaucuauauaauacaucaaccauaugugccccauugccuucccacucucucuugacccgccucuaucucaacauccuccuuggcgaauguguuuguucaguaguuggauacaggacugcaggcgugggagggccagcugcaugcugcaguugaggacauuacugauuugugagccauguuucucuuuuucuaacauacacacauguaugugucccuaguuaugaccuuuaaagugggaggaaagugggauccguaccaugaggagccagacugcucccuuagcuuggggaacccauuguccuacuaucaaagucuucaauuucugcauaaaacuuaaauuacccauucuacucccucaaaucugggacaccauuaacguuugagaaaugugaaagguguaggacuugucaacacaagcuucuuugucuguuucugauugcaagacacucuuuuucuaauucaccaaagauguugcaucucuaagccuuaguaaacacacacacgcacacguaaaucagugcuugcuuuccuguuugucucugguacugggguuggaccuaggaccaugcaugagcuauaggcagucgcuuuacacugaccuauauccccagcucacaauguaugcauuuuaucacaacaaaaucagccccagugcagacuaagggcauucacagauuggcucagaaaggaguagcugcuccccuguucucauuacagccucaauauugugcagucucaagcacugcagacaccacuccauuaucaaaccacuuagucacaaacuaauccgaagaaugaccacuggaaauaaaaaauguacuagguuuuauauauaguguuuuaauauaguauaaacauuuucagcuuucaguggagcuuugggucuuuaguauucuacaaauaaacuggagaaaaaccauuuaccugcgauucagcaagauaaccagcgucacugccuugcucaaguccagccuucacagccuaaaaccacaaaggcacauguucaguguugcaacagaauggcuagagguaaagugaugcugaguaagacagccagucuuuucaggcugugucauacccaguaggucauacacccagcuuugcaagggcagacccugaaccaacugucucucagcugcuguugaacccaccaggaaagggcaccuuaagcuguucuuccagcuucucucuaaggccagcacuuucugcucacuucucugugcuucugauaugugugugauuuuguuggucacauuaaccaggaacuccaugcaacucaacucuacauccagaguaggcacuaucccguauagggugguaaauaaaaaagacaaaggaaagaccccaagcccaaccaccauaauuuauacauaugauaggaaacaaaagaacccccaaaauucauuaaaagauaagugaucuacauuccucaccuugacuuccuguaauaucuaaacucaucaucuccgcuuggcaagcuucuuacgcagcacugcuuuuacuuaaauguauuucggagucuuauucaaaccucaauccuccauuaucagauauuggcugauagcucuauuuugucucuccuaauccucuuugacccacuaccaugaaaauaacuaaaguucaggacaaaguaaaauugauuaguucauuauugcugaccuuuuaagacuaacuguagccugucuugcuacaguaaauuagaauuaaaaaaagagugaaugugaauuagaaaaagagugucauacaaucagaaacagacaaagaagcguguguugacucguuccuuggcccauccugccuggccugagucucccuccaccuacccugugcucaccucucaggucagaucccaugagccucugccucaucucacugacugcuuccucugagcacugacuaccuggcauuaauuuuuuuuugcuguuuuauaacuugaauggcuaucugucuuaccguaaguauuuaaguucuccagcccagacuauuaaguaugaaugcagauguguuucauacaauuucuuuuuuuuauaaugcuggggacugaaucuagguuuauucaagccagacaaagguucuaccagagcuacauccccagcugauauuuuaugcuuaguaaucucacgacuucuacucuacaaaggauacuuuguaaaggauccauuccccagucuuuugguugcuugagauacaaucucucuauguagcucugacuguccuauaauucucuauguagaacaggcuugccuagaacucagagaucugccuccggcugccucccagaguguaagcacuaccacaccuggcuuuuauuuuauuuuaagacagggucucuacaaaucccuaauuucuccaguuuugauuauauguuguugaaucucccagucugaaaaguucuaaguuuuaaacuauuuuaaagaguuuuaauuaucuuucuuugucuuuucacacugccucuauaucauuaggucuucuuaagaauuauagcaaugggaaugccuucuuuaaaaaaugauuaucagcugggaguaguggcucaggucuuuagucucagcagccaggaugccgaggcaggcagagcacugagagucagccuggucuacagugcagguccuggguugaaggccagagcuacacagugagacucuuuuucaaaagcaaucaagugagcgagcacacaaagcuaacacacacuguucagaaucacagaaaagagcaccacuuccuguaagagggaggacucacaucaauuauuuucaaaggggcaggauaaaggccuuuagucugcuucuucacuuuuucuucaacuguuuuguaaaccuguugucugacaaaugggacagucauggcauacguugucagcucuguaagguaaaaugugguuagauauuuucugagaugauccaaggcucccuugucuauucgcucugcagacuccauagcacgacauaauuuuaggcaucugaaggaacacaauggaaccaacauccucugccugcacugggcucgcugccuuaacaugcagccauuacuuucuaugugcuaagguuucgucuggggacuuuuaguacacuauuauaaucuacucuuguauuaauguuuaaaguuuuccaauuuaacaggucucuaaacaauggcuuuagcugggggcugcagcgauggcucagugguuaagggcacugacugaucuucuagagguccugaguucaauucucagcaaccacaugguggcucacaaccaucuguaaugggauccaaugcccaauucuggugugucugaagacagcuacaguguacucauauacauaaaauaaauaaaucuaucuuuaccagauggcuuugcuguuaguauuaaguugaggauuuguccuugaggcagaauuguccccucuaaggcuuacuccuaaugugcuucucuuccucucccucccuccugguuuucagagacaaaguuucucugagaagcuuuggcuguccuggaccuugcucuguagaccaggcuggccucaaauuuacagagagccgccugccucugccucccaagugcugggacuagagguuugugccaauaccacccagcauuuuucucuuucuuuugaggcagggucucaaguagcuuaggggcaggcagaagcucugcugugugcuguuaacaaagccacuuacuuuccacaaggccuuugcucugcuuugcagagacuuuccgaucagccaggccuuuggcaaaauuaacugcaacuuccucuagguauucaauuguccuuucuucuggugauuuuauuccugguccuguaaaaacaaaauaaaacaacaacaacaaaaugauugcaaguacuugauuguaaaucaagcuugaaccaguccuaugcagauaaaaccuguggcaggaaggcucccacacuuccuucagugaugaucagugauguggaagcauaagccaaauaaacucuuucccccccaaguuacuuuggucacgguguuucaucacagcgacaguaacgcugacgaagacagcaaccaaguucccauuuaugggaagcuucugccagcuugugagccuguuggaagcagaaauuagguuauguguagcucaguggaguguaugauuagcauguaugagaccugguucuauccuuaguaccaccaaacaaacaaaacaaacaaaaaauggugaagcugagaaaucugagaagagaaguuacagggcgauguuacagggcacaaccaggcugucugcaugaacugcacuggggaaggcgcucgaguacagaaaggaguguacccacuuuaaguacucuggaaacaaagucuccagagggaggagucuacuacaaagacaucugucuuguucugaaccagaauggagaagaagaaucagaacuaaaccuuuaaaccaaagcucagagaggucccagaagucaaccccucaucauccugcagccuuggcagccgaggccgaggacucuguaggcagagugcucccgagcaugugcuccacaucagggccacccagaggggccccagcuagcacugcucagcacguucccgacggacaaguauccaagccagggaagaucaccagagagacaggaagagaacagacgccagcacaggacugcgaguggccuagaccuucugggauggaggucauccuacuaggcaaagaacugugaccaacugaggcacucccugagggcuacgccuuccuuauaccacacuuggaauguggccaguccucacuccacaucacacuccucaggggaggcauaggcaaggucacagguuacgggcuggcuaugcucucauacugccauucugagcccagauacccuucccuccuuggucuuuuuaccuuagggcaccagcggacaccuucuuaaugagaaaaaugagaauauuaaagauccuuugcccuaugaccaagccaucuuuucugccaggcuccauaaagccugucuguucaaggcuucuucagcagugagaugccucacaaccuccuguaacuguggcuucaugguagccaaaggccuccucuggccucuaaaggcacaugcacauacauaugggcacacucauacucagauacacaugugaacauaaauauuaaaaaaaaacaaaacuaaaauaaacccuaaagccaucuaagccagaaagaaaaacacaacaaaagaaaacaaaaaacccgagagccuuccaaccccauauauaacuuugugguuaguucuguuagguauuuaaguaaguaagaagaaauaucaauucuacacaaaguauuccagaaaacaagagaaaggaaaacuuuacaacucauuuuaugaggccagcacugccugacacuaacaccgugcaacuacuguaagaaaacauaauuauccaugagaccauucauuuuuuuaucaggcacaaauauuauuuauaggugaucaagccaguaauuuauaaacaagauacuguguuauaucuaagaggaguuuauuccugggcaaacacuggcucaauauuaaaacaacaacaacaacaacaaauucagugcaauugacaccaagaagaaaaucaaucaucagaucacugugauccaaaccacgacgacaucugacaagauugacaccgcucuuagcaaacugggagaaaaggggcauccaggacaaccuacagcugccgccacacucaugauaaauccuuccucuccucugggacugggagugaacugugugcccccaccauuccuguccagcccugaacagaggucucagccauagcaaaauccagagaaggaaacaagcggcacucagauggggaaggaagaaggcaugcugacuaacugucacagaacauggcagcauauguagaaaagccuugguaauccacaaaaaaaugcucgcagacuuaaugaauuagcuuauuaaaaucacacaacaaaagguucaugcccccaaauucaauuacauuucuacagacaaguauuuaaugcaaaauaaagcauauuagccuaaagcuaugcaauaacuaggaguaaacugaaauggucacugagaagucgagguacaaacacugcugagaaacugagcucgucagccgaggagacgacgcugauggcuuaacauguguggugguuugaaacagcccagcccaugggcaauggcacuguuagguacagccuuguuggaauagguguggacuugggggaggaagagggucgcugguaugugggcuuugagguccuaggcucaagcucuauaccaugcacaagagaccuucuuucuagcugauggcagaagacagucucucucuuucugaaggaucaagguauagaacucucggcuccuccagcaccaugucugccugcacgcugccacgcuucccgccaugauaauaauagacugcaccucugaaacuguaagccagcccccaguuaacuguuuacccuuauaagaguugccuuagucauggugccucuucacagcaacagaaacccuaagacaauauucuaauaaaaauucuagcaaguauuauuauaucuauaaucuuuguagguaugaucauauugaauacagaauuuauauucaaauguaaagcaacuauuauagaaaaaauaauuuugaaugaauagagcauaguuggagaaauacgauaucugauaaagcaauugucaagaccacauugugcuguuucgagaggggguugguuaacugaaaauagaauauauaguugaccuauuaccaagaugccacuguaguucacuggagaaaaaauaauuuuccuuuuuuuuuuuaauugagccagggucucuuaaaguaguucuguauguccuggaacaugcuauguagaacaagguagccuugaccucagagaucuacuugccuaugcucugauuaaugguauauaccacuaugcccagcuagaauaauuuucuuaaaaaguguugcagaacauugguauuuguaugcaaaggaauaaagacacucauguaaauguuaaccuaaaauggaucacagaccaauguucaagagaaaaaacaagaauaguuucagaagaaagcacgagaaaaaggugcuuguuucaggaagugaaaagagaagcugcugacugggagaaacgauccucaaguuacauauuuggcagaagacuucuauucugauguaguaagaacucugaaaacacaaacaaaaugauuugaacauauaugggaagcuguugggguaaucuuccuucacguugugugaagguaugucuguguuuuuccaauugcuaguuuguaccagcagagagcuaagugcgggaagggcuuugguacugucauuucuaugguucauuaccagguuuucuguuuuauaaaguaugaauguccuucuuuaccuguuuaaaggcaauugagaugagaaauguuaucagagguugucucacugcugauuuguuguaauaaagagcugugggucaaaaccuugggcagaaagaagagggcggaacuucugggcagaggagugacacagggagaagaaagaaucaagaguggacguggagggaacagacacagacugcagcagcacagagcuagccaugacgggucgcaggcuagacagcuggauuaaguuagauguucuaagugggagacugccccagcaaaaggccuaagcucuaaacuguaauagaagucuuguguuacaccagagaaugguacuguucuucuagaguucuugauuuucaguucccagcaaccacaggguagcucaaaacaaucuauucuagaaucuguugcucucuucuggugugcagguguacauacagauaaagcacucacauaaaauaaaaaaaaaaaucuuaaaagaagucuugugucauuauuuaaacugcugguaggucuguagaaagguccacuauaggaagcaaauuaauacaaaggcuacccaagucuaagacuaaaaccaugcaaccugguuggaaaccugaagucucaugcugauagaauaaaacccaguaauuacuucggguaacagguggguggucucuuaggagaugaacacacacacagcacacagacuaccaauccacucuucaguguuacucaaaagaaagaaacccuauguccacauaaaggcuucugaaucaaugcucacagcagcuucauucagaauagucucaaauuagaaacuacacgaaguucaucuuuuggugaauggauaaacaaacuaugguguauauauaauaaaacagcccucaauaggaaggaucacccuggguaggcagaugacucagcagauaaaguccaaugccaccaagucugaggugugaguucaaucccagaaccaacuccuagauccucugacaguaugcugugguguguguguauauauauauauacacacacacauaacacauguaauaaguaaguguaauaauuuucagaaggaacagauuauagauauaugcaauaacaauaauguauuucaaaagcaugcuaaaugaaagaaggaacaaaaagcuacauuuuagaaauguuuuacuguuguagaacuuauauaacuauguauauuuguuaaaacucaaacuguccauugaaaacuggaaaauuacauacauaucuuuaaaaaaaaacuaccuugaaauuugauguacaaacccuuugugugcauguguguacaugugugugcaugcaaguguguauaugcaugccacaggauaacugggaggagucaguucuuccacuguguggauccuagagaacaaacucaggucucuggguuuuguggcaggugccuuagcccacugagucaucucaauagcuccuguuuguuuuucugagucagggucucacuauguagccuuggaacucucugcaccauguagcucaagguaguucaaacuuauaguccauuugucucaauauucuaagugccgggauucuagccaugagugaccacacuaagccuuaaguuauugcucaaugcugauacuuaagaaguguauauuuuagagguuccuauugccaccagaaguagauaucuuuugcuagcauucugagguuggguguucuguguguuuacuguauuauuuaaauccacagggagagaugcagcucacuggcccagcaugcagaagacccugguuuaaucccacacacuccaggcaaaaauaaaaacaacaaaacaaagacccuccaccagagagugaaggaggcuuacacauggauaggaacacagguaacuacacuaauaacugaacugauugauucuuguauuguugguauccagauaaucaauaaaguaaauauaaaccagcguggggauaaaaaugauuauuagcucuuagaaaaugucacuccugguugguuguugguggugcacgccuuuaaucccagcaguugggaggcagaggcagguggaucacugaguucggaguuugaggccaacaugguuugcggagcaaauuccaggauggcacgggcuacccagaaaaacccugucucauccuguccccucaccuccagccccgcaaaaaggaaaaagaaaauguuucuccucaaaaaucauuacuucuuucuuaagaguuuugaguuuaauccuaauauucaagagaucaaguccuccagaaaacaaacaagucuauaugaccaaaauucugacucauguuaacacuuacccagcgguuccaccaacuggucaaccagucccauuuucuuugcucugucugcacgaauguuccugccagucagcaucaugucaaaugcagcaggcacacccaccuaacaugcaagcaagagacgaagcacaggggaugagggugggaguuaguuacaaaucaucacguaaacagacuuuagaggaaacguggggcuggagagaugcuuagcgggucaggugcuucugucaagccugacagccuggguuuaacagcuaggacucucguagcagaaggagagaccgacuccugaaagaugcccucugcccuccacaugcagaggauaccugugcauauacauccaauauaaaccaauaaauguaauaaaguuuucuaaaaaaggagaaaaaucaaaccaguuuuauguucuuuuauuaguaaauuaaaacuuauauacuaauauguuuuuaaguuuugagauuagauacucaucugaagaagaaaaugucauuauggugucuuuggcaugcauaaaaccauggguuuaagucucagcaucccuauuucccaaaauuccaauacuggaacuauagugcagacucugagaugagagacuugcuacuuuuacaaaggcuucagaaagaaguuugaguuuaacaaaaaugcagcucaucugauacaguauucuagaaauucugcuuucuagccagguguauuguuuguucuauaaucgcagaucuuggaaggcugaagcaggagaaucauugacucaaguccugucugaauugcagagaagacucugacucacaacaaaacaacaacaacaaccccaacaaaaacaucuggguauggaggcauaugccuuuaaucccagcacucaggaggcaagaggaucucuucuggguuuuagcccagccuggucuauacuccaggacagucagaaccauagagagagacuggcucaaaaacaaacaaacaaauccaaaaacaaauaaugaaagaacuucuagcaauguaagcaaagaaauacaacaaaacuuuuuaugucaagauaucuucuagacauuucuuauaaagagauguauaugauuuuaauuacuauuuugguauguguuauuccagcacuugggagggugaggugggggagauggacaagagugugaggccagucuaggcuacgaaugaggcuucugaaaccacaucaaaaccaaccaaaugaaguaaaacccucccuucccacucuaacuuguaugaacuucuugugcagucucucuacugagcccucuucacugaggagucuacagagcuagaagcuccaaggcucagugccuucuaaauaggaaauuucucugcagcuucuagguaugacucuccuuagaaauucaaaagcuuauugugccuuuuuugguccuuugaauacagcaaggagaugguccaaaucagagaaggacaggaaaguucugucucuuacuuagcaugaacuaugacacaugguuuuaaaaaccuauuaagaggaagaacaaauuaauguucuagaaaaguaagacaguagcuuaucgucuuuacacuucauaagggacuaacgaagacugaucaacaauucuguaggacugaaaaaauaaguaucaggagcgaaaaaaaaaucucucaaugaccgucuacauugcuaacuuacuugguuucugaauccuucauugagugucuaucuuauauauuuuguacaagauggauaaaggaguauuuauguacagcagugucaagcucaugguauugggguaaucuuaaacucaccauuuugggcagucucuggguaccuccggcuccugguaagauccccagcaacacuucagggacaccuaauacuguuuuucugucuuuuguugcuauucuguauuggcaugcuauggcaagcuucaaacaaaucaaaaaaaaucagaaugucagaaaauuuaacuggaucauguuggcaccuagguuggcaggucuaaagauuauuuauagagcagaauguaccacaaaauuaaccaugauuccuuaggcugacaucuggcacucuacaaucuaccuuuucuaucuguuuucauaauuuauuagcccccuuuuagguugcuauucgucuuaaaaauauuuugauggcaauggacuuuaccaauuaaaaaacucaagccagaaguguacuuccauaguucuggcuacacaagaugccgaagcaggagaauugucugagacuaugaguuugagacuagcuucagcaacauagcaagacccuugucuuauaaucaaaagcaauaauaacuaacaauuuuccuuaagucuuauuaacaaugacccagcugguagaaccagcugccuguguggccgaggcaagaggaaucucagagaugaccucuuccgaucaaucggguauacuugcagucucccgacaggccuugcuuccuguugcuuuugaauacaacuacacuguauauggaauacuucugaaaccauuuucuuguuaaucaaauucuuuuguggaucaggcccagguuucuuuuauuaauguaucuaaaaaucccagcauacaguccaccaugugauauaugcucaauaaaugucuuguuuuccucuuuuuuaaaacacaguacaaucuaguaagaaucucuucucucagcuggucauggcacacaccuuuaaauucagcacuugggaggcagaggcaggcaggucucucugaguuugaggacagguuggucuacagagugagauccugucucaaaaaucaauaacaaaagcucuuuaaucuuauuuugaagaguuuugcagauugaaaacucuucaaugcuaucuuuacuacucacaagaaacuauaugucugugucugucacacgugcacgggugcgcacacacauaacuuuguaaguaagacucagccaacuuaacaugaauucgggucacacuuccggaucucugcccugugacccugaagcaggcacucagaugugagaaggccuucacagaugugguacacacccccacuguaaauggaaguagcauucccuggcuuacugucugcuguuaauuaccguuucucaagaauuaaaaauuaaaaccauucaggcauuugacagcugaaaauaaaaucacuucuacucagaaaacuguucuuuugcuguuuuuagguaaaacgguagccuaaagggcucugguggcagugagugggaaagccugaacagcucuggaauacuucuauaccucaaguccuccucccaagcaggauccacugauggcggccacaacgggcuuuggggacuuuucaaguuucucaaacauucucugaccuuccugugauauucguguugcuucuugggggguuguacaagaggauagcaugcugcaguaucgacagaaaagaaaaacacaaaaggagagaugagacuguggccuauuuuguauaauauuucacccacuauauacuuaucucaauguauaucaauauuuggcaaugagucuucaaacacagaauggaacagguuacacaauuuacuuugcucuguaacaaacuauugagcacagaguucuaacgagaacaucaccugguaaauauucucacugucagacuagacaguucuaagguuauacucugggucuaguuacucucuuugagcuauuuuguagucuuuacuugccagacaugucuguuuuccuacugacuuguagcuuguuucaaaugcuuccuuaucugccugcacacaggccugauuauucuucuccacugguccuuaugaauggaguaggauuucuuuaguauauacaccuggauaagaggauguggcuggaacguauguauugcccccacaccuuguguggauguaccgcacgugugcucaccugugcgggcacauguggaagccaaugucaggugguuucuucacgucuuacuuuugagacaaagugauccaucagacucacugugcccagguuucucauggaugcuggaauucuaguucagacucuuggcugagcagcaggguuuuacccacagagccaucuccccagcccgugcacuuucaauuuugcuaaguacugccaaacugcgcuguaaauguuugcuggucugauggaugaagacuaggcagucauucuugguuaacuuaagaaagagcuguauuuagucaucuaugauuuaagcaacaaaucccuuauuucaugaacuuuauuauacccuggaaaacaacugaaaaaaaaccaaccuuugggagaauuuacuucuaucuuauuuuagagaagguauuauuuaaaaaauacauaauuaagcaggauaaacuuacuugaugucagccccugcgacaaagcagccaggcuuugaugagauaaggacagcacuccugauuuggucguuggcccagauuucguucaugacuucuaugaacucugacuguacuucuuuauucaauguauuuaccuacaugagaaagagcuacaucuaaggguuuaaacuggaaauuucacauacauacacaaucacugucaagucuguuuaugcagcagacacauauugcuagaagaaaagaaaagaaaacaaaacaaaacuaaaacacagaccgaccaaaccccccuaaaacccucagcuuucagguagcuuuaguuaauuauuaguaccccucccuuuaacaaugggucucacaagcuggaggaaugcagggugguuaacuggcuggccaugcaaguccaacaaccugagcuugagcacugaauccgauguaaaggugggagacgagacuuagcuucacucucacccccaaauacaucaauacaaacaaaagugagguggucucaaauagggacagccagcauuggccuuacuucugauccuaguacuuaagagggcagaggagccgggcagugguggcgcgcaccuuuaaucccagcacuugggaagcagaggcagguggauuucugaguucagggccagccuggucuacagagugaguuccaggacagccagggcuacacagagaaacccugucucaaaaauaaauaaauaaauaaauaaauaaauaaauaaauaaauaaauaagagggcagaggaaggagaacugcugcaagccuauggcuugucugguauacacacaaaguucccagugagccccaucucaaacaaacaaacaaacacccuaaaaauaaaaacaagaaugugaguuuguaguccuaagaguuuggaucauaugcaggauauaagcaaaucuacaaauauuuauuggugguuguggggaaccuauagaacauuaaaaaaaaagggauuaaaauuaaacauuguauggauuucacuuuguaaauauauucaacuucagaaaauuagguuaaaaaaaucaaaucugaaucacugguuaguuaguauuagccuaacucuagugaagagacgggcgccaauuacgcuaaucuguaguagcuuuagguguuuuccuguacagauccuccuauuuccuacaggguuuuauauagcccaggcuagccuugagcucuguagcugaggaugaccuagacuucuuucuauuuguaucucucggguguugugagccaccaugcuuggcucaaaaucuccuauuucuauaggcccugguuauaagacuuaaaaaaaaaaaagacaccuuuauauuugaaauggggggagaaugaauuccugcggaauuuugcaacucuuggcaaaagauggagguacugcuuccugcacuguugaacuugccaagauccagguuccauuuucacggaaccugauuucuagcacguggacuguccgggucauucaaucccccaggaggcucaagagccaaguauccacaguuaccccagacagccaugaacuugaacaaugacucuuucagucuccauauuuaccccagccguccuacugugaguaaugacucugucaggcaguaaugagguggauaaagucuuaucaacaacguauucauccucauucuauguaacaacagaaggcuaguuuuauuaaucuugauaccuagaagcaacaagaaggaauuauuuuuuuuguguccugucuguuucugagauagggucucacuaaggggcucuggcugucuggaagcuauagagauccaccugccucugcuucuccaaccaaaacaucaccaagaagaacuuuuuuucccuuguuuugggacagagucucacuauggaguucuagcugaccuggaacuugcucuguagaccaggcuagcuuagaauucacagagaucugccugccuuuguuacuacccauggccccaagaaggaauucucauucaagaacaucuauguaacucacaaaauuuuaaaaaucguaagacaaguccacuucaagucagggagauuuuauuucuauguaggauacgacucauaacuguaguugguagaaauuaacuaaagaaaguucaaguaccuuugaauugggugaguuaauccgaauaacugccacauccccuuugacgccauaauuaauauggguucuggcuaaaaaagagaagacagauugguuucuaaacauguuuaguauaaaaaaacauuuauaaagugauguuaaaaucauauacauacaugccauuauauggacuggacaguuauauuuaggcccgccaccccauauuuagagaugaacacacacauacauauucagagcuacacaccacacacauauacauacccauacacacuauuuacuuuccuccaaccccucccacccacuccccuuguucucucaaauucaugacuucuuuuacuuuguugcuauauauacauauacuacauuauacuacauacauauauauguacacguauauauauuuagggauauacacacaaauauauacauauuuagggauauguacauauguauacacacacacauacauacaucaacaaagaaagaggcuaugaauuugaggaaccagggaaauguaugggaggggcuggaaggaggaaaaugaauguacaauaagaugggauuauauuaucaucuaaaagaacaagaggauuauaaagagcaacguuaaguacauaagcaagagugaacuuacucagcagagcagaagacguuguaaagcugcggcaaaugcagccugcaagacaacaguguuucaaaauuacuuccugaaauagaguuucuuuaauauuugucaaaucagaaaaacuguuuuuaugccaauaaacuccuaaaucagaacaacguauucuaauccauuauuguuaccuuuucuuauuuuaauuaucaggucaaaugauuaaccagacagcaaguaagguagggagaagauccccucacccaggaaaaaaaggagguugcaucucuacaaugugagugugcaaagaagggcucugacugcaaauggaauuaagaucgaccuuaauauggggacaguaucauggauuaucuaaauggacuuaguguaaucacaaagaaaaucagagacaugugaccgggacucagcuccagcuugcugaaggaaggagaugagcacaggcagggaccccaggcugucucuagaacuagaccaugcaaagugauggguuucccucagggccuucaggaagaacagaacccugucaacaccaugugggccuagugagacccauuuugguagugcccuuguuaguuccccauuuccucuugggguuaaacccgggucuauuguaugcuaggcaaacacuauaccacugagcuaaguguccucagcucaagucucacuaaggaccucugaccucuaaaacugcacuggggaggcagaagcaaguggaucucugugauuuccaggccagcaagcgaaagcaugucuccagcacccacacuggcagaaaggcucauaguggcccagcuccagagaaucugaugcccucuucugaccuccaugggcacccacacacguggcauacacugauaugcauacauaaauaaaaauaaauagauaaauuuuuaaaaacaaacaaaagaagccaccaggcaugguagugcauacacugcaucccagcacuaaggaggcagaggcaggaggaugucugugagucugaugccagccuacuucacacagugaguuccaggucacccauagcuauauagugagaccuuguuucaaacaaaccaaaccaaaccaaaccaaaccaaaccaaaccaaaccaaaccaaaccuaaccaaaccgugaaaacagaaggcaagcacugucuauaaaggaaacacucuaugucacacuuugcugguuuaagcacaucuaacugaaacugcuuuccaccaguaacguucccaaucucugccuaacaaacuccacucuguucucugcugcuuacuaguugauccuuaucaucuaacuuguuuaguucuucagagggaccacaaagagaucccaucauauggccuuagccauuuugguucuaauuauuacuuugcucacuggaugccuuuggcaagcagccccaacacuacaggaaaagcagccauuaagacaguagccggacucacaagaugguccacaugcuaucauuccuuagcauuugggaggcaaugagacucaaaagaucauagguucagagcccgggcaaucuguuuuuuguuauuguuguuuugguuuggucuuuauuugagauaggguuucaccguguagcccaggcuagguuggaaauaaacacacacacauacacacacagcccaguaugaccuugaauucuugguuucaugauuuuccuaccuuaaccucccaacugcuaagaguuuuguuuggccacuauaaagucuuagcuggucuagaagaacuuguuauguagaugaggcuggccuugaacucaaagcuauucaucugucugccgugauuaagagaguaccuaucaaggcuuagugcugaggguuacuaaacccaaagauauaagcuagagaagugcucuaccacugaguuacaucuagucccuaagacuaucuccuaacugacacuagguauuuuauuucaaaauaauuuuugaggaaggccagcuguauugguuggcugugaauaacucugucuggcuuaguauauaauucccauacucccuccucagaguaugggaaaucuacuguuuugcugcuaaggauuauccuguccagaguucuaauuaacugcacuuuggggaaucuuagaccugccuuucucaugucagucacaucagugucaugaccccucccacacgcagcagucaguucuaauucaggacugggcuuuucucuaacagugacgaggacuggauccucugcgugcaagcacacaagaguggcccagugcagggucuuuccagcuagauucuagguagaagacagggaaucuaaggggaauuuuggacaaacauuaaauuuguuugaggcguuguucuauagccccuccauccuaaaggcuugugucuacccugcucuaagcaagcuuuaggugauaagcagguuguucuggaguagcucugaggcaacauccccuaaaugcagcuuuuaggguucuucagaacacccucuuuuucuccuucaucuauacucauguucaccucaaaccgccugucuaugcuccucucuaauucuucacucccuucuccugaucacugaguccuaaauuugccugacuauucuaggaaaguugucccuuuccuuaguuccagaaaaaaaaaaaaaaaaagacaaaugucacuuucuugauuaagaguuacacaugcaaacaucuguacucagaaauggcagaugccuuaaagcauugguucucaaccugggugucuugaccccuuugggaucacauaucagaugugcuguauguauaucagcagguauuuacauuaugauucccaacaauagcaaaauuaguuaugaaguagcaaugaaauaauuuuauaguugggggucaccacaacauauaaaacuguguuaaagaagguugagaaccacugcccuaaaaauaguaucaacuaacuaauuacuuauuucuuaauacuaaaacuucaguucuuggggcuggagagacugcucaaccauuaagaguacugacugcucuuccagaggucaugaguucaauuccuagaaccacaugguggcucacaaccaucuguaaagggaucugaugcucucuucuggugugucuguaaacaucuacaguguacucacacacacacacacacacacacacacacacacaugcacauauauacaugaauguauguauguauauacauaucuauaaaaauaaaauaaauaaaucuuaaaaaaaaaaaaaaccuuucaguucugaucaucaacaaaaugugcagggcccccuuucuugguggagcuugcaucccagggcugcuccagggcaugugcugaggacauggcacugaaucagcuccuguucgggggacacaggugaauauuugaaaauagcucaguguagacuguuugcccaccacacacacggaccuagguucaauacccaguucugaaaauucaauuguaaaguacaaagucuagugggaaagcagcaugggauggggaaucuaccuaggaaagaguaaaguaucccgaaguaggaauggacugacugcuagaguccaaguaggaaggggugagguacaaagacagacagaagccuagcaaaguaaguauguaagugauagaauacaaaugcugaaacaaauaacaaaccaaccaaaccaaccaacccaccuaaccaaacaaacaaacaacaaaaaaacaaccuucaaaagcaacaugguugcaacuuuuuuccaggugagguacucuuagccagcccaggcuagcuagaacuuguaaucuuccugucuuaauggaaugcccaauucacaaguauuuguauuccucagggcagaguuauuaucuuaaaaaucaaauauuuguucuuuaaagguugaagaugcaaagugggguguggacacacaccucugagggcagagggaggcagaccccuaggaguuccaggcuagccagaucuauugagaucuugucucaauaagcaagcaaacaaauaauaguaauaaaaaaagagcuggugcucauuagccuauuguuaagccauuuuaauuccagccgacuaacuucucuuugugguaaacacacucccacacacuuacacaaaacauacucuaaaccaacagagacaaaaagcaaagagaaagagcaguaaaugaacaaacauuuaaaaaaaaucuuaacgacuaucaauuuaaucaagccaaaguacaagguaacugcuucuggaauccagccuuacccuaacaacaaagcuuacuauacagacgcggugugaacuuuagccuacauuuucagugccagcaaaugcaaaaccuuugcccuacuuucuaaucaucuucauguguaacucaagaaaauaucuacaaggucauauacaacuauagucagugggaaggguuggauugugcugcacaacuuugaaaacuggaaacguuacuuuaguuuauagaaauuuauagcuuuuucaaaauucaacccugggacaagaagugagagucagauuuaaaaauaacuacuaauugccguucacuucuuguaaaauuguuuuaccacuuacauacuuaggaauuaggaaaaguaggaauuaaauggauauuaagaucaacuuaugacuuuuuugauagucauguuagaauaacaguauuguacaagaucucuuucacaguaagugccauaguucauuaagcauuuggcaaugccuccacacacucucagggucaaggacagaccugcugagucuagacucuaaauaguaaaucagguguacagcuaauuuuaaauagacuuuccugcauauuuuuucaaagugcauaagcugguauuaaaauaaucuguagcuauaauagacuacauuuucuuuucuuuuuuuuuuuuucuuuaaagauuuauuuauuauacguaaguacacuguagcugucuucagacacuccagaagagggcaucagaucucauuacgagugguugugagccaccaugugguugcugggauuugaacucaggaccuugggaagagcagucagcgcucuuaaccucucuccagcucuagacuacauuuucuuaaugaaaaaaaaaauacaacuuauauauuuagauauguuucuauguagaaguauaggaaaauuuagcuguuagcuuuuuauuaccuauguaaaauggauagauuacaaguucucagcuauauauagucauugcuucuaagggauaaaaaacuaauaacauuuauugagaauguaugccuauguguuauaccuaauauaacuucuuuagauuuaacaugauugacuccauuuuaccaaugauaaagauacugaaauuaauucccaaggucacuagaagguaaacuguagauucaagccagaugacagaguccguauuuaaugcuuuuaauugcuccaucauacuacuucuccugucaaagaaaaaaaaucacucucauucauuucacagaugggaaaagaaagcccauuuagaugaaagggcaaagucaacagcuagcuagugacaagagaacaugugacccaaucaccacuccagugcuaaccuggcugccaauucaugaaaguaccuuacaucaaauacaggaccauaggugccuuuuuuccccuaaaacuguuauaaauguggaaaaggaaacacaaccaagugcaaacaggagacauagagaucgauggaucuuucuuucuuucuuuuuugguuuuuccgagacaggguuucucuguauagcccuggcuguccuggaacucacucuguagaccaggcuggcccugaacuuagaaauccaccugccucugccucccaagugcugggauuaaaggcgugugccaccaugcccggcucuuuucuuuuuuuuaaaagacagggucucacuguguagcccugacuggccuggaacuauguagaccagacaggaacacaaagacccaccuaauauuaaaggugaauuagcacccaguccacuucacuuuuuuuuuuuuuuuaauuuuuuuuuuuuuuuuuuuugguggguagcaauuuuggcuauuuacacauaaucgaucuauggagguuuuuaaaaaaguagaaaaagauucaaucaauuaaaugccaggggaggguaagagaaguaaauucuacacgcaucccuuuuuuuuugugaggaaaauuaaagugaauucacguuacaaacuaaagucugggaaguaacuaguaucaaguaugauacacaaugaaguuacauuugcccuuacagauuugggaugucugggaaaaggcuguuuucuaacaacaccccuuuaacccuuucacugccagcuugaaaaggaaugcaguuccuggagccugacugggaaucgacagaaaugagauuagaaauaguuucuaagugaucaaaaauuuuuuuccucaucaaaauuucuuugccuaagucggagaaccuccaguuucaaccuucuauacauucaaacuaagauuacugaagugggagagcugaguucucugggggggaaaaaugguuuugacggaaaagaucaaggaguggcauugaucuguaaggcuaguagucaaugucaccgagaaggcugauagauaucucuuauggcgacuaacauguaguagagccucaaaaaugugacaggucuuacuuaguccuccgaacuuagcggugucagggccaagacaaacauuaagggagacaagaggggcgugagcucagggcuacagcagagaccugcgcaaacugccagacuaaguggaaaagacucaggaaaguuaggggagagccugacacugccggagcagggcgagagagggugugacaguuccuuuacaaggacacaggaaauagggucucggaacaguagccccauuuccacgggucccgggaaaggggugggaggcagacagugagaggcaaacgcugcuccccgccgccccaguuccugaaggcacuccgagacucucccgagcccucuccaggcucaccucuggagcguaggauccugaaggcagagaagcgacugagacugccaaucgcccgggacgccaccaucuugagcagaagaggacgaaagcucuucuaguggggggcaauggagccgagggcuuuucuuuucugagccuguccggcaggguguccuaagugccgccuuacuaaaacgcagacucugaguugccacccguccugucgcccuaccucuugcucucaacuaagcgagccgaaaggaugauuucucugaaggugagacuaaggaccuccgaggagag

SEQ ID NO: 2392 - RNA, 36861 nt, Mus musculus
cucuccucggagguccuuagucucaccuucagagaaaucauccuuucggcucgcuuaguugagagcaagagguagggcgacaggacggguggcaacucagagucugcguuuuaguaaggcggcacuuaggacacccugccggacaggcucagaaaagaaaagcccucggcuccauugccccccacuagaagagcuuucguccucuucugcucaagaugguggcgucccgggcgauuggcagucucagucgcuucucugccuucaggauccuacgcuccagaggugagccuggagagggcucgggagagucucggagugccuucaggaacuggggcggcggggagcagcguuugccucucacugucugccucccaccccuuucccgggacccguggaaauggggcuacuguuccgagacccuauuuccuguguccuuguaaaggaacugucacacccucucucgcccugcuccggcagugucaggcucuccccuaacuuuccugagucuuuuccacuuagucuggcaguuugcgcaggucucugcuguagcccugagcucacgccccucuugucucccuuaauguuugucuuggcccugacaccgcuaaguucggaggacuaaguaagaccugucacauuuuugaggcucuacuacauguuagucgccauaagagauaucuaucagccuucucggugacauugacuacuagccuuacagaucaaugccacuccuugaucuuuuccgucaaaaccauuuuucccccccagagaacucagcucucccacuucaguaaucuuaguuugaauguauagaagguugaaacuggagguucuccgacuuaggcaaagaaauuuugaugaggaaaaaaauuuuugaucacuuagaaacuauuucuaaucucauuucugucgauucccagucaggcuccaggaacugcauuccuuuucaagcuggcagugaaaggguuaaagggguguuguuagaaaacagccuuuucccagacaucccaaaucuguaagggcaaauguaacuucauuguguaucauacuugauacuaguuacuucccagacuuuaguuuguaacgugaauucacuuuaauuuuccucacaaaaaaaaagggaugcguguagaauuuacuucucuuacccuccccuggcauuuaauugauugaaucuuuuucuacuuuuuuaaaaaccuccauagaucgauuauguguaaauagccaaaauugcuacccaccaaaaaaaaaaaaaaaaaaaauuaaaaaaaaaaaaaaagugaaguggacugggugcuaauucaccuuuaauauuaggugggucuuuguguuccugucuggucuacauaguuccaggccagucagggcuacacagugagacccugucuuuuaaaaaaaagaaaagagccgggcaugguggcacacgccuuuaaucccagcacuugggaggcagaggcagguggauuucuaaguucagggccagccuggucuacagagugaguuccaggacagccagggcuauacagagaaacccugucucggaaaaaccaaaaaagaaagaaagaaagauccaucgaucucuaugucuccuguuugcacuugguuguguuuccuuuuccacauuuauaacaguuuuaggggaaaaaaggcaccuaugguccuguauuugauguaagguacuuucaugaauuggcagccagguuagcacuggaguggugauugggucacauguucucuugucacuagcuagcuguugacuuugcccuuucaucuaaaugggcuuucuuuucccaucugugaaaugaaugagagugauuuuuuuucuuugacaggagaaguaguaugauggagcaauuaaaagcauuaaauacggacucugucaucuggcuugaaucuacaguuuaccuucuagugaccuugggaauuaauuucaguaucuuuaucauugguaaaauggagucaaucauguuaaaucuaaagaaguuauauuagguauaacacauaggcauacauucucaauaaauguuauuaguuuuuuaucccuuagaagcaaugacuauauauagcugagaacuuguaaucuauccauuuuacauagguaauaaaaagcuaacagcuaaauuuuccuauacuucuacauagaaacauaucuaaauauauaaguuguauuuuuuuuuucauuaagaaaauguagucuagagcuggagagagguuaagagcgcugacugcucuucccaagguccugaguucaaaucccagcaaccacaugguggcucacaaccacucguaaugagaucugaugcccucuucuggagugucugaagacagcuacaguguacuuacguauaauaaauaaaucuuuaaagaaaaaaaaaaaaagaaaagaaaauguagucuauuauagcuacagauuauuuuaauaccagcuuaugcacuuugaaaaaauaugcaggaaagucuauuuaaaauuagcuguacaccugauuuacuauuuagagucuagacucagcaggucuguccuugacccugagaguguguggaggcauugccaaaugcuuaaugaacuauggcacuuacugugaaagagaucuuguacaauacuguuauucuaacaugacuaucaaaaaagucauaaguugaucuuaauauccauuuaauuccuacuuuuccuaauuccuaaguauguaagugguaaaacaauuuuacaagaagugaacggcaauuaguaguuauuuuuaaaucugacucucacuucuugucccaggguugaauuuugaaaaagcuauaaauuucuauaaacuaaaguaacguuuccaguuuucaaaguugugcagcacaauccaacccuucccacugacuauaguuguauaugaccuuguagauauuuucuugaguuacacaugaagaugauuagaaaguagggcaaagguuuugcauuugcuggcacugaaaauguaggcuaaaguucacaccgcgucuguauaguaagcuuuguuguuaggguaaggcuggauuccagaagcaguuaccuuguacuuuggcuugauuaaauugauagucguuaagauuuuuuuuaaauguuuguucauuuacugcucuuucucuuugcuuuuugucucuguugguuuagaguauguuuuguguaagugugugggaguguguuuaccacaaagagaaguuagucggcuggaauuaaaauggcuuaacaauaggcuaaugagcaccagcucuuuuuuuauuacuauuauuuguuugcuugcuuauugagacaagaucucaauagaucuggcuagccuggaacuccuaggggucugccucccucugcccucagagguguguguccacaccccacuuugcaucuucaaccuuuaaagaacaaauauuugauuuuuaagauaauaacucugcccugaggaauacaaauacuugugaauugggcauuccauuaagacaggaagauuacaaguucuagcuagccugggcuggcuaagaguaccucaccuggaaaaaaguugcaaccauguugcuuuugaagguuguuuuuuuguuguuuguuuguuugguuagguggguugguugguuugguugguuuguuauuuguuucagcauuuguauucuaucacuuacauacuuacuuugcuaggcuucugucugucuuuguaccucaccccuuccuacuuggacucuagcagucaguccauuccuacuucgggauacuuuacucuuuccuagguagauuccccaucccaugcugcuuucccacuagacuuuguacuuuacaauugaauuuucagaacuggguauugaaccuagguccguguguguggugggcaaacagucuacacugagcuauuuucaaauauucaccugugucccccgaacaggagcugauucagugccauguccucagcacaugcccuggagcagcccugggaugcaagcuccaccaagaaagggggcccugcacauuuuguugaugaucagaacugaaagguuuuuuuuuuuuuuaagauuuauuuauuuuauuuuuauagauauguauauacauacauacauucauguauauaugugcaugugugugugugugugugugugugugugugugugaguacacuguagauguuuacagacacaccagaagagagcaucagaucccuuuacagaugguugugagccaccaugugguucuaggaauugaacucaugaccucuggaagagcagucaguacucuuaaugguugagcagucucuccagccccaagaacugaaguuuuaguauuaagaaauaaguaauuaguuaguugauacuauuuuuagggcagugguucucaaccuucuuuaacacaguuuuauauguuguggugacccccaacuauaaaauuauuucauugcuacuucauaacuaauuuugcuauuguugggaaucauaauguaaauaccugcugauauacauacagcacaucugauaugugaucccaaaggggucaagacacccagguugagaaccaaugcuuuaaggcaucugccauuucugaguacagauguuugcauguguaacucuuaaucaagaaagugacauuugucuuuuuuuuuuuuuuuuucuggaacuaaggaaagggacaacuuuccuagaauagucaggcaaauuuaggacucagugaucaggagaagggagugaagaauuagagaggagcauagacaggcgguuugaggugaacaugaguauagaugaaggagaaaaagaggguguucugaagaacccuaaaagcugcauuuaggggauguugccucagagcuacuccagaacaaccugcuuaucaccuaaagcuugcuuagagcaggguagacacaagccuuuaggauggaggggcuauagaacaacgccucaaacaaauuuaauguuuguccaaaauuccccuuagauucccugucuucuaccuagaaucuagcuggaaagacccugcacugggccacucuugugugcuugcacgcagaggauccaguccucgucacuguuagagaaaagcccaguccugaauuagaacugacugcugcgugugggaggggucaugacacugaugugacugacaugagaaaggcaggucuaagauuccccaaagugcaguuaauuagaacucuggacaggauaauccuuagcagcaaaacaguagauuucccauacucugaggagggaguaugggaauuauauacuaagccagacagaguuauucacagccaaccaauacagcuggccuuccucaaaaauuauuuugaaauaaaauaccuagugucaguuaggagauagucuuagggacuagauguaacucagugguagagcacuucucuagcuuauaucuuuggguuuaguaacccucagcacuaagccuugauagguacucucuuaaucacggcagacagaugaauagcuuugaguucaaggccagccucaucuacauaacaaguucuucuagaccagcuaagacuuuauaguggccaaacaaaacucuuagcaguugggagguuaagguaggaaaaucaugaaaccaagaauucaaggucauacugggcuguguguguauguguguguguuuauuuccaaccuagccugggcuacacggugaaacccuaucucaaauaaagaccaaaccaaaacaacaauaacaaaaaacagauugcccgggcucugaaccuaugaucuuuugagucucauugccucccaaaugcuaaggaaugauagcauguggaccaucuugugaguccggcuacugucuuaauggcugcuuuuccuguaguguuggggcugcuugccaaaggcauccagugagcaaaguaauaauuagaaccaaaauggcuaaggccauaugaugggaucucuuuguggucccucugaagaacuaaacaaguuagaugauaaggaucaacuaguaagcagcagagaacagaguggaguuuguuaggcagagauugggaacguuacugguggaaagcaguuucaguuagaugugcuuaaaccagcaaagugugacauagaguguuuccuuuauagacagugcuugccuucuguuuucacgguuugguuagguuugguuugguuugguuugguuugguuugguuugguuugguuugguuuguuugaaacaaggucucacuauauagcuaugggugaccuggaacucacugugugaaguaggcuggcaucagacucacagacauccuccugccucugccuccuuagugcugggaugcaguguaugcacuaccaugccugguggcuucuuuuguuuguuuuuaaaaauuuaucuauuuauuuuuauuuauguaugcauaucaguguaugccacgugugugggugcccauggaggucagaagagggcaucagauucucuggagcugggccacuaugagccuuucugccagugugggugcuggagacaugcuuucgcuugcuggccuggaaaucacagagauccacuugcuucugccuccccagugcaguuuuagaggucagagguccuuagugagacuugagcugaggacacuuagcucagugguauaguguuugccuagcauacaauagacccggguuuaaccccaagaggaaauggggaacuaacaagggcacuaccaaaaugggucucacuaggcccacaugguguugacaggguucuguucuuccugaaggcccugagggaaacccaucacuuugcauggucuaguucuagagacagccuggggucccugccugugcucaucuccuuccuucagcaagcuggagcugagucccggucacaugucucugauuuucuuugugauuacacuaaguccauuuagauaauccaugauacuguccccauauuaaggucgaucuuaauuccauuugcagucagagcccuucuuugcacacucacauuguagagaugcaaccuccuuuuuuuccugggugaggggaucuucucccuaccuuacuugcugucugguuaaucauuugaccugauaauuaaaauaagaaaagguaacaauaauggauuagaauacguuguucugauuuaggaguuuauuggcauaaaaacaguuuuucugauuugacaaauauuaaagaaacucuauuucaggaaguaauuuugaaacacuguugucuugcaggcugcauuugccgcagcuuuacaacgucuucugcucugcugaguaaguucacucuugcuuauguacuuaacguugcucuuuauaauccucuuguucuuuuagaugauaauauaaucccaucuuauuguacauucauuuuccuccuuccagccccucccauacauuucccugguuccucaaauucauagccucuuucuuuguugauguauguauguguguguguauacauauguacauaucccuaaauauguauauauuuguguguauaucccuaaauauauauacguguacauauauauguauguaguauaauguaguauauguauauauagcaacaaaguaaaagaagucaugaauuugagagaacaaggggagugggugggagggguuggaggaaaguaaauaguguguauggguauguauaugugugugguguguagcucugaauauguauguguguguucaucucuaaauaugggguggcgggccuaaauauaacuguccaguccauauaauggcauguauguauaugauuuuaacaucacuuuauaaauguuuuuuuauacuaaacauguuuagaaaccaaucugucuucucuuuuuuagccagaacccauauuaauuauggcgucaaaggggauguggcaguuauucggauuaacucacccaauucaaagguacuugaacuuucuuuaguuaauuucuaccaacuacaguuaugagucguauccuacauagaaauaaaaucucccugacuugaaguggacuugucuuacgauuuuuaaaauuuugugaguuacauagauguucuugaaugagaauuccuucuuggggccauggguaguaacaaaggcaggcagaucucugugaauucuaagcuagccuggucuacagagcaaguuccaggucagcuagaacuccauagugagacucugucccaaaacaagggaaaaaaaguucuucuuggugauguuuugguuggagaagcagaggcagguggaucucuauagcuuccagacagccagagccccuuagugagacccuaucucagaaacagacaggacacaaaaaaaauaauuccuucuuguugcuucuagguaucaagauuaauaaaacuagccuucuguuguuacauagaaugaggaugaauacguuguugauaagacuuuauccaccucauuacugccugacagagucauuacucacaguaggacggcugggguaaauauggagacugaaagagucauuguucaaguucauggcugucugggguaacuguggauacuuggcucuugagccuccugggggauugaaugacccggacaguccacgugcuagaaaucagguuccgugaaaauggaaccuggaucuuggcaaguucaacagugcaggaagcaguaccuccaucuuuugccaagaguugcaaaauuccgcaggaauucauucuccccccauuucaaauauaaaggugucuuuuuuuuuuuuaagucuuauaaccagggccuauagaaauaggagauuuugagccaagcaugguggcucacaacacccgagagauacaaauagaaagaagucuaggucauccucagcuacagagcucaaggcuagccugggcuauauaaaacccuguaggaaauaggaggaucuguacaggaaaacaccuaaagcuacuacagauuagcguaauuggcgcccgucucuucacuagaguuaggcuaauacuaacuaaccagugauucagauuugauuuuuuuaaccuaauuuucugaaguugaauauauuuacaaagugaaauccauacaauguuuaauuuuaaucccuuuuuuuuuaauguucuauagguuccccacaaccaccaauaaauauuuguagauuugcuuauauccugcauaugauccaaacucuuaggacuacaaacucacauucuuguuuuuauuuuuaggguguuuguuuguuuguuugagauggggcucacugggaacuuuguguguauaccagacaagccauaggcuugcagcaguucuccuuccucugcccucuuauuuauuuauuuauuuauuuauuuauuuauuuauuuauuuauuuuugagacaggguuucucuguguagcccuggcuguccuggaacucacucuguagaccaggcuggcccugaacucagaaauccaccugccucugcuucccaagugcugggauuaaaggugcgcgccaccacugcccggcuccucugcccucuuaaguacuaggaucagaaguaaggccaaugcuggcugucccuauuugagaccaccucacuuuuguuuguauugauguauuugggggugagagugaagcuaagucucgucucccaccuuuacaucggauucagugcucaagcucagguuguuggacuugcauggccagccaguuaaccacccugcauuccuccagcuugugagacccauuguuaaagggagggguacuaauaauuaacuaaagcuaccugaaagcugaggguuuuagggggguuuggucggucuguguuuuaguuuuguuuuguuuucuuuucuuuucuucuagcaauaugugucugcugcauaaacagacuugacagugauuguguauguaugugaaauuuccaguuuaaacccuuagauguagcucuuucucauguagguaaauacauugaauaaagaaguacagucagaguucauagaagucaugaacgaaaucugggccaacgaccaaaucaggagugcuguccuuaucucaucaaagccuggcugcuuugucgcaggggcugacaucaaguaaguuuauccugcuuaauuauguauuuuuuaaauaauaccuucucuaaaauaagauagaaguaaauucucccaaagguugguuuuuuuucaguuguuuuccaggguauaauaaaguucaugaaauaagggauuuguugcuuaaaucauagaugacuaaauacagcucuuucuuaaguuaaccaagaaugacugccuagucuucauccaucagaccagcaaacauuuacagcgcaguuuggcaguacuuagcaaaauugaaagugcacgggcuggggagauggcucuguggguaaaacccugcugcucagccaagagucugaacuagaauuccagcauccaugagaaaccugggcacagugagucugauggaucacuuugucucaaaaguaagacgugaagaaaccaccugacauuggcuuccacaugugcccgcacaggugagcacacgugcgguacauccacacaaggugugggggcaauacauacguuccagccacauccucuuauccagguguauauacuaaagaaauccuacuccauucauaaggaccaguggagaagaauaaucaggccugugugcaggcagauaaggaagcauuugaaacaagcuacaagucaguaggaaaacagacaugucuggcaaguaaagacuacaaaauagcucaaagagaguaacuagacccagaguauaaccuuagaacugucuagucugacagugagaauauuuaccaggugauguucucguuagaacucugugcucaauaguuuguuacagagcaaaguaaauuguguaaccuguuccauucuguguuugaagacucauugccaaauauugauauacauugagauaaguauauagugggugaaauauuauacaaaauaggccacagucucaucucuccuuuuguguuuuucuuuucugucgauacugcagcaugcuauccucuuguacaaccccccaagaagcaacacgaauaucacaggaaggucagagaauguuugagaaacuugaaaaguccccaaagcccguuguggccgccaucaguggauccugcuugggaggaggacuugagguauagaaguauuccagagcuguucaggcuuucccacucacugccaccagagcccuuuaggcuaccguuuuaccuaaaaacagcaaaagaacaguuuucugaguagaagugauuuuauuuucagcugucaaaugccugaaugguuuuaauuuuuaauucuugagaaacgguaauuaacagcagacaguaagccagggaaugcuacuuccauuuacaguggggguguguaccacaucugugaaggccuucucacaucugagugccugcuucagggucacagggcagagauccggaagugugacccgaauucauguuaaguuggcugagucuuacuuacaaaguuaugugugugcgcacccgugcacgugugacagacacagacauauaguuucuugugaguaguaaagauagcauugaagaguuuucaaucugcaaaacucuucaaaauaagauuaaagagcuuuuguuauugauuuuugagacaggaucucacucuguagaccaaccuguccucaaacucagagagaccugccugccucugccucccaagugcugaauuuaaaggugugugccaugaccagcugagagaagagauucuuacuagauuguacuguguuuuaaaaaagaggaaaacaagacauuuauugagcauauaucacaugguggacuguaugcugggauuuuuagauacauuaauaaaagaaaccugggccugauccacaaaagaauuugauuaacaagaaaaugguuucagaaguauuccauauacaguguaguuguauucaaaagcaacaggaagcaaggccugucgggagacugcaaguauacccgauugaucggaagaggucaucucugagauuccucuugccucggccacacaggcagcugguucuaccagcugggucauuguuaauaagacuuaaggaaaauuguuaguuauuauugcuuuugauuauaagacaagggucuugcuauguugcugaagcuagucucaaacucauagucucagacaauucuccugcuucggcaucuuguguagccagaacuauggaaguacacuucuggcuugaguuuuuuaauugguaaaguccauugccaucaaaauauuuuuaagacgaauagcaaccuaaaagggggcuaauaaauuaugaaaacagauagaaaagguagauuguagagugccagaugucagccuaaggaaucaugguuaauuuugugguacauucugcucuauaaauaaucuuuagaccugccaaccuaggugccaacaugauccaguuaaauuuucugacauucugauuuuuuuugauuuguuugaagcuugccauagcaugccaauacagaauagcaacaaaagacagaaaaacaguauuaggugucccugaaguguugcuggggaucuuaccaggagccggagguacccagagacugcccaaaauggugaguuuaagauuaccccaauaccaugagcuugacacugcuguacauaaauacuccuuuauccaucuuguacaaaauauauaagauagacacucaaugaaggauucagaaaccaaguaaguuagcaauguagacggucauugagagauuuuuuuuucgcuccugauacuuauuuuuucaguccuacagaauuguugaucagucuucguuagucccuuaugaaguguaaagacgauaagcuacugucuuacuuuucuagaacauuaauuuguucuuccucuuaauagguuuuuaaaaccaugugucauaguucaugcuaaguaagagacagaacuuuccuguccuucucugauuuggaccaucuccuugcuguauucaaaggaccaaaaaaggcacaauaagcuuuugaauuucuaaggagagucauaccuagaagcugcagagaaauuuccuauuuagaaggcacugagccuuggagcuucuagcucuguagacuccucagugaagagggcucaguagagagacugcacaagaaguucauacaaguuagagugggaagggaggguuuuacuucauuugguugguuuugaugugguuucagaagccucauucguagccuagacuggccucacacucuuguccaucucccccaccucacccucccaagugcuggaauaacacauaccaaaauaguaauuaaaaucauauacaucucuuuauaagaaaugucuagaagauaucuugacauaaaaaguuuuguuguauuucuuugcuuacauugcuagaaguucuuucauuauuuguuuuuggauuuguuuguuuguuuuugagccagucucucucuaugguucugacuguccuggaguauagaccaggcugggcuaaaacccagaagagauccucuugccuccugagugcugggauuaaaggcauaugccuccauacccagauguuuuuguugggguuguuguuguuguuuuguugugagucagagucuucucugcaauucagacaggacuugagucaaugauucuccugcuucagccuuccaagaucugcgauuauagaacaaacaauacaccuggcuagaaagcagaauuucuagaauacuguaucagaugagcugcauuuuuguuaaacucaaacuucuuucugaagccuuuguaaaaguagcaagucucucaucucagagucugcacuauaguuccaguauuggaauuuugggaaauagggaugcugagacuuaaacccaugguuuuaugcaugccaaagacaccauaaugacauuuucuucuucagaugaguaucuaaucucaaaacuuaaaaacauauuaguauauaaguuuuaauuuacuaauaaaagaacauaaaacugguuugauuuuucuccuuuuuuagaaaacuuuauuacauuuauugguuuauauuggauguauaugcacagguauccucugcauguggagggcagagggcaucuuucaggagucggucucuccuucugcuacgagaguccuagcuguuaaacccaggcugucaggcuugacagaagcaccugacccgcuaagcaucucuccagccccacguuuccucuaaagucuguuuacgugaugauuuguaacuaacucccacccucauccccugugcuucgucucuugcuugcauguuaggugggugugccugcugcauuugacaugaugcugacuggcaggaacauucgugcagacagagcaaagaaaaugggacugguugaccaguugguggaaccgcuggguaaguguuaacaugagucagaauuuuggucauauagacuuguuuguuuucuggaggacuugaucucuugaauauuaggauuaaacucaaaacucuuaagaaagaaguaaugauuuuugaggagaaacauuuucuuuuuccuuuuugcggggcuggaggugaggggacaggaugagacaggguuuuucuggguagcccgugccauccuggaauuugcuccgcaaaccauguuggccucaaacuccgaacucagugauccaccugccucugccucccaacugcugggauuaaaggcgugcaccaccaacaaccaaccaggagugacauuuucuaagagcuaauaaucauuuuuauccccacgcugguuuauauuuacuuuauugauuaucuggauaccaacaauacaagaaucaaucaguucaguuauuaguguaguuaccuguguuccuauccauguguaagccuccuucacucucugguggagggucuuuguuuuguuguuuuuauuuuugccuggagugugugggauuaaaccagggucuucugcaugcugggccagugagcugcaucucucccuguggauuuaaauaauacaguaaacacacagaacacccaaccucagaaugcuagcaaaagauaucuacuucugguggcaauaggaaccucuaaaauauacacuucuuaaguaucagcauugagcaauaacuuaaggcuuaguguggucacucauggcuagaaucccggcacuuagaauauugagacaaauggacuauaaguuugaacuaccuugagcuacauggugcagagaguuccaaggcuacauagugagacccugacucagaaaaacaaacaggagcuauugagaugacucagugggcuaaggcaccugccacaaaacccagagaccugaguuuguucucuaggauccacacaguggaagaacugacuccucccaguuauccuguggcaugcauauacacacuugcaugcacacacauguacacacaugcacacaaaggguuuguacaucaaauuucaagguaguuuuuuuuuaaagauauguauguaauuuuccaguuuucaauggacaguuugaguuuuaacaaauauacauaguuauauaaguucuacaacaguaaaacauuucuaaaauguagcuuuuuguuccuucuuucauuuagcaugcuuuugaaauacauuauuguuauugcauauaucuauaaucuguuccuucugaaaauuauuacacuuacuuauuacauguguuauguguguguguauauauauauauacacacacaccacagcauacugucagaggaucuaggaguugguucugggauugaacucacaccucagacuugguggcauuggacuuuaucugcugagucaucugccuacccagggugauccuuccuauugagggcuguuuuauuauauauacaccauaguuuguuuauccauucaccaaaagaugaacuucguguaguuucuaauuugagacuauucugaaugaagcugcugugagcauugauucagaagccuuuauguggacauaggguuucuuucuuuugaguaacacugaagaguggauugguagucugugugcuguguguguguucaucuccuaagagaccacccaccuguuacccgaaguaauuacuggguuuuauucuaucagcaugagacuucagguuuccaaccagguugcaugguuuuagucuuagacuuggguagccuuuguauuaauuugcuuccuauaguggaccuuucuacagaccuaccagcaguuuaaauaaugacacaagacuucuuuuaagauuuuuuuuuuuauuuuaugugagugcuuuaucuguauguacaccugcacaccagaagagagcaacagauucuagaauagauuguuuugagcuacccugugguugcugggaacugaaaaucaagaacucuagaagaacaguaccauucucugguguaacacaagacuucuauuacaguuuagagcuuaggccuuuugcuggggcagucucccacuuagaacaucuaacuuaauccagcugucuagccugcgacccgucauggcuagcucugugcugcugcagucugugucuguucccuccacguccacucuugauucuuucuucucccugugucacuccucugcccagaaguuccgcccucuucuuucugcccaagguuuugacccacagcucuuuauuacaacaaaucagcagugagacaaccucugauaacauuucucaucucaauugccuuuaaacagguaaagaaggacauucauacuuuauaaaacagaaaaccugguaaugaaccauagaaaugacaguaccaaagcccuucccgcacuuagcucucugcugguacaaacuagcaauuggaaaaacacagacauaccuucacacaacgugaaggaagauuaccccaacagcuucccauauauguucaaaucauuuuguuuguguuuucagaguucuuacuacaucagaauagaagucuucugccaaauauguaacuugaggaucguuucucccagucagcagcuucucuuuucacuuccugaaacaagcaccuuuuucucgugcuuucuucugaaacuauucuuguuuuuucucuugaacauuggucugugauccauuuuagguuaacauuuacaugagugucuuuauuccuuugcauacaaauaccaauguucugcaacacuuuuuaagaaaauuauucuagcugggcauagugguauauaccauuaaucagagcauaggcaaguagaucucugaggucaaggcuaccuuguucuacauagcauguuccaggacauacagaacuacuuuaagagacccuggcucaauuaaaaaaaaaaaggaaaauuauuuuuucuccagugaacuacaguggcaucuugguaauaggucaacuauauauucuauuuucaguuaaccaacccccucucgaaacagcacaauguggucuugacaauugcuuuaucagauaucguauuucuccaacuaugcucuauucauucaaaauuauuuuuucuauaauaguugcuuuacauuugaauauaaauucuguauucaauaugaucauaccuacaaagauuauagauauaauaauacuugcuagaauuuuuauuagaauauugucuuaggguuucuguugcugugaagaggcaccaugacuaaggcaacucuuauaaggguaaacaguuaacugggggcuggcuuacaguuucagaggugcagucuauuauuaucauggcgggaagcguggcagcgugcaggcagacauggugcuggaggagccgagaguucuauaccuugauccuucagaaagagagagacugucuucugccaucagcuagaaagaaggucucuugugcaugguauagagcuugagccuaggaccucaaagcccacauaccagcgacccucuuccucccccaaguccacaccuauuccaacaaggcuguaccuaacagugccauugcccaugggcugggcuguuucaaaccaccacacauguuaagccaucagcgucgucuccucggcugacgagcucaguuucucagcaguguuuguaccucgacuucucagugaccauuucaguuuacuccuaguuauugcauagcuuuaggcuaauaugcuuuauuuugcauuaaauacuugucuguagaaauguaauugaauuugggggcaugaaccuuuuguugugugauuuuaauaagcuaauucauuaagucugcgagcauuuuuuuguggauuaccaaggcuuuucuacauaugcugccauguucugugacaguuagucagcaugccuucuuccuuccccaucugagugccgcuuguuuccuucucuggauuuugcuauggcugagaccucuguucagggcuggacaggaauggugggggcacacaguucacucccagucccagaggagaggaaggauuuaucaugaguguggcggcagcuguagguuguccuggaugccccuuuucucccaguuugcuaagagcggugucaaucuugucagaugucgucgugguuuggaucacagugaucugaugauugauuuucuucuuggugucaauugcacugaauuuguuguuguuguuguuguuuuaauauugagccaguguuugcccaggaauaaacuccucuuagauauaacacaguaucuuguuuauaaauuacuggcuugaucaccuauaaauaauauuugugccugauaaaaaaaugaauggucucauggauaauuauguuuucuuacaguaguugcacgguguuagugucaggcagugcuggccucauaaaaugaguuguaaaguuuuccuuucucuuguuuucuggaauacuuuguguagaauugauauuucuucuuacuuacuuaaauaccuaacagaacuaaccacaaaguuauauaugggguuggaaggcucucggguuuuuuguuuucuuuuguuguguuuuucuuucuggcuuagauggcuuuaggguuuauuuuaguuuuguuuuuuuuuaauauuuauguucacauguguaucugaguaugagugugcccauauguaugugcaugugccuuuagaggccagaggaggccuuuggcuaccaugaagccacaguuacaggagguugugaggcaucucacugcugaagaagccuugaacagacaggcuuuauggagccuggcagaaaagauggcuuggucauagggcaaaggaucuuuaauauucucauuuuucucauuaagaagguguccgcuggugcccuaagguaaaaagaccaaggagggaaggguaucugggcucagaauggcaguaugagagcauagccagcccguaaccugugaccuugccuaugccuccccugaggagugugauguggagugaggacuggccacauuccaagugugguauaaggaaggcguagcccucagggagugccucaguuggucacaguucuuugccuaguaggaugaccuccaucccagaaggucuaggccacucgcaguccugugcuggcgucuguucucuuccugucucucuggugaucuucccuggcuuggauacuuguccgucgggaacgugcugagcagugcuagcuggggccccucuggguggcccugauguggagcacaugcucgggagcacucugccuacagaguccucggccucggcugccaaggcugcaggaugaugagggguugacuucugggaccucucugagcuuugguuuaaagguuuaguucugauucuucuucuccauucugguucagaacaagacagaugucuuuguaguagacuccucccucuggagacuuuguuuccagaguacuuaaaguggguacacuccuuucuguacucgagcgccuuccccagugcaguucaugcagacagccugguugugcccuguaacaucgcccuguaacuucucuucucagauuucucagcuucaccauuuuuuguuuguuuuguuuguuuggugguacuaaggauagaaccaggucucauacaugcuaaucauacacuccacugagcuacacauaaccuaauuucugcuuccaacaggcucacaagcuggcagaagcuucccauaaaugggaacuugguugcugucuucgucagcguuacugucgcugugaugaaacaccgugaccaaaguaacuugggggggaaagaguuuauuuggcuuaugcuuccacaucacugaucaucacugaaggaagugugggagccuuccugccacagguuuuaucugcauaggacugguucaagcuugauuuacaaucaaguacuugcaaucauuuuguuguuguuguuuuauuuuguuuuuacaggaccaggaauaaaaucaccagaagaaaggacaauugaauaccuagaggaaguugcaguuaauuuugccaaaggccuggcugaucggaaagucucugcaaagcagagcaaaggccuuguggaaaguaaguggcuuuguuaacagcacacagcagagcuucugccugccccuaagcuacuugagacccugccucaaaagaaagagaaaaaugcugggugguauuggcacaaaccucuagucccagcacuugggaggcagaggcaggcggcucucuguaaauuugaggccagccuggucuacagagcaagguccaggacagccaaagcuucucagagaaacuuugucucugaaaaccaggagggagggagaggaagagaagcacauuaggaguaagccuuagaggggacaauucugccucaaggacaaauccucaacuuaauacuaacagcaaagccaucugguaaagauagauuuauuuauuuuauguauaugaguacacuguagcugucuucagacacaccagaauugggcauuggaucccauuacagaugguugugagccaccaugugguugcugagaauugaacucaggaccucuagaagaucagucagugcccuuaaccacugagccaucgcugcagcccccagcuaaagccauuguuuagagaccuguuaaauuggaaaacuuuaaacauuaauacaagaguagauuauaauaguguacuaaaaguccccagacgaaaccuuagcacauagaaaguaauggcugcauguuaaggcagcgagcccagugcaggcagaggauguugguuccauuguguuccuucagaugccuaaaauuaugucgugcuauggagucugcagagcgaauagacaagggagccuuggaucaucucagaaaauaucuaaccacauuuuaccuuacagagcugacaacguaugccaugacugucccauuugucagacaacagguuuacaaaacaguugaagaaaaagugaagaagcagacuaaaggccuuuauccugccccuuugaaaauaauugaugugaguccucccucuuacaggaaguggugcucuuuucugugauucugaacaguguguguuagcuuugugugcucgcucacuugauugcuuuugaaaaagagucucacuguguagcucuggccuucaacccaggaccugcacuguagaccaggcugacucucagugcucugccugccucggcauccuggcugcugagacuaaagaccugagccacuacucccagcugauaaucauuuuuuaaagaaggcauucccauugcuauaauucuuaagaagaccuaaugauauagaggcagugugaaaagacaaagaaagauaauuaaaacucuuuaaaauaguuuaaaacuuagaacuuuucagacugggagauucaacaacauauaaucaaaacuggagaaauuagggauuuguagagacccugucuuaaaauaaaauaaaagccaggugugguagugcuuacacucugggaggcagccggaggcagaucucugaguucuaggcaagccuguucuacauagagaauuauaggacagucagagcuacauagagagauuguaucucaagcaaccaaaagacuggggaauggauccuuuacaaaguauccuuuguagaguagaagucgugagauuacuaagcauaaaauaucagcuggggauguagcucugguagaaccuuugucuggcuugaauaaaccuagauucaguccccagcauuauaaaaaaaagaaauuguaugaaacacaucugcauucauacuuaauagucugggcuggagaacuuaaauacuuacgguaagacagauagccauucaaguuauaaaacagcaaaaaaaaauuaaugccagguagucagugcucagaggaagcagucagugagaugaggcagaggcucaugggaucugaccugagaggugagcacaggguagguggagggagacucaggccaggcaggaugggccaaggaacgagucaacacacgcuucuuugucuguuucugauuguaugacacucuuuuucuaauucacauucacucuuuuuuuaauucuaauuuacuguagcaagacaggcuacaguuagucuuaaaaggucagcaauaaugaacuaaucaauuuuacuuuguccugaacuuuaguuauuuucaugguagugggucaaagaggauuaggagagacaaaauagagcuaucagccaauaucugauaauggaggauugagguuugaauaagacuccgaaauacauuuaaguaaaagcagugcugcguaagaagcuugccaagcggagaugaugaguuuagauauuacaggaagucaaggugaggaauguagaucacuuaucuuuuaaugaauuuuggggguucuuuuguuuccuaucauauguauaaauuauggugguugggcuuggggucuuuccuuugucuuuuuuauuuaccacccuauacgggauagugccuacucuggauguagaguugaguugcauggaguuccugguuaaugugaccaacaaaaucacacacauaucagaagcacagagaagugagcagaaagugcuggccuuagagagaagcuggaagaacagcuuaaggugcccuuuccugguggguucaacagcagcugagagacaguugguucagggucugcccuugcaaagcuggguguaugaccuacuggguaugacacagccugaaaagacuggcugucuuacucagcaucacuuuaccucuagccauucuguugcaacacugaacaugugccuuugugguuuuaggcugugaaggcuggacuugagcaaggcagugacgcugguuaucuugcugaaucgcagguaaaugguuuuucuccaguuuauuuguagaauacuaaagacccaaagcuccacugaaagcugaaaauguuuauacuauauuaaaacacuauauauaaaaccuaguacauuuuuuauuuccaguggucauucuucggauuaguuugugacuaagugguuugauaauggaguggugucugcagugcuugagacugcacaauauugaggcuguaaugagaacaggggagcagcuacuccuuucugagccaaucugugaaugcccuuagucugcacuggggcugauuuuguugugauaaaaugcauacauugugagcuggggauauaggucaguguaaagcgacugccuauagcucaugcaugguccuagguccaaccccaguaccagagacaaacaggaaagcaagcacugauuuacgugugcguguguguguuuacuaaggcuuagagaugcaacaucuuuggugaauuagaaaaagagugucuugcaaucagaaacagacaaagaagcuuguguugacaaguccuacaccuuucacauuucucaaacguuaauggugucccagauuugagggaguagaauggguaauuuaaguuuuaugcagaaauugaagacuuugauaguaggacaauggguuccccaagcuaagggagcagucuggcuccucaugguacggaucccacuuuccucccacuuuaaaggucauaacuagggacacauacauguguguauguuagaaaaagagaaacauggcucacaaaucaguaauguccucaacugcagcaugcagcuggcccucccacgccugcaguccuguauccaacuacugaacaaacacauucgccaaggaggauguugagauagaggcgggucaagagagagugggaaggcaauggggcacauaugguugauguauuauauagaucuaagcuuuaaaauugcauuguccugaauauauagauucuuguuguuauuuaucauauauauauauauauauauauauauauacacacauacacauauauauauaauauuuaccuuguauuagguauuauaguuaaucuagagucaacuugaaauacagaggaugugcacguacuguauuauuuuauguaaagaacuugagaauuugugcauuaugucucuucuaagguccuaagaccaguguuugcauggauuccagggaguggcuauacuugacauuuuauguauguguguguguguguguguguauuuuuacauauaugcauguauauauacuuuuuauauaaaccacuuaucaaaaccuauugaauucaugaccugauagaucuuuauccauaauuugaaauccauaggauaccaaauagaacaugcuauuuccagauuaaauguagcauuauuucaugcuguuaaugugaauaagcaauguuaucagagucuuucuuuguaaugcuauuuguaaccccauaauuaugccagugugugcuaacaguguuaauaguagcuagcaaggagaguccagucguuuuuacuaguguucuuguuauuccuuguaacagcacuaugaacuaggcauccauuuucccauuuaaauagugaagaaagcuugacaguagggaaaggcaagaccagggugcaaacccagcugugugaaagugagaucccagcuuuuaugcugggaaccacuaaaccaagggacucauccuugaugcuaagacgcuuuuaaaguggcagugggaauggugcugguccaccugcugcagugggaagaaaacugaagucucuaggacccugcucaaguucugccuuaggcaagauggcccuaacuaauaucugguccuccucucaguccuccaccauagccaguuauuggaggaaugguaaaaauccaucugggccugagacucucaaucacaggcaaagguuaucacuccucugcuguaagagucugagagcugucacauuaaaaccuucuucaaggccaggugugguagcagaggcagguagauuucugaguucgaggccagccuggucuauagagugaguuccaggacagccagagauacagagaaaccuuguuuguuuguuuguuuguuuuaaauuuuuuuaaauuaacaaauuaaacaaaacaccaaaccucccucaaagcaguggugagacguccuucagaggacagugaagaggacaccaguugcagguggaagcccagcugcagcaccugugaacuaaggcacgggguguucccucugcugugcagagcaagugacaaacgagucccauuaccaggaccccagaguuccaccuuucccuuuuucuuuuuaccuuucagaaauuuggagagcuugcauugaccaaagaaucgaaggcccugauggggcuuuauaacggccagguccugugcaagaaaaauaaauuuggagcaccacagaagaacguucaguaagcugcccugccuaaaagccugagaauuugcuuugcagcaacugugcagggucaagaagccagagaacuagauuagccucagccucuucugcccuggacagccgagccuuuauuccaguacauucuuguguucagauccucugaguccucccuaggcccuucuagcaccuuuauagagcuuucuuaucucggaauaacucccuggcagucugguuuaggucucacaucucagaccaaagcuauaacucggcuccugugguaaauacuugccuggcauacaggaacuccgaguucaguuggcaguaccacacaacccagguauggugauauaagaccauauaagacccuggggcuggaaucuuuaaacaaaacaaaacaaaaaacagacucuuagcccugcacucaugagggugaguucaaagucacccucuucacggugaguccaaggccagccucggcuacauaagaccugucucagaagaaaaaagagcacccagaagcuacuaguaaggagacugaaguacucuggauaggaugguaaaucuugagagaaagggaaaugacagaaaaaugcuaaaaucacuaugaaauuaucaaacagacuagucuucggacauaaccuagauuuagauuaggcuugguuucccacgcuuugggcaauugagaguugguuuaguucugccuucauggaaaaaccaaguuuuugggccuagugaguuuuacauuuaucuuuaaaaaucaaaaauguauuguagauagacaucaugaaaagcucuuauacuuguggcuggcgguugguuuauuggcucacaguguggguaguguuucccagcuaaucagugccugagguguucaccagaacuguucgauccugucccuccaggcagcuagccauccuuggcgcagggcugaugggggcuggcauugcccaggucucuguggauaagggacugaaaacucuucuuaaagacaccacagugacggggcugggccggggacagcagcaaguguucaaaggguaaguggccuguuggugccaggagguggacuguguggggccgggaguggguuugguuuugucuuguuuuucaucacaggguccuuuugccugaacauagccccacacucuauaguuuuaccaaaguuuccuuugauuuuuuuuuuuugagaaauacuaauuauucuuucaacucuuuuucuugauuaugucauaggacauuggccuuugaauguuuccuuauuacuagauauucuaaauaccauuuauuccauccuuugguaugauacuaguaacugucagguuuggcaagguuugcauggaguugcccccguggaauggauuauggaaccugcacagcucuuggcagggcugagggagggugugugagaacaugugccgaccaaguagguggaggcagugcuggcagaggagagccccugccagugagccagaugcccgaggccugccgaccagcuccacaucugcagcagaacacccacaugcaaaguacauggcaaaguaaagguaaaacaaacgucuuaaaaugaaaaccaaggauggcucacagccccgucucacacggaggccgccaguuaggcugaguggaaauggagucagcucagccacacugaggcuguuuuuagcccaguguucugcacagacaugacggauuagcuggcugcaucagacuguccuucgugggacuuugugcugagugagggcauguguguccuaaguggauuauguggcuugagcucacuguccucccucagcuacggaggagugugugcgcuaccacuacacuacuggccaggacuggcagauuggugauauugccagauuauaauggaaaauaaaaaggagggggcagcagcguauacagcaacacugucccagcaccaacaccuaggccuccccuuccagcaucuccugcaaucaccagcacgaagagcuguugccauaggauagauagccucaucccugacuucuucuagauacucccuuucucaucuuaggccuggugaaugccaaucaccauacugcugucuuaggacauguuuucuuucccuucucagaaacugucacucggcauugagucagucacugcuguuggcacuuagacagccuguuguagcuagcuguaggaaggcagcccaugguuuuaaagccuuuauugaaaaaaaauauuuuuuuaugcauugguauuuugccugcauguaugucuguguaagaguguuggauucucuggaacuagaguuauagacaguugugaacugccaagagugugcuaggaauugaacccagguccuuugggagagcaaccagugcucugaauugcucagucauuucuccagucccuuauuggauaguucugugaacuuagcugcgacuuuaguuuuucuuuuccuuaagggaguuagugaauggguuuucaauucagaggaaaauucucuuauuuauucugaaaaguaugguuaagaugaaccuaaaagaaaucucguauuccuuggcgaugaaaugauccaguuauaacaagacuccuuuguaguucucccuggaaaaagacaaguucagugugagacuuguguacugagugaaaguagauugacagccugaaaaacaaccuuggucuggagaugucgcucaguguaagagugcucacuaaggcccuggguuugagacccgagcugggguuguuggguaguggggagagggggacaguguuagagagcagcguaaagggugcaguuaacacucgcuggucugggacacgguggcaagagccaugcucugugcuugccagucuccuccuugggucaugacucaccucuugcuggcacucccaacugucuuaugaguaauacagccaugugcagucaucuugugguagaaagccugugugccugggguccaaggugacaucagaugcuaucaccuuccucauuagccgcuuagcaccaagucccuuugaacucgaccucuucaaaauggggguaaugacacacagggugucgcagggugccuaaagccacacagcagcugucuucugcuguucuguucuaagaguguguucuuucuaggcugaacgacaaagugaagaagaaagcucucacaucauuugaaagggauuccaucuucagcaacuugauugggcagcuggauuacaaaggcuuugagaaggccgacauggugauugaggcuguguuugaggaccucgguguaaagcacaaaguguuaaaggaaguggaaagcguaaguaagggcuguugcacuugaaucccggagggcaccaagcagaggggucuugucggaggggagacgcaugccauagagcauguguggcagucagaggguaacuugcaggacucauuucucuccucucaccaugugggucccagggaucaaauccagguugucaggcuugacagcaaguaaguaaguaccuuuacccacuaagcaauuuugaggccucaaauguaaguuuguaugugaguguacacaugcuguguauaucagaaagcucagguaugaauccugugggaagaaaauuaauuaaguacccuaugcuccuaagcccagggcucauuagccauauuggaguggaaauggggagguuaccagccaucuaaauagccucauggguacacaggugucuuggggauuucuuguuguuggcugugagccauaaucaggugauuucauaucucgguagcaaagggaaccaagggagcuuucuccaggcuguuuuggaugguuaucugugguggcgcuccuuuggaccugcucaaguguucuaaaagcccauucuugagaugacagugaacaaaauacguaccucaugugggugauagaaagaaagguuuagaaaaggagaaauggcuguaguccaagagugagaaagagcacagcuagacuagacuagggaaaugauacugagcuggcaacacugguggcugucuuugcaagcuguggugaagcaggcaggauuacuaaggccaccuaaguggugucucacggccauccauaaugggaucugaugcccucuucuggugagcagguguacaugcagccuggccacuuaauacauaaauaaagacaucuuuauaaagagagggaaaauccaaggcacgaggaagaccuccagcacagcauccugcccauccucucgagagaccugaccuuuugcugcuuuuaagaaaacucccaagcugagucuacgaaugguucaguuuaaaucagucgucucuuacccccuauggaacuaaacagacuguuccugacauucuucacgggacagucucuaaagauuuguuuauuuuauuuuuuuauuuauaugaguauacugcagcugucuucagacacagacuagaagagagcauuggaucccauuacauaugguugugagccacaccaugugguugcugggaacugaacucaggaccucuggaagagcagucagugcucuuaaccacugagccaucucugcagcccguggaacaguuuguagaugcuucccugucuuucugucucggucauuagcucacaucucagcguacacauugcugagaagcaucucuugaacaccacagcgcccuaaacaccaagccuuucagggccuauuccucccauggccaaaaugucuccauagcaagguucucuaagagcaaaagagguagcugcagaacugcagcaaggcccaagaccaacggccaugcuucuguugguaaaaccaagccauggccagcccugauuuagagcgugggaaauagacuccuucuuccuaggaagaaaggcaugcaugaccaaggagcagcgagaguguugccagccaucuugggagauaaguauuugcucuccuagaguagaagauaaauauaccucccaggcuggccuugaacucacuauguagccaaggauaaccuugaguuucagauccugcugccucuuccgaagugcugggauuacuagcaugcagcacugugcccaguuuaugcaguccuggagaaccagcccagggcuuccugcaugugaggcgagcacucuaccuacugagcuacaucucuagcccaagaggcccuuucccucacccuugauaccauacuagcagcuaagagaguauguucacucugagucacaccacaccgucagcucacaguccacucugguugguuaaaaaucauaggauccuccucacagccaggcccuuuccucaaaugccuauacuuucuucugccuuuuuaauccuaacgauucacuuuugucuguuauaauuaacguuuuguacucaacuuuucaauguguuaaaugugucuucaaccuugauucuaaucuuauguuugcauucugucugugccaaauuugugcagauuuaacagacacaucuuccauauuuuuacccgugucagaaaacuugaauaaguugagauuagagccagaagacugcgcauccuguguuagggacagugcagacaggcaacuaaagcuaacaguuggucguauuuguuugcugcacgcauaauuacaguggacacugcccuucgguggcucaguuaggaugaaggaaguauacacuuucugacuuaggaagggugagcgaggguacagaaugguguaaucuuccagacuugagagcacaucuaaauaccaagaggggucaacacccaugccccacuuugaccgaaaccuaauucaacucauccuuguggcauuuauguaagguaccacguuuacccaagugcugagauguggucuccagggcaggacaggccgucaguagaggauggcucaauuaagagagcaaggucgcugggcagugguggcgcacaccuuuaaucccagcacuugggaggcagaggcagaggcagguggauuucugaguuugaggccagucuggucuacagagugaguuccaggacagccagggcuacacagagaaacccugucuugaaaagacaaaacaaaacaaaaagagagagcaaggucaacacaaaagcuuuuaggugagucacagagucuggguaaguauggauuggagaggaggcugggcucgaguaucacugagcugugcaguggcugucaucucuaggcccaccugacagauucuuacaugcuuuccccugcaggugacuccagaacacuguaucuuugccagcaacacaucugcucucccaaucaaucaaauugcugcugucagcaaaaggccugagaagguaaacccgacagaaacccucaaacggcagacugcuucagacucacuggcugaaauuuuaguauaugaaccaggaaaagaccaguguagaguauaaaguggauggggugcuuccccaaaguggucacagaaaacugagcgccacucucuacagguguaggauggugacuggugugcaucccucguggcggcuaguucucaaauguggacuauuaaaguuacuuacauuagaaccagauacugagggcuaggcccuaaaccaggaagcagugugcuguucagcuguagugcaguguggugccugccuaggcuggguaagacuccaauccagccuggaaggucagggcugggggaccuacagccucacccucaaccucuacccaggaucugaaaguacuaaacuuagaaguacuuucacugaguauuugcaaugcugucuagaaaguuaucuuugcuuaagcagauucauaaagaauguagucauuuaaagaggggaaaaaagccucacuucucuggaggauaccugcuucaacugagcagccagagagacuagaaauaacaacaacaaaauuucuaagcagcuacaguugcuaauacuaggccugugucuccaaaccacccaagccugacucuucccccuccuaugguguguggcugcagaacagucuaccuuuccuagcacacugguccagggaugugauguggggccugauggaggugagcccagggguggcaagagaccauggacccaacccucugccuagaucagcaguucugcccacaggccuuucucuccaguguuucccuccccggcacugguaaugugcugguuauggcucccucacaggugaucggcaugcacuacuucucccccguggacaagaugcagcuccuagaaaucaucaccacugacaaaaccuccaaggacacaacggccucugccguggccguggggcucaggcaagggaaggucaucauuguggucaagguaaggucagaagcagaagcaggcuaugaaaguucaaacaugauuucuugagccuccagacuuauuauaacucuucugugguggggggcaggggaaggggauaccagccuccaaaacucuguccacuagguugucuccaaaacggacaguaguggugacuguccugcugaaguaggauagcaggagugucugggcucuggcagauccucacuggugacuccagaccucagagaugacaugaaacccagacuguucgagguggcuucuucuccaguauaacauugagcauucugaugagagcuuaagucagcuaaagcugugaaugaugucugggaaaggaauacuggauguggucgugggcagcaaagcaaggcuguaagcucccuuccucucccuuggcaggacggacccggcuucuacaccaccaggugucuugcacccaugaugucugaagucaugcgaauccuccagguggguacuguucuauggaaugucugaggccuugucauaucuuuuucuguccuccaagcuaaagauguccagaugagggacaaguuccccaagaauguacuacugcuuuucuccagaggcccuuuugugucucccucucacacugaaacaggauguccugggacuaagacugugcccaacaggcagaguguuaacucugcugguugcucccccagcauugcaggagccagagccucccagaauggccugacuaccauuguaucacaccacacacacacacacacacacacacacacacacacacacacacacacagagagagagagugaguguguguguguguguguguguguccugguagccauagcaucuacuuaguccugagauucggagucaccagcgagaaggaacucugugaucggagugccugugggauagcugcaggguuucccuugugcuuuccuggaugaagcgcuaguucugcaucuggccaggugauguccaagaaaagaagugggcucugcacaagguugugccugcagcuuaugcaggcagcccuugugugggggaccugggauggcugugcccugaggcccuugcuuuacuucccguucaggaaggaguugacccuaagaagcuggacgccuugaccacagguuucggcuucccugugggugcugccacgcuggcagacgaaguggguguggauguagcacagcacguagcagaagaucuaggcaaagccuuuggggagcgauuuggagguggcagcguagaacugcugaaacagauggucuccaagggcuucuuaggugaguaacuccaggacacaagaguuagcugcuaguuacagagcucugagcaggugccugagaauagagaggguagaggggaaagauuccagaacacaggucccuagacauagggaaucuccuaggcuggggaaaggcagucggugccguguaugccagagaaaccagcauccuccuccugcacggucaggagcaaguucuauauccaccaggcccugaggucuggcuaccuguguccaacauacagaacauacaauugaggcugcagugaaaucuccuuuaggaccugggacuuucauuuguacauuaaaauugggcgugggcgugggcguggccuuucuuaugcagacucagauuuccaugcaccagagcuuucuccucugcccaucaucugacaaggguuaaauggcucaguuggcugcaugcaggagcuuaggggugcaguggagugcuagaagcucacagcauccagcagagacaggguuugcugcugggguaaaaggcaaugacuaacacagucucuuuauucucucaggucgcaagucugggaagggcuuuuacaucuaucaggagggcucaaagaauaagaguuugaauucugaaauggauaauaucuuggcaaaucugaggcugccugccaagcccgagguguaaguugauuugagugacuauuugcccgaaaauaauguuuaucuuaguagcucaaagcuccuuggccccuuuucuauucuauuuaugacccaaagcuggcaaaacacuguacagcuaaauucccugcacaugagcccaguuucaguauccaggugagagugggccaagccuguggacacccugccugcuccagccugugaaggugggagguggguuguggaggcgccuguacccuccucacuguugguuaccuuugggaaugugcugcuguugcugauccuucagaugugacagucaucucuccugugccaggcccuguuuaggugcucaguucacauuggauagggaagagaaaggacuuugaucuuugaggaugguguaguacacccuggccacuggccucccuagaacucacccgcaccccacgugcugugcucuggcuccucccuuucuuucucuagcuaaguucuccuuccugcucccuucucuuccucagcuccucugaugaagacguccaauaccgugugauaacaagguucgugaacgaggcaguccugugccuacaggaagggauccuggccacaccggcagagggagacaucggagcugucuuugggcuuggcuuucccccuugucucggaggucagugugcaggccgggaaguugccuuccuuuauccuugugcaaguuacagucucuuucacuaaaaagucugucucugcucagggcccuuccgcuuuguggaucuguauggugcucagaagguaguggaccggcuacggaaguacgagucugccuauggaacacaguuuaccccaugccagcugcuccucgaccacgcuaacaacucuagcaagaaguucuaccagugacaggcccucccacccuaccccaccaugcacuaacccagaccuggcagugccgcuucucagcugugcuguccaaauuaucaggaagcaggaaaaagaccaaggcuagccuugggcuugcuccuccaucagagugccuucugcccuggcccgcucuuccuccuggugaagucugacugugaauuaacuguuugcacuucauguuaagggggagccccacugugcuucuuuugcaagcccugccugagacccaaaucaacagcuaagaguaacccagaacaccugcugccugugccuucccagaggccaguggggccuggcagugguaagggcauuuuuugcaccaagccaaacacaggauaacaauaaaauccggacuuugugccucugccggacuggccuguuuucuucugucuacccuuguguuugagccuccccuucaguaaggaagccugugcaguggagcauagacgggcugggagaugucgggcagcugcuuuagacagggauuguaaugucagaaaacagacucugugcccaugccuuaugcuugacugccugagugccuuggcugggcugccuggucgggagaguggggacaguagaggugugguguaccaggaugcgaaagauacuccuuuccccaaccacuuccucacugugccauuguacacguucuucuuggcaugcucauccuggcuucugagaguuaugcaaaggauggauacccacagaucagcccaucucgcuucugugaccucaguuuguccuaccucugucccucggugagaguucucacucugggagaagcagggccuagcuauauaaauagugccgggcgccucccugggucccacugagucacuaaguggauauggaaccuaauuugggucccauccgggucacugugcucuguuccauguggaagugcuucaaguacucccacugggacuggcagacggcgcccaccuggcuccacugaauaccugcaguucacugcugggaagaccaacccuaaaguuggucaucucaaaugcauuuucagauggccagaaggcaaagaacugaucacaugcacaaaggccaagcccaggcgucuacuugcaacugagggugucucaggagcuggcagagcugcaguuacaccagaccucaguggcauugagcuuugauuucugggucuucccugcaagcacacagaugugggcucugauaaaaauuacucgagcagccuagugguggcagguggauuucugugaguucaaggaacccugugucaagaaaaagauuauugcgagaggauaggguuuuacaggccacagugaagacugcccccuuguguaucuacacauaccauucuagaguccuucccugcuuuagagacacauccuugguccucauggccuuucacagaaagaaucagccaacacccagggcccuacucuuucaccacuccagggucuagccuuuauuuccauauuccuugagguuucauuaaacaacugugagaagaca

SEQ ID NO: 2393 - RNA, 12294 nt, Mus musculus
guuguguuuuagaagcaguuuuuauuaguaauaacuuuauaauuaaauucugccccaaagaaacagaauuuugcccuucaucuucauuggaagaucacagguuccugucaaucagucauccuuucuucauaacuaucaaaaagaaacagcaaagaaaucacucaggagugacauuuuccuuguaucugucacaugcauuguuggguacaaaauacacugcugauuacagcucuuuuucuuguaguucuuuggaacauugccuuugguuuuuguuuuguuuguuuguuuuuuccuuuuguuuuguuguuuugguuuuuuucuagccaaggcaggcuuuuucaucagguuacuagguagcucuaacuaccuuuuuccugcaucuugcuuggauacuucagggugauagacugcugagcugcaaggaaaugaagaucuaccuuucuugagcagagccuagcagggaagagugccuuauugccuagaacucacuaguggauuccugcacacacacuuaccaggaacauggggucauguguggcucuucuccagugucugucuuuccuauagaaaagcuuauccugaaacuuagagcugggggacaggacacuugccucaccugcauaaacagcucuccucucuggauaucagaccucaaagggcaagccauuuaagguaggacugguuggcugguuacuuacacacacacacacauacacacacacacacacacacacacacacacacacacacacacuauaugauauauaguguuguuguuuggucaggcucucacuuuguagccuccuagauugggcuugaacucuugauccuccugccucagauucucaagaccugggcuuaugaccacagcuggcugaaacgagggucuuuccagauaauuuaaaauuugguauugugggaaucuggacugaacugguuccugguuuguugaugcuuugccucugcuguucacccagggauggccacauccgugggggguggagguggggaggcuuugcugaggagcugcuuggcaagagguugaccagaagccaggcaguggugacgcacgccuuuaaucccagcauuugugaggcagaggcaggcggauuucugaguucgaagccagccuggucuacagagugaguuccaggacagacaaggcuacacagagaaaaccugucucaaaaaaaaaagaagaagaagaagaagaaaaaggaggaggaggagggaaggaagaaagagaaagggagagagagggaggaaggaaggaaggaaggaaggaaggaaggaaggaaggaaggaaggaaggaaggaaggaaggaaggaaggaagaaagaagagguggccugagcuagguaugauggugcaugccuguaauccaaacacuuaagaagcugggguaggaaaaucacaaguucuuggcauguggauuagggugaguucaaggccagcccugguaauuuagcaagagaccucucucaaaaggaaaacuuagggguccagguucuggauuuaacccgcagcagcguugcuggggacgacuugguuuggaggcccuugcuccagcuucuuugaccccaucacuccgcuuccgggaagcugcuucucaccuggcaggcucacuucuuucuuugcuguguucugagguauagguuucauuugugaccuggggagaaguggaaaggcccaguuggggugaucauuauuauaguccgcccaccugugaagagggcgcauccauuuugacauucucauuugcuuuuccgggaauuuugguaucaacuaaguagauuucaugggagccccccacucugucuuuucuaauguggagcagaguauuagaugcaguagaccauagagaacagugccaccaggcauccugguggucacaggaaccccaagucccuuggcuggagaaacauaaccugaaaucugcuugcuguaaaaaggacuccuagugcagucccuagcacaguccucuccuggcugggcccaugucuccccaggagggcuggaaaauggcuggccaaaucucacagauagccaaggccuggugcaacucaccauggagauggcagaguuagaggaccggcugccucgcaaucguuugcgcaaggccucuaguaccugaaggaaagguaaauaaauaucugcuuauguugaucacaugagggccucuaggucaggcgugugggcaggagucagcugggcacucaccuucuugucugugaggcagccaaacacuaauaugaagacacccugaggaggggggggggagcugguuaggggugggggaggcucucuucuugcucccucuccucaucuuccauucucagaccuguucucuaauccacguccuaagucaccuccucaguuucuacacucguuggcaccauuugacauuguguaugcacguguguacagugugugccaugugcuacacuguacagauggaagucagggggcaagguaggggagccgguucuuuccuuccaccauuugggguccaggggucaagcugaggcuuggcagcagucaccuuugccugcugagccaucuugcuuacucucaagggccuuccuaaauuggauuaagacugcauacugauaauuuccagacuucaauguaaaccuaagaaaaccaaacucagacggguuauggaauuugcccauaguuauccagugaggcagugaaggaacugggaccuacauuuaauccuucuaagauuugugagccuggugguuggcagugacuuggucucguuaaaaagaccaaguggcauagccaccccacccuugccaccuaccuggaggcuguugagaauggaaaaggcguagugagagacuauggagccaucaaacagaguggccacgcccaguccccaagugaggccaaagaugggugugagaauaagcagggcuuuaagcacccccacaagagcuuggcgcuucuccacugugggccccucugacagugaaggucgcagcagcuucagcacagcgaugacaaggaccagcccguugacaccgacgauggccagcacuggcucacugaagcuguacagcaugacgccaccuccguucagaaagcauuuccccucccacagguauuuccuuugaggcaaguagaggcccagggugacacccgcaaaccccagugggcacagguagcccagcaucaccaucagugagaggacuacgugcuuggacagcugguggaagacaaaaagcagcuggugggccagcaccagggccugugccagcauccagaaaaagguggccagguagaaaaagugacacaggaaagcagugacuaggcagaucaggcugugguagccugaaggaaggaaggggcuucccaagaagcaugugucugcgaccagcaagcagaucaccauguuaaacagggugguauggcggaagaaggcgacuuuguuccggaccaccacucuccacaccagcccguaaauagccaggcagacgagcaaagccaggacggaagcccccguacccaccuggcucagcagguccagggugggauuuucugggacaguguguugggacaugaggauggaaaaggcugugagaugcuggcaaaugcacugagugaugcuggcauuggcugcauguaccucacacccuucaucugaccaaccucccugacccuggaagacccuguggucccagaacacacagugaaggguuccauucaugucuucauaguccaugauaacuucugccugcgugaaggccuggccgucugcuguuauggagaccacaaggaucagcccaggggugguguaugggguguuccacagcccuuguguguaguuugagggcagccgguaguccagcuuuugcaguacuaggcuaguaauacugacguuaguuccacuauggaccaguggggccagugaaugccauggaauccgugccugcagcaggggccagguggagaaggacauuugguagccaggaggagaggagugucugaggagcuggcucugcaguagcacauuagcugagcugaaggaaaaaggaugcuguuguggucuuaagcugugaaccaaggucuccacagccuucaggaaaucugagcccauggagggcuccugggccugggccagaguccacagagcgcugauguucgcgucuagaaucuugucuguggucgucaggagguccugcagugaccaacaguaggaguugugacuuacugaagucuacaggagcauuaggacuuacagaccccacccuuccuuccauggcaagacccagagugucgagaaaaagugacaggacaggccugugggggggccuucuggaucaggggacagagagagcacugcucagcagcuacagggcccucuugggaucauggucuccaaaucuacacccagauccuaaugccucuucucccacuggcaucuuugggaccucccagguccuacaaagguccuucuucaacuccguagcuuguccaguucugcaaagcuaggagugguggcuagcggcaggaagcucgcuaugcucaaguugagaaccacaugaggucugaguggccaucucugcaguuuagaggcucaccggagaggcgugugguguugcugucucuaguugcucuugauucauguagguagagcaaugccaaguauuucugaguggucucuauggguacuggguuaucgugugugugugaugcuuccaugcuugugucuccgaaacucaugucuccccaccccuucuggccucucagcaucaggcuuucuuuauucucuaugacugauguuuuacagagauagcaggaaccccaagccuaaaaaggucccuguugggccgcccacaggaugucagaaggcagaaguauuccuaaugaacgagcuuccaccugcgaccacccgguaggugcccacuaugccccaagaucuuaccuucagagcacugccugugagcucugugcuugucucugcuaccaccuuggccaguaaggucacagugugcagcauuucccauaagucagagggggugcuggccacgcccaccugcucuugcagcucacucaagauccauggcacuuccucguagggcuuucccuggccuuccagcagcagcugacagaaaggaccgugggugacaugaaaauccucacuaggaaggagccaugucuuccccugcugcagcuccuugcuccucugcucugcaccccucagaggagcaggaagaggagagagaguacaugcagaaggaacggcuacugaagggggcugauaguacuuggugggacugugguuugagacaaauaccaccaccaccaccaccaccacauagacccccuuugucccuggaggauccacuuucacacuccuuucuagagaccuccagcaaggacuucaggugagaggcugaauaacauguaagcuggcuuaagaaucugaauucugagggaaggagaugaagaggcauggagggagagaggaaauguaggaagacagacgggcaggcagacagacaggcaggcagacagacaugcaagcaaguaggugggcagguguuugcugggagagccauggagguagcagcuuuaccuuggcuuuaagacacaagguuaggaucuuugcuucugugcagguguucuggacuggccuccagaugccaucagucccacagagccucuuuaccacaccuuucuuauucacaggacauggggccugugccacgaagccagccuuggugacauuccagcuaaccacugagaaguccucagggcagguagugucuccaucugaagaaggaucagugaagccucagcagccacgagacagccagagcuucuguuuuagucagaaccuaugcaggccuugauaccugacucaguggcucaagguacagggauaacaaagaagaggccccauguuucagagacaagccacucagaggucagccuacuggacccaaggcccacauacccuggauaaucgugauagagacaggagccacgagaggaggcagguucugacucugaaggguacagguguaugugguauugguugcugggcagugcggaacagcuagcacaaagcauugggaauccgacauuuuuugcaaggaggcugaggacaagagagaggagaaaagugaggcaccccuggcuaaaucagaugagggcugagagguccuaaaacaucgcuucagaguggucgucaaggaugaagcaaugagggcaggcaggaugggaugcuagccuccaacugcugguucagaauuuggguuuuucugaagugcauccuauuggaaugucucuagcucugggcucugggucucaguuucaacagauuuaaaaauauuuguucuugcuauucauauggcauuuaaaaaagauucacucucauuuuaauuaugugcauguuuauguacccuuguguaaguagacaugggagcacuggugagcccaaagugagcuucagauccccugggcuggaguuacugguggugagccagcagcaugggugcugggaacagaucucagguccuccggaagagcagcaagugcuuguaacugcuaagucaggucuccagccccaauuuccucuccacccuuaaaaaaaccuguguuuauguacuuuauguauaugaguguucugucuucacguacaccagaagagcgaaucagaucacauuauagguggucaugagccaccaugugguugcugggaauugugguuccagcaccucuggaagagcagccaagugcucuuaaccgcugagccaucucuccagacucccaccccucucccccacccuguuuuccuccuuuuaaaaaaacaggauauuauuaaacuaaccucauagaguuuacugcaggagucaagugggaguguaugaugggaagguucuaucaacagagcagggauugcucugacggacauggcugcccaacucccauccagaacgguagccggugcugccuggagggaccagccucgucacucgucucugacaguguccuaccuuggcuguccuccccaggacuccagguagcaguguagucuguuguaagugggaugcagcagcucagcugaaagccaguggaggcaguacaggagauggacagggcgucugggagucgaacgacuucuuccuccugcaagggcaccuucaccagcugccgcagccuccaccugaaccccugggcuucgaagaugcucucguacucaccugcagagaugugcccacuaccugguggcucacccaagccugccuguaggccagcucuccacugcuuucuaagucucggcccaggcccuucaguuucccauuccugcucucugugccaggaccuuacuuccagcuggaaggccccaggacggcccuuuuggaaaacacucccuugucccaaggagaaagagaccuauagaagaggcuccuggccuguccaccuuagccagugccgauggacucugaaaugagccccuuccccccaccaugcuacccagccacucaguaucuggaccaaugcuucucagccuguggguugugaccccucuggggucgaacgacccuuuuacagggucaccuaaggccauuggaaaacacagauauuuacauuaugguucauaacaguagcaacauuacaguuaugaaguagcaaugaaaauaauuuuaugguuggggggggucaccacaacaugaggaacugaauuaaaagaucgcagcacuaggaagauggaaaagcacugcucuagacaagcaccagucuuuucucagcgggaacugaguguucucaguuuuuaacauucccaucauccuuugcagcaggaauauuauguucugaagaguaguagcaaucagaagauugacauuuuauuuuuucguuguguuugcgugucuguguguaugugcacgcacacacaugcacaagcaugucuggugugugggcgagcaugugccacagcaugugugggggucagaggugaguguucaucuuccaccucuauugaggcaggaucccuugguuugaugccauaucuccugggcucuuuuuccuuucaucuuuuggugggagguuucauguagggagcaugacugcaagcauaucguccuucugccuccaucucccaaaugcucagauuauaggugugcaccaccugccugguuuaggaggugucaggaacugaacccauugccuugugccugccgggcaagcacuuuaccagccagggcuccagagcugcuacagugcagccuagucacagucacuuuaaccagagacagagccagcucugcauuugcucccuguaauguugugaaggcagcacuagaugucacucacuacccauuccugacggagccaagugacaccagugugugugugugugugugugugugugugugugugugugugagauuuuacauugucacguaucaggacaacacugaguuuuugcgaagcucugaaaggguuuuaggaacccccagauuacagugcaaacaguuggcugucgaacaggacuuuccacacuauaaugagucucuuugccuuugcuuuucuaacaaauggaaagauggaaaagucuagagaggggugaauggaggggaaaaaaggaagaaaggggaaggagaaaugagagagagagaggugaagagaagcagagaaagaagugggcaguucauguauguaaccucagugguuggugggcugaggcaggaggauugcuaugagguugaggccagccugggcuacacagagagaugacuuugucucaagagacccaugggaaagaaggagagagaagaaacuggaguguuaccugcccaaugacgggacaugcgggcgacacgaaggccagacuggcccucacuggacgucugcaacacauuggucccuggccauaggcugaugggugugugguucuuugagugucucaagaaccaucucagguuuguggcuuccucuuucuugaggagaaugagguucaggguguugccgugcauuugcagcugggaguccaguaucagguuugcaggaacuacaggaagggaaagagacaggagcuagagaagggaguaaaguagcaauuccuccuccccgcccacccucugaggccugccucucugaauaacuuucuucucagacauccucagguaucugacugggacuacaccccagccugguagacccucccaaugagaaccaaaguggcaagccccucugacuuaugaccuccacuuuccagggacuugggguggcugaagcugcuuccgggaagaucaccuugcccaugugucuccagagcugcuuucauuagucucauuuuucaagucccaagcucagguccagggucuugcugaauaguuggcuccccacccccacccacaaccucagccaaaagagcagcugggcuuggaucagcugccagaaacacaggucuaaaguaaaggcaaaaacuaagcaaacaucuccaacaauccagaaagcguuucuuuucacuuggggauacuagugugcugguuucuaacccuccuuaccagguggcagcaacuggcaguagccaguaacaggaccguggaagcugcgacacauacaggaaucucuuucugaccugcggccccagcaguguggguaaagggaacaaaguguggcauuccauugguagccaggguggcaagugcagaggcugguuccgcugugguuagcacgacacucugaccgagagaaguaggcaggcugagaaaaugaggucucagggcuggauggcacuaaucuugaagucccaggaggucagacccgcccacccaaggggacuuccuuugcagccagcacugaguaaaacaggcuguaccuggcaaggacacccucgugaaguuccucacuaccuaucagaacauugggacaugaacaggaagggaggauguggcuggguaaggggaugaggaaggucaugggccaggggcaaugaaguagggaguaggagagcccacugcaucuugggcaagcugucuagcuggagaauuggggagcggcgugccaucugcagggagccccaugcaaccacuaccuguuguaaggccaaggccaguaagcguuuucgggggaaggacugccagggcgguaggaagaguaaaguuuuuagagagcuccuguggccaggcugugcuugaaaauuccagaugcacauagcuggagaccagcacugauucuauagacgcaaaggggacaucagaggagaggcagugaggccccaagcuaguccucuuuggccuuaacauacucagguggccauuuccggggacacaagcagaugucaucuccuguagccugccuagguacacagagggugcaggaugguaacaacucccauccucguuggggaagcacucuggucuaugguuccaaguugucauugcaaagugcaugugucuuucuaggccucacagcuaaagagcuggagagccccacccccacccccacccccagagccucacuguggcccuuucuguuucuuccuccccaccccacccccuuuuuuuguuuuuuguuuuuucgagacaggguuucucuguauagcccuggcuguccuggagcucacuuuguagaccaggcuggccucaaacucagaaauccgccugccucugccucccgagugcugggauuaaaggcgugcaccaccacgcccggcuuuguuguuuuuuuuuuuuguuuuguuuuuuuuuuuuuuuuugguuuuuuucgagacaggguuucucuguauagccuuggcuguccuggagcucaguuuauagaccaggcuggccucaaacucagaaauccgccugcuucugccucccaagugcugggauuaaaggcgugcaccaccaagcccggcuccuuuccccuuucuugauaccccugccccccaguccuuccacucacccccuucuccacuguacugguucaguugcugcccagauuucccuccauauggacugagcuccuggaaagagauagaggagacucugaggagagaggcuggucucaaguuccugccaggguacccucaggggcagccuggcuacucuggugugacuuggucucuuagaaguucuucuuuaggccagaggucaaauguaaguaucuggagggagaaaaggauguucagaaacggggacaggggcacaauuccagggacccugccagggccagcagccucaccugaaaccaggaaccaggcacacccuggaagucaacaugcuuuguuuagcuccuuccugaauugaccugucccugggccucuaggcuaauugaaauggcuggguccagagcuccaacaaggagucaggguccugcaaauuaacccauguuuuccucucaaaaucccauguguguaugcaucuaaaaccagauggcagcucacacuugcaaucucagcacccaggagacugaagcaggaagacuguagcaaguacaaggacagccugggcaacagagugaaccuuuauuuaaaaaacaaacaaacuaacuaacaacaaucaccccaaaauauaaauaauaaaaccagaaggaagccagacauggugguucaagccuguacaauaaucccagugcuuaagauaauggggcagggguaucccuuacuuaagauaauggggcaggaguaucccuuacuuaagugcaaggguucaagagcagccugggcaacacagaagauccacacagaaaauaaaaacaaggaaguacaugaaaacuaggaggauauaacacaaacaaacaaacaggugcaggcaaggauaggcuauagauaagacaugccacagaggaagcuacagauagggauauuuagaucuggggauugcaguagauuaggagcuguagauaaauagauaauaaaaugcaagccuaggcuccacgcuucuccucagacucuuucccaucgucuaugcuaauaagcuucuacaucugcaaagguuuucuucucauuucauuguaaguugguagccaaaagagcagcaggugucguagggugucauggggacucagguaaagcuauggaaguguccccucacccugggcaggaagauugccuucuugggggcaagcuggucccuuccuuccaccuuucauccuacacccugugguuccucacaaccuguggcucugacuguggccucugcaggucuccccaggguccucacucaccccaguacuuacugauugggcuguggggacaaauguuggcuccaacuccagcaggggaagagucacggccaggagcagcugggagagagcuagagaggacauggcucaacgcagcagucc

SEQ ID NO: 2394 - RNA, 366 nt, Mus musculus
cuuuuuuuuuuuuuuuuaaacagguucagcucuuuauuggccaacuuaacaaaagcaguuuagucaaaaaguccaaaguccaugucaucuucagacuccucggacucuuccuucuuugccuccacuuucuucuccucagcuggggcggcggcagcggacggagcaggaccaccaacaggcacagcuccagcugcuggagcgggcccaccagccccgacauugcagaugaggcucccaguguugacauuggccaaagccuuggcaaacgagccaggccagaaagguucaacgcugacaccagcugauuuaaugagggcauugaucuuauccucugugaccgucaccucgucgucgugcacaauacuc

SEQ ID NO: 2395 - RNA, 2905 nt, Mus musculus
uagaaaguuuaagaccagacuuaccuuguaaagcuguacucacugguaccccuguuccccagcugaagaguucugaauucaugcaguugaauccuucucaacagucuguuuuaugggaacacuucauuaccaugacccgcaguucugguucuggaaugagggaucuuccuugcgccggugaugguuaacucccgucccgaguuuucuuguccuggguuuuuucguccuggguucuuucuucccggauuucggcaccaacucuuacacgcguucacgcgaccggccaggaagaacgcaacaaaccagaaucuucugcgguaaaaacuuuauuauuuacaucuucaggagcaagagugcaagagccccccaaaagcaaaaacgaaaccccgucccucuuaaggagaguuauccuucgccuaggacguaucacucccugauuggcugcagcccauggccgaguugucgucacggggaaggcagagcacaugggguggagaacuacccuuggcacaugcgcagauuauuuguuuaccacuuagaacacagcugucagcgccaucuuguaacggcgaaugugggggcggcuucccacaagagaccuuaaggucuggcaagauggcuuaaaggguaaaggcacuuuggugccaagccugauaacauaaguuagauuccccacaacucacaaguugggaggagaaaaucaacuguggaaaacugucuucugauccauccaugcucacucucccccacaaauacauguuauuaauuaaaaaaaaaaacuggggcaaagugaaauugaauuguugaagaucccucagauaacaaguauaagaugacaaaggccagacaaaguucuguauuauuucuguuuaagaucucaggauuuauaauugauucuaaguuuuaacaaccauccacacaggagaggcagugaaccgcaacuacucgcugucacaaaauuuaaagcuguggggcuggagagauggcucaguaguuaagagugcugacugcuaugcagagaggaccaggguuccuccugagcacccacguccugaagcucacaaccgccucuaacuccagcuccagggacacgagauggccccggucuccucaggcaccuauacuuacgugcacauacucacacacauaauuaaagguaacaagaguccuuuaaaacauucaaaauuguucuuuaaaaaaauauuuccuagauugccuuuggggcaggaggaucaugaguuuaagucaacauuggcuacagugauucuucuuacaccucagcucuccagaaagcugggauuguagggguccacagccacacucagcucugguagggugguaauggggaagggacugguaagggugggugggacugggaagagaggagggagggggguugugagccgauguaaaguggauaauaaauguguagcucauguacuguuauuaguuugcaguuguguaaguuuuuaaaaaauuacuuuuuauuuuacacguauggguguguguuugccugcauccugugcaugcaguguccuugaaggccacaggagggcaucagauucgcuggaacuggagcuacagaugggugugagccaccucugggaguugaacucaggaucuccagaagagcagucauuacucuuaacggcugagccaucucuccagcccuauccugucacuuuuaaauguuuuuccacaaguaguuaaaguauuuuaaguaugguuuguauuucagauggaauggugcaaggcucauauuaaaaaaaaauugaugacaagauucuuuuugucauauuuauauugacuagaaaaacuacauagcaaagauuuuauguugguuuaauggacacuuuauaugcaucaucucauuaagaacuguacauuuuagaggugggugugguggcucacacuugauauugauaauauugucaugaaucugagguuagucugggcugaauagugaguuccaggcuagcuaggagcugguaugggauccugucucaaaaaagccggaaacugugcuuagcauaucuuagguccugacagcaauuuguuaagugaaugacuccaaggaacuuaaguggagauuucaaauuaauugcccucauuccagggaacaagggaacuauuagacucacugauaaucuguuucuaauagggcuauauuucuaauugggcuaaccauuuccaaccaaauaagugcuucuggauaggcauuguaauuugaauuucuugcugguacuggagaauacacaacuccggacugugugcuaagggaaauggggcaaaugccucucaucucaaaguuaauggguuggcgaugauguaugcaaaauucucugcacguaaggcacgcaauaaaaaguagcaauuauuaaacauuuccuauuauuagacacauauuaaccacuggugacguguucuuucuacaaugcacugggcccuaguuguaaaaucacuccuuguaaacacagggccccgucgagauugagagaucaaugguuuuaugggggaaucgaggagacuuaagcaauuggaauucgcaccggcugaaccaguggaauuugacgaggcaguccaagguucacaagcaucauggaucagaagggacugauuuucaagucccuuuggauuacucgauguuucccguucgcccgacaucaucauuucaggaucccgaagcuccaggcgcucacagcccgcuguggcacacaccugccuccgcccuuccccucgaacgcccccguacacacucacccgggccacaagauuaugcgagcaucccacacaaucacucgggguuccuauagcagagacaagagcaaaggcugcugggaaguugaccuuucacuccuccucuuacuucaguucaccuauuuugacucuggcaaaugaagcgacg

SEQ ID NO: 2396 - RNA, 7881 nt, Mus musculus
agagaggagacuggcccgcccauggucacucuugugccucucaacagccacaggagcaaagcucugucauccuuaggauccagucaucagggaacagaacagggagaccagaagagggccagcuggagccaggggguggaggcucaggaaacagucucugaaaggggcagggaccaggcacaggaggccaggggcccagagaacagacuccccucagaaguacagaagaggagagcggaaggaacugagggagggacagacaggagccugaggaggaaagaggagggggagaaggggucaggcccagcagccaaggaggaggcgugcagcugggggcugcaggcaggaagcuagggacagaacuggcucggcggaguacuguccccugaagcagcggcauccccuggaagugcgguauaggcauuauuggucagaccaagaugugccucuaagggcagcaaggaacauuucaccauggcccccagagcccucuggagcugcuaucucugcugucugcugaccauagccacggaagcugccagcuacccuccucgagguuacagccucuacacaggaggcacuggggcccugaguccugggggaccccaggcccagaacucaccacggccugccagccgccacagguaagagucuguauuccauccagggcugaaggcugugguugggaaagccuuuagaaggugggcaacaggcuuaacacaaugaagaggacagcgugaacacccauccaucaauggccuacccauaugcaccuuccgguggaacuuuuuccagggcuucgguagccuaagggggaucaacucucgccucuucccuaaggaggucuguaguugggugcccagggacacuacaccaagggguauggacuauccuuccugccagcugccagcuguguaccagccagcucuggaucaggcagaccuuucuccuccucuagggcuuccuuggccccauccacuaauguauaauucugacacuccuccugcucuguucccucuggcucuacagcagcucacagacuagaagccagugugaauggggucaagagugcagcaccgcaagccccaaggggacagagcccaucaguggcuuauucucuacuuaagcauaggucggacauuuggacacuggccugccccgcucuccucuuugaaggcuggguggaggcaccaugagcagggggucauguacaggaacccagcuuacucagcuggggcuugagauaggcccaaagaaguacacagggacugugaauucuaggguacccuggggccccacagucagaagggcugacuucucuguguguguuuuuaucauuauguuuuuccugucuugaaaagucuuuaucugccauagugacacaaaguguguguuugucugugugugucugugugugugugugugucuguguaggagaggggagugggugcugccccugcaaaaacccuaacuuucaauggguccuuaaggcccccuucaucuuuugacccuccuucaaccuccgggcccacuggggcuugugucuuugguccuuuggcccagguaggguugugccuacaggaacuggugugccuacguggugacucggacagugagcugcguccuugaggauggaguggagaccauugucaagccagacuaucaacccuguggcuggggccagccccacuguucccgaaguaucaugugaggccccaacuuaggggauugggugcuuacugggauccgggcaagggcagacagcugguggccaucuagggggucugugcaaaggagggagcagggggaaggacaggauuucagucagaaccauuuugagaagacagccggguccuagcuuggcuggugagcugccacaggcauucuccccuuguccccaaccuuugggacuucugcugacacaggucagucuuaaagagauuagcuuaggguuccagcacagggaaagaaaaaaccaggauuuagcccuuaacuaaaaagcagauagcuguuaacugagcaggaccacacacuggcuagagagguagacccagccugaagcacaagacaaccagcugcacugagagaauacaaaaccuuccuuuccucuggccagguaccggagcuuucuucgcccucgcuaucggguggcuuacaagacagugacagacauggaguggaggugcugucaggguuaugggggcgaugacuguggagagggcccugcuuccguucugggcccagcacccuccacaccacuuccccggcccaggccugugcgccccaaccugucuggcuccagugccggcagccaucucaguggacugggaggagaaggugagccugcauguugcuaggcaugggggaauccuggguggaaaauguggggcccagcuguggagggagggaaaccucuaugcucuaaacuuggggggaaggugguuauaacagagguaaugacgucccugaaacuucgaauguuugcaugcuugugugauuugagugugucugggggccggguggggggcagggcagagcuugggggagacugauugaaagaccugaaaacuuaagaucuggauaagacaagaaggcauagagacaauuuguucacauacucccucuaguggccaagguccuucguagucgggaacagcugugggagaagcguggggaauuccuuugagaaucucugucugcagggaagauaguuaagacuacaaauccuagcaugcauugcaccggacuacaggucccaacccccucccaggccccuggagacugcaggucccagaaugcaaucgccucuguuguguucuuuccuccuauguguaugaguuaggcuaggcacaccggaugcgugguccuuuccugccaaagagauaacugaacuauaauuauggaaacaggaacuucugguaaacuggcuggccagccagcaccccagcaggcuugcugcaagagccucuuguuugucccucuggugguuuagggaagggcccagucauugcaacaguggcaugugaaguacuuucccacauuuccauuuuaaacuguuugacagcccuaaaaggcaggacacauagugucaaucgaauuuuccagauaaggaaaugguuuccaagaagucaagagguccuggggacaaguuggguggccgggugaucuaaguuugaaauuugacauggccacuuguuaaacgcauucucuggaacuacuugccuaauuucucugguuccccguuuccugugccaucaaauggcaaaaguaucugcccaauagaaaaguuuuaagagcugugguccaaaucuggcccaaggacauucagugaaugguauuuccuuccuuccuuccuuccuuccuuccuuccuuccuuccuuccuuccuucccuccacucccuuuugcccaaaucauccaaaggagagccuucugacccuugacucuugcuggaguuggaguaggcagagacugggccauagaaucugagcucugagauccagcugcucagucauccgccuuucucucucuucagguccuguugagucagagaaggugcagcagcuagagcggcaggugaagagucugaccaaagagcugcaaggccuucgggguguccugcaggggaugaaugggcgccuagcagaagauguacagcgagcuguggacacagucuuuaauggaaggcagcagccagcagaugcagcugcccgcccgggcgugcaugaaacccucagugagauccagcagcagcugcagcuccuggacaaccgugucuccacucaugaccaggagcugggccaccuuaacaaccaucauaauggaggcccugguggagguggcagggccucaggcccugucccaguuccuucuggccccagugaagaacuguuaaggcagcuggaacggcagcugcaagagucuugcucagugugccugacggggcuggauggcuuccgccagcagcagcaagaggauagggagcggcugcgaacccuggagaagcuaauguccucuauggaggagcggcagcaacagcuugugggaccugccauggccaggagacccccucaggaaugcugccccccagagcugggucgacgagugucugagcuggagcggaggcuagauguagugacuggcucacugacagugcuaaguggacgcagagguucugagcuuggaggagcagcugggcaggggggccacccuccaggcuacaccagcuuggccucccgccuuucucgccuggaggaccgcuucaacucuacccuaggucccucagaggagcaagagaagaacuggccuggaggaccagggaggcugggccacugguugccugcugcuccaggacggcuagaaaagcuggagggacuacuagccaaugugagcagggagcuggguggccgcauggaucugcuggaagagcagguggcaggggcuguucggacuugugggcagauuugcucuggggcacccggggaacaggauucucgggucaaugagauccucagugccuuggaacgcagggugcuggacagcgagggccgguuacagcuagugggcucuggcuugcaugaagcagaggcagcaggggaggcucagcaggccguguuggagggacugcaagggcuccugagccggcuucgggagcgcauggaugcacaggaggagacugcagcagaaaucuuacugcgccucaaucuuaccgcagcccagcuaagccagcuggagggucugcugcaagcccguggggaugaggguuguggcgccuguggugguguccaggaggagcugggccgccuucgggaugguguggaacguugcuccugcccauuguuaccuccacggggcccuggagcuggcccagggguugggggaccaagccgugggccucuggaugguuucaguguguuugggggcaguucaggcucagcccuccaggcccuucaaggagaacucucugagguuauucucaccuucagcucccugaacgacucacuccacgagcuccagaccacuguggagggucagggugccgaucuggcugaccugggggccaccaaggacagcaucaucucugaaaucaacagacuacagcaggaggccacggagcacgucacagagagcgaggagcgcuuccgaggccuggaggagggccaggcacaggcuggccaaugcccuagcuuagaggggcgauuaggccgccuugagggagucugcgaacgacuggacaccguggcagggggacuacaaggccuacgugaaggccucuccagacacguggcugggcucugggcugcaguacgggaaagcaacagcaccagccugacacaggccgcccugcuggagaagcugcuggggggccaggcaggccugggcaggcggcuuggugcccucaacaauucccugcugcuccuggaagaccgucugcagcaacuuagccuaaaggacuucacuggugaggacagaaggcgugguggggugugcagggagggaggccccuucuugcucccugccucgcagccagugaggaggccugguguucucgccuccucuuuguucugccucaguccuagccccuacugcucaucagggagguugacguaugucugcagagaagcuguugugguguagcucccugcccuccuucugguugcuuagaugggccuuuggguggaacugggauguggcuugugcugguauguggcucuaucaaucagacaccuugccugcagcccgagggaccccgugucuccaucagucuuccccaucuccuaccuguggcgccaccgccuuuccuguccguuggaaagcauggcugaccuucaucucgguuuugguuuuguuaccauaggaccuucaggcaaggcugggcccccagggccucccgggcuacaagggccuucaggcccugcaggaccuccaggaccuccuggcaaagacggacaacagggggccauuggcccaccagguauguuggaugagacaccacuauccuggcagcccugcauaguauuccacacugagcuugacggagaaggaguaaggaagcagagguccggauggcugacagugaaaagaaagugacuaggagcugaaugaaaguggccauugggggcuggagagauggcucagcgguuaagagcacugacugcucuuccagagauccugaguucaauucccagcagccacaugguagcucacaaccaucuguaaugggaucugauguccucuucuggugugucugaagucagcuacaguguacuuguauacaugaagaaaacaagaaaaagaaaguggucauuuggcuccugggcacuguggucucccugccguauugcaguucauguagcguaugaggagcuccuggcugaggcuguggucuagcaucugcccagacuggagcccacuuacgcuuuucuuggcaucacauuccacaccuaacacccagagcagugcaagagagcagauguugggugagggcauggugagagauguccuauucacuguggucccuuucuuccaacagguccucaaggggagcaggguaagucguuagacucuggaaggggccaggagcuugggccuggaagacuauaguccucaggcagccugggcagcagggauggggacuggaguuuauuuaugagcauccaugcuaacacuaucucuauucaggagcggagggagcaccagcagccccugugccuaggguagcauuuucagcugcccugaguuugccacggucagaaccuggcacaguccccuucgacagagucuugcucaaugauggaggcuacuaugacccagagacagguaacuaaaaggccgacggguggccuagugagguaacgggugaagcugagcaguacuaaugccuccuucacaccucugcagacaaguacagcuuuucacuuguaauuacaaagaccucuauucuuuccaugcacucacaccacaguuaggcaaagagagagugggggaggggaggagacauccacaccacacggaucuuuacugggacagacuccagcacacacucugcagcaacugcuggagaugcagcaggggauuccuacaguguacaguuaguggaauagcagggaaaggacgggugggccacuccacagccaggagugcuguacccacucuccgagagaccuuccuugucccagccagcgucuccccuccugacugucauccuugucuccagguguauucacugcaccacuggcuggacgcuauuugcugagcgcuguacuuacugggcaccggcaugagaaaguggaagcaguauugucacgcuccaaccugggcguggcccgcauagacucgggaggcuaugaacccgagggacuggagaauaagccuguggccgaaagucagcccagcccaggcgcucugggcgucuucagccucauucugccacugcaggucggagacacugucugcaucgaccuggucauggggcagcuggcacacuccgaggagccgcucaccaucuucagcggagcccugcucuacgaggacacagagcuugaacagguguagacaggguggacccgaccaccaaacuuaucuacaggggccgcagagccaccuggaugguggcuacccaccaaggcaagggcaagucuggcgaccacgucccgcugcgguucaggcauccaaaucggucacuccguacguugugacugcguggucuaugggaccgaggcaucuccucuugaccuuuggccucauugccguccccaccagagcccucuccgggacccaagcugcggaagaggaaccuacccuccagggcucuccccaguccacaccaccguacuaaacuauucaggaauaaagacacuuuuuuuuuuucuacaaaacauagc

SEQ ID NO: 2397 - RNA, 6415 nt, Mus musculus
guacggcagcauucucuaaaacgggggaaaagguguuuauuguagucaauaauacaaauuaguacgaguccacuccugaaccaaguguccacaagacccccgagguggugcaauuugacaccuuucauuaucaauggccgcuucagccuuaaacaguucugcucauuggccaguaauugucaacgaaguaaaucuucuuggcugcgacauggccgggacuugauagaugagggugcgcagucaggugagcuggaagucuuguguggcucaugaagccuuggcuuuccggcgcuggguuccccaaaguagaauggagauggcuagcgugguggaucccagaaucccaaagaacauaagcagugaaaaugagcccugugauuagcaaacagacaagucacagcuguguagguacccagggccucuuuuaacaucuguucuuucucggucacucauccccucauuugggcacuuccucuauuuccuacccccuccagcauugauuccuugucuugugucucuuucugagaaguucuugccuaaugcaucccuuuauuucuaaaagguccaguuccucaccugccucauacacuuguauccauggaaaccaucagcacaaacgcacugcaaaagaccaggaccgucagaugcacaagauccguucucaggacacauuucugggagccagagaaaaacagucacugaagucuaaggccaauuacccugaagagccaagcuccucuuucuucuucuucuucuucuucuucuucuucuuuuuuuuuuuuuuuuuuuuuuuuuuuuuuuuuuuuuugguuuuuugagacaggguuucucuguguagcccuggcuguccuggaacucacuuuguagaccaggcuggccucgaacucagaaauccaccugccucugccucccaagugcaugugccaucacgccgggcuucagagccaagcucuucugaucucagaagcaaagcagggccugauugguacuugcaugggaggagaucacuggaucucauuaggcauuuuuucaaaucugcuuagauucuuaauuauuuguacaucaaaaguagagggaaaagccaggcauggugguaaacaccuaaaucacagcguuugggaagcagggcaggcgcggaucucugugaguucugguguacacagcaaguucuagaucagcuaggaauccuuacagaaacuuaucucagaaagucaaaacaaaaagaaacacuagaagaaaagcucaucaggagguagugcaagccuuugaucccagcacugggagaaaaaggcaugcauaucuuugugaguuuaaggccaacucagauugcagagugaguuccuggacagccagagcuguuacacagagaaaguuuguaucaaaacaacaacaaaagccagggugugguggcgcacaccuuuaaucccagcucucuaaucccagcacucaggaggcagaggcaggcggauuucugaguucgaggccagccuggucuacaaagugagugccaggacagccagggcuacacagagaaacccugucucaaaaaaccaaaaaaaaaaaaaaaaaagaaaaagaaaaaagaaauaauaauaauacagcaacaauaauaauuaaaccucgucaggggaauagagaacacacaggacaaaaaggcacuuuagcaucuuuacuuuucuaacguagagaauaauugcucuuuagaaagaaggaaagcacucuccagugaggcgaccaugcuaaagcauaccugggcuuccagugcuauugcaaaggucccuuugcccuuggcaaaucugcuuguccuugaaagaaguaacauugucccaggcauuacuaccuccaggacagggaacaucuugugguaguauccugaagacaacacauaugaucauaaaugcacagccaaagagguugggguguagcucgggaguagaacaaacauucaacaacacacaaagccauggguccacucccuaacacacaugcacauaugaacuuacucagucacgcgcacacgcacaccccacacagcaguaguggcucucauccugcugagcacuuagcacaucagcacucucucccuuccuguauuacucacagagucugcagcugaguaaacccacggaagguguuggccaaaucauccuugagaggauuugccugaaggucucugcaaaguacacacuguuagcgcucuguuugcagaaguuuucuauuagccuuuauaugugcuguccugggccaguaacccacuccuuauccucaguuguacaagguuagaugcuaauauuaaccuaccuucucaagaguuauuucccaucaccauauuuaucuuuugggcaggaaaauauauaaccacuuacaugauaauagcaguauaagccuguaaaaaguuuggaccaggauccuucagggaacaguucugaagaucuagccugaagaaacaaagaaaucagugucaacucugccucuuuuucauccccuacuuaagcuaauauugauggaauaucuauguucagaacuguaagguuaaggcuaugguagcagacauuguaaucauguaguagccaaucuaguuagcccuggcuacauguagacaucuuaauuuaccuaaaauucaaguucacucucaaaagcaacacuucaaacacauaaaaccuuggauccugugcugauuaguacagauauguagcauuucagucagcaacuggaauuucuauugggucacacaguuucuuguuuuuaauauuuauuuauuuuauuuauaugagugcacugucacugucuucagacacaccagaagagggcaacagaucccaccaaagaugguugugagcuaccaugugguugcugggaauugaacucaggaccucuggaagaggacucagugcucuuaacugcugagccaucucuccagcucuaaucaguagagccaugcauugugcaaauacuggaagaagccuuguggguuuuuuucccuccaggauuaguagguuuuacugaaauucuuacacucagaaguuacuguugucagggccuugugcauuucaggcaaguccuagcaccaagccacagacagagauuuuguuuuguuuuguuuuguuuuguugagacaagguuucucuguguagccuuggcugucuuggaacucacuuuuuagacaagucuaggcucaaauucagagaucugucucccacugccccugagugcuuuaaucccagcacuugggaggcagaggcaggcggauuucugaguucaaggccagccuggucuacaaagugaguuccaggacagccagggcuacacagagaaacccugucucgaaaaaaccaaaaagagagagagagagagagugagucagucucaaccgagugacaauccuccugccucagcuucucaaaugcuggauuagagagaaugaucagcauccccacagagaucauuuucuuuugagacaagguuucaauguaacccaagcuagccucaaauucacuaaguagcugaggguuaccuugauauuccucccaaguacugaaguuacaacugcacacagagguguuaaaugaaaggaaaaaaaggcaaaucacuuaaguuuucccaaguagauuuucuuucuucuuuuucuuuuuuucuuucuuuuuuuugggggggggggguggguggguucaagugcugggauuaaaggagugugccaccacgccuggcccaaguagauuuuauguuacagguaacuguaaaugccuguacauuaaggauuucaagccuccaagccuugugguggugcacaccuuuaauucuggcacuugagaggcagaggcaggcagaucucugaguuugagaccagccuaguuuauagaaggagcuccaggacagaaaaauucuauguugaaaaaccaaccaagggggcuagaaagauggcucagagguuaaaaguucuuaaguugcucuuccaaagguccugaguucaauuuccagcaaccacaugguaacucacagccaucaauaaugagaucuggugcccucuucuggcacacuauacacaauaaauaaauaaauaaauaaauaaaaauuuaaaaaagaaaagacaaaccaaccaaauaaaaaggacuucaacaaauuauuuuuccauuuacugugugccuacaaacuacaaaaaucauaacauaaaauauauauguuuuugcaagccuguaaucccagcuacucaggaagcugaggcaggaggaucacaaguucaugguuagugugggcaauuagugagaucaugugucaaaauacugaaaagagccagaugugauggcucaccccuguaaucccaguacuugggaagcuguaacagcaaugauaugaguuugagaccaaaaccugugcuacauaguaccaggauaggcagggcuauauagcaagacucugucucaaagaaaacaaaaggaaaagcaaauccaaaaaagguagcuugcauaaaguccuagguucauuuccuaguacccagaacaacaauaagaagaagaaggaaaaaaaaaaauuaaaggcuggaaagauggcuuagcaguuaagagccaguauugcuccuacagaagaccugagucuaguucccaguacccacacuguaucucacaacugccuaucauuccagcuccaggaggauccaaggccucugaaauuuuccagcaccugcacucaagugccuguacccagacagucagacagacagacagacacaauuaaaaacaaaaaaauaaaaugaagaaaaauuuaaauguauuuuaguaaaaauaauacaaagacuuaauaauaaaacuauuuuaaaugaagccacaaaagccuauaaaauggcaaaaacuaugauuugucauucagggaaaaaaaaaucaaaagaucauuuacuuaucgaaaaaucaucaaauucaaauguuuagaaucgagcauuaaaugucuccacuuagguacuaauauuuauccccagagccugcuaggcaagucuguagacuccagucugggaacucuaaaaaguucaaaagaauauucaaggaugucuucuccucccucaccccaagauggugcccuucugauucaggcagcaucgggccugcauuagcuucgauguauccucacaguaagcagccacucuggacaaauugugcauaccucccggacacagggugcauaucugcagaagagaaagaaaccugauuaagacuccagaaagaaaaaaaaaaaaaagaacaagucaguagccuuuccagaauucccauaaugcaaagcggaaaagugccuuuuguaaacagaacccauuuuuuucccuuaaaacccccgcaccaaaucagcgcacuguacgagagaagauccucguguuugugcauuauuacuugacuauacuguguccucuccagagacuucuccaccugacaggcaugguuuggcaaguguuaaagggcugcagguacacagcguacucaagcaucacuauauauuuagauagauagauagauagauagauagauagauagauagauagauagauagauagauagauagauagauagucgugccauugcaccacgcacagcauucgugcaaggagagcuggcagaagaacccugggacucgucugggaagcacuauuuaaaauuauucaaaagcaaggagaucaaauuucaaaggacucugaaugugggcagggcgaaggugcuaguggccugcacuacgugaguacuggacaacaccauccccgcaggcacagggcccggggaagcuucagggacaaaaaucugagcuuccgacuggccaaagggacagacaccggcgggcgagcuggauuccgggcugacggccagcaaccuucuucagccagaucucaaacuuucuucuguaccucagguagagccagggcccucuccacgcccagaaccaggagcagggcggccgcccgagagccgccugacucccgagacgccauuucccacugcuuuccaccgucuugacagcucgcgagaaccgagcgcgaggcuccgcccccagcgugucacgcgccagccuugaggcgaggcuuagcuuccaaauccugucacucuggggcguggccugguccgcccggggcacgagccguggagcccgaggcguaauuugcccgcagguucgggcugcucgcggaauucugagcuccuguccugcgcuugcucgcgguggacagacccaccaucucuccauucuuccuggagcgcaggccuguccaguuagcgcuuaguugccuugagcuacugcaugacccucagcccggugcggacgcccgggcagcuccauccgcccuuaguaaacauggcggcgcugggacccgggagggcggggguagggggcgggguccugcugucccgcugucaccaagucaggaggugcgagccgagccgagccg

SEQ ID NO: 2398 - RNA, 23704 nt, Mus musculus
gaacuguuuggcuguuuauuacagucaguacaaaaguaacuguacagauuugagguguaagaauggagaugaggcagaggggcccccaguaucugagacugcauccccaaguuagaaaagacucucgucuggagccuaaagcauggucccaguuuaguacaucuaugugcuugggcuaucuguaugcuccaggauugucugcuaagugugcugcccccguggggggggcaucgggauuccuugcccagcagcugggccugaagagacaagaaaggaagcugggaccuagaaacggccaagcacgguggcaagcagggccaugcggauguacaugccguucucagcuuggcggaaguaggcugcccggggguccgaguccaccuccacacugugagagaagcaaaagcauuaccacccagcuccuggagagcccguccaggcaaaggacccuucccacagccagccaaggguaucccagggcagaggggccgcaucaccuuaucucauugacacggggcauugggugcaucaccaccaucuucuucuuggcccgggucaugaugugaggagugaggaugaacugaccaaagcacuguaagguagguagggacuccauuagagacuucagggauggccacagagaacacaaccagggagccgcacacucacacgcagcccggcaaccuugggaccuggaacuuaacuguugcguucuagcccgugccccuucccacccuccucucccauggaugcccugcgguccagccccaggccuugugcucacagcuucauauuccuggacagagccaaaucguucuuucuggauccgagucauguagagcacgucugugucgggcagcgccuccucgaugcucucaaacuccuccuaaggagggagcugggugaaugcccugcacggcucucaccgcccaaucccgggcucucuggcguggacuaagucaccaggaucucaccugcuuggugccucgggaggccacaaagucccguacacuggguggcaugcgcaggcugggaggugccacguagcguaggcucacacgguacugggugagcaggcaggccagggagugcacugugcguccaugcuucaggucaccgaccauagugaucuaaaggaggcagccagucaccagaugggcuugcaacaagcaccucuccugccauuuuaaaggcuggagccuccuagacacggcacacccugccuagagugcccccccaacuccaguccucgucacccucaccgucaugccauugacaguccccagcucuucucgaauggugaagauguccagcagggccuguguggggugcuccccaacuccauccccagcauugaucacuggccugcgacagugcuuggcugccagcugugaaggcaggaaaccgugggagaaccaccuggcccaacgcagcuuggaaggcucgcucucucggccuccacuccacgucuccuggaccccccccccccaucuagcccaaccuaagacugugugugggcaggaagggacauuacguuccugggaucagccuuggccacccaucugagaguacugaggggacaggcuggccucaccuccacggcuccaggcugagggugucggagcacaaugacaucagcauagcaacucauggucugcaccgagucagcaagggacucgcccuuuuggacggaggauguagcuucugagaagcugagaacagcgcccccgagccgggccauggcugcugcgaaggagcuacuggugcgggugcucaccucguagaacauggaggccaugaccuuccccuggggaaaggaccagcagaagugguaugugcaugugugccucaggaaugcacccagggcggcacucgccucucacaccagagggcgcagagaaccucccgagaccugccaccgcacgacauuuccacacuaccgugacucagagcuaaagccaugacuguguguauaaccucagauugcaaaugucaacggcugccccccccgcacccccccuucccugugacuaacacaauucagaucagaugaccccauauguagggucacugcugggaggaagccgugugcuggucaagauggcagcaccaggcaggcccauggauggcugcccacagcgcuccaacaggggccauaggaagcaaagcuggcagccacagcccugaccuucaggaugucgaggcuccgcuccuucuguaccaucauccguagcgugugcgccacauugaacagaugagacaucuaugaaggaucucaagucagucucgcagguccugccacccacacuccaaacccucaagcucugugugucaccgccuugugacccucagguaccugauccuuagugaacugcuugacagacaggaugugcuggcccacuagggagugcaguaggggcgacaucugggggugcagcaggccagaagacccuagguucuggggugaugccugucuagguacugguggugcaggguagcagggaccaucagggguucccaucagcucugcagugagggguggugcagaagaggcuggucagaaggcucccccuacuuggaucagacuacagaggcccccagguaaauaugcaucagugcggacucaccugguuccacuaccuuccuggguggcuucucuuuagguuccucagcugcaaaugacaacaggacagaggucaccugguggcuauggugcagugggcccaaaucacaaugaccucugcucccagugcuuguguuaaagccaccucaaaucacaggugcuacagcagguuaggggaggcaggaagggugcagcaucuauggggaggaacccaggacucccuguggugcugugcuguaugggccgagugugcccucccagggccuucccagcuggcauaaaggaucugaggcagaggaauggccaaguucacaccaaccagcaagcgggauuuaccccaugcucugcugccccaugagaucccagcuccugggcggagguacagagcugcccacaacagaaaaaggccugugagaagaugcuacuuccugcugcaguaacuacuucaguaggguacaguggaucagacuaggugcaagggcaagagaguguggcaagaaagggacuugaaagagaggcuugagaagagacugggcccccaacccuggccuacuaaggacacgauguagaacaggucccaucccuccaucaaucaggcuauguggaacagcaucugucccuguacaagucaguaggaaagggccugcuccgugccgcagccaccucucuuaccuggcagaccugggucagaggcccgguggaugcgggguggcagguggaagcggccaucaggaaggcccgggaugacucggcguggucgcucaggugucugcaauggauauggcccagcauguggaaaaguuacggauuccguguuggccacacacagucccuugggagaagccagaguccaccccaccccaccucugcacuguugcagccuccccacaugcugucaccggcuggcagacacacuagccuguuggagguguaugcaaucuagcaacgaggccugggcagacacaugaacaccagccuugugauucucagagcuggcuuccuacacugaaaauuaaguccacuuggcaguggacagggaggcggguauagugauuuuaacuaucaaguguagcacuucccaccaauggaacugcugcuagcccagcccuaggccacaccccagggcugguggccagacccagccuaggggcaggguaguuaccguggugauuucggugguggcgggaguugaaggagggggcuggggaacaacccccugcggccacuuccguacaucuuguccauagcccggggguaccagcaccugaacaacggaaggcaaagagcaugaaggaacagggaguucacagagacucguagagauguagacaccagcaagaaagugucaccugggacacagggcaguggggcuauacuggacagggaguaaaaugaaagugcccaagaggucacuucugagaccccugggaaggaacccaacacauaccuguccaucaauauaggcgaccuccccucgcaagaccacacggcgcacugugcccuucaccuucuguccuucaaaugggguccagcgggccuuagagaagggcauguggcuggggacuguccacucaugcuccagauccaccugucaagggucaagggucaagucacagaguauagcugugaggguggagcucuccccaacuccaggcccucgaccgcucaccucuacauagguguccuccuggagaggcagguggaagauccgccgaggguuguggugcaaucgcugcagcaggucauccagacugaggcggcccucgcucacagcugucagcagcagcggcaacauggucucuaggcccgggaagccagguggaggcuugggcccacacuucucuuccaagguauggggagcugugagaaaaacagcuaucacucugggaggcaggcucagccaccucaucccaagacuucacuuggagcaaugccacgguccucucuaccaacccugcagccuuguugacccagcugcccucuggggcuccaccccugcacacauagccucucauuccuucuuucgaucagcauuugucaaucccugugcuuaaggaccucagagcccgggccuggcugccacuuucuuccuagagcugcugcccuacagcuugaguuggggcacaagcauaaugaggcaggagaugcgcgcugggcccucucaccguggucugaggcaaaacagucgaugacugccauauucucccacagggcuuccauauccucucgggacccaagcucaggacggaccucucccuucccaggucccaggcgcuccaagucuucccgguuuaggaacagguggugaggagcgaccucacaggucacuggcagccccugcgccuuugcaguuuuaaucaacaggaucuggggagagaggacaauucacaggagguccccgacgugacaugcccugcccuuccgucucuaugcuuggcauucuuucucagaacagcgagggccaaaugugccaaagguacuggccuugggcucucccaccccuuccugccuccaaggacagucaguaaccucuggucuuccugggaaagugacagggguaccaggagcucugaugcacucucaccucuuccuuccgagccacaugacauaugugcacuggacgcugggucagcugagccaccaugaggaccgcagcgacacucugccgcucugcaugggccacaauggggaggugggcaggccagguuucaaaaugcuggggacagaaagaauugaugagagaaagugcugagccuuugucuugcugcacucaucagagcccaggguccucagaaaccccugaauccucucugcuggcagcucagguagacgaggccucaagccgagagagagcguguggugacacacagcucaccuccauccacugggccacacuguccagccgcagcucagagaaggucucguugagguagagcuucaggccugcugcagagccggccacagcacccagaguccccgcguucucagaugaggcuccaaggaauaagguaaagucacagcgggcgccagccucugccagcuagauaggguacauacgcacgaggucagguuugcugccaucuaugcccagguaagucagcaagggaccagcacucugggguauagcggcucaccuucugggcaagggcgagagcaggagcaucaaugauggggggucggguauuaggcauagcacaaaccauggugacacccccagccaaggcagcagcugugccugaggcaaaguccucuuugugugucccaccugguucccgaaggugcacguggacaucaaucaauccuaggagaaaguugggggcgagaucagaguuggcgugggagaaaagcuacagccacugauacaaguucucaaugaagagcaccauggaagagggagcucacaccaagagcgauucuagggccugcacaguccguaaccccaggcagacaguccaccccaaaggccucacgcaccgggcaggcgcacuagcuucugggaggucaugcagucaacgugcacuuucaaaggaggggcugggccgaucuggccuagggccugcaagugggaagcaaaucaggacagacuuaagggacgcgugggugacccugggagguaaguuaggacccauuucuccauaacccacacucuuguucuccauccaccucccagccucuggagccaccaagcuuuacugugaacacauggcccuuuccuaacgccauacccccagccagcaccuggggcuguguuaccuccacaaagaguuuggugcacuugaugucaaugaugagaggcacagagaaaucagcggccagacgccggguacgguagcccuugguaacgaaggaggaaagacgccgacccccagccccacgcauggacagguuaaucacuagcucaaagugauuuucagccagcugauccaagaugcuccguuguggugggcacucaccauccaccgccucuucaaagugccaguccacagcuguuaccugccagcccagaacaaaggucaaggcuaacaucaccccccaaaacgucacugugcggccugguucugggugucaacuugacacaggcuggcauaucacagagaaaggagccucccuugaggaaaggccuccaugagauccagcuguaaggaauuuucucaauuagcgauugucuuagucaggguuucuauuccugcauaaacaucaugaccaagaagcaaguuggggaggauucagcuuacacuuccauacugcuguucaucaccaaaggaagccaggacuggaacucaagcaggucaggaaccaggagcugaugcagaggccauggaaggaugcugcuuacuggcuugcuucuccuggcuugcucaauuugcuuucuuauagaacccaagacuaccagcccagggauggcaccauccacaagggccccccccccugccuugcucacuaacugagaaaaugccuuauagcuggaucucauggaggcccuuccccaacugaagcucuuuucucugugauaacuccagcuugugucaaguugacacaaaaccagccaguacagugaucaagagugggagggcccauuguggguggugccuucccugggcugguagucuugaguuuuauaagagagcagguugagcaaaccaggggaagcaagccaguaaacagugucucuccacagccucugcauccacuccugcuuccaagucucucccgugugaguuccugaccugacuuccuuugacaaugaacagaaauuuggaaguguaagccgaauaaacccuuuccuccccaacuugcuucuuggucaugcaugauguuugugccggaauagaaacccugacuaagacaguugggaaggucuaucugagcagaucuagcucgcagugagaaugggaguccauaggccugggacaaggggcugccucuguuugcuacuggcaagggauaguccucaacugaaaaagcauuucucccuugugagcggaguuaggucauuaauagcaguacgaacccacacacauguacacaugcacaagacuuggaaagaaagccaaaacaaaacacaagaacuuuuaacagugcagaagagccuucgagaaacacacccugcuuauucuacccuggggcaaagagaaaaggagaggguccuuuggggccugggggacaguggcaagugaccacauaccuugaccccgugcucaguguagaagucugccguacccaggcuggcauagaggcuguagcccaggcucuccagcaaccgcacaguugggagcagcucacuuuuguucugaaaccgagcagaggcaagugaguccuagccuagacagccgaagccaugugccgugugucuucccuccugcccggguggcccugguaccuuguagcugccaauagucagcaggauguucuucucugggaucuuaaagccagugcugagcauggcuuugagguaggcuucacaacggcucucuccgaagccggccaccucuccaguacuggucaucuccacaccaaguaccacgucggcaccggccaagcgugagaaggagaacugagguaccugggggagcaacaggacagaagagucaggagucggggcagaaaaggagcucuguccccaucacacccacacagaagggcuggccucuacucuggcuguuuucuggcccuggacccaggcccaaggagcucugcaaacccaacagccuuaccauucuugcgauucaguuccaguaccaccccgucucccaaaacacacucuagaaacaacaccgcccaucuccaaacuccuuguacauuugguuuauaacucaguuauguagguguaucacagacuguucuauaacaagcuauuuuugaaccaaacuucauuugccuccuacaggguaaacucuuaagggaugaugaccaccauaucauccuaugguugggcaauaaugccuugugugggugagaguucuguucauugagcucucuuccuuagcucagcagcagcacucuugccugaggccauggguuugagucuccaguagcucaaaaauauaaaugaauuaaacaaagcagccaggugucccacaucuuacagaaucaucuaguuuuugaccugagcuuguuauaccaauuaggggaucuguacaccaggcucaaggggcccaucgcccaauuuaccuuuacucccacgacuccagagccagucaugagccccacgggcucuacuuucucccccaugaugauccuuguggccaaggcuacuagaucaacacccagugucuuggacacgaaggggaaagagcgagauacacgcacguugcauucaauaaccuucagcuggucauccuaggaaaggaacuucagguuaggccuugugaagcccaggugggcugacaaccacucuagugaccugggugucagccucucucucgacugaguaaucagccggaugaucgugaccagcuccaaaaccgcagugggcuccagcccugacacugcagugggcucuagacgugagcccuucccaagcuuugcugccugagugagugaggguaggagacagugcagggauuuguggcgguggggccagcagagaacacaggcuuuugucccuuccuguugacuuauuaccuuggcaaugagcugcagauugaaggguccuguaaccuguagcuccuggcccacagcaugcacaauggcuuugauccgcuccagaguuuucggggugaugucuugugggggggucaccagcguggcaucaccugaaugcacaccugcauucuccacgugcucagagauggcaauggccgacacgaugccgucacaggccaccgcguccacgucgaucuccuggaggcaacacgggcagcgggauuguaggacagggucauuuucuccuugcccuuuggugaaacagcguugucagacacaagccaucccucccggccacugugccugugacccagcgaguacacagccuccucuggggcuggcggggagacccucaccuuugcuuccugaaugaacuuggagaugacuacggggugcuccuuagagacggcggccgcacugcucaggaaacgcuccagguccccgucgguguacgccacauucauagcagcaccgcugagcacauaggaggggcgcacuacgcagggguacccgaccguguggcagaacuggcgagcagacugcagggacaggagggucaguggggugcucacacucacccacaagcgacauccgccccgcggcuuccugccagaccccagcccaccucaaggucacugagcucucgccacugaggcuggcugauaccgaugguaucuaggagccgggagaacuugaaucgguucucggcugagucgauggcuucgggggaggugcccagcacucggcacugcugccgaugcaaagccauggccauguuguugggcagcugcccacccauggacaggaucacaccuucgggguucucuaacucauagauguccaucaccaccuguaguacaggaaaggaaccgaaggcaaccaaaaggcucagggaagcugugugcuucacucacccuccccgcccccugccaagcaccaaggaaucuuugacugcucagccuaucccacucauucccuaaguaccuugguagcccuuaucccucucaccucaaaagagaucucaucaaaguagagucggucacacauaucauagucggugcugacugucucuggguuguaguucaccaugauggucuuauaacccaucugccggaggggggugaaauacauuagggauuaacaagaagcacacaggggcuggagaaauggcucagugguuaaagagcacuggcugcucuuccagagguccugaguucaauucccagcagccacgugguggcucacaaccaucugaaaugagaucugaugcccuuuucuggccugcaggaguacaugcagauagagcacucauacauuagaggaaggacauagagaagcuuagccaaaguccccaaugcagucggccggccagccagccuguuucccgugaaacagcuauaaacauagguagauaacauguuacggaugagauucaggcacagagagagguuguuuauauaggacuucuauuaauuccuaaugaacaggaagauccgguaucuuuugugggaggacaggcaaacaccacagagaacaggagaacuaccagagaacagggccucugaccuuccggagcugcuggaugcaacccacagcacaccaaucaaacucaacacuggagccaauccgguagacaccagagccaaggaccaggacgugaggugcccgaaagucgaggucauggguguugccccaguaugucagguacagguaauuugucugggcuggccacucagcugcaacugugucaaucuguuucaccgcugggcagauccccaguuccugacgcagcuuccgaacagccagcucugugcuaaaggaagggaaagaccagaugugggaauggaguauagacugacuuaggcaagcgcuagggcaggguuagcaaggaaacagccuaugggcagaugaagagaagaacuuccaaggcuccccuccaaugggccucccgaggcaaaagcucccuccccacaccaccaucucugaccucaggacugccagggcaaucugcuugucugagaagccgaggcacuuggccuggugcagcaggucuugggguaaagcuuguccacgguguuguuccagcaacugggcgugggucacaaugcgcuucauccggugcaggaaccagcaaucaaugcgggugagcucguagaggcgcuccacagaguagccagcccacagagcggcagccaccacaaagauccgcuuauccgucggagucuccagcuccuguugggggaagagcacagacggcuggaugcagggcagugccgggguggaaaaaaauacagccagggaaauaaggaauaguaaaucaugugaacgaugcugccauuacugucaaccagccaaggggugguauggagcagggcccaagucagggugcuuuuggagaggagagcugcuuaccaugucgcugacuggcuuuacuguauggucgaagccuacgcaguucucaucgaccaugcgcagggccuuuuggaaggccuccucaaaggaccgcccgaugcccaugaccucgccuggaagaaugggauggagggcagguagacguggggauacccaacacacucauggcagucacuugaucuuuggaagguucucaaggcccauggugguggugucuuacgaagcuugcuucaccauuaagaaaccuaaaagcaagcugagcaugguggugcaugccuugaaucccagcacucaggagacagagguaggcagaucucugugagucugaggccagucugaucuacaaagcgaacuucaggacagcuagggcuuguuacagagaauuccuggcucgagaaacaaacaaaacaaacaaacaaaccaacaaacaaaaaggaagaagaaagaagccuaaacacaaucucuuuuccuaccauuucuccagacaaacacagccuguccugugaguguguaaaaugggaugguagauacuggaacuuguuacuuaauagcagcagccccagcuacugaugacuguccagcuaucuggcuugcuuuauucacaucaggaugguaccaucuggaauguuucauccuagcacauuaaaaagucuggaugaccagaaaauguacuucuuucucuuuccugcuccuucacccccaagacaguuucuuuacguagcccuggcuguccuaguuuucacucuguagaccaagcuggccucaaacucagagaucuaccugccucugccucccaagcgcugagauuaaauaaaggcugagccaccaccaccaaccagcugccaacugcauuuuaaaaaaaaagauuuuaaggucccauggguggucccuuugggucccagcacucaggaggcagaagcaaauggaucucuguggaguuuaaagcuagccuggucuacauagcaaguuccaagacagccaaagaaagacccugucucaaaaugaaugaaugaaugaaugaaugagugaaaacagauuugaggcuaaggagauagucagugaugaaccugaguucaagcuccaaaacucacacaaaagauagguguuggggcuggugagauggcucgguggguaaagcacccgacugcuccuccaaagguccgaaguucaaaucccaucaaccacaugguggcucacaaccauccguaaugaugagaucugacucccucuucuggggugacugaagauagcuacaguguacuuauauauaauaaaaauaaauaaaaaaaucuuuaaaaaaaaaaaaagauagguauuuugacaaagcuuauaaucucagagcuggagaugauaacaagcagaugcuuagggcaccggcuggccggccagccuaucuuaaaaguuucaggccaggucuugaaagaaaaagggggagucgggcgugguggcacaugccuauaaucccagcacuuggggggcagaggcaggcggauuucugaguucgaggccagccuggucuacaaagugaguuccaggacagccagggcuauacagagaaauccugucucaaaaaaacgaaaacaacaacaacaacaacaacaacaacaacaacaacaaaaacaaacaagaaagaaagaaagaaagaaagaaagaaagaaagaaagaaagaaagaaagaaagaaagaaagaaaaagggggaggggagaaaaggguaacaguacccaauucuguccgcuggccuuauaugcccccacauaccacuccaacccacacccacacaggaugggguuuucuuccuggacucucccccuauauauguuuuauagacaacuguaguauacacaccaguucuguggccccgcccccaucagaaacccuuccccacacggcuguacaaccuccuaagcacugcaacaauuccugguuuacugcuuuuaaggguugauguggucagugaggcuguauaacuuguuguuuuagauuacuacuuaggaaagugcaaggcaauggguaggaguaacuguagccuguucuagauacaaaguguaaaguguaaccaacuuccuacuaagugggaacaucauuuuagaugaguucugcgaaucacaguaucuugcuugaggccgagugugguggcucauacuuguaaucucaguauuuaugagguagaggcaggaggaucacuauuagcugaaggccagacuauucuaaacauagcaaguuccaggcuagcuauggcuauauagugacagcuugucuggggggugggggugggggggcggucaagagccugaagcaggaagacuguaagacuuuggggacaguguaugcaguguauggcuacuuagugcacgccaggccaaccucaucuauaaaaugaauagcuggcaacacagcuagagccugucucaaaaagacaagaucaaaauacacaaagaaaauuauaaaaguuagcagggagaagauggcauuucgagaagucugggaggagcgagagacauuucaaagucucagcugggaaccaaccaaucuuucacuauccuguuuccaauccacuuccuuuagccacaacuuaauuauggcuccgcucccauguuuauuaucauuuucauauaacagaaacucaucuccagaaggaacaucuuggcagucuuggaggacuucuacaaauucugaaacaauaucuaagcucagacuuacuuguuuaaaagccacuuguguucuaaauggugacaugcuuauccaaauuggcugggagcacccgugccugcuucucucagacaaagcaacuacagagacacugcagagcacaucagcuggauuccagcuugcuucaccgcucaccaccacgcaauauucuaaacaggcuggcggguuuuuugguucuguuuuugagacagugucuugugguuauugucuaggcuaccauagacuuuauuccauagcccagacuggcuuugaauucacacucuugucugcugaaacucuuuguuagguaacaguugcuaucuugcucugaucuuaacucuguguuaaaugcaaauuccauuguagauacuagaaguuguugccagaggaggagacaggcggagaauggcuagcuagcaccaugcugacuucuggucacugaaaggaacuugcccggugaccagaguucaguuccuagaacucacuuaaagguagaaagaacugaaaaugugucccgacucccacaucugcacugugguaugcacacuccacccucacauauacuuugcacacaaagagcaauaaauuuuaagaauuagggauuuauagggccaggcaguggcggugcacgccuuuaauuccagcaauugaggggcagaggcaggcgggauuucugaguucaagguuugaggucagccuggucuacaaggugaguuccaagacagccagggcuacacagagaaacucugucucaaaacaaaacaaaaccaaaacaaauaaaaaacaaaaaaauaaaggauuuauaggaaagcaucaguaacccuuucccuagaaauauuuaaacagugaauaaaaugucacuggaguuuaucaaccuaacaaugccgcuggaagugagaugccacgucaugaggauaaagugucucgaggaagaugaaagacauagugaaugauggguuuacaaccagcaagaucuggcuuuugcuuugaccccuuacuacuccgugagccaggucacuuuccuccugagccccccuccccccauuuaccuguuuguuaaauaagagagaucaaauaaucugaucccagggacuauauuccaacacccgcuuccagaugacucuuguccccugcuccuagugaggauaacuaacuugaaauguacccauuaucucugagaaagcucuaugcgcucucucucucucucucucucucucucucucucacacacacacacacacacacagacacacacacacuuaucugcuuuccaagacaguguuucucuauguagcccuggccacccuggaacuggcucuacaaaccaggcuacucucagauugacagauccaccugccucugccuucugagugcuggaauucuaggcacgggcuggcauggaccaccauguccaacuaaugaucuguauuaaaggacugcagcauuagggaagcugaggaccacugcucuccugguucuagcaggacccaugggaguuggaacggguguagaaagcucaccaacacucuucaugcaacucccaaucuucguacugacacguaggaacuugcugaggucccagcgaggaaucuuuaccacgcaguaguccaggcugggcucaaaggcugcuguuccucccguaacagaguuucugagcaugaacgaguugggugccaaaaagacagaagaauauauagggugagcuugcagucccucucauagguccagucuuaugaauaauuucaacuuuccccucaccuuaacaucaggauucccccaaguuauaccugagcucuggcaggggaaugcccaaugcuagcuuggcugccacauaggcuaguggauagccuguggccuuacuggccagggcagagcuucgggagagccuggcauucacuucaaugauguaauacugcaaaugggagaacacagagaauaagucacugacaccuggccuagaaaagggcucaaaagggggaggagaaaugauugggccucuaccagggauggagagaggaaagggccuccccaagcuccaacccaaaccacgacaauccuggcuucacucuagggugagcagggccaagaaaccucuuaaccuugaggcccacagaccaagguaugaaggccucaguaugagacucaccugcucagacucgggguucaaagcauacuguacauugcacuccccgacaaugcccaggugcugagugaccuugauagcuguccgucgcagaagcugguacucucugucauucagugucuggcucggagccaccacuauggauucaccaguaugaaugcccagugggucuaaguucuccauguugcauaccuacaaguggggucacagaggucaccaauaaagggggucaaaaggcccaggaggcuacauccccaggcccugcuauaucugaaguguuucggcacucaccguuacgcaguugccauaggcgucucucaccaccucauauucaaucuccuuccagcccuucagagacuugucuaucagcaccugacugguaugggcaaaagcuggagccacaagagcugagaguuccucuuugguggaagcaaagccagaaccgagaccacccagggcaaaggcugcucgcaccagcacaggguagccuagucgcucggcagcugccugagccugcagugagugggagacaugaaccaacaagucauuucuggacccaaaagaaauaagauucagaggaaaugacaucauuccacuucuacccaaacaccuaacaaaccuguucaagagaauuugccgcuucacugggggcgacaugcucuccgaucucagccauccuggcagcgaaggcucgucgguccucagucaguucaauggucuccacggguguacccaagacccggaccccauaucgagccaguaccccagcuuuggucagcuccacaccgcaguucagggcuguuugacccccaaaagucaguaacacaccaucugggcguucauuacgaauuaccugaggcaggagguaggagucaaaggcauuaggggacaguagaucaaagcagcuuauaagugcccagagugacaucagcaaaccccuuugcccaucaagagcccgcgacacccaccccccgcccccagcccccaggccauccuuaucugacccguaccuggguuacguagugaaguguuaugggaaggaaauagaccuugucugccagccccugagaagucugcacuguggcaauguugggguugauuaguaaugucuggauguuuuccuccuuuagggcuuuaauugccuaacaggacaaaaauggcuggucagccucuucuacagaagacaggacuuaggcacuucuuccccucucuguacucuguccucaguaagugaccucuauccuuccugcccucaacaucuauauacccguagaccuaauccaucuccuccuccugcucaagacucaauggggcaggucccagugggaggccauucgccuuaccugagagcccgaguagucaaauucuccagcuuggccaauggagaggcccccugagccuaggauuagaaccuuucguggaggcgggagcccagaaccaggaauggggagcucagggggacagaggcgcugagccaagcguucucuuacugugaaugcaaaaucauggagugucagggugagcgaauuccagaagccaucuguacuagacccucacuuccaggcaagcacagagagggcgagcguccagagccccuaacucuagaguuccuuuacacagaaauggcacaaacugcccacaguucauugucucucuucuucccucacauaucuaguuuuucaaguaugucucucuuagacuagucuugggcuagcccuguucuuagguccacauacugguucuaugaaggggcuuuaccugucuggcccccaauguucccagcugcagccucucucacaguuucuagaaauacaucgaagagcaguuccauaucugaagggccggcccggugcucugggugaaacuggacacuagagauugaaugacagaaccuuugacaucacugccagagcuacaguggccucagagaggacugagguucaaugcugugccuuguuuucccaucuucacagucccuggucacccccaacaccccccugcucaccugaagaagggcaggcugucgugcacuaugccuucauuggaacagucauuggcauuggugaacagaggagcccagccugcuggcagcgaaucugcguccacugcaaacccaugauucugggacgucagaaagcagcgcccagugcccaccaguaaacagggcugguuguggccucgguuuccguaucuggagaaugggacagagucacaaccccucuugccaaccucucccccgcuacccaaaacucagcucuuuuagaucucaucgcucccgauagcuggaugacuguuuccacgccaauaaccccuagcucccaagacacuguuaaucgugggcuccuucugcucccacaagcccuaccucaucuuguaaguuuuggccccgauggcuaaagccaacagcugguguccaaggcagauuccaaacacaggucggggguuagguucagacaagacucggcucaguguggacaccacacccggguaagaggcagggucaccggguccauuacuuaggaagagaccgucauauucuggaaugggcagagaagguugacaaccaaagcaccaccugcgaagccugguggcccgagcuccguccccagaacccgugguaggagagaucagacuccugaaagcugagcuggggcacgcacuuacacccguuacuacaauaaauaaacuuguaaaauaaaagcacacacccaccccagaccgaggaagugaaaucccuggucucugccuuccuuccugcaacccacccugacuuuuaucaguuguccugagggauagcucuuccgcucagacccaagccacucaucugcacaggucccagauacucacucugacugucuaacucguggucccaggguaccacgguaacuucagccccaagcuggcagagacaucggaucugauuauacuugaggccacaauccagagcacagauccgaggggcacccccugcauugaauacccguggagucugaggagacaagaccgacaguuggcagcugugaucagcacguguaacucacgcucacaccaaaccccaucuuugaaguccuugaguuugccccaauuguggccagaaaaguaaccacuggucuuccaccugcaaacauguccuauucucuuccucuguaccuuaauagagaccucuggugccaggggccuggcauugggguccacgaauggcagggcugacggcucugucccuuucuggaccagcuuccccaaaagagacccuugcucccgcaacuucuuagucagcucccgaguguccacuccugucaaaacagcgcagccucagaugauggacccaaacucagucaccagugaggguguccaggaacacuccuccuccuccucagacccgaucaaucgcaacuguucuacacgcaucaaaauucuggaccacucugaugaaagaacacugccaugaaguggucuugcccuaaauaugacauccaaacugaaccacaaucuacauagccccaauuacuggaaauaacuucuagaagaaaacaaacauggcaaacaauacuauaggaguaagaacauaagcugggcaagguaguaggaaggcacuuugggaagcuacaggaggccauccuuggcuauaugauaacccacccugucuugaaaaucccaaaccaaaaaaaaagagcagacuacacaaaaguaacagaucccagaaaccucccugauucucucggucuagguacuguguacuuuacccagacaccccagugcuugcucucguaccuugcaggccggggaugccacgcuguugcagccacucaugcagggugcaguuggcacuccaguggcugggugugggacagcauucucccacuacaagucccgccacguggaucuccgaggauucaaaccacuauagaagacgagaccgcgaggaguuagcucagagacagcuagcucucaaaggcaugucccuccacugucuggccacacaggacaguguaucauuccuacaguauccuaagcacuccccacuuugcaggcagugccuuuacuaacuuugcauugucccacaagaaacacugaacaugggccuaucguguccagagaacaggaaauggggcuuuccucucucugaacacccccacuucuacauuaucuacaucaucucccuucuaagaaugaaccuuuuucuacuucacugcuauguacaaugugucuugaauauguucuugcacaugauacagacuaaauccucaagcauuuccugugugcucacuaggugcaggccuuguagcagaugccaagacaaaggcacugaacaaaggcagugaggaaagguaagguuuguuguccucaaggugcaaacuuccaccucagguauccagaaacuaacaagguaauaugaacaaacucgguaauaauuauauaggugugauaaagacaaaguaguaagagauuugcacagaacauuaaaauaaacaaagccgguggagcaugguggugcugcaccuuuaauuggaacuuagaauuagagaccagucuggucuagagaaaguuccaagacagucaggacuacacugagaaacugucuugaaaaacaacacacaaacacacacacacacacacacccugguauaaaaagaauaaaaaaauguccaugccucaaccccucaccugcagccccagcaccagggaaggcagaggcaggaggguugaguuugaaagucuauauaaacuacagccuucagggaucugaaggguguuuuggcuggcccuccccagguggagagacccagguacacaucuucaggcaaagcaaugcauugggcuguaggucucauucacccugcaucuaucagggggucucaauuuugacaacuuaacauauuaaccaaauucuuaagauauugccuuguagcuaggaggggguggcacaugccuauuuaaucccagugcuagggaggcagaggcaagaggaucucuauuaguucaaagccagugaggccagccuagucuagaaaaugagcuccaggcagccaaggcuagacggagaaacccugucuugaaaaaaaagagagaggagcugaaaggguuugcagccccuuaggaggaacaacaauaugaaguaaccaauacccccagagcucccagggacuaaaccaccaaucaaagaauacacauggcuccagcugcauaaguagcagaggauggucuagucagucaucaaugggaggagaggcccuuuguccugugaagguucgaugccccaguguaggggaaugccagggccaaaggagcaggaguagguggguuggugagcaggggagggggggagggaagggauaggggguuuuuggaggggaaacuaggaaaggggauaacauuugaaauguaaauaacaaaaauaucuaguaaaaaauuuuuuuaaaaaaagaggcaaagaaaaaagauaaaaaaaaaaaaaaaaaaaaggccgggcggugguggcgcaugccuuuaaucccagcacucgggaggcagaggcagguguauuucugaguucaaggccagccuggucuacaaagugaguuccaggacagccagggcuauacagagaaacccugucucgaaaaaacaaaacaacaacaaacaccaaagaauuaaaggcucugcuuggcacaugaacuaauaucacagcuugggaggcaaaggcugguggaucugagaguuccaggccagccaagguuacauagugaggcuucuguaagccugcagucaggcuuaagcucggucuguggaacacugcaucuaggcuauggugacuucuauugucuuaaugguugugucgauauuagccuuaacucucagaggcaauaguuuccagauuucacagaagggggaccuuacugugugaggaaauuugaguuuaucuaaagguaaacacuacugagaagcaaaaaaugaaacuaggccaaguaaggaguccagauggugaccaacgucacugcuacaauuggucuuagaaggggcaugacccuucuaguuuccaguuucucaccgauuuauagcagccugccugaaacagcguuucucaaccuguaggucgcgacccccgccugccucucuuacagggguugccuaagaccaugggaaauaucagguauuuacauuacgauuuacaacaauagcaaaauuacaguuaugaaguagcaacaauaauuuucauaugguuuaacgcagugagugccgagcuagccacuguauuaaagaauaacagaauuuguaaggauuguuuacccccuaugacucugcuacuuuaaaaaaaaauccucugcugguccuuccaagauaacuagaaauugcaccccuugcaauuuugagaacugcucccauaaacccuuuaucacuuuucuuggaccaugcuuucaguacacagaagacuuucagagaggguacuuuagcucucugccuuucaagguaccuagaaacccuguaaccacggucgcuuugguguguauagcugcuaucuccaggaugucuagcaggaugucaguggucacuucaccgcuaacuucugaucugagaagggauguaguggaagcacugggugugacuaccuugcucaggccgaacucguccucuucaucugagggaaugccguaguugccgaugagaggauacguuagcacuaggaucugagcuuuguaggaagggucagugagggccucuggguagccgaccaugccggucugaaacacugaagaaagacagggcugaguucaggcaagggcacccaucggaacacugccccgagagcagcaaaucccggaggagaugacugccuucggucgugaguggagaaagagagcuggggcuggagguaucgacucgggaagaggagugugcaggcgggguggacagguuaaguagaguggggucggcagcccgcccgggcuugcuuacccacuuccccagcagucgacacagcggccccaaagggccggcccugcagcaccgacccguccuccaacaccagggccgccaucgggucggagcugagacagggcaagcacgcagacgcgggaggcgcggcgagccccacuggaaccaagcgaacaccgcgcgccggaguugguccacguggcucgcugcgcggggcgcuggagagcaggcgggagcggcaagccagagcccuaagcguagugagcugaagcacgacugcg

SEQ ID NO: 2399 - RNA, 6244 nt, Mus musculus
auuggacaaagcucuuuuuuauuauugacauuccuuagccuuuuucccagugaauagagagagguuugaugguuccugggcccugauaccacauaguaagaaagaaacaauaaagcgggauacagagaggaugcuaagccaacagcuucgagaggcuaaaugaggucuccuucauacagucugucccaucacauuucaugucuguguuaagaaauaagaucuaaggggaucacucugugugaaguaacaugagggacagaggcaguaagauuggagcauggacugcagccuguccacaggaccacggcuaauaauggguuuaaggauggagcugaaguucaagggucgccacaaacacaaguuucccaagcugucuuauaaaugggguguuggugccagugguguaggaaccagaagauggugagaccagucuuccaaagguguugcaaagaaaugaagcuggugcuaaaaguucuugguacacaguguuccaacgaaggaggacuaauuggugcaacagcuccugggaugggagccaccuuguuuggugaucaggauccuggugaacuuguuaguaagugcucaggggccuacuggacauugacccagguacccacuggagaaagcugcacccacucagcaaacagcugccaacacgucuugagagcgcauguggauaaagacaggaauggagucagagcuaaacagaaaagcagcuggaagguucuuuggggacaggcuuugugucacuguggagggcagagauguccuuacgaggaugggugucaucauagcuucugaagcagcagggauuucuuuuaagaacaggagucaaaucugggugaguguagagacagggcuacuuucuuccuucuucaauguauccagugggcugagugucggggacucuugcugggccagcaccuaaugguagaaacaguugggacuuuauuaggaguaaucaccaauagccaaaagcacauucccucuguguaggcagcugggguugaugcuaaaagaauacagauuuuccaauaaugacccaucugaaguacuaccuaugcuuuaaauauauaugcacacacauauaacauguauauaucauauguauaauauauguguauuauauguaauauacacgcauguguguguguaugagugcacacuccugugucacagcaugcgugcagagaucagaggacaaucuacaggagucaguucucugccuucaugugggucccagaggucuaacucagauagucuggcuugguggcaucaccuuuaccagcugagccaucucacuggccucucucauccuuuacccacugcuacuucuccauuuacauaccccauuccucuucacguuuccuuaauuauugucacgucuuaauccucugcuucaauaucuuguguuccugugguggaauuauagcaugcuuauguaaauauaaccaugcacacguuuuuuuuuguuuguuuuuguuuucaaucuacaaacccuuaccuugcaguuacucauuagcagcaccagauggcacuggugugacccucagccaacauagucuuuuuaaacuuuuaacuauguggggcagaaacaaucuaaaacaaugcauucugugcugggggcguguuggcacacgccuuuaaucccagcacuugggaggcagaggcaggcggauuucugaguucgaggccagccuggucuacagagugaguuccaggacagccagggcuacacagagaaacccugucucgaaaacaaaacaacaacaacaacaaaccaaaaacaaaaaaacaaaaaauaaagcaaugcauuccuccugcccgagucccccacccgucagcccgcagguugggaaugaacuccagggccuuucacgugcuaggcaaaugcucugcuccuagaucauccuucuauuugcaauaagcugcaccugcaaacuugccuucagcgauuuccuuugaaagacugugcuuccccaguuccuucauaggaaaagcccucgcuacacugaaaugucagucuguagcauaaggaacaucggcuaccuucuccgucucucuucaccuccaaugaaacacucaagacacucacauguugggguuaacugcucgguucacacgggucuuucucacagccccucucuccacucuaccuuaccauuccuuacugagaccugacccccaaucccugucucuguuccucacuugaucuugaaggcugagaagaaacauucauuuggcgauucucuuccucuuccucggcugauggauuaagucuaccacagcauaaacagcagcagcagcaacaacaacaaccagugagcaagcaacaaaggauaacaagugucuacaagagaggagagaagaggccuugguccccuguucuuuuuguaguuccaugcagaucccccucucucuguccucacaucuagaaagggaggacagacacaauugucuugagaggagggcagccuuccuuccuuacucuauagacacagacacuaucuuacuauauagcccaggcuacccauugccucccaagagcugggcucagaggucugugucaccacagcugggucaauuuuauuuuauauucugccuacauguauguugugcaucaugugcaagccugauagcugcagaagccagaaggcagcucuggauccccugggacuggagguauagauaguagugagcugucauguggguaaugggaucaaacccagguagguccucuaugggagcaguagaugcuccccaccugagucaucucucuagccccuccaauuccuuucuuaauaagaaguacaauguaccuugaaccaacaacuguucacuauaaaauagaaucggacaccuucuucaccaaaauggucauacagguauaauccuagugagccgugccggucauagaucuucuuuuuuguagggucggugaguauggcaugggcuguguugaucucuuugaagauuucugcugcuaaaggguuaucuggauucuugucuggaugauauugcaaggccaguuuccuauccagacaauagucaaaaggacaguggggagggcuacaggaagcaacugaggcaagaagauuaggaugaacugcaggucugggucuuuagauaaugcaagggauacaggagauggggauacaagaugcaggcaaggucuacauuucuucucaagucacacugaaggagggguggccuccuucggccccaagauaaaaucgucuugggauuuaaaaaaaaaggggggggacuuggggcuggagagauggcucagagguuaagagcacugacugcucuuccagagguucugaguucaauucccaacaaccacaugguggcucacaaccaucuguaaugggacccaauacccucuucugguguuucugaagacaaugaugguguacucagauauauaaaauaaauacauaaaucuuuaaaaauaaauagaguuugaagauguuaaagguagugggggguauagauaccaggggugaauaaagggcauugaaccuguaggcuuuuuugaugucugcagucucagcacccuucuucaguuccagcacugcauagaggcuuuucccaguucuagauagucgcuggguugcgucauacguaagaggcaugcucugagucaaaaggacaaaaauacaaguuuguucugacuugaaucacaagaauguagaagaacacaaaugucaaagccauacacauuucccauuguccggcauguagcucccaguagagcggccuagaaaggagagguaggucuaaaaugaggaacagucugucuacagcuccuguaccugaaguaaauagcccuacaccugaccaccugguggcugaguuugaaauaccagguaacccagccacuaaauagguuggaucagaagucaaagucacaacagucgcagagagaacuagccagaucaaagauggguucaggaccccaugagggccuagacucgcguuccucucagccucaagcccacagcacugagagcaggauggcucccuggacagaggggaggcgacaagaacuguugcgcuggacagccuagcaucuucuuuugacuccagaccuagcuuauuaccucagaauuguucuauaaaaccagguaggccugacacaagcuuccuucuucccgguagacgugaacuuucauauugccucugggcuauggaaacugcgcuugcgcacuuuguaggggacgcgaguuuuuuggcgccgccagcaggaccgagucgggagcccauauugggcccggaacuuuugucgcuccagaagccugacccucaggcucagggcugaucguuacuuccagcccccagggccgaaggcacagccuuccacaucaucucaucuccagggagaggccaugaccaucccgaucaccgucaugggucuucaacucacuaauggaaaaacuaugggcuuggugaccuagcagaugagagguaaggcaggaauuaccuuugcagacauccucagagucuucacuugguccuuuuuauuucccuuccauguagaaacuucucuacaaauguugaaacucaccucaaauaucaguguucuggaaaaaucugaccuuccccggucaguugucuccuguuaaggccuuuauggcauuagacuguaacaguuuguuggcaugucccuucaaagugauauuuuugauccuuuccaaaagucacucuucacuucugugcuuccauacuaaggagacaccauaauguaauuauauaaucuaggcuguauauugaguuguuuauaacuacuugaccauacauuaaccccuuucauugaaaagcuuauaacauccuugaacaaauuucugauuucugucuaaggguugcguagugggaaaggaguuauugaguuaaaaggaaaggaaaaauguaugugguguguguguguguguguguguguguguguguaugccuuuggugacuugcauguggagaucagagaugugaguauugguucucuccuuccuuuaugcaggucccagggauugaacucagguggccaugcuucgugacaggcaccuucacccaaugacccaucuaacuggcccugaauaugcauauuuuaaacuuucccaacucagcucuuucuuuucuuuucuuuucuuuucuuuucuuuucuuuucuuuucuuuucuuucuucucuuucuuucuuucuuucuauuuuauuuuuucuuuuuuuuuuuuuccgagucaggguuucucuguauagcccuggcuguccuggaacucacucuguagaccaggcuggccucaaacucagaaauccaccugccucugccuccuaagugcugggauuaaaggcgugcaccaccacgcccugcccaacucggcucuuuuaagauuuguuuauuuauugugcguggugcuuugccugaaugcauguauaccauguguaugcuuggugcuuugaagaagucauaagagagcaucagauucccuggaauugcaauuauaggggguuguaagucugugggugcugggaacugaaccuggguccucuuccaaagcaacaagcacagcugggcuucauggugcaugccuguggucccagcacuugggaggcagaggcuggcaucuacgcguguggcauuagccuggucuacauagugaguuccgagacagccagagcuacauagugagacccugucugagaaaaaaccaaaacaccaaaaacaagccaaaaaacaaacaaaaagaauggauaaagccaacucuuagaugucaaucuccuuucccccuuuagugaguucugaugacccaacacaggccuuuaggcuuucuuuacagcaaguguuucuacccacuguguuuguuaccuugcuggccccaaacugacuguuuuugaagcuauugguccauauuguuaacuuucuucucuuuuuuuuuuuuuuuuuuuuuuuuuuuuuuuuuuuuuggguuuuccagacaggguuucucuguguagcucuggcuguccuggaacucacuuuguagaccaggcuggccucgaacucagaaauccaccugccucugccucccaagggcuaggauuaaaggcaugugccaccaccgccuggcuauuguuaacuuucuuaccagagugguuccgaagguaccauuuuacauccccaccugccaacaugggaagggacacuugucucuaccuggccagacuucuugucauuccucacagggggcaguauuuguaauguugccuuccuuu

SEQ ID NO: 2400 - RNA, 5745 nt, Mus musculus
ugcugaauuggcaauggcaacuauuuaggccuuaccccuucugacaggggcagugagagggaaccaaagguaggcggcaaucaggcugaguuuaaugauggggagcugcucagaccauucacagaccucugcccacccuuugcccaggcccugaaaagccagaaacaacccauggagugcuggaguuccucaaaagccagaaacaacccauggaguguuagaguuccucuccgaggcaaguagccacagucucuuggacuuugugcaaaauacuaaaugcuaauuuggcaucaagggccagcucuaaaaaagagacagugaucuuuuguguagccagcccaggaaaagggaagguaugguuaggaggccccuggccaagaggaacaaggagaaguggggagggaauaggaagagacuccccuaacgugggagcauaggcacagggcaaguguguauaaaucuccucucagguagagggcagacauccaggcagcugagauuacagauccucaucuccaaugcccucgaaggcgaaauugccguggacggcacuggcacuggcaucugugcugggacugccaaucccccgcaagcucacagcacucaguuuacucuguaacagaggugggaggagggucagaggguggcagccugugaggcccuacagucaaccucaccaacccuguaacucacugagaguuucaccauggacucccggcuggcgucuggugacuccuggggggaaggaggcagaacgguuagauuuaggggcagcaggaaggcaaggcugagcugggagccaaggugcuagcugacauuaacuuacgagcaaugguggggacuucacugcuugcuggcugucugaacgucucagggugccccccacccgccggcgcagcaucugauacagagagaaaauucacuucagagcccaaccacuuccccuuccucccaagagaaacuuacuccuaggacaaaccaaaccgggagagcacagccacucagcuguucagucucugccgccgcuuaccuuccugauacugcccccagauuucuucaccaucagcucaucuaccauggacugcaggcagaugcucaucaugauagccuaagggcaagaaggugacucagucugaagagaagucauccccacccaggucuacaacacggacucccacuuggggaccugagggcuucauaagagcucugagggugggcucauaccugugggcuggugauggugacccacuguagccgguccuugcucaugagguauucaaaagccaguuccaggcgaaccucaccccgaccccggcuuggacugcucgugcccccacuagggaguggcaccuagaagaggaauaggggucaggcugaauucauguuggccauagugccacggaguuugcaccagccucaagaugugggaaaaaaaaagcccagucacaaaagaaagccaggugugcuaauuguagccacuggaaagcugaggugggagggucaugaguucaaagacaccuaggcuacacaguuccaggccaguacuagcauaacuagacgucucaaaaaaagaaagaaagaaagaaaagaaacucacagaggaggugacccgccagcaucgcauucggguaacacggaaagagccuucacggaguugcuggccugguagucgcagcuggagacugagcucacuguugccugcgcucaccacaacagggcaauccuucucuggaaagucagccacacaggcaucaaagcgcagauagccauagugccgcagaguuugggccagccgcaagaacugaaaaauguucaccaggugugguuaguuacaagacagggaguagcucagagcucguaacccuuacagggagacaaggcaaaaaccagcucaccuccuuuuuggagaccuucucuugcagagauuugagcugccggugcugcucuuuggugaccaggauccagccaugcucaaugucugacaccgucuacauacaguggagacaacgaauggaaaguuggggaucccaguuaguacuuccagugaagugaucaaagugagcucugagccgggcguggugguacacgccuuuaaucccagcacucaggaggcaaaggcaggcagaucuacagaucugaguucgaggccagccuggucuacaaagugaguuccaggacagccagggcuacacagagaaacccugucuagagaaaaaaagugagcucugcugucaucgugagcugagagcuaacugcagugaggccuugaccuuuucaguuuauagagucagugucaggagcucugaccaauauucuagggacuuccucaggaccugggaaccagucauggaguuuucuugggaaaguggaauaugagucaccacuucacggcaagaauucugagucagcuccaaacucaccugagcauaaagcagguucaggccaacccgguucuccaugacaucgucgucauaggcagagucccaauaacugugagguggaaaugggucacagggcuaagcaaaaguagaauggaaaaugggcaagcgaacaauugcaacucugggguaaucaaugguggagccgaacgagaagggugggaggugugaguacaacauccacugcgguucccucggcaaagcuacuucaguaugaggcccagccauccagcccacacccucuccugcuuuaaggcucugcccugaccucuuucugagcacaaucuuauacucuugacuccgaagacugguaacagaaacauaaggcaguucaaacuccugcagcuuccguacaacuacagauuaaaaaaggaaagugugaucagacuaaagaggaaggaaagccauggaccugcuuggaggaaaugucccauucucacagcaggaacucacugccugaagcgcaagcaguaaaggacagcgacacucacaagaaaaggcuccaucuucuuuuucucgaacaaggaagagacuaaaauauccgaucaagucaucuggaagauccagcuuugcagccacagccugggaacaggaaguacaacuuaaccaaccagcuauuuuagugcagagccuagugugcccugggcacuugggcugucuucaacaaccaccucaccuccaggacaucuucugucuggucagaaguuagcacaguuaccagaacuuucuguccauugcugagcagcacuuccaaggaaaccuccucugugggcaccuguugggucuccugugugaauaaaugagauggggggcacugccuuguuaaugcaggucuaggguccagcuuagaugcaucccauuuuccaaacucccuccgguaucauccuuaaauaaaggcuggccuuuucuugacuucagcgguacaguagaagguuuguuccauuaaaaaaaaaaaaaaaaaaaaaaaggugccaggaaauacccguguaauuaaaaugacaugaucccccaucaggucccucucuuaaauauggguucuacccaaagccuuaccuguugggcccgacguagaaagcuauuaaaagucucacugcucccaagcaaugggucuugccgaacuguggagucaagagaacaauauucuaguaacuuaagacucacuguaggcuucccccgcccaaguccucuuaguaggucccccaaccccauuuccugggcugacgguggccugccacacccccagcuggccucaccucacacacuguuugcauaaauucuucaccugccccacccuuggcugccaucuaguugaguccagucuacagaacuagggaaauaacaaugauguuaaucugaagcacaugagauacaaaguucuccccacaaauuccucguaauucuacuauuguacuaguauuucucacagagauaaguuuccacauuucuuuacuaauauggaaaguuuaaaguccgugauggcuauucgcuuugcugguuaaguaacaucagaccagagacuuccuaaaucuaaccauuaagauggggcguuugacagagccaccugacuucaaucucuccccgugcgcucacagcagccuagaguuuacccgugcacucaccagcuugcauguacuucuccaacugcucucuccucugcuccaccucugcaggggucaaagagaacagcuucuuuggggggaaugcaggaaccacguuggccccauacuccuuccgaagcuauggcgagaaagagauacaauucuucacauaacacaggaacugaguggugacaacuaagacucacccaaguccuccuggguucuucuaacaacucuuuaaaagacgugugacaaaagaugacuuuggcagagucaggacccccaaagaucuuagguauaaauucuuguauguguucaugugaagacauuauagggugauuuuucaugggguccuggguccaggagcccuuugauuuacauagcaagacugcucaguagagaacauuuauagggaacacuuaugugcacagauaauaaagucauagcauacucaaguguguugaagggacuuugcugauccaagaaucuacuuuuuaucuggagaaacugaggcgggaagaaauuaacuugcucaggacugacaucuaguagaaacagggcucucuagagauucacuaucuauacagagcucacuaucuggugaggggggaaacauuuggacaucuuauacacugaugggaccaagaacacacaaggaaagcagcgaaugguuuguauuaauccggggaaugaauucccaaguuauaguuuaggugccagaaggaaugugcuuugacuaacaggguucaguuuuuccaugcaggggcaaaggaugaaaaaggagacagcucagagaaggaaggaugugugaguauagggaaguacaggaacugugagagacaagccgcucagagaguuuccggaaaugucacgcuaacaaaguccaccuuccacuguagcagugauuauagggugauguaaugaaaggggauuaauguccguggguauggaagggcuugaagcugcaucuagacaggguuguuagucccaccugcucgugcagccccagaagcuggcuguagcgcacccgacagugcaggacuccauucacgugaauguuauaggccugaggacacaaaagcaggcaaacaucucaggaucgacgugcaaaccaccucuugccccagaaaccuguccggaaguugccugacauauccgucugcgcaacgcuccgagacuucccgggauuuagccuguuuuucccccagggccggguuucaagcagaaggcccagucccgaggacacucgggcgcuugugcggcaguaucccucccggagaugacaauagugcccaccgccagagcagucgcggccuggccggggaaagaagaaccuauuggagcuugggguggcuuaaguacgaaacugagacaugagauggcuuccagugagguucgaaggcuggaggccgcuccgagagcuccggcccguuauccccgcccuggcccagcuucuagcaccuccucaccacguaggcggagccgccgcuguccccacugcgggacuccguuucaggaauggaaaagugcauguucccuaaggcagagcuccguacuaccagguucgcagcgccucugcucgcuugccucugccacucagcgcgucuccgcagcccagcucgccauuuuggugggccugaacuccgaggugggaaggcuguaggaugacggcucugcgagcagcaaccucggcaugcugggagcuguag

SEQ ID NO: 2401 - RNA, 18367 nt, Mus musculus
gaugcguaguucaugggcuguacaaccggagcgcagucgcagcaugaccaggaagugauugugaugcgcugcuagccaaccaaucagaagcuggacgcguaacccaaccagccaaccaggaaggugguacccugcccccuccauauacgaacuaggaagucgugccugaaggcgaacagcgcaggauggccuccagcgggcugcuuacucaggaguuaagacucccagcuccugcuccacauucacugcccccucuccagaggcucgggacacacacaagcaugcagcaacagccgcccaccacauauggggccaggguaggagaguaaagcaggacacuaugagcacgauuagcuuuuguuuggccuuuagucugaaaaaguguugcuugaaaguguacaacagagagcgggugcaagcggcuaggggucacagagccgccaauaaaaaagaauguccuuaaauaaaguguucacagaguaaaaaucagaacuaccaguccuucccuccaacacaacagagcacaggcacagaaccgauagucgaugagcccaaggagaguaaggaggcuuaagaggacagcagagccucccaggcugccgcgugggggggguggggggcccucuuuguaaugggcugaggaaagccacccagcccccugcacaccucauacccacugcuaaggcuaaaggacaaggacaaaacucagucucggguccaagggcucagaaaacaguccacaugggcaggguccgguugaccacuagucccucuuggccuucuuuuugucacuguugccggugucuucagcccccuccguggacagugccuccuccaguuuccucuugccacucucugccugaagcucuacuguguuucggggcuugaagcaaaugaugaugcacgucauguugucacacccuguaccauccccagaagugucuggcgccaggcacugauccagcagcuacaaaaagguuaaggcaguuuagccaugggguuugaaccaaaguaccacaagaaggcuuguccuugcuaauacaagaaggcaggacagaaggaaugggcaaguuaucacaaagaagaaaccugugaauuucugaggcccaaggcuacaucagggaaaugaggaaagagccaccuuuuuaaucaaagucaucuaguguguacagugauucuacucccagccucugcucacaucucaagagaugugucuguguaaaccaggcgccugccucccaacuuuagacucaccucuuccacaauggaugacaauaaccgaagcuccccguuuucaucacguugacugaucuuugauugaauaaagucuacaaccuccuggcugcucaucacauuccugggucaaaaaaugacaaucaaucuuuaauccuaccaaagagaggcagguaggcaucaguacugacgcaggccaauuucaacaccccuguaaaugcuccucggcuuggccuggggcuuagugcgcguuuucaaaacauuuuuaaaaauaauuaucuauuuuaaguaaaugaguacacaguagcuaucuucagacacuccagaagagugcaucagaucucauuacagaugguugugagccaccaugugggugcuggaaauugaacucaggaccucuggaagagcagucagugcucuuaagagaugagcaagguugcacaaggguguuuaagggcauuucuuucaccagugcucaccagaugccgucacaagcaaugaccaugaauucauggucaucagugagagucagcaccuugaugucaggaagggcagaaaucaucuguuccugggguggcaaguuuuuguuucucuuguagaaguggucuccugaaaaguaaggacggugaguaguuugacuaauucccagacuuguauuagaggugggucaaaucuuuaaguuucaucuuuucuaguuucagaucugcucucagaacaaagagcucauuugccucuuuuaacauccagaacacagggaaaaguauaacuuuaccauuuuacagagguauuuaagaacaaagaaggcaugagcuuauucugaagagcacagggcuuaaacuuugcuauugguaguuugggacacaggacaaaaccccaagauugccuaguuucuuaguccuuaccaauggcccuggagagguugaggccuccauugacucguccauccauggugaccuugccaccagcauucuugaugcgugccagcuccacuucauccucugguuuguggucauaggacauaucuaaagcuuugccagccucggacaccacacagcgagagucuccugcauuggccacaaucaacugcuucccucugaucagagccaccaccgcuguugugccacugucagaaccaggcuuaaaaggaacaagcagagccuuguggaagcuccucgguaggagugcaccccucugacccaacuaucuauaugagagcuuuaacaaucaauaggaagagcuguccagagagacagcagcaugcuccuguacccuuuccaaggcaaaccuauucagacuacccuuaagaguuccuacuguagaauuaauucuccugaugaugaauuaaagacuaaaacaccaaggggauauacuuccaaauaucaaaacucacgagacuuauaccagucccuuguccuuuccaaagucacucauucccucccccacacaccucuucuuugccuuccauuccagggaccaucaucucuucaucaucauccucuucagccuccuccgugucauccucgucuuccucguucucugccuccucacugcuguagccguccucguccucacuacauuccuaccaggaagauuccaagcuacugagacuggguauugagacuccccagugcccaccuuccccaacguauacucaaagauauaaccagucucaguaucaugaaaaucugaggcaagggacaggcuaggaaacgcaugacaaacuggcauucugaacugggcucagauaucaucagcaaagauguuugggcaauuuucccuggggaagaucaaaccagccagucaaaacaccuuccagagaauaaauuguuggaaaaaggagaaacccaaauaucucaaguaauaaaaccaccuuccuguucucuaggagucagauccugaaaggccagaacuaaaucacccuguugugcuagagagauggcucaaagggucgagucuggugacccaucccugagguucaauccucaggacucacgugggagaaagagaaaguuauuccucucaagauguccucgcuccuccacaagcaugcccuggcauucagguauacacacacacaacacaaaauaaaauacauguuuauuuuuaaauauuaaagaaaagccauuuuucuugaauauaaaaucaacaaaagaaaagguaaggguuaaaggaacuuguaauggcagagacaauguacucaaaggcuauaaccucgaauaccugagucuuggaaaaugauuuaagguauaagaaagagggggugagauggucaauuaggcgcuagcuguuaagcccaauaacccaggccucaccugaaggaaguagggaacuggcucaugcacuuuauauauccucugaccucaacaaacaagccaugacacuauacacgaacacacacacacacucucacgaaauauaacaaaaacuuuaaaguaccaaagagacccucacagcacccucagucccgucugcccucauagcccuuaccucacugucauccuccucuuccuccaccucaucugauucaucuucacuguccucaaagaacuuggacuuagcaacucgaggcagcuugucagaggcugaagagcaggaagguccagccucaccgguagcaguaccgggcucacuaauuuggccugccucagucccauguuccgaguuggaggaaaagccuguguggccuuuggcuguggggccauuuuccugggaaggaguuucccuagauggguccucagguccagccuccccauugaggcccuggggcccugguucaucgccugucccaauuccagauuugguguggggagggaccuucugacaguucugcccauaucgcgucagcagcucuucaauagucaugguagccucuucaugcaacaaugcagccuccucauuguccacugcagagaaagacuacaucagaaccccaucccagauuccucacagaucagccccuuuggauaacucuugugacccgaggcuuccucauuaccuucuaccucugaggcuccucacuauucgagucugagaaaaacugucccuugcuucuuccucgguagacuuuuccugaucuuuuauuccuuucuuagucagaagaacaacagucauacuuccccauuguaccucuccuuuauauuaaguugaaacuuuuacucugacugaggcccagaaagaagcccauauaauagcuuaggagaagggcuaaguuguaaucuauggcuaucaagcauaaugacugccucagcccugaagaaaaacucagcacauacauaacaacaggaaccaggaaagguuacuucucuuuaucgugacauuuuauauauauaugcauauauauacauauauauauaugcauauauauauguauauauuuauacacacacacaauguagguauaaguuuuuuuuuguuuuguuuuuaaaguuuuucaagauaggguuugucuguguagcccuagcuguccuagaacuuacucuauagaccaggcugguguugcacucagagaucugccugccucugcuccccuuauagcccauauaagguuguuuucuuauuuuauuuuuuacauccagacugaaguuugcccuccccccucuccccccaguaccucuccccauauccacuccuucuaauucucuucagaaaagggcgggcauuccaaggcuaucaaccaaacaaacauggcauaucuaguugcaauaagacuaggcaccuccccucuuauuaaggcuggacaaggcaacucgguaugaagaaaggggucccaaaagucagcaagagucaagagacagccccugcucccacuuuuagaaaucccacaagacuaaggaacucaaucauaacauauaugcagggggccuaggucaguccuaugcagacucccugauuguugguucagucucugugggcucccauaagccaguuuaguugauucuugugguguccuuucaugaagccaucauuucuuggaacugauaaccaacugcucauuucuuucuaacacacucaccaucauccucaucugcuacuuugucuuuaucauccucaucuucagugggucucccugcaaucugggccaguuccuuaaugacuuccucuguggucagcuuggcaucaauagccaagaaggcaucuuguaaagccugaauguaagcaaaguaguauaagacaacuacaguggauacaaaccaacuacccaauacacccagcuguaggcacacaaugggaaugcacauucaugggggucaaucauaacaagacacacagauagauaaaguaagagaacaagguaagucuaaaaauacccaagugggaagaagccucuuugggguuugaggcauagaacucuuuaagaggaaauacaauagauaagcaauagcuagagugcaaagagaagcuaaagguuggaaaaccagggagaacccuccaaguggagaauuaacaguguagaaagacagaccuucugaagcuugccuuccuuguaggccuucugaucuuugauaauaucaggaagauauuuggcacaguacaaggcaaccucuuccccuaaaagaaagguuuuauuaacaaaauaguguguccucacacaaggacacaggugaugaacaccguagcacaccugagaccuagcuacagaacaacagcagagugugacacccugaaaacauuucccuagcacuccucugaguacauuaauaaaguccuugacauuuucuuauccauuauacuuaguucaaucauggaaaguggaagaacaaagaaucccuuucuugcccaucaguacgucugagauaggggucuuacacuacuaccaauaugaucuccuaaaguuaccuccauguccaucguagacagaaaacauggcugucucauuguccagcucaggaauacaguugugagcauccuagaagaaagaacauaauucagaaugucucaucaaguucaaacacuauuucuccuguauuucaggacacaagguacuuucauaucuuuguagcauaacccuucucugacaggccagacguggacuauagcugcuuagcaaaccuagaccugacccuuuggagcuucagaaagacucaaugcagacucuuuuguucuguuuguuguuguuuuaaaagaggguucucuggguagcccuggcuauccuagaauuuacuuuguagaccagguugcccuugauuguacagagaucugccugccuuugccuucugagugcugggauuaaaggcgugcaccaccacccagccuagaauucagucucuuuaaaguuacuucugagcccaaaugauggcucagaguuaaggugcuugcugacaacccuaucugcuuaaguuugauccccaguagaaggaaagaacaaauuccuacauggugcccuaugaccauacguuauuauggcacaugaagacccuuccuccaaacaaaauaaguaaauauaugugauaaaagauaaagcuauuggcugggugugguggagcacgacuuuaaucccagcauuuaggaggcagaggcaggcgaauuucuugaguucgaggcuagccuggucuacuggucuacagcgugaguuccaggacagccaggacuacacagagaaacccugucuggagaaaaccaaaauacacacacacacacaccaaaaaaaaaaaaaaaaaaaaaaaaaaaaagauaaagcuauuucuaaauccaucucugaauaaauagugaauaaauauuuucaagaaagaaaauacaagaguauagcaagagaaccuccuuaggaccucacaaaccugaaaaauaaagagacuccuacagaagacuuuaacaguaccagacaauacugcacuaaacauacuugcuauccucagcuuagagaaauuagguuuacaagggaauucucuuuacaacaaauucaauuccaauggcacagcacaucugaaaggaaguuggaaaaggcccugaccacacuaacauuuuuucauuaaaaaguuugacuguauucuucuaacaaauuucuaaugccucaaacuaauguugcaaaguagggcaaaguucaagcaaacccguuaagucuuugguagaugugugcugcagcuuacucuaccauaccccggagacaauccaaacucccuucagauacucuucagacagagggcuaaaugcuaaucaacgcuguacuuugguuacuuaccuugcagggguuaauuucaauaauaauuuuccuuucucuuucagguaucagcauuuaaaacuuuauaucaauauugagaauaucugaauguaguaaucauucuauuggaacugaacuaagucuauggaauaguucuuggguaagaaaauaaaucauaaggcagggaagaaagacaucaaaaaaggauuuuuacccgcuucccggaaacaaacagaauaucuuuugucuccucuccaggaccuaguuaguuaccacaggcuaaaggccucuuccaacaagccuguguuuaucuuccuagaccuuccuacucucuguuuguuuguuuguuugagcuuuucuagccaagguuucucuguauagcucuggcuguccugaaaugccacucuguagacuagccuguccucauacucagagagccacuugccucugcaagggaguuuugggauuaaagguguggaucaccaugacugcuuuguuuguuuuugagacaggaucccgauauguggcuauccccaaacucaaugauucuccucucucaucccuguaaguguugggaucacagaauaaaucacuauacuuagccuuuuccaaauacuuuuuuuuuuuuuaucauuugcuauguagauauucugcucugaaaguuggcacuuuuuucucacuuuucuuuucuuucuuucuucuucuuuuuuuuuuuuuuucgaguuuuuuuuucucggguuucucuguguagcccuggcuguccuagaacucauuuuguagaccaggcugugcucgaacucagaaaucgccugccucugccuccugagugcugggauuaaaggcgugcgccaccacgcccggcuguucuuaaccucuuaaaucaucuuacuucuuccuguggaauuguaacugucccugccacacuaauagcggucccuccucaccuuccuagcugccauucaccuauuagagggcugcucaauuaucccugguagcuuucaccacauuguuccugccuuacuuuguuuuaaggcacucagccacccuuacacccgagcauaacccaaucucuaauucuaaagcuauuuuccaacuacuccacuuuuaacacacaugcugcuucugcuaccuagcaaagaauguacauacacaaucuuuucuccuauccuucuucauaauacuccucccuauacucacuagucuugucuguuauacucuacaucucaaugacucuaagaggccuuucccaacuacaccagugcucuaauccugcagucuuucuugccuuuaccaaugauuggacacugaacagauacuaccucacauugucauacaauguuccgugagaaagagaaguccuaugaccaaagccagauuuuaaaccagcaugcaaaagcaaagaagacugucuugaguucccuuacugcucuggggucuaaugcuaccacaguauagcagaucccccaugucugcuuaggauggugcuaugguuugcugcccacagguguauguauaugcucuagaggccaggcacccagcaugguaguguugaaguaagaccuaguagaagggauuuagguagcgguuccaaccucauaaacagaguaaaguuggcuuuccagaaugggucaagucugguaggguauauuacuuccacgagaccgcuuaucaugaagagagagacagaaagccugagucaccucuagucccuugcuuccuacgucuuaacaacaaaucauuucuuccacauguacuccuaacauuugcuacaugguucucaacagaguggagcaaaucaugcuuggaccuccgaauuugugagcugaaaacuuuucuuuauaaaguacacgcuuucagguauuuugucacagcaaugcaagacagauuaauaaagacgaaguauucccaaaugucucaggauaacuaccuuaaagauaucuucuucacuuacugcaugacacccagaaauauaauuauugugauguuuagaagagaugacacagaauacacacaacaugagucaccugagaaaggccuuggucuuacuaagucauauauccaacagcccuuuugacauucuaaacaacagguucauccacauugauaaaggguuaauuaguucucuucugaugcucaucuccugacagcuguucugguuucaaaucaaccauuuacauuuaugauauauacauuuaccuaaauccuuguuaagucaagauaaaagauucaauggcaguuaggaagggaauuaauuaucuuucuaauuuaaaaaagccaccuguggugguauaugcuauauaauuccagaauaugggaaguaaaucuggagaaucaacaauuaaaagauuaguugggcauugguagcgcaugccuuuaaucccagcacuugggaggcagaucucugugaauuugaggccagccuugucuacagagugaguucugagacagccagagcuacacagaaaaauccugucugaaaaaaaccaaaaaccaaaccaaaccaaaaauaaaaaaauauaacauccucaacuauacaaugaguuugagacuagccuagacaacaccagacccugccucaaauuaccaaacaaaaggaccagugauagggcuuagcaagaugccugcuaucaaaccugauguucaguccauggguuccacacaagggggaaggagagaacugacacccacaaguuauccucugaccuuuauaugugcacuaugguaugugaauggcucucccaacacacacauaagaaauaaauguaauaauaaacaaaccaaauagccuuaaaagauaauguaauaucauauaauuuuaaaaauuagguacauucaggcugagagauggcucaguugguaaaaugccuaccaugcaauuaaguucugauucccagcacccagauaaaagccagauagugcugggcuacaugagacccugucucagaaaacaaaauggcuggacagcagcauacaucugugauccuauaucccugggugugggaaugggaggcagggacagguagaccucuggagcucaucagugacaucucaaaaacuacgaugacagagauucaagaagacacaggaaaccaccugaugccaauuucugguugcuacucaagcacaugccccauggacacaaccacuuaaguaaguagguauggcacacacaacacauacaucauaugcauguauuucuugaagaauaaaaauuaagucaggcaugguugguauauaccuguaaccucagcaguugggaggcagagacacaaagagaggccaauacaaguagauuauucuaggccauuuaaagcuacaauagugagauccugccuuaauuccucuaccaucaaaagaagaaggaaggagaaggaagaggaggaagaggaaaaaguaguaagcagcagcagcagcagcagcagcauagaacagugguugucauauagaccauagaauaguggucgucagggacugaagaaauguucugggaguagaguucuagcuuuccaaaaugaagagugcugaaaauuagcuacacggcaugaauauacugaauacuacaaaacugcguuuucauuuuaaaauaggguuuuguguagcaugggggaaccuugaacuccuuccugucccuaccucccaaacacuggcauuacagacagacuaucacauucagcuuuaaacuguuguaccugagagguuaacaccagauguaaauuuuauguguaacaauuaaaaccuuagccaggaguagaagcauauauuauuacaaucccaggauuugggaggcaugcaaagcaugaauacugcuguuagaggccaacuugggccaaccagugaggacugucucaaaaagaccugaaaacaauuaaaacaacaacaaaaccucacaaguuaccacacuaagucuaaguuaagaugguuucauuggugaauucucccaacagaaacauuaauaaaauugauccuauuaguuaacauaaguaaucuagagaugauuuaaauacuaugggaagguuuaaaugaauuauauauaaauauaacacuauuauuauuaacaaaaauuuagguuuuuuuuuaagauuuauuuuauuauuauaucuaaguacacuguagcugucuucagacacaccagaagagggcgucagauuucauuacggaugguugugagccaccaugugguugcugggauuugaacucaggaccuucggaagagcagucugugcucuuagccacugagccaucucuccagcccaauaauuuaguuuuugagacauaauauagccuuugcuagccugggcagugguggugcacaccuuuaaucccaucacucgggagacaggcauguggauuucugaguucaaggccaaccuggacagccagggcuauaccgagaaacccugucucggaaaaaaacaaaacaaaaccaaaaaaaaaaaaaacauaccuuccuaauuucauauaaaggacuugauaaucuuaucaacagggugacgugaaucuuuguggauuccaagagacacuuguacuaauucuucacaaacagauaaagaggcaauauuucuaacucauuauaugaggaccuauuauccuuauacuaaaaccaaacaaacuagucacuugguggugguacauguuauuaaucuuggcacucagaaggcagagguaggugaaucucucugugaguucaaagcuggccugaucuacaaauugaguuccaagacugccagggcucuguagaaaaauccugucuccaaaaacaaaaacaaacaaaaaacaaaacaacaacaacaacaacaaaacucaacagaauaguagccaacaaaauccagcaacacuccaaaagggcuacuuauacuuaaugaccccuccccaaaaaauaaaaaaucauaugcugaauauagcuagacuuagcauucaaaauuaguggcauaugccaaagccacaugguuagcuuaauagguuuaaaaacaaauaaaagcauuugacagggguggaaagauaacucagccauuacgaucacuuacugcucuaccaggacccaaguucaaguccucgcacccacacacauuaggcagcuuacaaguaucuacaaacccuccuggacucaauucugugggcaacugcacaucaaaagacacaaaauaaaauccuuauguuaaaaaaugacaguacuuaacaaagucuaggacagacacaagcaaauuagggggaaagaaccuccucauucaugcugauaagagcugaucuguaagggacggagacacagcucaguggcaguaaguauucucccaauaccaaacacuucaguggccacagguuuuuccuuacacaccgggcaguggacagaaaguuccugaaacuccucuauguucaauuaguuugcuaguacaaaucacuaaauucaggaaaauauuuauagugaauccagggcugggcaucacugaacuuccucaaucgacaguuuucaugcccucuggugaucacauuuuucaagaaucuccauacauucuauuguaagcccccagaacuccuuugguguuauauaggcacugauuaaucaaauuauuggccauuaacagaucagccccucuacuguucuggagguuaaggaugugugcugaaaagcccuaaccaucaacugcacaucacuuuuucuucugacaaacccucauccuagagauacaggagcuaccagcuaucacccaguccauuagcacauaaaaagacaccacuuugaugaauucaaggauuuuaauaugacagaaaauaugggaaauaggcaaauauacauuuccuaauaucacucauagcaauuccauucuuagguauauacccaagauauauuuccacacaaaaaguuguauacauauguaggcaaaugugcagaucuuaacaucuauuagcaaugaagaaacaaaauuaagagaaaccuuauucaguuauuaaaaagccauggaaugaaucagaauacaucaaugccaguuuaaaaauauaacauauaggaagcuggaagagauagcucacugguuaaaagcauugguuauucuugccgaaccaaaaccuggauuugguucccagcaccaacacgaccucccagugacucaacuaucuguaacuccaguuccagaggauccaacacucuucuggcuucuauaggcaucagacaguccuaugaggaguucaaggucaucuucaguaaguuugagguuauauaagaccauuucaaucaaaacaaaucaucuugagaguuuucuauucaacaugauauucaagucaagauguucuuguaaaaaaauuuaagauguguuuuuauuuuauguguaugggcauuuugccugaauuaucugugcaucacauguguagcugguauccaggcaggccugaaagaggccuggagaagguguaagauccccugaaacuggauuuacagaaggcaguuguuagcccccauaccgggguccuuuggaagagcaucaaguugcucuuaucugcugagacaucaucuauucaguccuucaauaaucuuucaugaugaccacucaaaguuagauucaaaacauaucaauaccaaauagggucuggugauccaaaccuguaauccuaacacucaggaggcagagauaggaggauaccugcaaguuccagaacagacagggcuacauaauaaauuccuguuuccuacccucagcuucucaaaaaggcugcagaaauaacaggaauaaguaaaggcaguugccaccaagucugggcgaccugcgcucaauccuaggaccuccaugguaggaacagaaaugaaauuuccacaagcuguccuuugaacucaugugugcuauaacacacgcauauccacauacaaacaaugcuuaaaaaaaaaauacagagaguuuuuaaaaggaggaaaguaguggagagagacggcucagcaguuaagagcacuggcugcucuuccagagguccugaguucaaaucccagcaacuacauggaggcucacaaccaucuauaaagggaucugaugcccucuucuggcauccagguauacaugcagaaagagcacucauuaaaaaaaaaacaaaaaaacgccgggcuugguggcgcacgccuuuaaucccagcacucagaaggcagaggcagguagaauucugaguucaaggccagccuggucuacaaagugaguuccaggacagccagggcuauacagagaaacccugucucgaaaaacaaaaagacaaaaaaaaaacaaaaaacaaaaaaacccacaaaccuuuaaucccagcacucgggaggcagaggcaggaggauuucugaguucgaggccagccuggucuacaaagugaguuccaggacagccaggacuauacagagaaacccugucucaaaaaaccaaaaaaagagagagagagagagagagagagagauggcucagugguuaagagcaaugacugcucuuccagagguccugaguucaauucccagcaaccacaugguggcucacaaccaucuguaaugggacuaaugcccucuucuggugugucugaagacugcuacaguguauucauauacauuaaauaaauaguauuucuuuaaaaaguuaaaaaaauaaagaggaguauuuauugaauuuuuguaacaucccaacucuccacaaaacuguuuucuuucagaggagccucaacaauccuuuuccuuucaacaguacauugcguucaaacuggacuucucaccagccaccaaaaccucacaauuuuuguuuguuucucagcaccuccuccuccuuuuaacuccauaggauagcucaacaagcuggagaaucccuccaaaucacaaagaaggggguguaucacuacagcauuuugacacccucuccacuuccucccccaaauucuaguucuacagcaagaggguuggagagacugagacagaagguaugaaaugccagcuuuuggugacuaccacccacccuugguucaagagagagacuaaaacaggcuuaaagcugugucagacuuuuacuaacuucuguaagguaaaccaauacaacuuaucugaacccagucuuuagaaucaagccaacaaugugaaugggcuucauuaauugguggaauuaagucuauuccuuaggaaaagaggaaccaagacauagcauaacucuuuccccaccuuuuuggccuauugaacuauauacacucuuagaucaagaucuuauuuucugaaagauucuucuaagagacuaaaaacuuuagugucuuucuuaaaauagcaaagauacuauguaauacuuugagggaggacacaaaccuagaaagaaaguaucuaugcagcagaaagggaucuuaacuagcacuucaagauuaggcauauuuacucaaacaaaaguaaauccaggaauagcacagcaggagcuguaaugcucaaacauugccuuuagagugaagauuauggucucaagaacaguugagcaaaauucuucauaccaaacagcccuaaacucaaaaugaaguagauuuuuaaucuccaauggaggaaccaaaacacagugggaaaugcuuagcagagaaguaaaaucacagaauuccuagaucuaaaaacacucagcucaauucauaaaaaaacuagaaagagugcccccaaaaguggaaaaaccauuucauuccacggaaauuaaaaaacaagaaacuugaaaagucuaugagaugagaauaaaagaaccccauagccuaacccaaacaccagccagacuaacuuuauggcuuuucuuccaccaccacccuccccaacccccacugcacuugaaagaacuaguuaucagcagaggccagaagagggcaccggauucaaccacggguuuuuuuuuuuuuucuuccgagacaggguuucucuguagccuuggcuguccuggaacucacucuguagaccaggcuggccucgaacuuggcuguccuggaacucacucuguagaccaggcuggccucgaacucagaaauccgccugccucugccucccaagugcugggauuaaaggugugcaccaccacgcccggcuuuuuuuuuuuuuuuuuuuuuuuuugaaccacagguuguuggaaccuccuugacaugggugggcacugagaaucacacucugguccccuguaagaacagcaaguugcacuuagccacccccaaggcuuuccuucugaagcuauacuauacccagguaucucuaacuuuacccagucauuacuacagcaugccacugagaaauaugaaagcugugcuucaucuugacaccuauauaagaacagcuccuauugucuugaacaccuuaauacaauucuuuguaucaagguacaaguacccuaaucuuucuaggccucaauuuccaagccauuaaaugugggcacugagccaaaugaauaggacccucuccuugcugaaauuauuuaucuagauucugcuggaucuagauaaugcuagagccauaaucaaaagcuggugaaaauagcuuuugagucugagaacaaaccauuuagguucacacugucauuccagagcuaaccacagggaggagcgagggaauuugagagaaaaaaaaaaaaaaaaaaaaaaaaaaaacaccaagggaaacuauuuggcuguuaccuguagcccaccuacuaacuggauaaacccucgauuccagacauaauuagaacuuuucacuagucccuuagacuucacacaaaauugcucaaagacaccuauucccuguucauuguaguuucacauccauuugcucaacacugucaauccaaaugauugcuuucccuuucauccaaaguggacuuuucuuuucuuuuuaaaaguuauucguagauggugacaaaaaaggauugaugacaagacugaaaaucgaguauacuaaauuauaugcagaggaaaaugacaacucaguaaguuuuaaagaaaucgaguaagaaaaaaaauuacaagcauauuucaaaaaauaaaaaauaaaagcaagccuagugacagacacgauuccuuuccuaaagaucauaaaagauuucgaaaagaauacgaacgagugacaauucucgaaggucaagcggggcuucugaaauuaacaugaggugucuaaggcuaaaagcaacugaggguuaagaauggaaagcacauuauuacccgggcuccuuuucgccaucaaguuuguagccccaagaggccugccacauuacauauuucaagaauaaaaacgaaccagucauucacaucuauucgaccaauaagcgaacaaauaacgagucuucccucuucccucugacaaccccaugccgcuggaaaagcuggagggcugggcuggcaccagaggauggcgcgaagguacggagagacggcggccaguaggcggaaggugccucuucucacauggcagggcucccgcagccacuagccaucaggccgcgguccccaagcucuagccgcucccucuccgcccggaucccgcgcucgccgccgccucccgcaccguggcugcaggcucucgucagggaccccugcuugaggagaaccccaucccccucgcucccuuucucugucagguuccugccaugcaguggccagccgcuggggcccugucucaccuccauggagacgcgccagccuugcauggcggagaagccguagggcagcgggagccgcggggcgccaaccccguccccggagcacuucaccguguugggcugagagagguaggcacccauggcggcggauggcuggcuaccugaggaacagguaagcgggacgcgacccuugccggcgccggagccggggccccugggggcgcgcguggcaaggagcgggcccggcugcgcagucgacgcaaggugccggcgaaaggcgcgaggccggcuaggaggcgguaacgggacaggagcggggagagggcggaagcggaaaccgcgcugcuccaggccccgcccuacuggcgcggugagccgcugcgggcggucauuuccuuagcaa

SEQ ID NO: 2402 - RNA, 876 nt, Mus musculus
caggcccucgggcccgggcccccgccccgcccccgcccgcgccgccugccccgccucucgcggccagaguuccaagagaacgccggggccccccgacccgcgcccgcagaauuccgggccgccgcggccacgccggagacaccaggagggcgggcggcgcccuggggccaagguggccccucagcugcgacgggccgggcuaggucgggccugacucccgagaaagcagggccgcccgacagcacccgccggccgcguccugccggcccgcggcucggggucauccugccgcccuuccgcgagccccucccuccagggccucuuucuccggagcucaccucccgacuccgcgcccgcagccugcgcuucagcuccagcucggguuccggggccucggaucccagcgacucccucacagcugcgcuccgcagcgcaaccgaacugcgggccccgcccucgcggcguccggaccaacagugggcggugccgcaccgccgccagguuuccauuggacagggcagcggggggcgguucccacagaccgaggcucucaaggcagucuacugccgggucuccuccccuugcgggguuccggcagacugccugccagcguugucuucuugucucucuguccauccuccucccagucgaggugcccccaaguaauucugccggacgaaaggaaggccuucucucucuucuugaaagcgccaugacaguccuaauccucuaagaagacaaaaggaacggaagacgcagccuuucaaucugaggaacgaacccacccacauuccccauuugggaaagagacagugcacuggucaucaaauuuucagaaagcuuuuuuuuaaucgcuuaacaugaaaacuaauaguu

SEQ ID NO: 2403 - RNA, 13238 nt, Mus musculus
augacuuuuuccaaaaauaauuuauuuuuaugugugugugugugugugugugugugucaugauggaggaguugguucucuccuuacaccauguguguccccgguaucaaacuuaaauugcaagugacuuuacccacugacccaucucucuggauccucaaaugucuuuuuaaacaaaacaaccaaaacaaacaccugaaacaaaccaacagcuguucugaagcaaagccagaugcugcguacccggcagcuguggugggcccuguuugccaccuucacaaggagaaaaggugaaagcgugugcauggugaaagauacuuaaaagucugggucaaaagucaggcguggguggcacaugccuuuaaucccagcacucgggaggcagaggcaggcagauuucugaguucaaggccagccuggucuacaaagugaguuccaggacagccagggcuacacagagaaacccugccucgaaaaaaaaaaaagucugggucagcacaagagcauauggaaaguaaaaaugacgaggcuggcuggaauaaucuagaaaagaaagaacucuggggacagcugcauaaggguaacagcuguccccacggcucucacuuuguaagaggccugaguagcaugaauaguuugaacucugacugauggacuuaaguuuagcuguuacugucugucuugcuacuggguucccaaugacgacacaaaauagacgaaugaauugcugacgucuauuauagacgucauauauugcauauauuuacaugaauauaugcaagcuuugaaauuuaagcaaagcaccucagugucccaccucugcaaggagcaucaaaguggcaugacuccucucaagcgugccagagacacggcugagaggagcugagauaaaaccagccgggacaguacuuuggucugauuaccaggucaguaucacaacucagcugcgaacgguggcuuaguuguuuuaaagaaguacagaaacgacgcaaagugaacuguuacuagguuaggaacugucucugacauuagcaaaggucuacacuuaagaauacagucuaauuacuacucaugggcuuccugcuggcgcucugcaguuaaaucuuccucauccucuuccugcagcgcugauugaacacaggggaggaccccaugaggcugucaguggagugggaaccauagcugcugucugagucgucagggcucugagggaguccagccucacucaugccugacauuggcuccucaaagacaucacugcccagcaccccaugcgcagacacauugccuucuucacuuucuugagguuccauuuucacgugagccagguuccagagaggagaagcauugaccucugcaccuagaaaugaagggaaggagagauuaugagcccacggggaggcagacacagaaccugcacaucucgcccucacacaacuagcgaccuccgagcugcuuucauuacagcaccccacaugggaugagggugucacuguuagucugggguucaaauguuacccccaaauuaccacuuccuuuccacuuucaugguuuuucccuuccccuuauucaccccuacuucuccuauaccaaaaaaaaaaaaaaaaaagaaaacuggguagaaagauuauguucaaaggcagacacaauuccaguuuacccccauaagaagcucuauuuuccuguauucaugcuugcacauggaagccacagaaggaugugagguauggaagcaucuucuuucguugcucucuuauugccguaaccuggaaacucaguuuucacuaagcuggcuggccaguguugggguugugggcacacagccauccacaccuuuuacaugggugcugggauuugaacucauguccucaugcuugcacagcaccucccgagcucccuggccuucuuuucuuuuuucuuuuuuugcuuuuucgaaacaggguuucucuguauagcccuggcuguccucuggccuucuuuucauuuggcuuuuucccuuuuauuugagaaucucucuaggccucuuuugcauuuugaagacuauguucacacgugaugcugacaucagcucucuacuugucucuccugacaggagacaugguuguugguguccucugucuuucuguauuuugguaaugcagcucugcuguuaacuauuaugucuuccucagagaaaaaccucucagcgcuucuaaggcugaccuaauuuuguuugggucacauaugaggaugugauauuuaaauuucuuacguguuuacauuuguaaacaacuaaguguucaaacuaauuugcaacugagcugagucgggauagcgagugaagcacagcaacugcagcccgugggagcucgugggaggcuaaagcaggaggccuucaauuccagaccuaccuagauggcaagauggcaaggugugggguguaaaaucaugucaggauguuuaggauguuugcuaagguagagcagggcgagaccuggggacuugguggucacacaccugaggcuuaggugacucccagcucccugccagacuccugacucggaacacacaugccacguuucucacauaaaagagacacggccaagaggucucucugcuaaugagguaccuagaggcccggagcauagccaauaagcuuuccuucccagacgcuccucccuguaaaagguguuuaccucaggcccaccagagaaguggggaugguuuuauacacccacuucccgccauacaauaaaugccuuagaaccauggacugccucuuuucauugaucuguuguggggagccaugggaaaggccuuugccuauagagcacagccuaaucuguagacggccucucugaacucccagccacaaccgccagcaagccugcugccccaucaagccaaggacucuuucggugggaccagcuggagcucuccuccccccacccaccuuagguuaaacccagcccaaaggcccacacuuuucugugacucccaacagugccuggauauccaagagccugugagaaccccacagcccaagcauuguugcaggcccaggguugggacugcuccccucaacccccauaagcacagucaaaacuccccacaucccaccuccccugugguggagcagaugagggacccacaacccuacagcaagacccugucucaagaacuaaaccaaaauauaauugcuuaaaaauaaaaaguagggcuggugagauggcucaacugguaagagcacugacugcucuucugaagguccagaguucaaaucccagcaaccacaugguggcucacaaccacccguaaugagaucugacgcccucuucuggggugucugaagacagcuacaguguacuuacauauaauaaauaaauaaaucuuaaaaaaauaaaaaauaaaaaaauaaaaaguaacaagccaguucugcaggcuccuaaaguccucauggcuauaaccuacaacagaacaacuccauccaacacacaacaauuucauucccuuuggucugcaauuuucuugaaguuccuaucaaggaaacagcuccuuaaaccagagaguacuguaaaggauucaccacagcucuguuugcuccagcaacuucuguucugcccaugucugccuuucucccacuuggaguugauuccaaagugucaggaagugcuaagaugggcagagccagaugcaaaaugaauacaacuuucuuucuuacuuggagccuguggcgaagccuccaccuccagguuggaugggaagcgcucacucugagccccgaggaccccaauggguaaggacugaucuccagaagcaagguccgcuucuagcuccucacugacaggaaaugugaugucgcucacaggcucuuccuugaucuucacagguuuagugucuucuguggccuucucgggauucacaauccuuucauauucuucagagagcugcuuacuaaucuguugguaagcaagaauuaguuuuccagagcuauuuuagaauuagauuggagagugagcuuacaguaacccaaggaaaacugggcagagcaggaguuagcaaaugaguuguucuuucuuucuggugugugugcacgugugugcaugugcaugaauaugugcacaagcauguguuuguguguguacagaggucaaagagucaccucaguggucauuccucagguacuuccacuucucaguugagaaagugagcuucaggaacccgccugucugccucccaucucaccaucgauggauggccuuacaaguguaugccaccacaccuggcuuuuuacaugggcccuggagaucugaacucagggucccgggcuuucaagauaagcacuuuacuaauagccagccuggaaagugagauuuaaaaccucuccugccagggcuggggugcagugcgagaaugcaugcccagccugugcaaggccaugaguucaaucccagcaccaucaaacaacaaggacagaugccacugccaaugguaggaagucauuuaaggguuugggucugcauuuaugauagacacauaaagaaaauaugucagaaauugucaucauuaauuaaaaguuacacaaggcaaaaaagccagagcuaaggcaaaauacugcauuucugucuauaaaaacuaacaauuaucuagacauaguguauggaauuccaucucuuaggaggcugaaaagaaaggaggggaguaaggccagccuggcugcucagggaagccgugucucacacgucagaaaccucccaaguaucuggcagacagacccuagaggcaaaccuucagugaagcaagcaaucuggacccuuuugucagaugcuaaagguuacuggucacuacaugccuaagccucaagaacuggagagacggugcucuacuugagccuccuggcaugccacuggcuuguuuaguuuucaacacauuuaaugcuaucugaaauuguugugcuuaguauuuguuugccuguuuuugcuucccaugaacacuucaaacucaagaguugauuccucuuauaaacuacuaucucccacaaugccugacucauaguaaguccucaauaaauacuuguugaauagccaaccacggggcgagggagaugguucagugguuaagagcacuggcuucucuuucagaggucaugaguucaauucccagcaaucacaugguggcucacaaccaucuguaaugagaucugaugcccucucuucugguaugucugaagacagcuacaguguacucacauacauuaaauaaauaaauaaauaaauaaauaaauaaauaagagagagagagagagagagagagagaaagaaagaaagagagagagagagaaugcuagccauaguacuugagaccccagguacccauguacuucauccagaggaagcaaugaggaaugggcuacccacugggccagugguaugucagauucacucugcuccaagucccugugcgcuguaccccagaacauguguuguagacucugcccagccagggcaguuugcccaugucucccagggucuccucaccuguagcauguaagugugauaguccuugaugcggugcugccagaacuucugcagggagagcacacugccaaugcccacuucauggaacaccuguuccauuacaucagggaaaggagucugucccagcagggccucucggucgacagcaaagcgcagcagcuuggugaacuugaggcaguauucaugugccacaucaguuagggucuccaggacacuuucauuagcacacucaaagccugugugggccaggauuguggcgacugcuugauagaggagcugccggcaggagugccagcucagcucugucacaggcucuccuuucccgcugagagaggagacaaggggugaccagccugucucauugggguuuuacaagccauuuaagagaauucuagagaaacagccaccuucguccugcucuucucagagcauaggucagcaacccaauaucauauuccugagccccccaauuacagaguuugaaaaggcaaugcgugucuaaaauaaacuguacagaguaauaguggaggaacuagaauuagacaacugagugaccaguuccucuagaagaacaagcguucuuacccacuugucaucccuccaaccucucugaauacguacugguguuaugccuccaucugcaaaggaaacuguuuuauaaaucucuguucuuugguuuaugucaccacuuccuguaguagguggugucugaagaggccucacucauuuacuauuaucugcucaauaacaaccacggcaaguuauagauagccaaaaaaggagacgacaacuaacuuuucauuuaauauguccguggccagucuaucugggccaaagguuaaaagcacuggaaauaccaaauaaagagcuaauuacuaucacuuaauuugagcacuuuauggacuuauucccuugcaguguugggauuugaacccagagccugugaaaucagcagggguuaaccugaacuacaucuauagccuagauauaggcuucuuuaauggaaagugauguuuugguaccucauagcugcuguguauuauuuuuucuuauacaguuucuuaaaauauguauagaacaaacuagguucaagucaugugugugugcaugugugugugugcauauaggggccugaugcauguacauguaugcacaauacauacugacgccuacagugucauuucugaggaaaugacaaaaaccucccugauuuuuucagaaagggucucuucuugggaccuuucuuaggagcuuauugauuaggcuaggcuggccagccagugagucccaggcauccuccugccucugccuuuccugcccucggauuauuaucauggacuacccugcccagcuuuuucacuggguucucauggcaagcauuuuccugacugagcaaucuuccccagccacucucuuuuauuuugaggcagggucucuuuuuguuauuuugucuuuuuuuucuuuuccagagcugaggacugaacccaggaccuugcgcuugcuaggcaagcgcucuaccacugagcuaaauccucugaugcaggcucucuuauaagaccuggagcucaccaaguagguacacugucugacuagagagccucaggcauguuugucucugacucccuagugcugagauuauaaacgaaagccaccaugacuggguuucuuuuacguugguucuggggacagaacacaggguuuauuaaccaacuuacuaacuaagccauuucccuagccccgagguucuucuuaaaaauuaaacuugcugggcggugguggcgcgcaccuuuaaucccagcacucaggaggcagaggcagguggauuucugaguucgaggccagccuggucuauaaagugaguuccaggacagccagggcuacacagagaaacccugucuugaaaaaacaaaacaaaacaaaaaaauuaaacuugacaaaaaaacuacaguuggaguaauaacacaaauuuaaugcgaugaacguuauuuuauugaaugaaacuacauuacccucaaaauaugacuaugcugcugacuguuacaagcuggggguuuuuguuuuguuuugauuuccuuuaugcugggccacuacuuuaccagcccauuuuucacuagucauguaccaguuuauuguuucacuuuuaguaaacugucuggcauuaauaaguacucaguaaaugccuauugugcuagaaaauuaaaaaauacagauagugguagcacaugucuuuaaucccagcacuaaggaggcagaggcagguggaucucuaugaguuugaagccagccucgucuauagaacuaguuccaggacagccaaggcuauacagaaaaacucugucucauaaaauaaaaacagaaacaacaacaacaaaaacaacaacaaaauuauagacuagcuucuggcaauuuggacuaauaacuccacuaaugacuuaagcaacauuagucuagccaaucacucuccucuccaguguucucauguagaaguggaaaugccacuauaaucguaacaggaucauggggggaggggagaucacuuaauaaaaacaccacagcaaugcuuugucuuaccgguaaaagucacucucugggucacugugccggaucuggaauggagcauugggauuuuuacagucuaaaggcuggaggucaucagggagaggaggugagccagggcaggagggaagagguucacucucuucagccuucacacccucugucugcugcugacucugggucugagcuguggcaauaaggcugcgcaggcgucgguuguguuggaucaacugaaugguauggauggugaggcuacacgguucugagggaauguccagcaucguggggggcuucggcuuguuggcugagggcuggugcaggggcgggucauggacuuccaccagacggaacucccgugggagcagaucaaaggaacuucuguuggucuguccugacgguauugguaucucuccccaguaccucagcauuuuagagcaagcagagaagggcucuccagcuuaauguaaacgaucuccuaaaggugugugcuuccgucucuggcaacuguagaucagaagcuucugcagugaaaaguaggaagucuaggcaguucccacauaagaagcaagcuaagaucacuuuaaaaaggugcuagcaaaacucuaggacagacaauacucucccugaagaaacgaagagaaaaauaacuguuagaugccaaucacacagcgacaacuccucuuugaauuacaaaaggaaaaucaaaguaacuaauaggugaagaguaguaauugguguguggggcucuuaacauauacacugccuauuucacgucacaaauucaucaccagaauacccaucaugccucauucuaaauaugugacaaggcauaaaacuaaaguaggaggucuggacuacuuccagaguauuucuacacaauugugcuagacuaauaggaaaaagagagcagcauuaaaacuacuaacaggcagccagauaugguggugcacuccuuucuuccagcacucaggaggcaguggcaggcagaucugaguucaagguuagccugaucuacagaguaauuuccaggacagccagggcuacacagagaaaccauaucucaaaaaauaaaacgaaacaagacaaaaaauacuaguagguguuuuuuaaccugugccguguaugguagaaacauucaugaaccuuuaaucuagccuuaugcuuccaaauucugacauacacaugaacaaauagagggucucggugggcgugugcauggaggccaggaaucagccucaggcaacauuccaccuugcuuuuugagauaggaucucucgcuggaguguaggauuugcugauuauucuaagccaguguauugccuguacuucuauucuaccgacuuugcucugggaaaagccgagcuccuagcuccccacccagcuucccuugaaucuguggauaaaagacacacacacacacacacacacacacgcacacacacgcgcacacacacgcacgcgugcacacacauaguuuauucuuuuauaacuugccuucuuggcacaaucgcuggguguuacugucucuugccuagaaaagcaugaccuuauuaauauuuuuagcuguuucuccaccugccccaaacuucaguggcuagugccaccuauguccugccaaaaauccacagccacccaguucccagccacaggccucagcucccccaagaccucacaugguugcugcauucuucuuccuccaaagcauggcagaaagaccucucuccuuccuuguggcuaccuuuuccuccuggaaccuggaagucccacauguaccuuccucccagcaauuggcccccagcuuucuuuacugacaaauaaagaaccaauuggggaauaagaccuuaacauaagaaccacgcccuucaccagugagucccagggaucugacuguuucugcuuuccuccccacaagcugaguuuauaagcacaugcacccauaccuggauuuuuacauauggguuuggggauugaacucagguccucaugcgugcaauggacugagcugucuccccagaaugaaucugagagacuucuguugccuucuaacaaguauuccuuccucuaguccagugguucucaaccuguaggucauaaccccuuuggggaucaaaugacucuuucauagguuaaggaauaucagguauccuguauauaagguauuuacaauaggauucauaacugcaacaaaauuacaguuaugaaguagcaaugaaaauaauuuugugguugcauggggucaccacaacaugaggaacuacauuaaagggucagaccuuuaggaagguugagaacugcuauuccagucuuuuucagaaucugaucuacacuuggcccugcugcuagacuuucuuccuuucucugucugucucucuuugugugucucugucucucauucucucaaugcugaagauuuaacacauccuacaaaaguauuuuuauuacugagcuacacuuccaagcuuuuuuguuuguuucuuuugcuuggaaaaagucagaauucuguggcuuagcauucaauaaaagcuuacuaagcgucuuuaauucacgucuccagguuuacugccuauaugucuccucagguccaacaaacaucaaaugaauacauugugugacgguguaagaucuuuguccugagggaauaacagaagcaaaauacugcaguauagcagcagcuggcacugcuacuuuaaaggcgugaguucaguguccugcaggcaagugaggggcuuccuggacaaaaugaaugcccucagcucuaacaauauacuacucaguuccuuucuuucucuuucuuucuuuucuuuuuuuuuuuuuuuuacauuuacuuauuuuggguaugugugcaugaaaaaaucacaagacaacuugugagaggcaguucucuccuuucaccauguggguuccauggauugaacucgggcauucggacuuggcagcaagugccuuuuaccuacuaagccaucuaacuggccccucagcuuauuuccuuugcuaagauuguauuuuuaaauuauuaauuucgagacaggguuucccuuugaggccuuggcuauccuggaacuugcucuguagaccaggcaggcuaugcauucacagacauucguuuuuguugucuguuggggguugaguauaugcuuguguguuccauguguaugcaggugccaaggauaucugaagagggcaucagauccuucuggagcucaaauuagaggugguugugaacuccccugauguggguacuggaaauggagcucagauccaccgaagagcagcacacagaaccaucucuccagcuccaccacucagcuucucaagaacaugagauauuuuuauaauugacccuuugaguugugaccucugccaggaacccucuacaucuuuaucagacuugaauuuguucuuuaggaucccugaaaucaccauuccccccaacagaucuccuuucuuuguauauuuacaugaauuugcuuuuaucccugaaccuuaacuuuaguugacuuauucaucuguauucucccacuuguuauggcugccaucuugguauaguuucaggccucugucaaagaguuauaauauuaacuauggcuuaguucaauuuuccauaaauuuuaugacaaauuaacacuacuauuuccaauuuuucagauguggaagcuguuguccagggucaugccaacaucauaaauacaaagaguaaaaaagaaaagagguuucgaugcucagguuuguuaagccacuaaacaugcuaucucaauauuuuguuccgaguaauaaaagaaugaacaauaauaaauugcuucuuuacuaacuucauaaaaggaauaaauucgagagcugcagauagggacuccuugcuccggaucuggaggcuuaggcuuaggcgccgaccacaggauccugggaagucugauuuacaaggcagcaggaaaauggguggcucuggaccggaaccagaaaauaaaguucaaauacucaccgcccugccccaggagugguauacgcggcugccugacucugacaggucggagucgaggacuaggucaagccuaggagccuuguuuauugauuaauggaccaaggccacggaagcacuucuucccaaucgcccucugccacaggaaguuauuacuagccuacaugcaacgccuaaaauguccguauccugcacagcacucugagagccucuccccgcuuucugguauugugacucccuagugcuauucacaucuuuaaaacucugcgagucuugaaagaggaacuccaacauuucuguccagagaagccucagggaggugggaaggaggaggagaagugagcgggaacguagagagcgaggggucgggguuuccgagggacacauuuugagauugcacccggcuaaggauggcugauccuaccccucagcuagaugcgccagcuccccaggaagucaguagcgaguuuaagaagccgguuuuaccagugccuuccgcaguacgggguaaggcuccggccuccagucccuccguuucugaggaugugaagaaagaaugucucgcggcgcagcuggacucuggaugugaggagcccgaggucccgccaccgcagccggacagccaggagaccggggguccaccgguggagcaacuccgcuccccgcggguagcuccugcgucuggcgguccgacccgggcuccuccguaccgagagccaucguggggcagcccagccacggcccccuacagucucgaaacccugaaggguggcaccauccuuggcacccgcaccuugaaagacacgagcugcugcuuuuucgggagacuugcuaguugugacauaugucuggagcauccuuccgugucucgguaccaugcuguacuacagcaccggggggcggaucccagcggagacucugagggucaugagcagggcuuuuaucucuacgaucugggaaguacccacggcacguuccucaacaaaacucgcaucccaccccgcacuuacuguagaguccacgucgggcauguaaugcgcuuuggaggcagcacucggcucuuuauccuucagguagguagaaaaaucuaaaauaaaaaucuugggacuucacuguuuuugguuuuucaagacagggcuucucuauguagcccuggcuguccuggaacucucucuguagaccaggcuggccucg

SEQ ID NO: 2404 - RNA, 13238 nt, Mus musculus
cgaggccagccuggucuacagagagaguuccaggacagccagggcuacauagagaagcccugucuugaaaaaccaaaaacagugaagucccaagauuuuuauuuuagauuuuucuaccuaccugaaggauaaagagccgagugcugccuccaaagcgcauuacaugcccgacguggacucuacaguaagugcggggugggaugcgaguuuuguugaggaacgugccguggguacuucccagaucguagagauaaaagcccugcucaugacccucagagucuccgcugggauccgccccccggugcuguaguacagcaugguaccgagacacggaaggaugcuccagacauaugucacaacuagcaagucucccgaaaaagcagcagcucgugucuuucaaggugcgggugccaaggauggugccacccuucaggguuucgagacuguagggggccguggcugggcugccccacgauggcucucgguacggaggagcccgggucggaccgccagacgcaggagcuacccgcggggagcggaguugcuccaccgguggacccccggucuccuggcuguccggcugcgguggcgggaccucgggcuccucacauccagaguccagcugcgccgcgagacauucuuucuucacauccucagaaacggagggacuggaggccggagccuuaccccguacugcggaaggcacugguaaaaccggcuucuuaaacucgcuacugacuuccuggggagcuggcgcaucuagcugagggguaggaucagccauccuuagccgggugcaaucucaaaaugugucccucggaaaccccgaccccucgcucucuacguucccgcucacuucuccuccuccuucccaccucccugaggcuucucuggacagaaauguuggaguuccucuuucaagacucgcagaguuuuaaagaugugaauagcacuagggagucacaauaccagaaagcggggagaggcucucagagugcugugcaggauacggacauuuuaggcguugcauguaggcuaguaauaacuuccuguggcagagggcgauugggaagaagugcuuccguggccuugguccauuaaucaauaaacaaggcuccuaggcuugaccuaguccucgacuccgaccugucagagucaggcagccgcguauaccacuccuggggcagggcggugaguauuugaacuuuauuuucugguuccgguccagagccacccauuuuccugcugccuuguaaaucagacuucccaggauccuguggucggcgccuaagccuaagccuccagauccggagcaaggagucccuaucugcagcucucgaauuuauuccuuuuaugaaguuaguaaagaagcaauuuauuauuguucauucuuuuauuacucggaacaaaauauugagauagcauguuuaguggcuuaacaaaccugagcaucgaaaccucuuuucuuuuuuacucuuuguauuuaugauguuggcaugacccuggacaacagcuuccacaucugaaaaauuggaaauaguaguguuaauuugucauaaaauuuauggaaaauugaacuaagccauaguuaauauuauaacucuuugacagaggccugaaacuauaccaagauggcagccauaacaagugggagaauacagaugaauaagucaacuaaaguuaagguucagggauaaaagcaaauucauguaaauauacaaagaaaggagaucuguuggggggaauggugauuucagggauccuaaagaacaaauucaagucugauaaagauguagaggguuccuggcagaggucacaacucaaagggucaauuauaaaaauaucucauguucuugagaagcugagugguggagcuggagagaugguucugugugcugcucuucgguggaucugagcuccauuuccaguacccacaucaggggaguucacaaccaccucuaauuugagcuccagaaggaucugaugcccucuucagauauccuuggcaccugcauacacauggaacacacaagcauauacucaacccccaacagacaacaaaaacgaaugucugugaaugcauagccugccuggucuacagagcaaguuccaggauagccaaggccucaaagggaaacccugucucgaaauuaauaauuuaaaaauacaaucuuagcaaaggaaauaagcugaggggccaguuagauggcuuaguagguaaaaggcacuugcugccaaguccgaaugcccgaguucaauccauggaacccacauggugaaaggagagaacugccucucacaaguugucuugugauuuuuucaugcacacauacccaaaauaaguaaauguaaaaaaaaaaaaaaaagaaaagaaagaaagagaaagaaaggaacugaguaguauauuguuagagcugagggcauucauuuuguccaggaagccccucacuugccugcaggacacugaacucacgccuuuaaaguagcagugccagcugcugcuauacugcaguauuuugcuucuguuauucccucaggacaaagaucuuacaccgucacacaauguauucauuugauguuuguuggaccugaggagacauauaggcaguaaaccuggagacgugaauuaaagacgcuuaguaagcuuuuauugaaugcuaagccacagaauucugacuuuuuccaagcaaaagaaacaaacaaaaaagcuuggaaguguagcucaguaauaaaaauacuuuuguaggauguguuaaaucuucagcauugagagaaugagagacagagacacacaaagagagacagacagagaaaggaagaaagucuagcagcagggccaaguguagaucagauucugaaaaagacuggaauagcaguucucaaccuuccuaaaggucugacccuuuaauguaguuccucauguuguggugaccccaugcaaccacaaaauuauuuucauugcuacuucauaacuguaauuuuguugcaguuaugaauccuauuguaaauaccuuauauacaggauaccugauauuccuuaaccuaugaaagagucauuugauccccaaagggguuaugaccuacagguugagaaccacuggacuagaggaaggaauacuuguuagaaggcaacagaagucucucagauucauucuggggagacagcucaguccauugcacgcaugaggaccugaguucaauccccaaacccauauguaaaaauccagguaugggugcaugugcuuauaaacucagcuuguggggaggaaagcagaaacagucagaucccugggacucacuggugaagggcgugguucuuauguuaaggucuuauuccccaauugguucuuuauuugucaguaaagaaagcugggggccaauugcugggaggaagguacaugugggacuuccagguuccaggaggaaaagguagccacaaggaaggagagaggucuuucugccaugcuuuggaggaagaagaaugcagcaaccaugugaggucuugggggagcugaggccuguggcugggaacuggguggcuguggauuuuuggcaggacauagguggcacuagccacugaaguuuggggcagguggagaaacagcuaaaaauauuaauaaggucaugcuuuucuaggcaagagacaguaacacccagcgauugugccaagaaggcaaguuauaaaagaauaaacuaugugugugcacgcgugcgugugugugcgcgugugugugcgugugugugugugugugugugugugucuuuuauccacagauucaagggaagcuggguggggagcuaggagcucggcuuuucccagagcaaagucgguagaauagaaguacaggcaauacacuggcuuagaauaaucagcaaauccuacacuccagcgagagauccuaucucaaaaagcaagguggaauguugccugaggcugauuccuggccuccaugcacacgcccaccgagacccucuauuuguucauguguaugucagaauuuggaagcauaaggcuagauuaaagguucaugaauguuucuaccauacacggcacagguuaaaaaacaccuacuaguauuuuuugucuuguuucguuuuauuuuuugagauaugguuucucuguguagcccuggcuguccuggaaauuacucuguagaucaggcuaaccuugaacucagaucugccugccacugccuccugagugcuggaagaaaggagugcaccaccauaucuggcugccuguuaguaguuuuaaugcugcucucuuuuuccuauuagucuagcacaauuguguagaaauacucuggaaguaguccagaccuccuacuuuaguuuuaugccuugucacauauuuagaaugaggcaugauggguauucuggugaugaauuugugacgugaaauaggcaguguauauguuaagagccccacacaccaauuacuacucuucaccuauuaguuacuuugauuuuccuuuuguaauucaaagaggaguugucgcugugugauuggcaucuaacaguuauuuuucucuucguuucuucagggagaguauugucuguccuagaguuuugcuagcaccuuuuuaaagugaucuuagcuugcuucuuaugugggaacugccuagacuuccuacuuuucacugcagaagcuucugaucuacaguugccagagacggaagcacacaccuuuaggagaucguuuacauuaagcuggagagcccuucucugcuugcucuaaaaugcugagguacuggggagagauaccaauaccgucaggacagaccaacagaaguuccuuugaucugcucccacgggaguuccgucugguggaaguccaugacccgccccugcaccagcccucagccaacaagccgaagccccccacgaugcuggacauucccucagaaccguguagccucaccauccauaccauucaguugauccaacacaaccgacgccugcgcagccuuauugccacagcucagacccagagucagcagcagacagagggugugaaggcugaagagagugaaccucuucccuccugcccuggcucaccuccucucccugaugaccuccagccuuuagacuguaaaaaucccaaugcuccauuccagauccggcacagugacccagagagugacuuuuaccgguaagacaaagcauugcugugguguuuuuauuaagugaucuccccuccccccaugauccuguuacgauuauaguggcauuuccacuucuacaugagaacacuggagaggagagugauuggcuagacuaauguugcuuaagucauuaguggaguuauuaguccaaauugccagaagcuagucuauaauuuuguuguuguuuuuguuguuguuguuucuguuuuuauuuuaugagacagaguuuuucuguauagccuuggcuguccuggaacuaguucuauagacgaggcuggcuucaaacucauagagauccaccugccucugccuccuuagugcugggauuaaagacaugugcuaccacuaucuguauuuuuuaauuuucuagcacaauaggcauuuacugaguacuuauuaaugccagacaguuuacuaaaagugaaacaauaaacugguacaugacuagugaaaaaugggcugguaaaguaguggcccagcauaaaggaaaucaaaacaaaacaaaaacccccagcuuguaacagucagcagcauagucauauuuugaggguaauguaguuucauucaauaaaauaacguucaucgcauuaaauuuguguuauuacuccaacuguaguuuuuuugucaaguuuaauuuuuuuguuuuguuuuguuuuuucaagacaggguuucucuguguagcccuggcuguccuggaacucacuuuauagaccaggcuggccucgaacucagaaauccaccugccucugccuccugagugcugggauuaaaggugcgcgccaccaccgcccagcaaguuuaauuuuuaagaagaaccucggggcuagggaaauggcuuaguuaguaaguugguuaauaaacccuguguucuguccccagaaccaacguaaaagaaacccagucaugguggcuuucguuuauaaucucagcacuagggagucagagacaaacaugccugaggcucucuagucagacaguguaccuacuuggugagcuccaggucuuauaagagagccugcaucagaggauuuagcucagugguagagcgcuugccuagcaagcgcaagguccuggguucaguccucagcucuggaaaagaaaaaaaagacaaaauaacaaaaagagacccugccucaaaauaaaagagaguggcuggggaagauugcucagucaggaaaaugcuugccaugagaacccagugaaaaagcugggcaggguaguccaugauaauaauccgagggcaggaaaggcagaggcaggaggaugccugggacucacuggcuggccagccuagccuaaucaauaagcuccuaagaaaggucccaagaagagacccuuucugaaaaaaucagggagguuuuugucauuuccucagaaaugacacuguaggcgucaguauguauugugcauacauguacaugcaucaggccccuauaugcacacacacacaugcacacacacaugacuugaaccuaguuuguucuauacauauuuuaagaaacuguauaagaaaaaauaauacacagcagcuaugagguaccaaaacaucacuuuccauuaaagaagccuauaucuaggcuauagauguaguucagguuaaccccugcugauuucacaggcucuggguucaaaucccaacacugcaagggaauaaguccauaaagugcucaaauuaagugauaguaauuagcucuuuauuugguauuuccagugcuuuuaaccuuuggcccagauagacuggccacggacauauuaaaugaaaaguuaguugucgucuccuuuuuuggcuaucuauaacuugccgugguuguuauugagcagauaauaguaaaugagugaggccucuucagacaccaccuacuacaggaaguggugacauaaaccaaagaacagagauuuauaaaacaguuuccuuugcagauggaggcauaacaccaguacguauucagagagguuggagggaugacaaguggguaagaacgcuuguucuucuagaggaacuggucacucaguugucuaauucuaguuccuccacuauuacucuguacaguuuauuuuagacacgcauugccuuuucaaacucuguaauuggggggcucaggaauaugauauuggguugcugaccuaugcucugagaagagcaggacgaagguggcuguuucucuagaauucucuuaaauggcuuguaaaaccccaaugagacaggcuggucaccccuugucuccucucucagcgggaaaggagagccugugacagagcugagcuggcacuccugccggcagcuccucuaucaagcagucgccacaauccuggcccacacaggcuuugagugugcuaaugaaaguguccuggagacccuaacugauguggcacaugaauacugccucaaguucaccaagcugcugcgcuuugcugucgaccgagaggcccugcugggacagacuccuuucccugauguaauggaacagguguuccaugaagugggcauuggcagugugcucucccugcagaaguucuggcagcaccgcaucaaggacuaucacacuuacaugcuacaggugaggagacccugggagacaugggcaaacugcccuggcugggcagagucuacaacacauguucugggguacagcgcacagggacuuggagcagagugaaucugacauaccacuggcccaguggguagcccauuccucauugcuuccucuggaugaaguacauggguaccuggggucucaaguacuauggcuagcauucucucucucucucuuucuuucuuucucucucucucucucucucucucucuuauuuauuuauuuauuuauuuauuuauuuauuuaauguaugugaguacacuguagcugucuucagacauaccagaagagagggcaucagaucucauuacagaugguugugagccaccaugugauugcugggaauugaacucaugaccucugaaagagaagccagugcucuuaaccacugaaccaucucccucgccccgugguuggcuauucaacaaguauuuauugaggacuuacuaugagucaggcauugugggagauaguaguuuauaagaggaaucaacucuugaguuugaaguguucaugggaagcaaaaacaggcaaacaaauacuaagcacaacaauuucagauagcauuaaauguguugaaaacuaaacaagccaguggcaugccaggaggcucaaguagagcaccgucucuccaguucuugaggcuuaggcauguagugaccaguaaccuuuagcaucugacaaaaggguccagauugcuugcuucacugaagguuugccucuagggucugucugccagauacuugggagguuucugacgugugagacacggcuucccugagcagccaggcuggccuuacuccccuccuuucuuuucagccuccuaagagauggaauuccauacacuaugucuagauaauuguuaguuuuuauagacagaaaugcaguauuuugccuuagcucuggcuuuuuugccuuguguaacuuuuaauuaaugaugacaauuucugacauauuuucuuuaugugucuaucauaaaugcagacccaaacccuuaaaugacuuccuaccauuggcaguggcaucuguccuuguuguuugauggugcugggauugaacucauggccuugcacaggcugggcaugcauucucgcacugcaccccagcccuggcaggagagguuuuaaaucucacuuuccaggcuggcuauuaguaaagugcuuaucuugaaagcccgggacccugaguucagaucuccagggcccauguaaaaagccaggugugguggcauacacuuguaaggccauccaucgauggugagaugggaggcagacaggcggguuccugaagcucacuuucucaacugagaaguggaaguaccugaggaaugaccacugaggugacucuuugaccucuguacacacacaaacacaugcuugugcacauauucaugcacaugcacacacgugcacacacaccagaaagaaagaacaacucauuugcuaacuccugcucugcccaguuuuccuuggguuacuguaagcucacucuccaaucuaauucuaaaauagcucuggaaaacuaauucuugcuuaccaacagauuaguaagcagcucucugaagaauaugaaaggauugugaaucccgagaaggccacagaagacacuaaaccugugaagaucaaggaagagccugugagcgacaucacauuuccugucagugaggagcuagaagcggaccuugcuucuggagaucaguccuuacccauugggguccucggggcucagagugagcgcuucccauccaaccuggagguggaggcuucgccacaggcuccaaguaagaaagaaaguuguauucauuuugcaucuggcucugcccaucuuagcacuuccugacacuuuggaaucaacuccaagugggagaaaggcagacaugggcagaacagaaguugcuggagcaaacagagcuguggugaauccuuuacaguacucucugguuuaaggagcuguuuccuugauaggaacuucaagaaaauugcagaccaaagggaaugaaauuguuguguguuggauggaguuguucuguuguagguuauagccaugaggacuuuaggagccugcagaacuggcuuguuacuuuuuauuuuuuuauuuuuuauuuuuuuaagauuuauuuauuuauuauauguaaguacacuguagcugucuucagacaccccagaagagggcgucagaucucauuacgggugguugugagccaccaugugguugcugggauuugaacucuggaccuucagaagagcagucagugcucuuaccaguugagccaucucaccagcccuacuuuuuauuuuuaagcaauuauauuuugguuuaguucuugagacagggucuugcuguaggguugugggucccucaucugcuccaccacaggggaggugggauguggggaguuuugacugugcuuauggggguugaggggagcagucccaacccugggccugcaacaaugcuugggcugugggguucucacaggcucuuggauauccaggcacuguugggagucacagaaaagugugggccuuugggcuggguuuaaccuaagguggguggggggaggagagcuccagcuggucccaccgaaagaguccuuggcuugauggggcagcaggcuugcuggcgguuguggcugggaguucagagaggccgucuacagauuaggcugugcucuauaggcaaaggccuuucccauggcuccccacaacagaucaaugaaaagaggcaguccaugguucuaaggcauuuauuguauggcgggaaguggguguauaaaaccauccccacuucucuggugggccugagguaaacaccuuuuacagggaggagcgucugggaaggaaagcuuauuggcuaugcuccgggccucuagguaccucauuagcagagagaccucuuggccgugucucuuuuaugugagaaacguggcauguguguuccgagucaggagucuggcagggagcugggagucaccuaagccucaggugugugaccaccaaguccccaggucucgcccugcucuaccuuagcaaacauccuaaacauccugacaugauuuuacaccccacaccuugccaucuugccaucuagguaggucuggaauugaaggccuccugcuuuagccucccacgagcucccacgggcugcaguugcugugcuucacucgcuaucccgacucagcucaguugcaaauuaguuugaacacuuaguuguuuacaaauguaaacacguaagaaauuuaaauaucacauccucauaugugacccaaacaaaauuaggucagccuuagaagcgcugagagguuuuucucugaggaagacauaauaguuaacagcagagcugcauuaccaaaauacagaaagacagaggacaccaacaaccaugucuccugucaggagagacaaguagagagcugaugucagcaucacgugugaacauagucuucaaaaugcaaaagaggccuagagagauucucaaauaaaagggaaaaagccaaaugaaaagaaggccagaggacagccagggcuauacagagaaacccuguuucgaaaaagcaaaaaaagaaaaaagaaaagaaggccagggagcucgggaggugcugugcaagcaugaggacaugaguucaaaucccagcacccauguaaaagguguggauggcugugugcccacaaccccaacacuggccagccagcuuagugaaaacugaguuuccagguuacggcaauaagagagcaacgaaagaagaugcuuccauaccucacauccuucuguggcuuccaugugcaagcaugaauacaggaaaauagagcuucuuauggggguaaacuggaauugugucugccuuugaacauaaucuuucuacccaguuuucuuuuuuuuuuuuuuuuuugguauaggagaaguaggggugaauaaggggaagggaaaaaccaugaaaguggaaaggaagugguaauuuggggguaacauuugaaccccagacuaacagugacacccucaucccauguggggugcuguaaugaaagcagcucggaggucgcuaguugugugagggcgagaugugcagguucugugucugccuccccgugggcucauaaucucuccuucccuucauuucuaggugcagaggucaaugcuucuccucucuggaaccuggcucacgugaaaauggaaccucaagaaagugaagaaggcaaugugucugcgcauggggugcugggcagugaugucuuugaggagccaaugucaggcaugagugaggcuggacucccucagagcccugacgacucagacagcagcuaugguucccacuccacugacagccucaugggguccuccccuguguucaaucagcgcugcaggaagaggaugaggaagauuuaacugcagagcgccagcaggaagcccaugaguaguaauuagacuguauucuuaaguguagaccuuugcuaaugucagagacaguuccuaaccuaguaacaguucacuuugcgucguuucuguacuucuuuaaaacaacuaagccaccguucgcagcugaguugugauacugaccugguaaucagaccaaaguacugucccggcugguuuuaucucagcuccucucagccgugucucuggcacgcuugagaggagucaugccacuuugaugcuccuugcagaggugggacacugaggugcuuugcuuaaauuucaaagcuugcauauauucauguaaauauaugcaauauaugacgucuauaauagacgucagcaauucauucgucuauuuugugucgucauugggaacccaguagcaagacagacaguaacagcuaaacuuaaguccaucagucagaguucaaacuauucaugcuacucaggccucuuacaaagugagagccguggggacagcuguuacccuuaugcagcuguccccagaguucuuucuuuucuagauuauuccagccagccucgucauuuuuacuuuccauaugcucuugugcugacccagacuuuuuuuuuuuucgaggcaggguuucucuguguagcccuggcuguccuggaacucacuuuguagaccaggcuggccuugaacucagaaaucugccugccucugccucccgagugcugggauuaaaggcaugugccacccacgccugacuuuugacccagacuuuuaaguaucuuucaccaugcacacgcuuucaccuuuucuccuugugaagguggcaaacagggcccaccacagcugccggguacgcagcaucuggcuuugcuucagaacagcuguugguuuguuucagguguuuguuuugguuguuuuguuuaaaaagacauuugaggauccagagagaugggucaguggguaaagucacuugcaauuuaaguuugauaccggggacacacaugguguaaggagagaaccaacuccuccaucaugacacacacacacacacacacacacacauaaaaauaaauuauuuuuggaaaaagucau

SEQ ID NO: 2405 - RNA, 2123 nt, Mus musculus
auagaggacuuaagcaucuguagauuuggggauggggcaaguggaauuagccuccacagauagcaagaagggauggguguaacaugugucagguacuggcacuggacauguccugacucauugaacucuucugaugaccccaucagguuguggacucccauucugcagagaaggaaacaaaggucaaguggcuugcucaaguucaugcacuuaguaagugguggagccaauauuugacucaggcuggcugguuccagggcccacaggccuccacucugacaagcuaauuagcccagagcauuaacauggcugugcuaggcuccagucuagaguucucugcauggcucuggcagugggugagacugggggacugcugggucuggguggcugggaugagagcaggagaggcaggugccccaggggcagucugggugcugauguugggcgagaggcaggagagacaggcaggcagccaucuggguuguguaauuuacagcccacgcugugagagccaccagcaacaggggcaugauaccuccucccagcuggaauaugccucaggcuugggaggcauacugggguaacacaggggaagcuacagagcccuccaaguccuggcuauccguguauacauauguaggcaaagacaggauugagcucccaaggacaccucacacugaaggcucccugggugagcaggacccuggcucagacaccaaacaugguaucagucuccacuuggguugugaaauaaaucccagucaaaccuuccccacaagccugucugaacuuauguccucucacuguccccucccaagucaacccuggguaacuagcauucugcagacacugucauacucaaauggcuuuuagcuuuggcucucuacaggauugucccaucaagggucucagaaagguuaaaggaccaagaaggugucagaugugggacagcuaugaugaacuguguuugagaagggggacaguagcugucaccaucagcacccacccaugcuagccucucauuucuaggugguaacuuucuaucugccaaagggugcucaggugcugguguuccauguggggacagaaguggucucagaauugaaagggauugguuuucucaggugguuccuaagguaacucaagagacacauuccaaaaggucuuuggaaugaggagacuucuaugccagccaggccuauuccauggagacucacaggaaaggggaggugugcuguuaggagcaggaacgucugucugagguccuccagaccucauugugcucaucccaaaguccugggcaggaagcugcccagaagaggcagggucacaguagaugagucuugguugcuucugggcuacucuuauuaccaugauuaucaugguuugucaugacccuaagcaggacuucccacaguuguaaagugugauucuuuuaaaggggugagagaguaguguggagugaaguucagagccucagagaaggaaaauguccauuacaacuacuggggucacugcauaguuaaccuggaaccaugccacagaccugcaggccuuuggugauaccuggcuaaauguccuugguaauucuaaacaauuuucauccuucccccccaccaauagaaaaguguuuggacuuggaccugcaaaucugguuuuaacuuuaaaguucuauuuugucccaagccauucuagugcaaccaucuggaaauaaguugguaugauauacacuuauguagucacacagauauccuacucacauacaaagaucgccuucaagugcauuuuuguuuugcuucucggagacaggguuucgugcagcccaggcaguuaaacucaccacguagcugaggacggccuuuaacuccugaccuucccgcuuccaccuucugagugcuagaauuacagacauacguuaccauggcaguuucaaaguccuuucuugcagaauccacuguggucagugugaccuuggagccagcaaacaugggucucacucuagauagcuucauaugguuuccagcccaggacccaccauagcaagccccugucaugggaggaauguccaaaacagcugccacaaugagucccuuaaugguguugacaugcucugagaaauagug

SEQ ID NO: 2406 - RNA, 2891 nt, Mus musculus
aguuauuaguuugauuuuauugaggguaaugcaacucagcagaguguauaaaauuccgcaaccagaaggguuguuuugugcacacagguaccucuacuguccaccagaugaacauuuuacuuacuauuucaugaggaugggaguuuugccucauuucugugugcucaccacaugugugcagugccccagaggaggagagagcggaagaggauguuggauccuguggcgcuggaguuacagagagcugugaggugcccuugggcuggagaggugucucaugguuaagagcacuggcuacuuuuccagaagacccagcucgguccucagaacccauacgauagaacauucauuucauuuaaauauaacuugucucccccgcucccgcuucaaggcaggguuucccuguguagcccuggcuugaacucacuuuguagaccaggcuagucuccagcucacagagauccaccugccagagccuccugagugcugggauuaaacguaugugucaccaugccuggauuuuauuguuguugcugcuguuguuguuguuguuguuguuguuguuguugagagguucucuuguagcccaggcuagacuucaauucacuaugaggcugaggaugaccuucaacuccugauuguccugccuucaccuccuaagggcggagacuauagguguguaccacggugcuugcacuguagauuuauuuccaguguauguuggggaugcguaaguguuagaccucagagcgcaugugcugcaagugcccuuuggguccuggagcagaugcuguaagcccauggggguggagggaagcugucuuguucacucaaaaccccacucccauacccugugggccccuuaggaggagaagcaguucccagccuuuccuggacccucacaccugacagauacaaacacacuccucagaauuaguggcucugaauagcccccuaacaacucuguuuccagcuguugccagacauuagauauacuaaauuccccguuucuccaacccucucucaaaggacccuccccaaagaggucaccacaaagaccuuguccuuugaaccauuugagcugaaaucugcuugcugguggcuccuugacaaauuuauagguacucagaaaacacaaacacuucugcauuaaacagguuguccuguuguugcuuuguuuggccugguguguguguguguguguguguguguguguguguguguggcggggggcagggugcaacucugcacaaauuaaagaguuaucugagaagagcauccucuuuugagaaaaugucucuaucagauugccuggaggcaagucucgaaugcauucuuucgacuuaagauugauguggguaggcccagcucacuggugggccacaccaccaggccuggggguggugcgugaguguguccuggaccauguaggaaagcagacugaguaagucacagggaaugagcuaguaacagcucuccuccgcggccucugcuucugcuccugcuuccagguuccugcucuccuugaguuccugcccucacuuccugugaugugaagagcaagccagauaaacccuuucuuccccaagcugcuuuuggucacgguguuucaucacagcaguaagaacccuaaccaagacucgggcuucgaauauaaaugcuuucaggaaccagaacauaucaucuaaugcguuguuuacuauaaaguuaugacugcagaucccuccuagcagugugggagguaggguuaucacuaaggaguagaaucuguagacugucaagguuggaagaacacuggguuuaagggcacgggagauggcuuugcguucagcugcagacguccacagguuggaccguacugaggagguugcgcugucguuguauucuuuggcuuugcaugggcaauccugacucugguccacagcugaccuugcucuuccuggggauguugugagacaagcgaaguugcauauauugaaaggucuucaggaaacgcaccuuccucugaugggugggucacugagggggacaaucauucuaagauccaagacgucucucaagggcaaccugggcugcaugggauaacaaggaaacuggaaugagugaaacgggaggguccagacacucagagaggcgaugaagagucagcccagacuaccuuuuuauuuccccacagcggcaucucucuuccuuucccucacucagaagagaaaaaaggggcacuuuuaaaugucaguuaaagccacgaacaaaugaagucugugcuuagaaagccagagagacauuccgguaggaggcagguaaugcgguggaggcggguaggcagacucagucagaggcgguuuuacuuucaacucguuauuaaacacugaccaguuccccaggacaaguuacuuggucuugcuuucuugaacugacaccuggaaaugagagacaccucaaauguuuguuguguggauuacaagggacaguauguuuucguuuugauuugagacauuggggcuuaaucccuguucugagcaucuuacuccagccccuucuuaaccgcgugcccccagguaugucuucccacguaggcgccgcugaacuggguuuagauaggucaaacuucaagcauccacugaaucaagggagaccagugucccggcagcucugccucuggugccacgggacugaaagguggccuaggcuguggaaccuaggucuccucuccaggcaggcacgggaagccagcucacguuccggagcagggccaggcagggaucaaagcgcucucaggcgggccggggcgcaccaaagggaggccggcgacuugcaucagcacagauuccgugaugcucugcagacgucugggggcugcuggcuuuacgggaagccacaagaaaggaaag

SEQ ID NO: 2407 - RNA, 1017 nt, Mus musculus
ggcgaguuggccacaggaaguuuauucucgggcuccuuuucuaaaaggaggaaacagaaguuucucccaaccggcagcuuuucuuuuucgccuuuuuggcgcccugagagaucggggagggagucccccagagcugccaagcgacacccgcggggcuccuagucuuuuugcguugcccauuuuucuccagcccgugggucccggcagagcuccggcugcgcgcgggggcggaagggcgcgcgcaggggagggaccgagggacgcgccgacuuuuuagagggagggacucgguggacaaccgguuccgcggagcuugcagagcagaaacgaagugcggugcgcggcgaucgggggggucacuucccgagugucgcugccuccugucugccuugguuaggggacaucccgggagcgaaaagcccagcccguggccgggccgguggaccagcgagcgcgcagcagacugugcgcggccgcggcgagggcggggaagaaaaccacccuguuuccucuccggcccccaccgcggaucauguaccaggauuaucccgggaacuuugacaccucgucccggggcagcagcggcucuccugcgcacgccgaguccuacuccagcgguggcggcggccagcagguacgugcgggccggggugcaccuggcggcgcgggcagacuccuacccucuucuugcucccacugccuccacccccaaccuccuucuuuucccuuuccuagccaggcuagaaaaauacuucaccgcuguaaguuguggguuucuuuucuuuucuuuuucuuuuuuuuuuuccuguuccgcccuacccacucuccacuuuucuuuuucuuuuucuuuucuuuucuuuucuuuuuuuuuaagcaaguggagagugggcuugaagagccaacgacacccucucccccuuuucguacuuaauuuuccagaaaagcucuugaaauuacagguccccuccgggaagccuguugccuccuuccgagccgcucucccucccuuuucacguu

SEQ ID NO: 2408 - RNA, 76822 nt, Mus musculus
agaggaggagagagggaggccgcggggugcgggcguccgggaguucccuccuccucaaguaaagcgucccgggccggcugcgccgccgucgcugccuccuggcgccccgcgaccuggagguggagaagggagagggacccgcgggcguccaccucggccggccgccuucuccccgcggcgacccgugcgagugcggccggacucagguaagcucgcggcguggccucgcgacguaggcagcugacccggaccgggcagcucuaggccucggcauccacccuccugcucccgggcuucucgaggcgccgccgccccugccgcuguccgccuacuggucccggagucuggaaguugaggagaaacuucuccccucccgcggucuggcuggcgggcgugagugucucgucuccugggcucacuaccugcuugcccagugccucggucuccgcccuguccaguacuucccgauucugcgggaguccggauagugguccagccuauguggugccgccgcugcacccuccaccccaaaggacguggggucacucccgaaugaggaccagaggguagggcagcggccccuucucguccuagcggcuggaggucugugucgccggacgcccgcagcaacugucuggagcgaggaguggaacucguggagcgagcgggugagcggcggguuguacuugguuugauugcaaaccacgaccuguuuauaaaguuuuccuuuguuuggguuugaggguguugggacguguuacaaucagcggccacuuuuaagugccuugccacuccgccuccccgugaguucgguucucuguccuccugugucaacgaaaauuuuguuuguguuuugcuucuugauaauugcuuccagcuuuugcuuuauugggcuugagaaagaguuguuuuuaaaaagugggaauaucguuucugguauagggauugugaauggggcauagcguaguuuugauguaguuauucuuugcauaagugauuggaacagcaguggaaaugacaguuaucaaaguaaauaaacgaaaaguaugcaguugaaacauaacuuuguaccucucuuguguguuccacagcuguguuuuuuacaugugauuucacaggauauuucgguaugguauauucauguauuucguguaaaauuacugaccaaaauuggcaauugaaagugaguuuaaacauccuguuaaauuucuaaauuuaaauuacucacuaaugaaaauguuauuaagugugcaugugugacucaauuuaaggccaaaugugugcuaccucuauuaaccagcacaaugguguggacuagaaacauuuugagugggcagauagggaguguuaaauuaaaagccaaaguucuuauaugcaacauauaugagagagaauacaacuguaggaaaguuguucuucaggaauuuuuuccgcuugcuaaaugcauuuagcuauaucuuauuuuugaauaccagcaaaaccucagugaaaauguagaugcugguugacauuucaguagguccuaaauuuaggggagggagaagauugccuuugauugaaacuuagauacaagacuguuuauauuccauauuuccaggauaaaauaaaagcuuuuaaaaugugugcuuugccauaaaacuacgguaauguuauaccuuuaauuuuguagcuaguuuuugcugacuucacaaaccacaaaauugacuccuuucuguucaacugaaagugaaauuacagccuugaccugucuucuugggauaggugugaaauuuaucucauggccaaaggauaauauuaauauauagucaaaaauuguuuuuaguugaagaaauucucaaaaaaacccauugucuuugcaaauaaaauuuuauuucauugcauauauaaauaaaagaauaugcuaaaagaguagugaaauauuacuacuuguauacuuguuuaaauccuuguuuacuuacaguucaaauuugcauaguucuaacaguaauagcauacuacuguggguaauuuaaaaaaauauauuuuauuuauauaaguacacugucgcugucuucagacaccagaagagggcaucagaucccauuacagaugguugugagccaccaugugguugcugggaauugaacucaggaucuccggaagagcagucaaugcucuuaacugcugagccaacucuccagccuugguaauuuuuaaaaaaaauauauugagcuuccaauuuagugguucagguuggugugagcaucauuuauuagucuuauuacuuauuaccauuguuuaggaaagaaaccugagcagauuuuuuuuuuuuuuuuuuuuuuugaagagcauugcuagguucugaugucuagggaugcaaauuuaagugauaaaacuauuaaaaaaaaaacuacaaggaagugaugcuucuauccuuggggucuuggagguguuaguuuuaauuuaauuuaugagcucauacauuuguguguuuguuaccuggguuuuauauuuuacauaaaaauauuuuuaagaagccugaauguaaugcaguauagaaggugcuuagguuaaguuaauaauuuucaagauaaucugguuuccugucacauccuuuaaucuuuucccuguugauuaaaaauuuuagucauuggugucuagcuuaagggcacucccugggcucuucuuugcuaacagguuuagacuucuugcaucauaaauaucauauacuaguuugugugugaaaauaccacacacacacacacacacacacacacacucacacaaaaaaaucuaauaaaaaaaaguuaaaaaaaaagaaaauaccacacacuuccaaauguucuugauuuuuauguuauuuuaauguucugagagguguuauguguuauuaauuuuaaauauaaauaguaaauagaaaguaaucaaaauguuuauugaauggauagguguucuuuuaucagguaccuaccuuucagaaaaucagguaccaugacaaaacugacauagcaagaguugacuuucauucauuuuuuuuuccuuaaagcaauaaugcuucaaauaagaacaauucagugucaguuuuaacauaagauuuuucauuguguagugauuuucccuuuaauuacacuuuaugagguuuguagagucugaagcaauaauauacuuuuguuacagaaggaagcaaugacaaugguguuucagagacagagugguugccugaggccgcuuuaguuauucuguguaguugcuugcuguuuuagcuguugguuuuguuacuuuauguugauguaauggagcgcugaagaagagauugcaucugugccaaguucaugucacaggaacuuugccucauuguaaaggcaauguuugugauucuguccuugugugcauauuuacaggaaauuuuaguaagaucuuccauuguucagagagcuacauggcuaggucaccuuugguucacauuuaaacuuacuuauacuaaagauacaaguccucuagcaaaagcccuaacugcuucucuucagaggaaauaaucuguuccuauuaaaguguguuggugucuuaccagcacuguguacagccacuuauguaugacuacaaucggguauauauuuucuuuuuucuucucucagcugcuccagugccacaauuagcugaguauugcucagcugcagcugcugggugauuaugagccauccagcuccugucuaaacucagagacagauuuagcaaaggagcuauaguaacagccgagauagaaagggaagagccagugcugcugccaguaucauuugagcaagucugugccaagggauccuuggcugcugcagcacuacuguugucuuggaaccagccgacuugauggcagcgugucuguaucugaguggagguuuauaaccuuaagacugggaaacauacuccaagaaaaauggagaaugcuaugauuacaaaguagagugugauguacugauggcaugaauuacaagccucggugccucaucuccuugccuagcagugccuuucagauguuggguuuuaagaagcauguaacauauuucaaguuagagggguggcuggauugcugauguacauuaauuuggacucuccuacaaaaaguagaagaucccuugagagggguuaguucuagaacuagcuacccccuguugucugaacuuugaaaauagaaaccccaaauuccuuuuucuuacuguugguauuugagaagcuaagccucaacaaguacagguacuaguaauccaugguagucaguaagaggaggugggauggggggauugggaguucaaggccaguauuaccuugucucaaaaguaaaagggggaaaugcaaacacagugucagcuauguauggcaaaccagacuggaagagaccaggagacgauuuugcugccugugaaaugauaaugcaucguuuuauacuguucuuuuuacagcuaucuacugaaaauuagauggaacagauccuuuuaauaauccuggaaguacuggguggcucaggguuugggcuaauuugagguagggauuagaaauaguucaaauuagcauaacccuaaggaagagaugcggaagacugacugguugaacaugaucaagaauacauugucauuaggccacugaacaauagacugguaaaauauuuucuuccuuugugucuuacaaaguucauaugacuaagcacauuucucauaaaauuguaacuaauuucuuucuguggcucuuauaguugauaaaguguuccugagucaaggugcaguuuuauaguaauucacaguaaauauuuuuuuaaagauuuccuuauuuauuuauuuauagagugugucucucugugugugugugugugugugugugucugugugugucugugugugggggggaguaggugagaggacauagcuggagcaacugaggauagacucccuagaguagcauacuugugauuuagcauaaugaaucaagaccuuuauuccuugggaauaagaaacggugguagaaaagaagggucuuuuccuuuuucuucuauuuuaaaucauauauuugaauugggagcaaaaccaaccaaccaaccaacaaacaaaaaaacaaaaacaaaaaacaaagacaaauauucacuuacauuuuuguuguuauuuguuucuuugguuguguguaccguuuuacaggguaaccaaacuggccuugaacuggcucuguaacacaagcuggccucagauuuuuagucuucuggccuuugcuuucugcuuccuagggguggaguuagagacaucaaccacuaucuaacucuuacuuuuucuuuucuuuuccuuuucuuuucuuuguuuuuuguuguuguuguccuuguuuuuucgagacaggguuucucuguagcccuggcuguccuggaacucacuuuguagaccaggcuggccucgaacucagaaauccgccugcuucugccucccaagugcugggauuaaaggcgugcaccacuaccacccagcguguuccuguaaaucuuauugcuauacaaauucuucacuguuugaacaaaaguuuccguccagagcucuaaauggaaguuuuguuugcuacuuuggccauguauucuuauguuaacauuucuuccuucacuaccuuagaagucuucuuuggcuuccuuuuaugucuugaauuguaacugagauuauacuguuaguccucccucgguaaacuagaauguaaguuuucacaugaaaauugacaggcuuuauucuguuauagugccagcuauacacuagaauuuaagcuuccugggguggggaguuuuguuauacuccuaaaauuuuccaugaaucuaaaacugugacucuugugaaguguuuuugagucuaggggugugcagcuggcaguguuugcuuaucacagacccaucaacaaauaccucauuaaacucaugcaacaaccacagguuuuuguuuauacuuaauuuuuuuguguguggcagagcuaauguaauucagugacaguuuuuucaaguacauucaaauaagcauuuaacuugacugauguuugaacugucaaggagagguguuaaagaguuaucguggauagcccuggggcuaaugauauuugauguuaauuccauucuccuaugagggguggggaacuaagaaugagucugcacucaggugauuuccuguaaaccugcuucccaccuuaauuuauaaaauaaaggagagcugaugauugggcagauaaagggaagguggagcagaagguggagagagaaggagaaaauggaagagggagaggaugcagaagaggaggaagaagaagaaaagcggagcagaagcacauggccuggagaauccgcaaguuauaaggggucucauagauguggaagaugguauuguagugauagaucugcccaauccaggcgcacagccuguauucauauuaacugaguuguguuuuccuugcuugggcauauuuggguuggagaaaucuaccgcaacaaagaguaguacuuaauuaucccuaagcacaauuacuauuuucaaugaaagcauuccguuuaugucuagagaccaugcuucuuaaaaacuguagcauaugucaguuccugcuauauuaacauuaauguaaacaagucauauggauuuaccagauggcuauaagaagagcugagcaaauaauccuuguuaaggcacccuaguuucuuagaacaacuuuacacacaggaggagaaaaauuuuugguggauagauagauaucucugccacagaaaugacccaguaauuaaacaaguuggauaguguuagaucacagaaaccuaggacaugucucacucaauaccuguggcuccucccagcccuucucacacuacuaacuacccuaaaccucucucucccagggucugggcuuccacuucccuucccccagcuucagauuccacagccauuuugguuauguaccuucuagguuuccggacuagcucuuggaugcuugguccauggcuccccucuuggacuacuugcuacuccccuucucuucccuacuugcucccuuuccccaucccuccucucucauggccccauucagucugcuggcuauacuuagucuagaccauucuagaugcugucccuccccaauauaauauguauauguauauauaaaaauaaaauguauguauauuucuuucuuuuuuuuuuuuuacacucgagauuuuauuccccuccugguccacccuccccccuuucccgguccccuuucccucccaggcuccucccucccaagaaaguuuauuuucuaagcuagagagcaucuguuaaauuuaauuuggcauuugaucuuugaacuuaauuuaggagcacuaagaaggaaaaaugcuggccaucugcagauucuugacagaaucuuuggugguaagggcagugucauccuuaaaaguccuaggaaaaacaguuuuucauuuuaagaaguacccugacuuuaggaaacauuaaaaucuacauuuacuaauguguagcuuaagauucuaaugggcagcauggcagcauuuaauuuguugauauuuaaguuucaucuucuguauacaccucaguguaugugugugcccuuuugugagugcaugcacccuugggcaugagaagaggacauuauauccuccggaauuguaguuacaguuuugaaccacuguacaugcuuuagcggcaaguucuuucaaccacuggaucaucucuccagccucacccaacuuuuuauaggaaaaacuuaugaaacauucugguuauggugguaaaggagaguucagacuaaaccuaggauuguauuucuauccacacaguccuucuaguauuugaaaagugagcuuaaauaacaaugucaacgaauuugaugggagguaguagcugguagaaauuauaguggaauuccucacccucuucauugucucagaaaucucuuagucacuccuauuggaacucggugguaguuuuguguuguucuaauaauagaggggguuuugaacaucuuaggauauuaaccagagaacaagugagacuuuuagaaugucuuaggaacgugauaauacuaauaaauagcaagacacuguuucaacuuuuuaccuuuucucuucucuucuucucucucucucucuuucuuucuuuauuuuauuuuauuuuauuuuuugagacagaguuucucuguguagcccuggcuguccuggaacucacuuuguagacucugccucccaagugcugggauuaaaggcgugcaccaccacgccaaaacaaaucuuaugugaagguguaguuugagauauuuccugaccucuaucugagucaauggaaguaugcuuguucaucaaguguccauuguguacaucuaucaguugguuaaggcaaagaaaaaagaacugucagacaucauauuaguggacuuugaugaaauggaauagauauaaugcaguguauuuuaaagcguguaauaugugauauaauacuuaauaaaaaugaaaaauacuuuaaaauggaaaagagguuaucuagcuuuaaauaauaucaggucuuuaguuugagaagaauuucauaucuuauuuucuuuuuuuaaaauauuuuuauuacauauaaguacacuguagcugucuucagacacaccagaagagggugccagaucccauuacagaugguugugagccacuauguaguugcugggauuugaacucgggaccucuggaagagcagucggugcucuuaaccacugagacucacagaucagccugcuuuugucucugccuuugacucugccuccccccacccccaagugcugggauuaaaggugugcaacaucaccagguuuauuuuucucuuuucuauaauuaacucuuaaugaaaugauaaaaauugauuuaucuuuaaaaaauacucaaagcuagggauguugauagacuaaaaauuauuuuuaugucuuuccagguguguguuuaaagaaaaaugaacugaaauauguaggcauguuuuuuuaaauuuuuuauuagauauugucuucauuuaccuuucaaaugcuauccuuuugggucccuuauaccccccccccccgcccugcucccguaccaacacacucccacuucuguagguauguuuaauaucuaugaacauaaacauuuguuauuuuuuauauauauacauacauauauauauauauauauauacauacacauauaugagcaaagauacuuuaaguuauuuuuugaguuuuuuauuuguuuuauuuuggaguuuuuguuuuguuuuuguuucucguuucuuuguuuguuuuaaugguuuagcucuauugcccagucuagcuaagugauccccuugccucagucuccccaauuguugggacuacaggugugugccaccucauccaaccuuuuaaaguuacuuuaaauguguccucaauugaaggcucuuguacauuuuuguuuguuuguucaguugguugguugguuuaugucucuuugcuuguuuuugagaugggaucuuuguauauaguuuuggauggcauggaacuuucucuuuuuuuugguauuuuuuuguuguuguuuuucgagacaggguuucucuguauagcccuggcuguccuggaacucacucuguagaccaggcuagccucgaacucagaaauccaccugccucugccucccaaguauugggauuaaaggcaugugccaccaccgcccggccagcauggaacuuucuauguagaucauguaggccuugaacucacagauauccaagagccucugcucuuggaaauuccaugucugauugcuuuucaguuaauucccuuagcuuuugcuguuuaauuaaauuaugcagaaacaauaacuacagucuaaauucauuuccagcuugucaccaucuuauuuuguucuauuguuguaguuugcuuucuauuucugugagaaaacaccaugaccaauagcaacuuggggaggaaggguuuauuucaacuugaaugcauaucacaaucuaucacugagggaaggcagaguaguaagcuggaggcaggaacagaagcagaagccaugucugcuuacuaagguuugcuuuccacggcuuucauagcuugcuuucucguauaguccaggaccaccugucuagggguggcacuguccauuguggauugggcccucccacaucaaucauuaauuaaggaaauacaucacaggguugccuacaggccagucugauagaggcagucccucaagguuccuuuuucucagaugacuuuaguuuguauuaaguugacaaaauauuaaucagccuccugugggcaccauucacaggucggcugcuuucaugcauguguaguguguaucugaauccagaugaagguuuccuggaacugggacaugugggugcuauugaaugaaccaaggugcuaugggagcaaccagugcccucagccuccaaacaugaauaauaaagucuuguucucuugaaaaaaauaaaaauauuaaucagcacaguuguuagguagcuuuauuaguauuuucagauuggguuaaagaauuacuauaaguuuuaaugaaaguauuucuaauauuugucacuaaguagugauuccaaaauuucuuugagcuuuagauauagaaauaauguuauggaaggauucuucuguuucuguuccaugaaaguucuuauuuuauaaauggagugcuuaauuucuuuucuuggcuuuuuaaaaauaaaguaucucuuuccucuauccuuucguguguguguguucacauacacccagguaaaugugugaggcaaugagaggacaacuuucaggaguugguucuuuucuucuacuacauggacacauggaucccagggaaucaaacaaacuuagucauuagauuuggugucuucaccugugaagugauugccuucagauucgaucccuagcucugcaaaaauuaauuaaaacaacagcauuuagauuuuuccuuuacauaaauuuuuauuagagggaaauuugauauacauuacacuuaacauauuuggagcuaaggguauuauagcuggguguuaacaucguguguuuaucaugugaggcuccagguucaguccccagcuucaaacaaaauaaaacaucuaaccuauuuauaauaauauuuucuaucaaaauaaauuauauauacaaaauguucuaguuaauuuuuacuguuaacuugacacagcauacaucucucaagaagagagccucccuccacugaacuauugcacagaucauacuggccugaaaccauguauguuaaguauugucuugauuuuugauugaugugagagggccuaguccacuguggguggcaucauuccuuugacaggugguccugggcuauauuugaaagcuaacuaaccgugagccagagagugaaugaggcaaccaaguagcaguguuccuuaaugguuucugcuucagguucuuguuugaguuccugcucucacuucccagugacagacaaugaccugugagcugaaauaaugcccuuucaucccuuaaguugcuuuuggucagagugauuaucacagcagcagaacuuuagcuagagcacaaaauaauuauuucugguuauguucuauaaaaucucuuuaacauaaguuaccagcuacauccuuaggagaagccuagaguuaggaucauaggagcuuuugcaaauaaacuguaacugcuacuuguguuucagcuuaaacauaccuuaaauuauauuauugauuugguaacaucgaacucagaaaaauaauacuuuaguucaugcuaaguacagcucuuugacacuucuguuuucucuguaagguacagcuuagacuuuuacaucuguauauuuuuauuuuugaaaauaaauauacaucuguauauuuuuuugaaaauaaauauacaucuguauauuuuugaagcagggucucuuucacaacucagugauugacuagacagguaaguucuaaggauccuucuguuucuucuuccauauuguacagcaguuuccugagaucaaaaccuuccauuuuggagggaaccuucuuaagauacaggauguaaaaaggaaaauggaacaacaggauguucuaagaggagggaaaacacuccagccuguacagaaucuccuuagcuaugaaguaaaucaaaauagcuuuugggagucccugaaacugaccagauucuccaagaauguauaagcaguaaagacugagaauuauucucaagacaagccaauaccugaaagacucucagacucucuugaagagacucagaccagccuagcugccugaaagaagcauagaccagcacagcuguuuauaagagguguagaccaauggacuaccaggaaaggacacucugcuuguaggcugugcaauguggcucugguuuccagccuucaugcuugcaugggcucucggugauguagcugucuuuaagucauuuauggucuuauuacaaguaagcccucacccauauuccuauaagcaacccugguaaaacuuauucguucaucaaguugaacuuugguaguaucugaacuuggucugugucauugguucccugucugggguguguagauauuuguucucaucuuccuagggauagugucauucauacaguauuccccaacauugagauugcaagcauguucugccacucugguuuugauauggaugauggagaucagaacucagguuuuucaugcuuagucagcaaauaguuuacuaacugaguuauuuccauagccucuucuuucaucuaggcauacuucaccaugaacccuaaaucccaguggggacauuuaaauagcaaaauaaaauguacaaaaauggaaaaaaaaaacccacuaaagaccacauaaagggcacucaagaaagcaguaggucaccuuguuuugucuaugcuaggaauauaugcaucugucagcucaauuuuuguaaugccuucugaaaugccuugaacauucacugagucaaguaauuuuacuaagggaaugaaugaccacauguauguuaauaauaauauuucuaguaguaaauauuacagaucaauuucugggcuaaccauaauaauagacaaagauccuauuccaacuuuccguaguucuuuguaugcauugaucaaacuuagcacucauguagcaucuccucuccagugugggacaaaaaggaggaaaaaagacuuuaguguuuaguggugugggagagaaggaaaucacucaacucuuccaucuuuaaacccuggaaguuuugguaauugcuguauagagggccgcuucuugucaguauuaguaauccaaauuucaaagggggaagaugaagagacacugugucucuuauuggcuuauuuucuucuaugaccuaguaaaaagaguuaaauccuauugacuaauacucauugcuuuacuuugagaguuaaauuaauaaaugaaaacauccaaauugccuagcaugguaauacacaccuuuaaucucagugcucuagaggaagaaguagguggaucucugugaguuugaggccagcuuggucuacaaaguaaauuccaggacaucuaggaccauuauacagagaaacccugucucucuaaaaaacaaaacaaaacaaaagaaaaaaagaaagaaaagaaaaaaggaaaaaaagaagauagagaagggggagcagguuguauuacuuacuacagaguucaccuuauuuuauucaaaacaugguguuuggacuuuaacaauagcugucugucguuaucuuugugcucuauaaccucagauacagccaacaauaugacuuagggguuagggauauaguucaaugauagauugcuaacauuaccuaagacacuggguucaaccuuuaguaccacaggguggggagguguugaaauaagcuguaucuguacugagcgugaagacuuuccuugucauuauuaucauauuaccauauuaccuugcauauuaccagcuaauagaaagauaauuuuaaaguauaagugagaaaauaaguagguuacauguacauaguucacccuuuucuauaagagacuugagagcccauggauuuuggcauccugauuauauuuugaguauauugguauuguuccuccguggauacugagagacuauaugcuaauuugcuaguguaggcgcuaugaaagccuaagucaugacuccccaagaucacauccuaugaauuccaggaauucauuauuugucuuacauugucuauauuauaauauugucuauauuauauugucuuagucuguuuuguuauuaacaguacagggacugguagcuuauagaaacuaaagguuuauucaucuuacuguuuuaaaggcugggaaugucuaauaaugaggguuguaucugaugagagccuuguugacagagacacuauagaguccugguguggcgcugagcaucacauaggaagagauacaagagauaacuucaaacuggcucugacaagaaacccaaucuggaaacaaaccauuaguuuauuauugagaaacaguuuaauccacucaaaggaggagccuuucaugaucuucucaaacaccuuauggucauauguagucuguaucaccauaauuucucacaauuucaacaugaguuuuggaacauuuauuuauuuaaaagauuuauuuacuuauuauauguacguacacuguagcugucuucagacacaccagaggagggcaucugaucucauuaugggugguugugagccaccauaugguugcugugauuugaacucaggaccuccggaagaggagucagugcucuuaaccgcugagccaucuuuccagcccagcuuuggaacauuuuuuuuuuaagauuuauuaauugauuauauguaaguauacuguagaagucuucagacacuuuuucuucucacuccagucccaauugcucgcuguagcugucuucagacaccccagaagaggguaucagaucucauuauggaugguugugagccaccaugugguugcugggauuugaacucaugaccccuggaagagcugucagugcucuuaacccgcugagccaucucuccagcccuggaacauuuuugauaugcugucuuccccccccccuuugauuuaaguuuuauugcauuaugaugagaagagauacauaauuucugaauuuguuaacacuuaaaaacaguuuuugaguaauuagacuuacaucacauucuucuuucccuuuuguuccccaacuccuccuggagagccaccguccuucagaacuugcaaugucuuucauuuuuuuaucauauucuuuaaaauuuauaaaauauuguaacaauaaaaaugaguuauagccgggcgugguggugcacgucuuuaaucccagcacucggaaggcagaggcaggcggauuucugaguugaggccagccuagucuacagagugaguuccgggacagccaggacuacacagagaaacccugucucaaacaaacaaacaaacaaaaaaaagaguuauaaaaguuguuugauauaaaacaacaaucaauuaaacagucuuauguagauguuugucuacagcaauagugaaaaugcauucuuuuucucaguauaaauuucaaauaacuccaaauauauuaacugcaugauauuuuauaauaauauaucacuauuaggguuuuuuuuuuaaagauuuauuuauuuauuauauguaaguacacuguagcugucaucagacacaccagaggaggacgucagaucuuguuacggaugguugugagccaccaugugguugcugggacuugaacacuggaccuuuggaagagcagucggguacucuuacccacugagccaucucaccagcccuaggguuuuuuuaaugaacauaaauagauaaaguuuuuuguuuguuuuguuuuguuuuguuuuuaguagagcuuaaaaucuuggcucuuacugugguacaaacccaaaauaagaacaguuuuuggacauuggaauucauuguaauaaggcuguaugugaaugucccucacgucccaaaggauuuuaccuccauaguagauaagcuuagaauuggcaguucugcugcaccaagggaugaauuguaggcacgauuuuuggauacagauuuccugcuacagucaaagcuguuugacuugagggaacagguuacauucauuuaagaaauugugugucaagcagggcagguaccuggaggcgugaacugaagcaggggcuauugaggaguacugcuucauggcuucuucaugcuuucucagucugcuuucuuacacagguaagggccacauacucagugacagugguagcacccacaauggacugcacccuaccacaucaaccaaccaucaagaaaauucucacagacuugcccacgggacaauuugguagggcccuuuucucaauuuuacucuucccaaugacucuaacucuagcccaugucacaucaacauaaagacuauccaggauguuguguaagcacauuaaaucugaacagguauucuuaaaauaguagcacauuauagccagugguauauuuaaaaauacaaauaaaaaauaaaaaauuuaaaaauuaaaaacccaaacacccaaaaugguguguuuauuaagauguucuauccaugaagucauucaucaacuguuucauugaacaaugguucugcuuggaggguggcacagacauuaggugaggguaagauucuaguuccuuggcugugaugauuuugaaaagcauucauuucagaauaagaguaacuuauaaaguccucuucuucaaaauugauacacugauuauaaauaccaagcaaagccuucagucuuacucuuugcuguucucuuacaagccaccucccaaauuaauugucuacauuucuuuuggcuguauaaauaauuuugaaauguguaagcuguucugaaaaccauacuauaguguaaaaacaucaaauaaacaauccuacuaauagagaggcugagauaggagaagcaugauuucaagaccauuauguggcacacaccaagacccugucacguacaaacaagcagaaauuauauauggauuguacaauauuggaccuauuucucccauuaccaaauuagagagaccaugggaugacagcugacaauuuuuuuuguuggguuuuguuuuguuuuguuuguuuguuuuguuuuucgagacaggauuucgcuguauagcccuggcuguccuggaacucacucuguagaucaggcuggccucgaacucagaaaucugccugccucugccucccgagugcuggaauuaaaggcgugcgccaccacgcccggcuacagcugacaaauuucuaauuccucauauuuuugaaucucaaucgauuaggauauguugguaauauuaauuuucauauuaagagauauuaaggaaaagugauuguuucuuccuguuaauuuucuuguuagaaguggaauuauguuuguguggguuuguugaaagaauacuuucuugcuucuucuaggguguaguuucacuccuuguguugguguuuuccaucuauuauccuuuguagggcuggauuuguggaaagauauuguguaaauuugguuuugucauggaauaucuuuguuuucuccaucuaugaugauugagaguuuugcuggguguaguagacugggcuggcauuuguguucucuuagggucuguaugacaucugcaaaggaucuucuagcuuucauagucucuggugagaagucuuauguaauucuaauauguuacuugaccuuuuuccuuauugcuuuuaauauucuuucuuuguuuugugcauuugguguuuugauuauuaugugucgguaggaauuucuuuucuggucgagucuauuuagaguucuguaggcuucuuguauguucaugggcaucucuuucuuuagguuagggaaguuuucuccuauaauuuuauugaaguuauuuacuggcccuuuaaguugggaaucuucacucucuucuauaccuauuauccuuacauuuggucuucucauuguguucuggauucccuggauguuuuggguuaggaguuuuuugcuuuuugcguuuucuuucucuguuguguguuaauguuuucuaugguaucuucugcaucugugauucucucuucuaucucuuguauucuguuggugaugcuugcauguauggcuccugauuucuuuccuagguuuucuaacuccaggguugucucccuuugugauuucuuuauuguucuaguuccguuuuuagauccuggaugguuuuguuccuuuccuucaccuguuugguuguguuuuccuguaacucuuuaaggaauuuuuguuuccucuuuaagggcuucuagcuguuuaccuguguacuccugcauuucuuuaagggaauuauuuauguccuucuuaauguccucuaucaucauaagaagaagugauuuuagaucugaaucuugcuuuuccgguguguugagguaucuagaacuugcuauggugggagaauuggguucugaugauuccagguaaacuugguguauuggcuaguuuugugucaacuugacacagcuggaguuaucacagagaaaggagcuucaguugaggaaaugccuccaugagauccaacuguaaggcauuuucucaauuagugaucaagggggcaaggccccuugugggugggaccaucucugggcugguugucuuggguucuauaagagagcaggcugagcaagccagaaaagaacaucccuccauggccucugcaucagcuccugcuuucugaccugcuugaguuccaguccugcauccuuuggugaucaacagcaguauggaaauguaagccgaauaaacccuuuccuccccaacuugcuucuuggucaugauguuugugcaggaauagaaacccugacuaagacaaauugguaccagcagagugggguauuccugugacaaccugaccauguucuggggaggacuguggaaggacuuuggaacuuugggcuugaagauccauccauuguuaagagcucugucagauguuguguaggagcuuggaagauaauguugagaacacugcagaagauggaggucugguuugugaaauuucagagggaaaauuaaagacucuuuucagggccauugcuguuuugauugugaagauucuguaguucugguuagcuggggcugaagaaucagcugugauuaacaagauaccagaacuacuaaagcaaaaacuuugcauuacugggacuuuugaugcugguuagcuggagcuaagaaauuagcggugauuaagaagagaccagcaucauugaggugacaucuucugggaaguguuuucugagagcacaguggcugcguuccagauauagccaaaguuguaccuugugcucuggcuggacuugguaacguguaagggucacccaggugguacugguuuugaaggcaugaaggaguugagcagagcagcugaggcuuggcacugugagaggccauggaaggccauuggugaaagugcagccucaguugcaauugauggcccaggacugaaggggucaugcaguguuuuggagaugccaguaccaugagaugaccaccaagaggagcagcagcaguggaguagaggcaucuggagccuagaggaugacgcgugugcuacaaagggcauggcuggagaagugacccaagcccuuggaggagcccagaagaucgugaguuggaucccagacauuggacgguuggagauugauuuuugcuuuugauugugacugugcccugauauuuucccucuugaaggaagaaacuguuuuagugaugcccacaguuaagagacuuuuaauuuaaaaagacuuuggauuuuuaaaagagauggauauuuuaaagagauugaaauuuuaagaauauguaaagacugugggacauuuaaaguuauuuagaccuuggggaugaauaagaauguaaggguugaggcuuacuagugauguguuugugugucaaguugacaaggggucagcuguauuggcuaguuuugugucaacuugacacagcuggaguuaucacagagaaaggagcuucaguugaggaaaugccuccaugagauccaacuguaaggcauuuucucaauuagugaucaagggggcaaggccccuugugggugggaccaucucugggcugguugucuuggguucuauaagagagcaggcugagcaagccagaaaagaacaucccuccauggccucugcaucagcuccugcuuucugaccugcuugaguuccaguccugcauccuuuggugaucaacagcaguauggaaauguaagccgaauaaacccuuuccuccccaacuugcuucuuggucaugauguuugugcaggaauagaaacccugacuaagacacuugguuucuguugcuuauguucuuauacuugccucccgccaccugguuaucucuaguguuaccugcccuggcuaugucugacuggagccuguucuuccugugauccugguugugucagaacuccuccaagucaagcugucucugggauccugugauucugggauccugugauccugagaugauccuggugugaucaagcuccugugauccugugauccucugauccagggcauauuagagcgccugugaguggagcugccuauggguguuguggggcuggcugcagaguuugugcccaaggucuacucuauuuuuuuuuuuuucccgagacaggguuuuucuguguaacccuggcuguccuggaacucacucuguagaccaggcuguccuggaacucagaaauccaccugccucugccucccaugugcuggaauuaaaggcgugcgccaucaugguggaucuucuugccucaaccuaaucuaaauaauaugccaucugacaugccuagagacuaaccuaaucuagauaaucauuucacaaaagguuggguacagacaccuguguuugcacaugcuuuuaagguuucuaauaaacugagauuuugcuuaaaauuugaaauagugccuccuaggauaucuggauugaccuaauauauuuuaaaagauuuuuggguuuuuuuuuccucugugugugugugugugugugugugugugugugcauccccauccaaaucuaaggugggacuuaaguuucugguuuaaguuuuuuucuuuugaccgugaguuagauuuggucuggagucuuaaugaaaguaaacaccuucuuuuauuagguuacaugguggagucuuuguuguuguuguuguuuguuuuguuugagggauguuuuaauuuuuuuugccuauauuaguaggucuuacaacuucaagauagguacuauucuugcagguuuugggcucagucaggguuggaaguggggaagaaguuggguuuagaaaagauuaaagagcauaauaaguggccaaaccggaacugaacuguagauccaaacccaaaguuauuucuuauccguguacuauguacaaaguacuguguggaauagauauuaaaccaaccuacgagcuuuucuccuuggccucuuuguucccaguuaaacuacucugaaacuuaauuauuuaugaauaaauaccuaggccauaagcuuuggcuccuuccuugacuagcuuguaacuuauaugacccauuuauucuagucuguauuaccucuucucaguuucauuuguuggucuccuccaaguccagggcaaaaucuccugccucugacuaucuucccagaguuccagucuuccuacuagaacugccaccuucuuucuuuuuuuuuuuuucuuuuaaagauuuauuuauuuauuuauuuauuuauuuauuauacugucgcugucuucagacauaccagaagaggacaucagaucucauuacagaucguugugagccaccaugugguugcugggauuugaacucaagaccuucagaagaacagucugugcucuuaaccgcugaacuaucucuccagccccaagcugccaccuucuacuuccugccuuuuacuagcuggcagugcuuccacaaaguauacaagacauuaucccuaccuauccccgccaccaaaaauuuucuaaaguuuagaauauaaagagaauuuugguuucuuuaaaaaccuaguaugugaacauguuuuugcuuuaaucccaugugugggacaggagggugcuucacagcaggugauuauuauuugccuuguacucuagcaggggcaugucuuugccagcugcaaaaauaguuucugcaagugugugacauggcauucugagaacuuuugagaggguauaaaugccaucccccugagaagagccagaacaccccagaagugggaacuccugcugaacacaaagcuccuaaucagcaggaaguacucuaaauagaucuauggcccuuuccccucuuucuuuuucaccuacauaauauugggacauuggaagggauugguguggagaagggugguagauauaagaacccaauaaaguagcccaaaaaguaugcuuacguuagaauucagagaagguuggaggcauaaacagacagugauguaaguucacaaaguuaaaugcugugggggaaagaaugagcugugagaacacaagaguauuuagggaagauuucaugacuacacaagauaaggcuggaggagucauaaacuaacuauaaaauaaaagauugugccaaacagcuaagaaaacaauguggugcacuugagaaucuaaaagauacaucagaaagauaaaauacaagaauagacaugaaaaagccaggagagggaaguuguauauagcauaggagaguaaauuguguauagcauguuaaggaauagacuuuacagaaagggaaaggaucaagcuauccaugacuuguaaucaaaaagauuggagaacaaauuaacacuagagacacaaggauuuuggaaugaucuagacaguacgugaucaguaguagccaagggaaguaguaauuaauuaguugaggggagaaguuuuguuuuauuuuaacuagauuauagaguuguuugggcaggucuucgugacuaagugacuaaagaagcauggauggaugagaccaaagugccucucaagugucuaagguagaggggagugcuguucucacuauucauagaggauuugugacaaaaauagaguggucuguugugauaggaaaaaugacaagucuuacuuuggacaugauaaauuugaaaauauuggaaaagauuccaauggauguccuguagacaacuuuaccaguuuccaaagagccuuugggugucuggaaaagaguguaggcaucuguuguuaacuggacuugacuuucauaugucagaauaccuaagagaaaucaauuaaaggaagaaagguucauuuugacucacauuuucagagguuuuaguuccugguuagcugcacuagggucaaggugaggcauaacauuaugucauggagcauauggaagagcagagaugcuuacuuuauggcauccaggaaggagaaagaaagagggguguggauggagggaaggaggaaagaaugcagacccaggaacaagauaacuccuucacugacauuuuccuagugaugaccuugaauuaugaauccaucauugaauugauccaagaucuucaagauccagucacacagauuauuaaaaccaaagguaaaaucuuagaacuuugcugccaaguacuaggaggugcuauugauuccucagacuuuucgucuuucccccccacccuaugaagccuguaccugggaaguuuuccaaaugucagaagacugacugucuaagaauagagguaaacaggggcuccuagccauagugggaagagaugaggaaauaagcuagccaauauagaguaaccagaggaugaccuucaggagucuuggucucacugucugcaggguacauccacacuaauacaauacaacuaaaaaagacccacuaaagaaagggguaggauagauuaaaauagcaauaaaagcauccuaaaaaaaauaaguccaguuacuucugaaaacccugucaauuaguaaaugagccuuuugaaacauuucagauucaaaccuuguguuaguguugcaaguguaaaauacucugacagaaacaacuuggggugugaaaggguuuauuuuagcuuacaguuccagguuauaguccaccauagacaucugggugacaaaacuugaagcagcuggucacaucauggucgagagcagagaguggauuuguauguacucauuucccacuuuugccacucuuuaacucucucugcucuuauacuguuaugcucuagguccacaggaaacccacgggagcccaagaauuguaaagucugcugcaacuugcaaaagagucuuuuauuuacaaguucgaacucgguucgcccaccuagcacucacugcgugaaugcuggcaagcgacccugagcccagaaaacauuggguuuacauacgguauaggaauagugugaauacuuacagaaaaggggaguagaggguggaaugaacugaagugggaggggauaaugggugucuguucaaggacuaauuuuauggccagucauaacugucugugaccugaccucugcuuaccuuuuauuuuuccaaacagaaaauggucuucuugagcuuguuaucucucuaaggucucaaggacaggcaccuggaguucuuaucagcaggaguguugguuuuuggagacacagagucuccucauuaugauugauucuaacgcuuggggaggaggagguagcuugggcugcuuggaguggguuggggugggagggucaggggugguaguggaagaaaaugcuuccauaagauugggcuguacacaaaccuguagggaauuuucuuagugauucauggggucuagcccacugugagugguacucccuuggcugguggccuuggguucuauaagaacucuugccacucagagugaauaggucuucccacuucucuuaagauaauccucucacuuccacccccauccccauucccaacuugcuuuaaacauuauuuuauugaaauucacuucccagaugauucuagacgggucaaacuuacaacuaaaacuaaccaucauaagccauaacaacaccuaauauuuuagaugaucugggguuuugccuguuaauuuaaaaaguaaacuuauguuuuuuccaauaaauuauuggaaaaucauugcuugccuaugcaauucuaugaacuuuuaggaguaaacaagcuuauuuuaaaagcaaaauuagagcugggcgugguggcacacgccuuuaaucccagcacuugggaagcagaggcaggcagauuucugaguucgaggccagccuggucuacagagugaguuccaggacagccagggcuacacagagaaacccugucucaaaaaaaaaaacaaaaacaaaaaacaaagacacacacacaaaaaacaaaacaaaaaaagcaaaauuagaauuugcugugucuuuuuuuuaaauuaauuuauuuauuuuugagacauaguuucucuguguaacaguccuggcugcaaaggggugggugagacagauaacccaauuugggauuaaacauuccauggccauuuauuuucugcacuuugacugguugugagccucuauauuaacuguugucuacugcaguaagaaacaucuuuaaugaggcagauuagauacugguaaggguguuggguagcuggucuacagagugaguuccaggacagccagggcuacacagagaaacccugucucaaaaaaaaaaacaaaaacaaaaaacaaagacacacacacaaaaaacaaaacaaaaaaagcaaaauuagaauuugcugugucuuuuuuuuaaauuaauuuauuuauuuuugagacauaguuucucuguguaacaguccuggcugcaaaggggugggugagacagauaacccaauuugggauuaaacauuccauggccauuuauuuucugcacuuugacugguugugagccucuauauuaacuguugucuacugcaguaagaaacaucuuuaaugaggcagauuagauacugguaaggguguuggguagcuggcuacuuagguuaugaccacuguuucuaccacuaaauuauaacucagugguuaacuuguuaaccaauuaauuguuaacuuguuaggauuuaauaguuuuuuuuuuuuuuuuaguaaauguguuuuaacaucuacugggccaaaugcauuuuguguuguugguuuccuuuugauaucaaaaaggaaaagcuuucuaaguuuagugaaaugguaucuguauuauuagaucuaucuagacccauguaucuguaucauggcuuuuugagaaagaagugguaauguuaaauauguaaagcaacugggauucacaggaaugugaggcuuccuguagaacagauuaaaacagauaaauaaacagguucauagagcaaaagggucuuuaacuucaucucaugaccaaccaguuccauuccuagcuguugcugaggguggagagacuaguaaccagaauguuuauagcucaaagcuggacaaugccaauaaaauuuaaugagcuaauuauaauuguggagcuaucucauacacaguauuuaauuuuuaaaagacacaaaagacugcuuuugugauucccucuaugugaaauacuagaagagaugaaucuugaauuagaagcaacugguuagugguuaccuaggcucuaguugggaauugucugaggaaaggaugaucaaaacauuauaguguaaguuauaguguuagguguaaaguugugcacauuuaacaaaacacaacugaaccucuuaugaaaauggauucauuugaauguauuuaaguuauuccuugguuaaauggggggguaauauuuuauguaaaaacugugauaguaucugaaagaaaggauuucuauaauuuucauuuuaagauauguucauauucuacaagaaucuuacaauugcaguaccauccacuuccuucgcaaugcuuccuuuccucacuuaaacugcucuucuauuccugguauuuuguacuucccuccccucuauuacuuuucagauuucacaguauuuuguuucuuauacuuugugugggaucuuuuuuaaaaagagagaccagcuucucuugugcucuaauaauuuaugcuaacacaugccucuuaauaaggucugaguuuggaacucagagcaauccauaaaaaaaaaaaaucugguguuuugaaaaucuucauuuauuaugugugcacauguacaccaugguaugcauguaaaaaucagagaacaacuuucaaggguguucuuuaaaaaaaaagaaaaaggucaguuauauuuggcugaagagauacuucagugguaaagagcacucuuccaaaggaccuggguuugauucccaacauggcagcucacaauuccucuaacucaagucccagggcaucugacacacucuucuggcuucuguucguaccaggcacacacaugguacacaggcauacaugcauacaaaauacccuuauacaugaagugagugauuuaaaccauucucuuuaacugaaaaaagucaauccaugccucuuugccacuccuguuucuccuguguugauuauuucaugcuagcuggcucagaagguuucagccuguuguccgucucugcuucccauuuuacaguagagugcugagauuacagacacaugcugucacaucuggcuuuuuaugugaguuccuauggaauacaagcucuuugcuguuguuuuuguuuuucaauacaggauuucucuguguaauagaccuggcuggccuccucugccuuugucuccccgagggcugggauuaaagguguaugcuaccacacccagcuugaguggcaagaccuuuuacccacuaaaccagugguucuuaaccuugcuaaugcugugacucuacauuuccucauguuguggugacccccccccagccauaaaauuauuuuuguuguuacuguaauuuuacuacuguuauuaaucauaauuaaauauuuuggagauagagguuugccaaggaggucacaacuuguagguugagaaccauugcacuaaaucaucucacucccccacaccaccacuaccaccaccaaauaucucuaaacucuuguuuacaccuggugguuacuuaaaauaaaccacaccuuauauuuauaauaugugaaaugagauggacaucaguaguugcuucuauguguuaaugcaggggugcugauggaaccagacugccaauggugaucuguccugugcuauugaaaaggauauguggauaggugaaaagaggaggaaaaaaagagguauauaaaaauuagaguagucaggguuuagaugauuaaucugacuaaggaaaaggggacaugaagaaacguauuuauauucacuauauggaccaagagcguauuaaaaggaaggaguuggagaacggucaggaauggugauagaagacuuugcaguaauaguaagaguaguaggugggcagaugaagguugugcggcucuagaagcuagaagggagaggauguguaguuauuagaggagugguuuaggaggugauuaccaccuacugcaugaagaaaguaggaaaaugauuaaggaaacugccagaggaaauggguggucaguaauuacaguauccuuuuuuugaacugauaggacauuucaucaucauccugcuaucagauuuaaaauaauuaguguuuucuuucaaaucuuuaacucuuugauaugacuuauucuuuuacauuuuaguuaaguuauuaauauuuccuuaauacuuagacuuuguauuuagauacuuuuguaaauuuauuauacuauuuuugcaauuuaacauauuuugugaauauuaauaauuuuggauaaaauucagccuuaaguauugagguagaacuuuccaaagugauaaucaaaaaggauaauuuaaaguuuguauuggcugggagguugaacacauguuucuuucuguuauuuugugcuguuuucuuaaaacaucuuuugcaggguaagggaagaagauggggugccuuguucaaagcuguccuucagguugaucuguaacugcuauguagaccaggcugaccucaaacucacagagaucgccucccucugccuucugauugcuggaauuaaaagcauguagcauggaccaccacauuggacucaauuguaucuuucuaaaguucccuguacauuaacuaauucucaaauucuuaccuuauugccucugcagauuugauaaugggcugcauuaaaaguaaagaaaacaaaaguccagccauaaaauacacaccggaaaaucuuacagagccuguaagcccaagugccagucauuauggaguggaacaugcuacaguugccccgaccucuuccacaaagggagcaucaguuaauuuuaacagucuuuccaugacacccuuuggaggguccucaggggugacuccuuuuggaggagcgucuuccucauucucaguggugucaaguucauauccuacagguuuaacaggugagauuuaaauggauaguugcagaaaauauaaccuuggccuuuacauacuucagaucuggccacugcuagggaaaaaacaaucuuguuagcagacuucccaaaaugugugugagcaaauaaguucucuaacaaagggcaggcuuuaauuuuugagguaggaucccacuguguacccaccucauccucaaauuuuuaguuuuuucuuuuuuuucuuuuuuuuuuuuuuuuuuguagaacuggaaaucaaaagcaaggccucuaccauaacaugcuaguuaccauaacgugcuaguuaccauaacaugcuaguuaaguguugcccugaagcuuauuucuagcuccggagucuuaauguauauauaggauucugagaaauuugguaauaaugacuauuuaccgaaauucuaccauaaaguguuucauuaacucaguauccaaauaauuauugagcagcuacuauguggcggauacugggaaaacagauauuuaaaagaauccuuuuuuuuccucagcaauuuacuaguuuuugacaacuguaaagugcuaucgagugcucuauuauuuaauaaguguuaauuacacaucaguuuaguaacaguagcacacuguuucuaucagauaguggcuuuauuaauuuacuuauuuugugugcucuuccaugccucauaauauauauguggaagucagaggacaguuugcaggaaucuaccacauugguucugaggauuaucaguguugacagcaagcaccuuuaauaguugagccauuucacugguccagguauggauuuuaaaaaggaaaguccuacaguucauaguuaggguaguuuuccuccagagucacaguugauaagcaacagauuugguacccuaauccagaacuccauuuauaacauugucauuuucuuucagaggauggcaagaagugauaguugcuauggaaucaagaaguccuaaaaguauagacuuuaaaaagaaagaaaauaagauccuuugcccagcaucuuauauaguaggacucuuuucucuugaaauaacaaagcacagcuggcuuaggaaagaaugagcuuugggauucccggaugugagagagagguccgugaugucaggaaggcaugcaguuacuuucaucccuucuuuaaucuuggggugcccuucuuagccuuggguguaaacaacuaccaaggaauggaauggcucaugucuuuauuaaucauuaguggggacuuaagagacuuuuuuuauuggauauuuucuuuauuuacauuucaaauguuaucccucguaccuguaccugguuuccucuccaaaaacucccuucccccauauccucucccucccccugcucaccaacucacccacuccugcuuccuggccuuggcaagauauagcucucuccugaaaggcucugcuagugccuggcauauacagaaguggaugcucacagccguccauuggacugagccuagggucccauaugaaggagcuagagaaaguuuccaaggagcugaagggucugcagccccaaaggaggaacgucauuuuucuccaagcauagacuauaugaacauugcucuuucccagucugcaccucaggagcaguagccagaggacugccauacacugaaucaauuuagauagcauuugaaaagugguagacaucacagucaaucacaguccuaauuucagccucccagcuguaaauacuaaaaguaaucaaagaccaugguucuauuucugauaguuauuaacacaaaccuugaaauuacuugggaaagguaguaauucaaaauggcuagaguaaauaaauguugauauaaaaagacauuuuuuaguuacuuaaagcaauuuuuaaaaauacagcauuuuuauucauugcaaauuucaugcaugcauacaauguauuuugaucauuuucaccucucacaauccaccccacaacucuucccagauucacucccaauacuuaaagcaauuuucuuaugugaaauacuccaagcaguuuucuuaacaugaaguaccucauucauagaugucuauuuaauagcugaaaaaacccaacaacaacagugucuuauacaagguauagagcggugaguaacacaaacaaagcuucugaaccugguggaguuuacauuauaauaguugaauaauaauuagugaauaaacaacuaaacaguaaucaauacuggugcuuaaguauugugauggcaaaaacaagaugauuggugaaggcccuguaguuggcauagaaagccaccuuaggaagaaaucucuugaauugauauuugauugauagauaaaaccuauuuguagagcuaaggaaagaacaaaauaacaaaaauaacaaacacaaaguucaagaaguaaauagacuuggaacuuuugaagaccaguguacacagaugggagucuuguauaagacuagacagacaggacacaguaguuaguacuaaggaccauagacuguaggaaugaguuagaguguuauucaaagcuauaaagaagcuuuuagauuuaaagaaaggauuuuguucucuaaaagcacuauaggggcuauaaagaugggcucagcuauuaagagcacuugaugcucuucuagaggaccauaguuugguucuuaguauccacgucaggcagcucaaaacugcauguaacacccuccuuuggccuccucaguaaccugcauacacauggcuuauauucauauacauagauacuuaaauaaaaguaaaucuugagaaauauuuaaaccucccucuagcagcuuuguggagaauggaugauggugaaggugaguaggaacaguuagaggguaguuucugaugccagcauuccugugagagauggccacaguagaaguggggaaguaaguaaacuguccacuuuagagcuagaacuaauagucuucccuuugcuuagagggaaaugaguugggcaaauagagauuauagaagaaaauccaagagcuucauuuuuuaaaauaaauuuuaaauguucacuagacaguaaaguagacaugucaaauaagcaaguugauugaugacuaaaacugaggggagaagccagccaagugagcugaugcuguguauggauguguccuuacaccugugcuuuucuaucuacuacuugauauuuagaggcagcaaguuuuauaauucauuuuccaugucacaguauuuggacuuaucacuuauuuguaauuuuacuaccugcuuuuucugucucccauuccuuggaaggacugaugucuauaaacuaacaaugaauacaccaagucaguauugaguuguacuagauagaauuuauacauaauugaguuaagacuauguuguucaaaacuggauguaguagcaacacauuuuuaaucccaguacucaggagacaggugcaggcagaucucuaugagcuggauuuaggccuuguccacacagugaggcuuugucucauaaagaauauauucauugauggucaagucuagaaguauagcucacugauagacuaacuuugcauguaggaggcuaaggauuugaaccuuuccuauccuucucaggaaaaguugguaaaacaaauuuugagaggaaacaaauugaagaauucuauuguacaaccuugugacucugcuuaguaacaacaaauugugcugaaaguugguaaaaguagauuuuaaguuuccugcccccuuaaaaaagaugaauauuaugauguagguugauuuaaccauucuguaauuuauguuucaaaacauuuuauuauaauugauaaucucuaucuuuuaaaauugccauaaugaauuuuuaagacugcuuugaaguauuuuaaacagugcaguguuauuuuuauuuuauuuuuaucugcucuguuauucuaauugcaaauaauauauuagauguuaaauauguucaucuuuuaaguauauucacacauugcuagaucugacuauuuuuuugaguuuguaccauauaauucauacuagacauaccuuuaauguuuaagacaaauauaacauuuucaaguauaaagugaaccuuaagaaaaccuuaaugauugcuguuaaugguuauagacagaaguucccuccuguuguggauaaggaauugaagacaagugccaguagucugugugcuuucccuucgaaagaacugaucugcaguguggcugucuuuucaagccagaaauguugcuacuuaagugaaauuacauuuuuuucaguuuauggaauuuuagaacuuaugcaguacaauuguuucacuggaagccuuaagaaaacaucuacucauaucuaacuucuaaaagugaauacuagagcagggaggaaacugagcuuaagcuuuuacuggcaauaguuguuuauuucuucuaugcauucaucauuuaccuuggucuuuuuuccccaugccagguggugucacuauauuuguggccuuguaugauuaugaagcuagaacuacagaagaccuuuccuuuaagaagggugaacgauuucaaauaauuaacaauacguaaguuuuguguguauuuucuuuuuuuuuuuaagauuuauuauuuacuuauuauauguaaguacacuguagcuaucuucagacacuccagaagagggagucagaucucguuacggaugguugugagccacaugugguugcugggauuugaacuccggaccuuuggaagagaguugggugcucuuacccacugagccaucucaccagccccuuguguguauuuucuaagagagaaaccuggucucuacauuggaccacugauggaguugaugauacagagaugcgaguggugggguaugaaucuuugucccuguguuggaugaugcauuugccuugagauacauugcuauaggcagaaguuacuauuuugcaagucauacucauggaguuagucuguaaacaauugagauuuuagaacaaagaguugugggugugaugguauauaucuauaaccccaugacuggagaggcuaagacaagaagaucuucaguuugagguuagucuagguugcauagugaauuccaggucaucaugggcuacauauaugucaaguuccugucuccaaaaugaugcuccuuguaaaaagggaagagaaaucuguaguuauauaaauaucagaugacuuaaaauaccuuaugaggggugcuggauaugggaccuuuuuacucugaaacuuaccaaauugugcuuuuccuauguuacucuuagacuuugucauuuauuggucugccauagaaaauuugaugcuuguuaugcagcagauuuuguaauuucauuagcaagcauagcaaccacucuguaacuucucaaagcacacacuuauggccucucugcuucuagucaucuuucccuccauucuuguuuuaccauguauuaucacuuucuuacuguucuagaauauaaacaugagcugugauugugacucuuugccuuaagagccuucaauagcuaaugauggccauaaagauuuaaaaagagcaaugacaacaauaauaaucacugagaauuugcccuguguuucuauccuuucucauucugccauccagccauaaugaaguauuuacaauuugcaguauuuuguaccuuuuuuauaccucuaccuauacuaauucuuuuucuggaaugacuuuuccuuucuuuuugguggaguggaaggguugcuuguuuaugaugggauagaguccagagccaguguucugucucuaugcuguccugagcccuuguuucuuuccucuuuaaguuagaccuccucauccuuuagaagauaguucucugguuuguuuuuuccacgguuccucugcuugccuuuucucucuccugcugcuauaugcaguguuucucuuaggugguuuacacgauacucuacaaaccucagccauggcuguccucacauuguaaauuaucauuuuuaacuuacuugucauucuuuuagaccagugguucucaacuugaggcagaaugacacagaagguauuuagcagugucuagagauauuuuugguugucacagucagggugggagugugguuacugucaccaggguacaugccagagauauugguuaaauccugcuuaugaacauaauaaagauucaucaacuccaaagugucaguguuaauaccaucaaaauggccaaccacguuccagagucaguucuugagcuuagaacugcuguuggggcugaagagauggcucagcgauuacaagcagcgacuacucuuccagagguccugaguucaauucccagcaaccacauggugccucacaaccaucuguaaugaggauacgauacccucuucuggugugucugaagacaguaacaguguacccacauacauaaaauaaauaaaucuuaaaaaauaaagaacugcuguuuguauugcauuuaguaacagugggugauucagagauugcuaacgaagaucaaauacaaaauuuuaguuuaagucaggacugccacaaguucuauaagccagcaagggcuacagaguaagacuuuguaauuuaguuuucugccuuuauauaugaaaggauuuaacauauucuaggauacuaguaaucaaaguaucuguucgcaaauaguuuaauuaccaaaagcuuucuuaauucacuuuuuaaagagaauaaauucacguagaacauuuuaaaaaguuuuaguuuggacaaugcaugcaaauaguaaaucacauauauaucauuagagauacuuuuuuuguauuauuuuuuauuagguauuuauuucauuuacauuuccaaugcuaucccaaaagccccccacacgcucccccacccacccacucccacuucuuggcccuggcguuccccuguacugaggcagauaaaguuugcacgaccaaugggccucucuuuccaaagauggccgacuaggccaucuucugguacauauucagcuagagacacgagcucuggagggauacuggguaguucauauuguuguuccgccuauaggguugcagaucccuuuagcuccuugguuacuuucucuagcuccucuauugggggcccugugauccauccaauagcugacugacuguaagcauccacuucuguguuugcuaggccccggcauaguuucacaagagacagcuauaucuggguccuuucagcaaaaucuugcuaguguaugcaauggugucagcguuuggaagcugauuaugggauggauccccggauauggcagucucuagaugguccauccuuuugucucagcuccaaacugugucucuguaacuccuuccauggguguuuuguucccaauucuaagaaggggcaaaguguccacacuuuggucuuaguucuucuugaguuucauguguuuagcaaauuagaaauuuuggaaaagccaaggucaauauauuauaaacaauauauaguucucauguuuugaaucauaauauuaaacugauaccaguuuuuggauaacauuuuagaagcauacauguuuguuuuauuugaaucugggucuugcuauauggccgagucuaacuuuaaacucacuguuguccugcuuccaucuccugggugcuggaucauaggcuuaugucaccaccacuagaaacaucaucuuuuaaaaagaaauaguuguuuuacuuauugugagcgaaagaagcagacaaauauuuuuacuuacuauaagagaaaacaaauauacgauacauguguaccaugguauauacguggagaucagaggacaauuuuuggaaguagguuuucuguuuaucccguguaggccugggccuuuuacccacuaaaccauuucuccagcucucaaaauucaacuuugaauuguuauuauucacuguuaaguuuuuugcuuuaagaauguuaagaccuuuguuuuuuguuccuaaagugacuuaaaaaguuauacuuuuauaaguauuugguagcaacaacaaaaaaaccugauauaggcuaaaauauggaugaaccuuaauaauauucuaagacagcagucacaaaaauacuuuauaaauggccccaacuuccaugauaagcauauucauaaaggcuucuuaaagagaauguggggugaggguggggcugugagugacauguuggcaugggcuggcuuuuuucaacauuuauuuauuuauuaguguguauaugggcacauguggaggccagaagacaacuugguguacuugggucucaccuuccuccuuuauacugucucuggggguuaaauguaggguuuuagcuuacguggcaagugaauucuccugcugagcuaucuugcuagcccaggugucuuaguuaggguuuuacugcugugaacagacaccaugaccaaggcaagucaugguguccaaaggcugcuaguggaagacugacuuccaggcaacuagggugaggaucuuaagcccacgcccacagugacacaccuauuccaacaaggcuacaccuccaaauggugccacucccuggcccaagaauauacaaaccaucacauuccacucccuggcccccauagacuuguucaaacacaugagucuaugggagggccauacuuaaauauagcauagugcaaaauguauuuaguccaacuuuuaaaguccucauagucuauaccagucucaacaauguuaaaaguccaaaguucaaggucucuucuugagauucauccaaucacuaacuguaauccccaaagcaagacaggaaaccagcugugcaaacuccaaacucugcaucuccauggcucaugucaaagcagucuucagaucuccgcuccuuuuucaucuuuguugacugcaacaaacugcuuucuucugggcugguuccacucccuguuagcagcuuuccucagcauguauaccauggcucugccauauuuaacaucuuugagucuccaaagcaauuucaacgguaacagcuucuuguuucaaugucugggauuccacuugaucuuuuggacuccuccuaagggcuggcaucacuucuccagcucugcacucuguagcacucuaaacucagguugauccacuccacuauggcugcuguuuuugaucauuccaugguacugacaucuccaauacacuggggcauuccacuccaacuaggcuucaccaauaaccucucauaggcucucuucacagugccaagccucaaauucuuugcaagacccccuaaguccugggccaucaacuacaacugaggcugcaccuucaccaaugaccuuccacggccucucacaagugucagccucagcugcucuucauaaccccuucaugcuuucaaaaccaguaccaccugggugacucuuucccauuaccaaguacagcugcagugggagguccaaccuuggcuaucucuggaacacagcuucuaugugcucgcagaaaacacuucccagaagauuucaucucagugacacugaucucuuuuuaaucaccgcuaauuucuuagcucuagcuagccugcaucaauugucccaguaguuccuuccauucuuaacucuagagccagagccacauggcugaagcugccgaguucugcugcuugcaggaacuagaacaugacccccuuuuacuauuacauuaucacuggcuuuauguuuucaaaauccuuccgugccuaagcuuggcuauccugguacuugaucuggauauugaccuugaacgcagagaucagcaugccugucuuuugggauuaaagguguguaccaccaugccuggaucuaaauuuagcugaguaggaucuugccccaaagucccacucccuuaaucuguuaucuccuagaacacaggauuuugauccauuucacuuccugguacuccuuuaauacucgaaccauguauuuuauauuuuuccuuucuaagcuugcuaugcuuguucaaacuucucuucauaagacuuaaccagagaacaaagucucugcugggcuuuuuugaaacuuccuuugacaaugcaauuaaucugagucucuucaccuuagccuuaggcagacuuuucagacaagggcaaaaaguagccacauucuucaccaaaauaccacaaaaacagucuuuaugccacauucugaaauucuucuccuuugaaaucuccugggccaggucaacacaguucaaauuacucccagcaacaaagucuuccauauuccuacuaggaugacccaguaagccccauuuaaagcauuccacugcuuuccaaauccaaagucccaaaauccacauucuuucaaauaaaagcauggucaggccuaucagcaauaccccacucccugguaccaacuucugucuuaguuaggguuuuacugcugugaacagacaccaugaccaaggcaagucuuauaaaaacaacauuuaauuggggcuggcuuacagguucagagguuaaguccauuaucaucaaggugggagcauggcaguauccaggcaggcaugacgcaggaggagcugagaguucuacaucuucauccaaaggcggcuaguggaaggcugacuuccaggcaacuagggugaggaucuuaagaccacgcccacagugacacaccuacuccaacaaggccacaccuccaaauggcgccacucccuggcccaagaauauacaaaccaucacaccaggguuuuuaagauggugaaauguucuauaaugaauuauuuugaugacugcacaacucugaauauauuaaaauccuuaaauguuauccuuuaaaugggaggggguauuauauaugacaugcaaauaaauuuuauuuaaaauuuaauaaauguauuuauugaacauaguuuuacuaguuuuaguugaaagaacauaaagauaaguagaauucaaggugcaguauuuagggguuuuuuuuguuacuacuguugguuuagaacaguugugcuuugugugaacuuaauugccuuaauucauguaacuggcuuuuaaaaauauuguucauuuaaguucauuucuuagucugauuaauccauaaaaaauccagauuaaaaaauggaaaugguuucugaucuuugcuugagauaagaaauuacaccuuggauaagggucuacauuauggugauuguugguuuuuuguguguugcagggaaggagacuggugggaagcaagaucaauugcuaccggaaagagugguuauaucccuagcaauuacguagugccugcagauuccauucaggcagaagaguauguuauuacuucauauuuuauuaauuauuuugacuuuuaaaaugcuuuaaugcacauucuauguaaccaaacuuuacacacgguuauaugcuagucuuaaacagcuaauguaucauauuaauaaaugcucuuugaaaauuaauaauuaauauucuaucugcucagaaacacacaguaaguaaaucugcauuaaucauuccacauuauauuuaaucucuuuccuuuauuuuucugcuuauuuuaaaaauucauucuuuuguaugccacagacugucuuuucagcuccuugcacagaguauacaguugugcuguuuguuuuuacugauauaagucauaagagugcucuuuuucuccuauuaauuuuguuacucuuuguuuguuuguuuuguuuuguuuuguuuuguuuuugucuucuucaguauucugugaacuuucccacagcagugccugucauuuuugucacuaaacuuuguuaaacugacacagauuuggaauuaccuauaauuuugauaguacauacuugcaucuuacugaauacaggugaucacauuguuuccaaagaguuauuucccugucacugacagauuuuucuaccuguauuuucugucuuuccuuuucuguuuuacuguuuuuuuggcugguaacuagaauuuaagagacauguugaguagauaguacauggaaaaacuaucagaggauauuucccuaguuaauauaucuuuauauuugauuuaauauucauaucuauuuuuacuuuguuauuuuuauauuuauuguuauauuuaauuuacagcuauuccuugucauguuuucugucacacuccauucuuuuuuguuuuuuguuuugacaggguugguccuggcuguccuguaacucacuuuguagaccaggcuggcuguccucgaacucagaaaucugccugccucugcuucccaagugcugggauuaaaggcgugcgccaccaccacacagcuuguuuuuguuuucaagacaggguuucucuguguagccuuggcugucuuagaacuuucucuguagaccaggcuggccucgaacucagagaucuaccuguucugccucucaagugcuggaauuaaguugugcaccccacugccaaacaucauacaccauucuuauugauacauguauguaauuuuuuugacccucaucuuuccaaaucaaaauaucacuaauuuuuuuuagaugguauuuuggcaaaauggggagaaaagaugcggaaagauuacuucugaauccugggaaucagcgagguauuuucuuaguaagagaaagugaaacuacuaaagguaugacuauuauauuaucaugugccuagaauaccuuccccauaguuuggggaagcuggagugacagugccuaucccccucccuccccaggugcuuacucccucucaauccgugauugggaugaggugaggggugacaaugugaagcauuacaagaucagaaaacuugacaaugguggcuacuacaucacgaccagagcucaguuugauacacugcagaagcuggugaagcacuacacagguaagugagcacuucagaggaggaauuaaucccucauguucuguuucgugaagauaagccugucaagcuuuaaucucauuuauauuuacacacauauuuaccuugcacuauguggcuccuauggaugaaacuuaaguugucaggcuugaccacaagcaccagcuuccaaaugaggaacaagacuugcauguugcccaggcaguauagcaggacccugacucagaacaauaaagaaugauaauaccuggaaacuaaauuggauuauaagauugcaugcucauaucagacuauuauugaaauuguuaugucuugcugacacaguauuuacauuggaguuccagaucauaauauauaaaugcuaagauugauuguaacaguaaauuuaaaagugugacagcaaagacuuuauuuauuuauuaaguagcuaaaauuaacuuguaguaguauaaaaaagcuuucucagacccggaauuguagcucagugauaaagugcuuaauuauguguguggaaguucucccccccgcccccccagcacugcaaaaaggaaaaaagcccucagaugccuucuuugauuuucuucuguagacacugaaucuauuaagaccuccuaaaauauaaacccuaccaaauccaauuugaagaugccauuucuuacccaagaaaaaugaacuuauaguaacuauagacauucuugccuuucaaggacuuuugaaaaguguuuuauuuuggagucuuuguguuuuaaauuuuuucguugucauuuagauauguaaaugcaugugagagucuuuaaauaauuaguacuacaagaggggagguuuccauggcaguuauucugugacagcuagcagcaaacaaaauaucaagucagacaacacguuugaaauugauugacuguguuacugagcuggcauuacuuguaauugccuuuguuauaauggauuuaagugguugcuugaugagaaugggaggaaaugugucuugaaacagggagaaguuuuauauaagcaggauacacaaaccaagccauuauguauccugacuggcugucuucagucuccuguauuuaaaauucagucucauaucaacuucuuccgugauuuucagaguuuuacaaauuagucguuauuagaaaugacaacuaauaaugcaucucccuuggggauuacaugaaucuugguggucaaaagaagagcuuuaagcuguggugcaagucuguacucccagcacuuagaaggcuaagacaggaagaaucugaauugaacucucagauacccuauguaccugccaaaaaguagaguggaguuuugaagacagacagacuuguguuugaauguucucauuuaccagcugggaccuugggacaguucucuagcuuuuccaaucucaauuuauaugaaagauuuauauuacauaauaacauaggcauacauacucaguaaauauuagcauaaaauguauuucuaaaguguuucguuuguauauacuucaucauucuucuuauugaaagauucccaugcuauauaucuuuuuagaguaaaacugauaggagacugauuuuaauuuaaugacaagcuuuuuaaaagaacaaauaauaagccagguaugguggcauauaccuuuaauccuagaagcaggugaaucucucucugaguguaguccaggccagccaaggcuacauagugagaucuaucucaaagaucagucaaauaaauaaauaaucauaugauacacacacuaauauucuguuugacuuaaaaaguaauucauuuacaauauacccuguuuaucuaucuagaacaugcugauggauuaugccacaaguuaacaacuguguguccuacugugaaaccccagacucaaggucuggcaaaagaugcuugggaaaucccucgagaaucauugcgacuagaggugaaacuaggucaaggaugcuuuggggaaguguggauggguaagaagccugaacuuuguuguuacuucauuuuguuauggaaucauaaauuaaaauauguacaauauauauuuuauuauguaguauaacuuuuacuguugauugaauuuuggucuaauaguccuugaaauacagauugagaaaguaaaauaaauuguuuuccuaggaacauggaauggaacuacaaaaguagcaaucaaaacacuaaagccagguacaaugaugccagaagcauuccuucaagaagcucagauaaugaaaaagcuaagacacgauaaacuuguuccacucuaugcaguuguuucugaagagcccauuuauauugucaccgaguuuaugucaaaagguacgugcauuguuuguuaaaggauuguguuacgaugaaacaauuuagguuguuuuuuuuuucuuuuagauuuauuuauuuauuauauguaaaaguacacuguagcuguguucagacaccagaagagggcaucagaucucauuacagaugguugugggccaccaugugguugcugggauuugaacucaggaccucuggaagagcaaucaaugcucuuuaacugcugagccaucucuccagcccaguuuuauucuuacuuagauuaaaaaccauacaauauaucuuagucauaucauauucuuucucagauccccauucaauccacccacccaccaaacuuuauauucuuucuuugagaaagacagacagacaaacagacaaaaagucagaaaaaaaaacccacaaaauuaaaaacaaaaacaugaaguucauuuuguauuguucaacuguuccugagcaugcaaccuucccugggguguuuugauauacccagugucucuccguuggaaaagcugauuuuucccuuucucagcaguugucaauugcaaauaggcucuugcuuaggaguugaaccaugugcuuugccuucucugugcuaggauuuugucuaugugaacugugcagguauugugcaugcucucacagucuuugugaguucauauguguaucagauuugcuguuuucauggagucguccaccaccucuugcauagaucccuaagccuugggggaagcgguaugauccauuuagggugucuaacccugaucccauuuagagcucaauguuccaaaaucucuuauccugcacguuguucauuugugccucuuuguguuaauugccaucugcaaaaagucucucugauggugguuccgugaugcacuugucuagggauauagcaguauguugucagggguccuuguguugcuuuguucauuuaacagaauaauuguagauguucccuagggcccaugaucucagagguucauggccucauuaacacugucauauggguucugacuuuugaaaugggccuuuuaaguccaaccaaaagaugauugguuccuuccauaauauucaugucccgauuguaccaaugaguuaccuggcagguagauugcuacuguaacucacaauauucacaguucaaagagcuugauuacuuuucuccuuuaagauuacauuuauuuauguguuuugcauguauauauguaugguugcaugugugcugugacacguguagaagucaaaagacaguuuguauuuagucuugggaucaaagucagguuacuagucuuggcagcagacaccuuuaccuacugagcccucuuaccuccauuuuuauuuccucuauuuuuauacauucagaguuuugucuuucuaacaguacuuucuaacaugauuuuucuguagacguuugaaaagaggaaaugugauaguuuuuuaauagaacaguguuuauuccuaguuaucccacaggaucuuaugagacuugaaaggaaaauuaagcagcuugagucuuuugaaaguagauuuaacuaaaggaaauagauugcuagggcaguagaaaaguugaauuaaagugauaaaccuguaucuauagcacuaaggcaaagacauuagagggaaucauuuuugccucguuuuuauaaauacaguucuuacaggaugucuagaaacucuuuuucucugcugucauuugaaauuucucaucugcccuaacccaggcacaggugggcucuuaccuaacagcuaauuagagccaggggcaaagccaggcaagauugauacuauuucuaggucauuggugcuuuagaauaggagccagcaagugaugaaaugaugcugauuagccugaaucuauccuauuuggauuguaucuauuuuuaaauuuaaauuuuuuacuuuuuugaaucaaacuaguuaguauuuugucaucuucucuacuaguucaccuuagcugaugaaauaguucccucuaguggugauaggggcaucuacccacuauaaauuugcaacagggggcgaaaaucucucuaaaaggacuaaaaauaauugccuauuaauugauaaccaacauauaccuaaaguaccaaaguauaugucuuuuuuggaagguguuugggcugcaaacaacuuccaccuguggcauuugaaugagugcauuaaauaaaauaggacaggaagugauaaaaagacaagaaagacauuuaaaucaagauauuacuaguauaagaagucaaugaagguaaguauaauggaucaucuacauagcucaauuauugacuuuuuaaaauugggagaaaaugcuagaauucuguucuauaacuucauuaauuauuugcaggugagagauuuagaauauaagaaaacaaaaaccuuucugguuuuaaaaugaaguaauuccuuguuuuacuauuuaguuguuuagcaguagacccuuacaacccaucaaagcuuauugccuccugugcuuugucauuauauugcuucacgugcagacagauuuucuuguuguucuugauuucuuuguuguguuuucuccuacugauguggugacacucaaacccagggucuuguauauaauaagaacacgcucuaccacugagcgagccuggccccagcccugcccauaaguucugcucauguuguucucauuccugagaauuuguuucccucucuugaccaguucuaccaauuauacuucccugguccaguguggaauccaucuucaaacccaauauucaauugccauuucucuuuugagucuuuuaaucugaaaccuucuuaugaaaauguguguuuauuuuuuguuguuuuguuuuuauaaaagugugucuugauuuggguuuaucugauauuguaugaucuuaacuaacaguagagagagaacaaucaaaccuuugcugaguuugucauacuuugcuauuccuauagugccaucuccuaacacuaagagcuauauaucagaccaccucuuuguaauuauaacuaccccaggauauucccaguuggcugaaaaaaaaaauauauauauauuuauauauauacaaaacacaaauauacacacacaaaaacuuuuauacacacacuauauauuuuuuuucauauauauauauauauauauauauauauguauauagugugugugugugugugugugugguuugaugauuuauuuuauuuuauuuuauuuugguuuuucaagacaggauuucucuguguagcccuggcuguccuggaacucacucuguagaccaggcuggccucgaacuuagaaauccaccugccucugccucccaagugcuaggauuaaagguaugcaucaccacugccuggcugguuugaugauuuaagguuuuaaagaguauuuacuuccauuuuaauguaauguuugaauuuuucuagaauaucuuucuaucucuuacaggaagcuuguuagauuuccuuaaagaaggagauggaaaguauuugaagcuuccacagcugguugauauggcugcucagguaguugcauauauauguauauauacauacauacauacauacacacacacacacacacacacauauguauauaucaauuuuaauugaaagcauauguuuaaaaugcagaagaaucuuggcauaauguuaaaauuuuguguaaugaaauacuagaauuuuaggagaggaaggaacauuggagauaguuccgugugagcuccuuaguagcagagccaauauuagacugcuauagcucucucagucaggugcugcccugugucguauggccuuugacacauuucauccauaaaugcaaaguuuguauuuacauuucagcagauaaauuuaagaaaauuaagaugggcuggguggaggugacagcacgugcuuuuaauccuagcacucaggaggcagaagcaggccaaacucugacuccaaggccagcauggucugcagaaugaguuuuaggacuauacagagaaacugucuugaaaaaccaaacaaaaagaagaaagagagggaaagacaagaaaacuaagguggaugaagguuauucagaaagaaaaggaaggaaggaaggaaggaaggaaggaaggaaggcagacagacagacagacagacagacuaagguagaggaagguuauuccaaauauuaaaaccugaaagugugcugaaauuuuuuuguuuauucuagucuaagacaagaauucagauaauauacagguaagaauuagucuuuuauacuucugaauuuugguugcaaaguuucuguuaagauggaugcaaguacugcaggcacuuuuauuggcuacaguugaugaacuugcuucugcagcucuuaccuaucaguaagaauccacauauccauaacaucugauaauguagaguaacuucagaggagacaggcauguacaaggcucuuuguucaaggcuauuaggcacuuucucuuggaaaaauggcagaccuuuuuuauuacaagaaacaaacaaaaaaaccuuaaguaaaugacaugggcuuuaugagccacauacaaacucuauuggaccucauuaguuuucacagcccuuuaaaaaaauguuaaagccuuauuuguuuuuuuuuaacuccuuaaggcauaugaaaaugggcuguuggcacaucugacugacgagcuauaauauguugguacuucagcaccuuagauuuguguugguuuuuguuuugucuuaugaugcacuucuucuaaccauugaccagaaaauaggucauagugauauguuggguuuuguuuuuuuuuucuugcaguguuaggauauaaaaauuuagcuuuuuuuugcucuuguucuuuugguuuuuuguuugucuguuuguuuuuucgagacaggguuucucuguguagcccuggcuguccuggaacucacuuuguagaccaggcuggccucgaacucagaaaucugccugacucugccucccgagugcugggauuaaaggcgugcgccaccacacccaguuuuguugcucuuguucuuguugcagagauuuuuguuguuuuuauuguuguguucuagacuauuacugucauuguuuuugagcuacccaguuuuucaacagucucuuuaguuuaacaguaagugucuuuuccccuuugcaucauauauuuugcauuuuuuccucuccuaagaucgcugauggcauggcguauauugaaagaaugaacuauauucaccgagaucuccgagcugcuaauauucuuguaggagaaaaucuuauaugcaaaauagcagauuuuggcuuagcaagauuaauugaagacaaugaauacacggcaagacaagguaaaguaacauacauagaugcuuauaaucuaauguccuaugcuugucuuaauacuacuuugaauacccagagccuuguggaauacaaaaaguucuaguggauagccaggucccugccugcuccugccugugggcugucagguaggaugcagcuucaaaaguccuuuguugugaggcugccuuuuuguccuuuuuguccagcauguaacaugcauguucauguagaccugacacaaaacuaucuguagacuaaaugccucugaguggguguuucucauguagcaaagcagcucucuauguuugaccccuagaaucccugucaucuguaauccuaacauuucuguaggaggggauggaaggugaagguaggagagccauucagaagcuggcaggccagcuaaccugcaguaaguagauuagcaucagaaaugagagacccugucuugacaagguagaaaaaagaaacaacucccuaaaauaguccugucugccguacccaugcuguggcaugaauagccugcacucaaaugcauguacaaaugcacauauauaugcaaaaaaauuuuuuuugaagcuuaaaaauaaaacaauuaaaaauaaguuacaauaaaaacgaauaguucuagauuuuuccagagggcucaaacauugauauuauacauaaaauuauaucugguaacaacacuucagcuuucuaauaguuaauuccugcaaagaacuugacaagauacuuuugcauuauaaauauagcagauaaaaauccuuguuacuuucuuuaggauguuagcaguagauuuuauuuauccuuuaugugugcauguguguuuguguguaugaguauagauacacacaauaagcauuuaaaggucagaagacaaccuugggcaucuucccaucauguuugaaauuuaauuucuuguuucccaguauaaggccaggacuagcugucugcaaacuuccugacauuuucuuguuuccacuuucccucacuguaaaagacuaggauugcaaacacuaguuauagcuuuacaugguucuaggaagccauauucaugcccucaagugcacaagcaccugacccacugagcuggcgccucugucucauuuggcgaguuguuauuuaaacuguugucucagauugaaggugauucccaaucaagcauuauuucuuccuacuccaaggugacagcagcagugucuagaaacaguuuugguuguuccaguuuggggacuacuaucaacaucugauagauaugcugaaacauacagacuaauaaucaaacacagaagauaauuacaugcccagaauagucagcauugccaagguagaaaaaccaugauuuagcuccagguuuggcguuuuuuguuuuuguuuuuuaagacaggcuuucucucuguaaccuugacugucuggaauccacucuauagagcaggcuggcccccaacucuuuuuuuuuuuuuuaagauguauuuauuauauguaaguacacuguagcugucuucagacgcaccagaagagggaaucagaucucguuacggaugguugugagccaccaugugguugcugggauuugaacucaggaucuucagaagagcagucgggugcucuuaccugcugagccaucucaccagcccuggcccccaacucuugagugcugugauuaaauaugccugccaucaucacccaguuagcuccuguuuuuaaaaaguauuuauuuuuauuuuauguguggguguuuugcuugcauguuaugucugugcacagcaugcaugcuguggaagccagaagagggugucagauccucuggaacuggagccacaaauggaaguuagcuguuagguaggugcugaggaucaagccauucccucuagaaaagcagcuagugcucuuaacuucugagucauuucacuuucuccucuacuucuuugcugucucuaccccuauguauacuuaccuccaaguagucauagguuccuguaauccuuacuuagaaaauccuaaccauuuguuuaaggcuaauuuagcugccacucucuaaugaaaccucuucuuauugugacaaaugaaaauugaaugauauuuuccuaauaucuaaaaucuauuuauuuauguuguaaauauauguguguauauauaaucaccucaagcauagacauuaccaauaauuuuauuagcauaaguacacaauuuucuggcagcuuuauuguuuguguacccauaauauaauuaugcuuguguauuauguuugugcacccauaaugcuuguguauuaaaaucauacauuaaauauuuguguaaauuaacaugguguuuuuaaaaugguaauacaaggaagggcuggugagauuguucagcggcaaaugugcuugcuucucaagccuggugaccugaguuugauuuuuggagcccauguaaagguagaaagguagagccaacuccacagcguuguccucugaccuucacacaaguuccauggcacaugcacacaaccaaacacacaacaaagaauaugauagcacaauagaaacuuauccaaagacagcacaaaauacagaaaugauuaugagcaaaagccaguagcuauuagaucuaacagaauaugccuucagacauaauuagguauagccacuggaugucaggugacccugaaguuguugauuuuacaauagaauauauaguaucucaugucucuaaaccuagcacuugugagugagagguggaaggaucaguauucacagucauucuccaauagauagcauguuagagaccagcugacccuuccucaaaaagcucaacaaggagagagagacuuguacaugaaguuuuaauuuuugcucaccucauaucacacacacacacagccgugcaugugagcacaaauaaacaagcaaaaauuaguuacagauuuaguuugauuuagcuaacaauuguaaucccagcuuucaggaggcugagacaggauugugaaaauuuaaggccagccuaagguagguguguguguguguguguguguguguguguguguagauagauacauagauagauagagauagaucaagaucccaugugccuccccccaaaacuugcagauuuuauaaucuacauuucugucuuauuaaaaccucuacuacuguuuuauugaaucauuuucuguucccaccagcaacuuuuuauaucauuaaauaaaagaaaaaaaccagauuuaguguaaaaauuuuaaguuagugcuguuuuccguauauuuuucugcguuugaagacuuaaacacauagaauugggauagugauaaagauuaggccuguguaccuuacauuuacacaaguauucuuuaaaaacacuucaacugucaauauuguuuguaggugcaaaauuuccaaucaaguggacagcuccugaggcugcucuguauggucgauuuacaauaaagucagauguguggucauuuggaauucuacagacagagcugguaacaaaaggaagagugccauauccaggugagcuuguguuuuucuuuaucucuuuaguaucucagcauagguuuuaaugagggauacacucagcaaaaaugugaggaagaaagacuuucuuuuuccccauccccuuuaauuggguguauaguagcucaugagagcuagaauccuuuagcaagcacaagaaguauacccuguauucuucuuuaagauguuuucccaaaaaguccuuuuauauguuguguuccucagaucagaagcauaucuuaaauaucuagguuauauuugcucccccaccccaaguaauauucuuuucuagaagugugacauucuagacucaaaagauuguuuugagaagaaauguuuucucuuuaauaagagggcagggggaaacuacgcuaaaaauuuccucuuuuuuaugucuauauaggugugggagagcaagaagaaauuuuagcuuaguugaaauucagcuauaauugaauauuccugcaaccuguuaccucucaaacauuuccucugaagguagccuaguaguugaggacugugaggauguagaaaaugcagucuucaagaagaauugcuguacugaccuucuguuucaugccauuccuuaacacuugagcuguaguuguagugcuguuguagucucugguccacauccuuucauugugugcugacacauacagcucacuuaauggucacugcucaucacccuguccaauaagauucugcuucugucuuaauccauggucaacuuuuuucuuauuaauuuuuuuucauacaauauauuuuuaacauuuuuccucccauuuuccucaccucucuacccacccaucuuugguuuuuucaccuccauuucaaaaaacaaaaccccacaaaaugaaagucaaaacaaauaaguaaaagaccaauaagaccaaaaaaggaaauacaugccacaccaggccuggcguauaccuuuaauccuagcacucauagagguaggugaaucucuuuaaguucuaggcuagcccaguguacagagcuaguuccagggcagccagagcuacacagaggaacaugucuuggaaaacaauaagaacaacaacaaaagucugcagauauacuaaguucauuuuuguugaguagcuaccccuaaguauauggucauaccccauauaggaaugugguuaauacaccacgugacacuuccuuagggaaaacuaauguuucucguugauaggcuauaaguugcaaauacauaaaugauuagggauuggacaucaugccuaauuuccccuuucagugcuggaaccccauuggguuugaaccuguacagaucuuguguguuacaaaagacugggaguguguacgcacaguccuauuguaucuagaagauaguguuucuuuggcaucaacgaucaccucuaccuuuuacaaucuuucugcuuccacauaggggcugaacguuggggggcuuugaugaagacauccugccuuaguuaugguuuaaauugcugcagugaaacaccauaacuaaaaagcaagcgagggaggauaggguuuauucaacuaacuuccacauugcuguuuaucacuguuaggaacucaaacagagcaggaaccuggaggcaggagcugaugcagaggccaucgaaggguccugcuuacuggcuuguuucacauggcuuguucagccugcuuguuuuuguuuguuuguuuguuuguuuguuuguuuguuuuuuauagaacccaggacuacuaguccaggaauagcaucacccaccauggauuagacucuccccaucuaucacuaauugagaaaaucccuuacagcuggaucuuacagaggcauuuccuccacuaaggcuucuuccucucugaugauuccagcuuguaucaaguugacacacaaaaccagccaguacacaucucauuuaggacuuuuuuuuuuuuaaucucucaaucucugcacauuuucuaguugugggacucuguguuaauucccaucuucugcaagaagaaacuucucugauggcuuaagugaguucucugucugauaugacuuaagacacugaacuauggguauagcaauaugucguuaggaguuuuuacuaugcuccuuuagccaaauaauaauacuuguuucauccaaagguccauuggucaucuaucuuaguuucuuggccacuuuagcagugucagguauagguuccaucucuuagaguaugccuuaaauccuuucagaaagugauugauuauccccauaaccuuuguggcacuauugcaccagucugucuugcaggcagaaugcugcuguagguagcugggugauaacugaugauuucucuuccagugcgugcagaauaccaggaacgcccaucaguagucauaaaucuuuguaucaggcaccagcucaccuuuaaaacuguggucugugucauuaguaaauguugccuuuagcaauagguccuuaccaucagguuguggagaacaaccaauaaccuuggcaguagccugugauguuugacagugggguuuucacugggaccccuuuagcaaacaucaacaagacauuucugacacugguaguuuuucuuggcaguacaccaugucuaguugagacauggucuccccuaauauuuggugacuaaauucuuaacauauaugaaaacuuuauuuccacauauguaaagaaauaugauuuuuuuaaaaauccaaaaauauacacuggagaaaaaacagcaucuucaggcuaaugguacuguucagaccagauggcuccauguagaagaauccaaauauauauacacacacacacacacacagagauauauuucccugcacaaaauuucucaugggucaaggaccucaacagacauaugaagcaguaauuaugaaggacuugcuuacccugucuugcuagaauuuggcagucaacuucccuguauuuguuuguccuuucuggacaguauuuugucuauauuugaagcauaagcauuuucuuagcccaguggcuagcuuaccacaauugaagcaacuccauaugaaaguuauucauaccuaccaucuucuuugaaguggaguggggguacugucaggagcagaccugucucauugucgaaaagauauuuaauuaacaaaacaucuuuaaaugucauauucgguggaucucugagguuuuaaaaacuaauuaucuauagcauaucugaauuguccaaacacuguuuauuuuuaacuauuuacugucugaauaaccuugcaaacaucucacuauaauuaacuaaacuaguaucuaauaugaacauaaguuuggcugacuauuguaguuuuauuucucucaguuuguaauagcagcuuuaaaaggucuaaaacuugacauuguaucuucaaggcacaauuuuucacauaaaaauugaaaacauauauaccuauauguaucaaauucaccuuaaauuuguaucacuauacaauaaccuauaccaauguaucaaaaauaacuuaggaauuuuauguaucuauacaaaauucugugucaguauaccaaguauagccucaauucugcauccaauuauaaagacuauaccaauguaagauaauggcuauaaaaugauucaaaauuccaacccuuuuuuuucuuuguuauuccuauaaucuuauguuccccccaccccucuuucuucuuaaccuccuuucccuuaccuaagaaagaagaaugaaggaaagugucuuaguuaggguuuuacugcugugaacagacaccaugaccaaggcaagucuuauaaaaaacaacauuuacuuggggcuggcuuacagguucagagguucaguccauuaucaucagggugggagcauggcaguauccaggcaggcauggcgcaggaggagcugagaguucuaugucuucauccaaaggcugcuaguggaagacugacuuccaggcaacuagggugaggauuuuauacccacacccacagugacacacccauuccaaccaggucacaccuauuccaauaaggccacaccuucagauggugccacucccugguccaaggauauacaaaccaucacagaaagggaagaaagaaauccuugaguuuaaguucuuaaacuuuacuuucaccugucuaagacuauaacuauuuguaaccugccccuauugaaagacaagaaaaugggcgggagggacugcucagcaguuaaucccagcacacgggaggcagaggcaggcggauuucugaguucgaggccagccuggucuacagagugaguuccaggacagccagagcuacacagagaaacccugucuugaaaaacaaauaaacaaacaaacaaaaaagacuacucuuuugaagguccugaguucaaaucccagaaaccacaugguggcucacaaccaucuguaaugggaucugauguguuuuucuggugugucugaagacagcuacaguguacauacauaaaauaaauaaaaucuuuuuuaaaaguaacaaaauuuccaauaccuugguuaggcuuuucucucaacuagcucauaccuuaaaauaacccauuuagucuaauauacauucugccacauggcuguuuaccugucacaucuuuccgagcaaaucucccaugucuggcaccaucucagaauccuuccugccucucagaugacccagcuccuauuaccugccuaagcuauaggccaucagauuuuuauugacaguugccacauccauauagacacgauauucuuucuacagauacccugaaucugauagaauaaaaaguagugaaaaggcuugaacucauuaguacagaaaaagacuuugugagcagggcaccaguagcauaggcccuaagaacaacuguuaauacgugcagacuugugaaucugaaaagcuucuguacagcaaggacacagcagucauuuuaauacauauaucaaagggucuucugaucucucauggcuugagcacuuuccguuugugauccugucauuuuucauaccuucaaccuuaacaauaccaauaccauuaccacaguuucaugugccccuuaucugacuccuaccuugaaucuuuccagccuucucugcuccagccuuagcaauuucuugauacuacuaagcucuuuaaugcauuggcagcaacuuugccagacccucaucuucuucacaaaacccccucaguuccuuaaacugcacagucaagcaguaugaucacccccugaguuuauuuuguccugucauucuuuauuuuuuauuguaguuuuacaugucuuuauauuuuccuuuuuugaauaucauaauuuuuuauuagauauuuucuucauuuacauuucuaaugcuauccccaaagcccccuauaccuuccccacucccugcuuaccaacccgcccacuucugcuuccuggcccuggcauuccccuguacuggggcauaugaacuucggaauacaaaggagccucucuucccagugauggccgacauaugcauaugcuacauaugcagcuagagacacagcucuggggguacugguuaguucauauuguuguuccuccuauaggguugcagaccccuuuagcuucuuggguacuuucucuagcuccuucauuaggggcccuguguucuauccaauagaugacugugagcauccacuucgguauuugccaggcacuggcauagccucacaagagaacuauaucaggguccugucagcaaaaucuuucugguauaugcaauagugucuggguuuggugauuguauaugggauggauccccagguggggcagucucuggauggucuuuccuuccgucuuugucucuguaacuccuuccauggguauuuuguuccccauucuaagaaggagcgaaaguauccacacuuuggucuuccuuccugaguuucauguguuuugcaaauuguaucuuggauauucuaaguuucugggcuaauauccgcuuaucagugagugcauaucauguguguucuuuugugaucagguuaccucacucaggaugguauccuccagauccauccacuugccgaggaauuucauaaauucauucuuuuuaauagcugaguaguacuccauuguguaaaugugccacauuuucuguauccauuccucuguugaggggcaucuggguucuuuucagcuuguggcuauuauaaauaaggcugcuaugaacauaguggagcauguguccuuauuacaaguuggaacaucuucuggguauaugcccaggagagguauugcuggacuuauguccaauuuucugaggaaccgccagacugauuuccagagugguugucccagcuugcaauccuaccaacaauggaagaguauccuucuuucucuacauccucgccagcaucugcugucacaugaauuuuuuauuuuagccauucugacuagugugagguggaaucucaguguuguuuugauuugcauuucccugaugauuaaggauguugaacauuuuuucaggugcuucucagccauucgguauuccuugguuaaaaauuccuuguuuagcucuguaccccauuuuuuaauagggcuauuugauauuucuagaguccaucuucuugaguucuuuauauauauuggauauuaguccccuaucugauuuaggauugguaaagaucuuuucccaaucuguugguggccuuuuugucuuauugacagugucuuuugccuuacagaagcuuugcaauuuuaugaggucucauuugucaauucucgaucuuacagcacaagccauugcuguucugaucaggaauuuucccuugugcccauaucuucgaggcuuuuccccacuuucaccucuauaaguuucagugucucugguuuuauguggaauuccuugauccacuuagacuugaccucaguacaaggagauaagaaugcaucaauuugcauucuucuaugaauuguugugccagcaccauuuguugaaaaugcugucuuuuuuccacuggaugguuuuugcucccuugucaaagaucaagugaccauagguguguggguucauuucugggucuucaauucuauucccuugaucuaccugucuguggcuguaccaguaccaugcaguuuuuaucacaauugcucuguagcacagcuuuaggucagggauggugauuccaccagagauucuuuuauccuugagaagaguuuuugcuauccuagguuuuuuguuauuccaaacguauuugcaaauugcccauucuaauucguugaagaauugagcuggaauuuugauggggauugcauugaaucuguagauugcuuucggcaagauagccauuuugacaauauugauccugccaauccaugagaaugggagaucuuuccaucuucugacaucuucuuugauuucuuucuucagagacuugaaauucuuauaauacagaucuuuaacuugcuuaguuagagucacaccaagguauuuuauauuauuuuugacuauuguggaggguguuguuucccuaauuucuuucucagccuguuuauccuuuguguagagaaaggccacugauuuguuugaguuaauuuuauauccagcuacuucauugaagcuguuuaucaggcuuaggaguucucugguagaauuuuuaggaucacuuauauauacuaucauaugaucugcaaauagugauauuuugacuucuuccuuuccaauuuguauccccuugaccuccuuuuguugucuaauugcucugacuaggacuucaaguacuauauugaauagguauggaaaaacagaacagccuugucuagucccugauuuuagugggauugcuuccagcuucucuccauuuacuuugauguuugcuacugguuuucuguagauugcuuugauuauguuuagguaugggccuugaauuccugaucuuuccaauacuuuuaucaugaauggguguuggauuuugucaaaugcuuucucagcaucuaaugagaugaucaugugguuuuugucuuugaguuuguuuauauaguggauuaaguugauggauuuccauauauuaaaccaucccugcauccuuggaaugaagccuacuugaucaugauggaugaucauuuugauguguucuuagauuugguuagcgagaauuuuauugaguauuuuugcaucgauauucauaagggaaauuggucugaaguucccuauugucuuagucaggguuucuauuccugcacaaacaucaugaccaagaagcaaguuggggaggaaaggguuuauucagcuuacacuuccauacugcuguucaucaccaaagaagucaggacuggaacucaagcagguaggaaagcaggagcugaugcagaggccauggagggauguucuuuacuggcuugccuccccuggauugcacagccaggacuaccagcccagagauggucccacccacaaggggccuuucccccuugaucacuaauuggaaagugccuuacaguuggaucucauggaggcauuuccucaacugaagcuccuuucucugugauaacuccaacugugacaaguugacacaaaacuagccaguacaccuaucuuuguugggucuuuaugugguuuagguaucagaguaauuguggcuucauagaaugaauuggguagauaccuucuguuucuauuuuguggaauaguuugaggagaacuauuggaaggucugauagaacucugcacuaaacccaugugguccugggcuuuuuuguuuugguugggagacuauuaaugacugcuucuauuucuuuuagggauaugggacuguuuaggucauuaaucugauccugauuuaacuuugguacgugguaucugucuagaaaguugucuauuucauccagguuuuccaguuuuguugaauauagccuuuuguaguaggaucuggugguguuuuggauuuccucagguucuguuguuaugucucccuuuucuguuuucauuucugauuuuguuaauuaggauacucucccugugcccucuagugaguuuggcuaaggguuuaucuauccuguugauuuucucaaaggaccagcuucugguuugguugauucuuugaauaguucuuuuuguuuccacuugguugauuucagcccugaguaugauuauuuccugcugucuacuccucuugggugaauuugcuuccuuuuguucuagggcuuucaggugugcugucaagcugcuaguguauguucucucuaguuucucuuuggaggcacuccagagcuaugaguuuuccucuuaggaaugcuuucauugugucucauaaguuuggguauguuguggcuucauuuucauuaaacucuaaaaagucuuuaauuucuuucuuuauuucuuccuugaccaagguaucauugaguagaguguucuucagcuuccaugugaauguugacuuucuauuauuuauguuguuauugaagaucagcuuuaguccauggugaucagauaggaugcaugggauaauuuccauauuuuuguaucuguugaggccuguuuugugaccaauuauauggucgauuuuggagaagguaccaugaggugcugagaagaagguauauccuuuuguuuuaggauaaaguguucuguagauaucuguuaaauccauuucuuucauaacuucuguuaguuucaaugugucucuguuuaguuucuguuuccaggaucuguccauugaugagugugggguguugaagucucccacuauuauuguaugaagugcagugugcgcuuugagcuuuacuauaguuuccuuaaugaauguggaugcccuugcauuugaagcauagauauucagaauugagaguucaucuuggaagauuuuaucuuugaugaguaugaagugccccuccuuaucuuuuuugauaacuuuggguuaggagucgauuauuugauauuagaauggcuacuccagcuuguuucuucggaccauuugcuuggaaaauuguuuuccagccuuuuacacugagguaguaucugucuuugucccugagguggguucccaguaugcagcaaaauguuggguccuguuuguguagccagucuguuaguguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaaguccggauuguaguucauuccaaauauugucaaguugacaaccaggaauagccacuacaauccaccccuugucaacuugacacaaauaauaucucauguucacaugaaacaauaacaagguuguaaauacgccuaacaugauauaacuaucccucguacaaucgcaaacgcauuaguaaauuuacaaugggcauucauauuacuuuauaauccucguuucugcaacugguuacguggccuuaauugguauuuauaacuaccuuccucuacuacccauucuguauuuccuucaccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccugcacuccagacauaaucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaaugaaauguuuguuguagcuccugguaggagcacuccccucucuggagccaaaacuucuaagccagcagaaccuagaguuauggggacaggaagcaaaaauuuuccuagagggucacuaggagugauaguaaguggaacuauuccguuuuccaccccuugauuccuggacccaugaauccuggcuaugggugaaacuguaccauauaucgagcgcugauucaaagcauauacugccuucugaagaacucugccccagccuuccaagcuguuaccagcuaauuggcacuguaacugcgucuucaaaaggccauuccaucuuucuaucagcccagcugcuucaggaugauggggaaugugguaagaccagugaauuccaugaucgugagcccacugucguacuucucuggcugugaaaugaguuccuuggucagaagcaauacuguguggaauaccaugacgauagaugaggcauucugucaguccgugaauggugguuuuagcagaggcauuacgugcaggaaaggcagauccauaaccagaauaaguaucuacuccaguaagaacaaaacgcuguccuuuccacgaaggaagugguccaauguagucaaccugccaccagguugcuggcuggucaccucgaggaauggugccauaucuggggcucaguguugguuucugcuguuggcagaucuggcaaucagcagcagcuguagccaggucagccuuggugaguggaagcccauguugcugagcccaagcauaaccuccaucucgaccaccauggccacuuuguucaugugcccauugagcaaugacagggauggcuggggagagaggcugauuguccacagaacgggucaucuuauccacuugauuauugaacuccuccucagcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugagucaguguauaaucguacaucuggccauuucuucuugcaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucagucgaucauagggaacaccccaugaggcuauaggcacauguuuggcagcagauggcauuguaacaggaauagaaaccauaggcauuugagcaacuucuucauguaacuugcuugugccuucaggaccugcucuggcccgaucacguauauaccacuuccauuugauaauagacugcugcugugcacgucccacuuuaugacuugcagggucugauaguacccagcucaugauggguaguucaggucgcauagugacuugguguccuauugucagacguucaguuuccacuaaggcccaauagcaggccaagagcuguuuuucaaagggagaauaguugucugcagaugaugguagagcuuugcuccaaaaucccaaaggccuuuucugugauucaccuacaggggccugccagaggcuccaaacagcaucucuaucagccacagacaccucaaguaccaucggaucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauagacccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaaggaaacuacaucugguacagcagcugcaauuggaguuacuaccugauuuaguuuucgguaaucaacugucauucuccaugauccaucuguuuucugcacuggccagauaggagaguuaaauggagauguggugggaaccaccaccccugcaucuuucaaguccuugauaguggcaguaauuucugcaauuccuccaggaauacgauacuguuuuugauucacuauuuucuuuggcagaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaaucaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucagaggaaccuggccaccccuucauucaagggguuccggaucugcaaacugucucaagucuggaaauugauucacuggccgagauugcuguuuaccacgaucuaauguagccuuucuuucauuuguuugagaauuuuucugcuuauacagaucaaacaaauaugcaguaggcuuccuauguauuucauuccuggaaacaccaugauugauuagccaguaccaaagguccaagcgagucaugccauuauaaauuucaccucuccugugcugaccauuacuggguauguuauuauaaacauucuuuugucuacgcuguccauuauaauaacuaggaucaccuugucuccggcgauucaaugcugccaccuggcccuuguuaccucgggauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccacggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagcaaacucauuaagcuccuuaguaguguagugaauuuccucauggacuauacuuucuaccuccccucuaggagccuguuuugcuuugagucugguuacaggucuagaagaaacuauuggugggccgugagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccgucccauguuguaggaucccauucuuugccaauuagagcccuuacuuuaacugucgacacacucugaggcugagacuugaauuuucucuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauauuugaaagugcugguggaucaacaagccaauuccaguauuuuaaaagauucauccuuguacuucuguuacucuagaaccacuccugguaccaacuucuguauuagucaggguucucuagagucacagaacuuauggauaauuucuaaauaguaaaggaauuuauugaugacuuacagucggcagcccaauucccaacaaugguucagucgcagcugugaauggaaguccaaggaucuagcaguuacucagucucacgcagcaagcaggcgaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaaguccggauuguaguucauuccaaauauugucaaguugacaaccaggaauagccacuacaguuagucuaugucuuuuuauuggggaauugaguccauugauauucagagauguuaaggaaaaguaauuguugcuuccuguuauuuuuauuguuagaguugggauucuguucuuguggcugucuuuuuuuuuuagguuuguugaaggauuacuuucuugcuuuggaugguuuuguacaauuccauuaccuauuugguuguguuuucuuguaauucuuuaagggauuuuuguguuuccucuuuaaggucuucuacauguuuagcaguguuuuccucuaauuccuugagggauuuuugugcuuccucuuuaagggcuccuaccuguuuagcaguguucuccuguauuuuuuuaagugaguuauuaaugcccuucuuaaaauccucuaccagcuucaugagauaugauuuuagaucugaaucuugcuuuugggguguguugggguauccagaacucgccguggugggcauacugguuucugauggugaccaguagucuugguuucuuuuagcaagauucuuucguuugccuuuugccaucuaguaaucuucaguguuagauguucuagcugucucugacuggagcuuguuccugcugugauucuuuagccucugucagcucuccugggaguccaacucucuccugagucccaguggucagagcacucucugcaggcaagcucuccucuugcagggaaggugcacagaagucaggagcucagauccaccuccugauuccuggggucagagcccucgcuggaggccgacucuccucugacagagaagguguccuggggucugggucucagcucugucuccugacugaggaugaaagcccgaagggacccuguccaagaagcucuguugcuucugcugcccaugugcucuccugcauagacuggucucagugaucccaagauucugggugugcuagagccugccuuuguccuuuaucccuguuccugcaccagaccuucugcguuuugggaauggauguguguuucacucaccagugaucucaagaccccagaugugcuauggugccugcagcauggagaguccucuggggaccuuggggcccucugccgagauugugccuaagauccuauuuuauugcuaccuaacacaaucauaaugcuggauaaaaucuacuucugcccucaauauacuaguaaauauagccagaggggggaaaacacuuaaauuaaggaauuucacuuugcgguuuuagucauggucuacuuuccauuuuggccacaauagacaaucuaaaaucugcuaucuugcuacaaacaacuagagauuuaaacagauccauaauccaguuuuguuuggguuuuuuuuuuuauuucauggugaucaaggaagcuuccuuuuuuuaaaaaaugaguccuauauuuauauaacauuucuccccaauauuuucuaagugagcauacugauggaagucaaaacaaagacaucaguuuuuguuuucuucaauguuuuuuuuuuauuuguuuuaacugaccaaaggagaaagaagucuaaggaggaaucugugagaauggagcugauaaauaaggagacuaaacucucauuaaauagccaaccuuauucagcaccucaaacaguuuguacucugaggguuaagaaaggucacaugaguaaaguucucaugaguucaagcuguguaaaauucccauagaggcauaaagaggauaguuuuagcaucuaauugauuuacaaccacaaacuaaugaacuaucugaaguaaacucaaguccuaugcuacaccuaggaggagcacaaaaacacauuccaauaauaauuucauguuuuucaagaaacuuaggucacaagacuuguuuucuuagaauguucucauaagcacucagaauucuccucacaugacacuauuccuggacuauguuucucaacagugcucuaguagaagaggcaaaauuaaacaaaaccugaagccaggucuugccaaggaagaaccaggugauuugacaguacauuuacuguuaaaaccgaauguccuguagaaaaacaaauccacuguguguaauucagaaugucaacguugucagaaauaguaucugcucaggacccccacaaucagguucucagcacaaaggagauuuguuugccuccgugggagagggcagugaauaagagacagacgagagauagaggacaaggagaaggggaggggagagggagagaggcguauuugcccuggaggacaaaggacugccucuggauagagacagauguggccccuuaggcaaauggaggcuuauaaagguagagggggaaauuccauguaagaauaagguauuuaauuuuaauuggguguauucauuaggugagccaaaggaagcuuuuuuuuuuuguuuuuuuuuuuuuuguuuuguggcuuuuucgagacaggguuucucuguauaguccuggcuguccuggaacucacuuuguagaccaggcuggccucaaacucagaaauccgccuaccucugccuccugagucaaaggagacuuuugauugcuagacuucaauacuuugauagcugggccuuaguggucagcuucaggaggaggaaguggccaaauaaaggaagagaccuuaguggccagcuuuagguauguagucuaaugguuuuuagagaaagacaaagccuaccagagccaugcccaccaugcucaagcuggucagagucccuucaaacauaaaauaggucuauuggugcaaaauuuuauauucuguagaagaaaaauaaagucacaauuauuuauugcggugguucucaacuuuccuaaugacccuuuaauacagaauucucauguugaggugacccuaaaccauaaaauuauuuuuguugcuacuucauaacucuaaguuugcuauuguuaugaauuguaauauaaauauuugauauggaggaucucuugguauaugacccuugugaaagagcuguuuaacccuccaaagagguuguagcccacagguugaaaaccgcugauuuagugggaggaggaaagagccguuuuaguuacugugaaaugacagugugaccaaggcaacucuuaaaagggaagcacuuaacuggggaguugcuuucaguuuuagaggguuaguccaggguccccagggcagggagcauacagaccuggcaaggaagcaguaguugagagcauuauauccugaugagcaagcaucaagcagagaaagagaaagaaacauuaguccuggcauugccuuuaaaaccucaaagcauaguccuagugacacaccuccaacaaugccuaauccuaaggccacacaauucaguuaacuggugacuaagcauauuugaggucauucucauucaaaugcccauaaaccugguauaguuuugugugcuuuaaucccaguacuugagaaggaaaaacagguggaucuuugugaguuccaaaccaacagacaacaaaguaagaccauaucuccucuaggagacccuaaagccugccuacauggugacacacuuccuccaacaagaccacacauauuccaacaaggccacaccuccuaauagugccacuucccaugggccaagcauauucaaaccaccacagucauauuaaaauacagauuauuauuuaacauuucuuuauauuaauugauaugccuuuuuacaagauaaacuugauguuucuucagcuacuagcuaggauguuuacucucuuuugguauuuauggccaagacuguuguuuuuaauauuugaaucuuaacauuagguaugguaaaccgugaaguauuggaacaaguagagcggggauacagaaugccuugcccccagggcugucccgaaucccuccaugaauugaugaaucuuugcuggaagaaggauccugaugaaagaccaacauuugaauauauucaguccuucuuggaagacuacuucacugcuacagagccacaguaccaaccaggagaaaauuuauaauccaaguaaccugugugcacagaucugccaaaacagagagaccuugugugaguucuuccugcacagaaaugagaagauaugcuucacucggcauguuucuuaugguaaacuggaauuccagauacgguuacucaaaaccacuuuuuuuuucuccaagcauuaaacucuaaaguaccaaugaugcaucuuacagcauacuucaggguccagagaaaguagagcuagagagugugauuguggguguagcaugguaagaaagagcaacaggacuacuggucauugccuuuucuuccccaaacuugccaagagaaaacuacuucuugguauguauaaaacuuggcuguuacuccacaggaaaauucuaagaucaaagaacuucaugggaccaaauaauuccauuccaguuuuuuaaauuuucuagaauuuuuuuucucaaaguuuuuuuuuguuuguuuuguucuguuuuuucccuguuuaauagucaacaugcacuccuaucagaggccuccuuuugugugaaaaugggccaagucuuccaaaugcaaaggaauggauuauaaacagcaucaaaaacauugauuuaaaaagccauggaaguuagaagcauaauacaguaugcucacacuuuguccagagaacuggaaagcaaaacaaauuuuucauaucagucaugucuuaaauuguucagcuuugaauaaugaagguaaccagaaaguggauuaaucuuuuuacaaggguguauuaauuuuuaaaggguuauauacaauugaaauuauucuauccaguccaagagaaaaaucuuuuaauauuugcauagcauaaaaauaaaaaacaaaccuaacauuuaagcagucaauuuuuaaacaauaaguggaguacuaugagguguugcuaguauguuuuuaugauuaugggcuccacaaauagaaaacaucacuagaucagggacuugaaugcacuuugcuuauauugaguauagaauaggagagaagaaaauguauuuaaagaaauaugagagacgacaugugaaaguucuacagguauugggauggggugggaugucuaauguugguguuguagagaaacaacauggcuuucuggcacucaaaacuccucauuagcuguuuucuuauaccuuaaaaguuuuaaaguaugauuguaaaacuaauuuucuuaucauauacacuguuuuaucuccucaaaauagugaggauaaggcucuacccuaauuucaguggcccagcuuuuauacagaaccucuuagaacaccaaguuucaaaucccuguuggaaacuuuacuuacauuacaacuauacuugaugguuaucauauuuuccuuuuauaauuaauuugaggaaaaauacuuacugaguaacuguaauauaaaggggggauuuugcccauuuaaaguacagguguaaagcauuuaaaaugagaguuuuucuaacucagaaauuaugaaauauuaauuugaacugaguaguauuaacaguuuaaggaucuagcaagaggaaaauggagucugcuaaaagucuaauauuuauguuuuaaaauauauuauuuuauaguuauacuuuaaggcauuauaucaaguucuuuuuauuuucagaauauaauuuugaacuaccaucaguaaauguaaaaaugugugccaugguaaacauguucaaauuuuaaaugugacaagugaacuucaugcaaauuggcaaaaguucugguacuaaaaguuguauuuguuuuucuuuuacuuaaccuauucaguacugacuccucugccaagagggucuccugagaagacuggguccucuugcccugaugucuacucugugacaugaguguuuuaaagggcuucaugugaacuaugguauuauaguguauguaagcauucauuaaaggguaauaaaauauguuuauguacuaaagcugaucagaaaaauaaggcagaaaaauugauggcauucuuuagauuuuaacuaaauggagcagcuccuuauaauacaaauuguauaguaaggauacaacacuaauuaauauguuuucaguuuaauuuguuauguauuuuuuaauuaucaagaaaaagaaacaguuuuguacauuugaggauuuuuuuuucaacagcuuucaucuguauugucuuaacguggaacuuuaacacaccagaaacgaaaguuguuaaaagcagccuucuagcacaaacacuuuuuuaaguaaauaaugguagccuaaaacuuaauauuuuuauaaaauauuguaauauuguuuuaugaauuauuaaaauaaaauucuuuguugaaugcaucuauguauucuuuucuguugcucuuuguauuucauuaacuuuguaaauuuugacauauucugaauuuauucuuccauuaggggaaaaauguucaguuagaacauccuuggaaauccuuaacagaguuaaaaucgucucuucuuacauuuagaauacuguugaauuuauuucacaugacuaauuucuugugucuaguaaaugauauguucuaaaauuguaucagcaaauacaguuacuguaucacauaggaacccuugguguuuugagugaagcuauuuaggacauguaggcaguauggaggcuguaaaguagagcagccacucugggccauaggaauucacacacacaucucuauguguucuacaauucucuuuucaaagguuuaaugaaaauaaaaauuuaaauaucaagucaaaagcccuuaucauuuucgguacuguaauuguguugauuacuuuuuacuacugcuucaaguaagauuuuuccccucuucaugauaucuuuaaaaacauuuccaaauaacaguaaaucagcacaaugcuuucuucagugcauuauuuauggaguauaucaacaagccuauggcauacauacuucuaaucccaacccucgaaaggaagagacaggcaaaucuuacuuccaggacagccuggucuacacagacaguuccaguccagcuaggguuacacagaaagcccgugucucaaacaaucacauuuuuuucuauuuugcugauuaguuuuuaauauuacauguacuugauugacauuuaaguuguacauuuguauugugucaaguauauuccuuuuauucuuagaaaguaucugucacaauauuaaaaauucuuaucaccuauuuuauaguuuaugcucuuuguuuuuaacauuuugagucauuuagaagcuauuggauuauaaaacaugacauuacugu

SEQ ID NO: 2409 - RNA, 1705 nt, Mus musculus
cacugucuacgccuucccaugccacaaagucacuuaugaaugaaagcccuauacaguucucggccggcuuacaucugcuucaugucgucuccggaacugguuucaacacuaggguucugcagccagaggguggcccagcagagauuccagcugggacaggcgggucagcaucaccgcuggcagcugcugauggaagcaauggccagguggaaggcacaccaucugggguguaucagaaagaaggugaggcacguggcggcagcuuuccaagcucuguaugagucaugggugucuuggggaggcaucuccagacagaacucagggcaagaaguuuuagggcugggauucugcaggaacaaggcugcaggagcugcugcaggcucccguaaaccuaggaauagccagccucagaaucaaggcuaccccaggagaaggcugcucagaagagaaaucugcuuucuccugaccccugacuuuagaucuggggaaacuaugggggcaggagccauuggcagaaagguguucacuuggguggagucuccccuugcagcuggcccaggggcuggggauagacccugaguuaggugacuguggagucugacuccgugugcauuugcucucuaguuucugcagagacaagcugcccaacuccuggcacagagacucggucgggccugcuucuggcagaggaagcaggugagaaccaguguagcacuucuugccuacuggcaagauuucagcuuagagccaucucagccccacaucuaguucagucuuuaacacugucuuugucccagggcuccaucccugugugugccucacccccacccccgcacuaucagcuuccuucauaugccauuuguagaaggcuagucucuucgauucagguuucucuuaaagugucaucuuaaacacacuggaauaauacccaaaaauuaaugugaagugaauuucaagucuuuguuggggucuugauaaaaaaccagaaggccacagucugcucagcacagccaaguuuacagucuguucuugcucuaggcuggagagccuucccuuucggcucugcucccaguuccccagcauugcucuguccauucacuguccagucagaggugucugugcguucuuccuuuuguacuguccuuuuccucuucacagucccugaauauauuaacuaucucaagaucaggaggaggccagguccugaacccuucccaguagaaggaggguagaugcuugagcuggugggcugagaguggccauugccauguugccuguguauuccucugaguaacccaaucuuucgggcccacagcuggcaguccggaagcaagaacaguggggcacagccgggcccuguggcucugggccuucucacuacaagcaaagguaaugguucuaauucccugggcacuccugccuucaggggcugcucuguaggcugggucgugggauccaucauggaagccugagucuuaucucuuguccucucuucugcaagguguggacugcauggcugggcuucauacuugagaggaggaggaaggccgcaugaauggaacgggcuaugcaagccuaccagcagcagcagcuccuacaggagggugccacacagcuucugugcuucacagcugguaugaaugccuuccggcagcagcuccaggcccagcagcagauccagguaagccagggcugcuggugagag

SEQ ID NO: 2410 - RNA, 1705 nt, Mus musculus
cucucaccagcagcccuggcuuaccuggaucugcugcugggccuggagcugcugccggaaggcauucauaccagcugugaagcacagaagcuguguggcacccuccuguaggagcugcugcugcugguaggcuugcauagcccguuccauucaugcggccuuccuccuccucucaaguaugaagcccagccaugcaguccacaccuugcagaagagaggacaagagauaagacucaggcuuccaugauggaucccacgacccagccuacagagcagccccugaaggcaggagugcccagggaauuagaaccauuaccuuugcuuguagugagaaggcccagagccacagggcccggcugugccccacuguucuugcuuccggacugccagcugugggcccgaaagauuggguuacucagaggaauacacaggcaacauggcaauggccacucucagcccaccagcucaagcaucuacccuccuucuacugggaaggguucaggaccuggccuccuccugaucuugagauaguuaauauauucagggacugugaagaggaaaaggacaguacaaaaggaagaacgcacagacaccucugacuggacagugaauggacagagcaaugcuggggaacugggagcagagccgaaagggaaggcucuccagccuagagcaagaacagacuguaaacuuggcugugcugagcagacuguggccuucugguuuuuuaucaagaccccaacaaagacuugaaauucacuucacauuaauuuuuggguauuauuccaguguguuuaagaugacacuuuaagagaaaccugaaucgaagagacuagccuucuacaaauggcauaugaaggaagcugauagugcgggggugggggugaggcacacacagggauggagcccugggacaaagacaguguuaaagacugaacuagauguggggcugagauggcucuaagcugaaaucuugccaguaggcaagaagugcuacacugguucucaccugcuuccucugccagaagcaggcccgaccgagucucugugccaggaguugggcagcuugucucugcagaaacuagagagcaaaugcacacggagucagacuccacagucaccuaacucagggucuauccccagccccugggccagcugcaaggggagacuccacccaagugaacaccuuucugccaauggcuccugcccccauaguuuccccagaucuaaagucaggggucaggagaaagcagauuucucuucugagcagccuucuccugggguagccuugauucugaggcuggcuauuccuagguuuacgggagccugcagcagcuccugcagccuuguuccugcagaaucccagcccuaaaacuucuugcccugaguucugucuggagaugccuccccaagacacccaugacucauacagagcuuggaaagcugccgccacgugccucaccuucuuucugauacaccccagauggugugccuuccaccuggccauugcuuccaucagcagcugccagcggugaugcugacccgccugucccagcuggaaucucugcugggccacccucuggcugcagaacccuaguguugaaaccaguuccggagacgacaugaagcagauguaagccggccgagaacuguauagggcuuucauucauaagugacuuuguggcaugggaaggcguagacagug

SEQ ID NO: 2411 - RNA, 37790 nt, Mus musculus
ugcucccguacguagcacgucacuauccggcgugccccguacccgccuccuccgcucggccggcccaagauggcggugcaggagucggcggcccagcuguccaugacccugaaggugcaggaguacccgacccucaaggugcguucuaggcgcggcuagggucgccaccgcaucuugggaggggucgugguggugcaggggcugggucgcugccggagucgcuucuggagggacugcacggccgggggcggggucgggggcgguggggcugcggcucuccagcgcgaugggcacgggccggggccucccgauggggccaagggggaccucucgguguacugugaccuagguggugcggggcgacagagucagagggcuuccgaggcccgggcggcggggccugagcccugccucccacccagccuucaaagccgagaggcugcgggccgugcgagugcgggcagcgaggccacggccggggcggcgggcacuaaagaaccaggggcccuggacgcggaggugggucgcggcggccccggggcguccuuccggaagcucggccuggggcguggcgggcaugccucuggugcuaauuagggggccaguggggagcacuggcgacccgguggcaccccgccucgcugggcguccccagaacuccagcgcagcuccugcccuugguuuccggggcgugaccuuggguggucgcugcgccagugcguuccuuuaggacaaacguucauccccgccggaagacugggaggcuucaguugcuagagggcuugaugguaccggauggacugcggugaaguaccugggaagaaaagccuuaagaggaagaaaaaaauucuuugguuccaaggaaggccggcagagccuucguguucuacauuccuuggcugaggucugggcagcuuuucuucuggagcucuuggcaccucauccaucucuuuggugacccagugguuguuugguggugggugggugggucguuuagcuaagguugaagacuacagguucuaggcgagaccgcuuuuucugugcuuagggagacccagauuguaugggaggcaccugacuucugcugguguucccuugucugauguaagcccuagggagcacuuguuuuccuccccgagggugaagugagcgagcuuauauugcacauggaagucuuggcauucccuggaaggcaucucuugucauugucccugugacaucugacugcucuggaguaguuugucuucacaggagggcagaagcaaggcccagcuggccuucuucuauaguuggugagcagccauauuugaucaauguuuuguauccugugcuuuauuugacuaaggaagggagcaaacaccaccagucuuuuuugucagauguucaaaauguauggcuugggggaguaggagguacuugugacagaccucggucuuguacgugcuaggccaaugcucugcuacugagcuacauccucaggccuuguuuucuuucuuucuuuucuuuucuuuucuuuucuuuucuuuuuuuuuuuuuuuuuuuuuuuuuuugaggcaggcuucuguaggccaugaauccgagugcugggauuacaggugacucuuaccaauccuguaguuuccuggcacucuuggauuucuguugauugacagauggaaacccugacucuuaacaguggucauacuuggggccuucuaucacuagaccuguaaccacugacgucugggccucgccaggacuuccagaccuguugcaaugagguugcuuugggagaacguggcuauuuguucuggcuggugaauuugggacccacagacaggaaagguuucagagcucccucccucucuggcuuacugaacgcauuaggcagugaaauggauggucaggguuccuccaguccguccucuggugaccaggaaugcacucugcauuccaaagcuauugcacagcucugacgaaaacgauucuguggaucucugugcagguacagagaggugguggugucauggaaacagaaucacaccuuuucuuuucuuuuuuucucuuugacgaaugauagaaagaaaaguuuuugugaguagaaaugcuacucccuccagguccugcagacccuugccuuauaacuucucugcuuuguugacaguguaucuuugcuuuguucacguuuuccccuuacauuguuguuguuuggcugguuuugacuuguuuuuuuuugagacaggucuguuguagccuuggcugggcuguaacucacugggauagcuaaggaugaccuugaguuucugauccuucuuacugucuccugaaugcugggauuccaggcagugcagugagagagaucagauccaggacaucugcaugaugggcaaacauccugccaacugagaugcauacuuagcugcacuucuguacuuuuucaacaguaauugauggugggcacuuuauacuuugauucagaaguguuugaugacagaaucaaucagaauaccaggagagagguguuuguggucaguccuuaggaggguccagaugcauguauggcauguggguugggaucccucccagaagugaagacugguggcuggagggcuccccaaaagcaguugggacugcaguauacuggacagacuuaaauuuuuuaagauuuauucuuugaacauuucauaacuuauguauguuuauugacagauuguucaccugcagagcaaggccucuucagaugugcagccuugggaucuggcggguggcuuaagcaguggaccuagaugucuguuuugcagucucaggcaccuggcagccaucuucuuuuccugugaggggcuaugguggcauccccugacccugggcauggcucuuuucuguuccuguguuuccuccauagugguggccuggcacaggcuucuuuauaagccuuggaaccuuccagcuucauuaucccagugguaucccuagccucuaccuaccagguguaggaguauccccagaauaccuccagacauugccagguugccuuggauacaaagucaccagcaugaggaccucuggacugaauguugcuuuagggaacuuguuucuguguuuuucagagcucugggaaugugguucaugagacauccucuuguauucugacuguagcuuuuuuuccuguugaagucugacuggugccagauugaaagugacaggucuuugaagcaaggggagacuaggauucguggcccagaaucauaaacuaagauccccuguuugaauuauuuuuuuaagcuuuuuguuguuguuauaaagggagauuuuucuucuuuagucuacugaagugaucaucauuccauuaauauuucuacucuuuuuuuuuuaacccccccuucagguagcuguagcauaguauugugucaccuuuucuacuugccaccuaaucagguggcaacuguccagugucaggaccugaagauauugggguagccagcccuggaccccagcuucuuucugaaucucacccuggugguguaccuugauccucuuuggagcccagucagguucccagcuuccacaguucucuuauacacagacacucaaguaugcacacacacacacacacacacacacagagcugcugcugcuuuacggaaaccuggguacaguauucucaagcauaaucuuucguguccuugaaguuuguucuuacagaaauacuuccuugccuuuccugccuugcauuugauaacagacugauugaccaaauacugcuuuggaaauucacagccugaauuaucacagagaaugugagugccuagugcauacccuggauuaaacuucuagagcaguuuuguaaaccugaucuuggcugcguugggaggaucaucaaguaugagagaugcuaauagccauaaaaguuugacuugggacaugcacuuacugcuaggugguggccauaguggaauccuagaguaggccagaccuuuucauauacaaauuugagccagcuguucucaguguucaggcuguuugauacuaaggaugcuugguccacucuuugcccuuaaguacuuagaaaacuguaauuuuauucauuugccaaacccugccacuuuucaacacucuguguucuagucuggagcagccuccuuuuacuuccuuuuagauccugccauuugucagugggccagucugaguuccuuuuguucuuaaggaccugugcccugaugcauguauccuacccccucaaucaccuugcuuuugauuugucggacauuugagugauuguguguccaauuggcauaccucuguccuucugaaaggcagaugucuacugagguuagaaagugcagucuugaauaccuugauagcugcuggguuuguuuuuuacauguuauugucuuaaacagauuuugugggguuuuuuuguuugguugguugguugguugguugguugguugguugguuuuuugagacaggguuucucuguauaguccuggcuguccuggaacucacucuguagaccaggcuguccucaaacucagaaauccgccugccucagccucccaaaugcugggaucaagggcgugcaccaccacugcccagccuuaaacagauuuugaguuaggaaaacaaagugcuuuguaaugccuaguucugugugguggguggaccaugccagaggcacugcuaaguugaggcacagaguggcaagggacuugaguaggccauauccaggacaagcccuuggccuuugcugugauagcaguuguugaugaauuuccuaucaggccuuucgagggcccucagguguuaugaaagguacuuaugcguguccucucggaauucauacccugccugaagauagcauuuaacaagggaguguuuaauauauagauagaucugguaaaagguaaccagaaugggcgauauggcgcagcagguaaaggcgccugcugacaaaccugugaccugauuuugaucccuggaagccuugugguagaagaaacccaauuccuaaaaguuguaaugugaccucuacuuacaugacaucugcauacacucuggcacucauguccucucacauguacagacauaaaaaauaacuuuugaaaaagauacuacugaagccaaagugaaguugaguaguggaaggggacugggcuccuuuggcugacauggucagcuagugagcauggaaauaauagcuggcgcucugaagccauggacuguguaaagucuuagcugacauugccuuagaaggcacauaggccagcaggaugauaauggcugguaaagaccuagacagugugugagacuguaggccuagaagaaaggagacugaccagcaucuauauccaguauguauccaucuguggaaguuccuugacuaccacuagucucauggggcucagugucacagaguucaggcucugccggugcugguguguauugcuacagaaucuuuagacauaggaaccauuccuuugaaaauuugaaaagaaguauucacuguuguaauaacuaguaaauaucugccagaaugugacuggcuggagaaaacacugggccuggcuuuacuuuucugauugugauccucuggugcuacccaguaccugccuccaucucaggcuaccuucccuccuauccuguuugcuugcuugcuuguuuguuuguuuguuuguuuguuuggaggcaaugucucuguaauccuggcuguccuguaacuugcuaugcagaccaggcuggcuuugaacucagagauccacuucugacucccaaguggugagguuuaaggcgugcaccaucacgcccagccucuuccugcuguccuuuuagauacucuuuccuacucgucugucgaccuuuaccaguucagcuguccaugccuaucaugaguuauggguuccacaugucccacuuuaaccuaacuuuagggcauccgcuuguuuuucugcuuuccuguuguguugcacuuccccagcucccgccuuacugggguggucugugaguauguagcuagcagcuguugcugcucuccccaucuucuccuuucucuaucauacugcucugccccacuuuucuccagguuuucuccauucuuuucuggguagucuauugguaccuuuacuguuucuccacaaucaggaaucauuuugcuugcucauuggugucaccaauuaaccuugagaggugagguagccuuagugcuugacgucaggcuucugccuccagcuaggcuucuccagcucucacucuacuagugacuacugcaguguauauguuucuuugguuaucugggagguaggucaggagugccacuugcaaaaugaacaauagauacuggccucaaagccucagaccuacugcuuaccauccuaguugaagacagugucuucuugacuuguuccauggcaggcuacaacuccuagguugucacucuauccuuucaacacacauggagucacaccuccaagucuccuguucucuuuaaaauccauaguuaauaguagcugcugggagacaggcuucaugucuagcugggaagguugagaacacugcuaugccacguggaccaguuuccuguggggcaucuuuccagaaucccuguggaacauuuauaaacauagacuggccacaucuaucucgacuuacagaaccuggaaauacauagcccauuuguagcuuacuauugccuaaauaaaagagagauuuguggucauuucuuagccuguuuuuguuuuuaaauucccauuuguuuguuuguuuugagauacuuucucuauauaucucuggcuguccuggaagucaccauguagaccaagcuggccucaaacucagagaucuguuuaccucugccuccugagugcugggauuaagggcauacaccucugcauccucccuauuuauauuuuuuaaaguuuauuuauuauuauaaauaaguacacuguuguugucuucagacauaccagaagagggcgccagaucucauuacgggugguugugagccaccaugugguugcugggauuugaacuccggaccuucagaagagcagucagugcucuuacccacugagccaccucuccaacccuauuuauuaauuuuuaaagguuuauuuuuaguuaaguguguguaucugcauguggguaugugcuuuugagugcagguuauuugagaaggccagaggagucaccucuggagcuagaguuguacuuugagcugccuggguugggugcugggaaccaaaccuuagguccucugggguaccaagugcucuuaacccuugaaccaucucucuagccucccacccccuucccuguuuugguuucuuuauaguauuaacaauucaacagaauuaccuacacuugugaccuuuuuucuccuucucuuucuauuagacaucuccuuuagaauauguguuggucacugcuguaucccugcacauccaaguuccuggcacagagucaugauaaacagcuauuggccaaaugaaauucuccacugucugguuggaaaauuccuuaaaacuuagugucacuuuuguucacuugaauuccagcaugcuuuucuaggcagacacaucccuucuuuguuuccuuuaaaucaguuuucuaaccuacuugugccugauugcaacaucaaccuccuguccauacaggucuggcauucuuacugauaaauuccagccuagagucagccaucugugugaauucugcauuagcccaguaguugcucacuucugggggcccuggaggcucacuuggagggucccuugcauccaagagcuguuucauguauugcucuuuucauucaccuuaagcuccuaugcuugugccauaccccaugggcuguguucauggcuugcuuuucauuugugaccuguuugccuauacucauugccuuguuccagugacuuagaaauaagucaucuguucucuaccccugcucaucuucaucccucacaguuaaaagaugugcaaauaauggcugccaguuauccagugaacaaagugucccguucucucuccuccuucccucccucucccugagaacugucuuuagaauagccucacuucuguucuugcucacauuguccauggucaugcuguugcuagggccacugggcaaccuuauagggcugcucagacccuuugaccacauguccauucacagcaaccugcuaacagguauccugguguucaucuugaccuuuucaggcuagugacuucucuguagucuugagguacauuccuguuuggcuuccacaguaguuauuugccuggcuuccccaggcucacagccaacucucauucuucauuauugaacuaucugcagaauacuggaacagcacccaagcuugauccuguuaguuguguucuuggugaucacaugagucuuguggacuuaaaggaauucucuauccacauggcugauaugcccuagaucccugcuccaggagccugaaaagcauuaccuuaaacucuguaaguugcuuaguuuagaauggcuaaaguggauuuuguaaaaaaucuuuuauuuuauuuuauuuuuaugugcauugguguuuugucugcauguaugucugugugagggugcugggaauggggccuggaagagcagccauucucuuaaccgcugagccaucucuccagccccaaaaguggaacuuguaaaucuguuugugggguuacuuuugaaacaggguuuugcaguauggauaagggagggacucuugaggucccauccccuuaccgaggaacuguuggcaguugauagcugcuacugggggacguagaaucauucuuuauagguguggcccaggcuggcccugaacucuucaaucuuacugccuuggaugccugagugcugaguucuguuaucuugguuuaggcuuuaacuuaauugccuucuccaaauccaucucccacuuuccuccuacaguaaaggacagccacuggggccagaaauuuggaggaagcuuugaccccacaccuauucuuggauguauuuuaugaacacccgagugggagccuaauucaguugcugcugcugagaaugggugugauuucagcucugcagaguggauguggcucccaggugguugcuuguucuaucucugcccgucauauccuuuugcagauagcuaacaguucacaggccauacaguuugacgcgugguuccuuaaguaaaggucaagaguuuuaagaggagucagccuagcucuucaugaugccuuuccucuacuaccacaacagccucucuucucagcccucuguccugucucuuggcuucucauucaugucaccuacugaaauggcaauucugcuucuuucugccuucuccuacagccaguacuucauccacugcacuguguuguucauggaaacucugcugaaggguaaagguaauucuaaguauuauucuggccauucuaccggugcaguggcauaaggcucagaggacaucaagaggcacucaucagcacacaccaguaugauugauuaccugcauaggaccugcagaagaucacagacucaaacuuccugcauggcuaggagaggaacucuugagguugucaguagcuccuggggaaguagaagaauucuucuuuguagguguggccauugauagguuccccaugcuccuuuggauggccccacgcccaugcacauagcuggauuuacuagguuaugagggaugaaggaagaagaaaaaauaaugaaauugggaugaguguauuagggugacuaucauauuucauguaugcauguaagaaguucuauaagaauaaucuuuaaagaguaguccagacaguagguagggggucauaugcugaaggacgagucuauauacucuaaguaugcucaauaugaguggaacaaaaagcaucuggagaagagcagacaaagcuagugagguaggcagcugugaaggaccugcaguagaugcugugcugaguuccugcauuccauaugggaagccagaacuccaaacacuccaaugcuugcuaauauucccaguccucauccccucuccagauagaagauagauuucuuugacucaucauagcugagcaggacccuguggcagguucuggccagugugcuaugacuugggaccaagucucauuuccagggccagggcguacaauggcaugcuucucaaagaccugcuaugaugucaggcuuuacagaccuugguugcaaaugagaaaacaaccagagguuaaaaagacagaaaguacauuaauauuugcccagacuagaagaaauagaauuauagcaaucuauucgcgagauuaaaagcauguuuuaaaaagagauuguaauaauaaaugcaguuuucuguaaacaagaaaaguuaaagaaucauagucgcuagaugaguguacuuugaaguaugaauaaugccucaguaaaguugcuggaaaaacaaaacaaacaaaaaaguaugaaguagaaguuaggaacaacuguuaggaagguuuaguggggagcuggggagaggguuuaacaggagcacuugguuuuagaggacuggauucaauucuugguacccauauggcagcuaaaaaccagcuguaccuccaguucuaggcagucugaugcccucuugugaccuccaagggcaagcacacauacuggcaggcagaacacccauauacauauaaaacaacaacaacacaaaacuuguaaaauaaaguuuaguggucagcuggccaugcaguaggcacugauaaaguuuaguggucagcuggccaugcaguaggcacugagccuagccacugcccucuguaccaucaguggccaguuguaucauauccugaggagaugucuauucacgacagcaugccaauuggaagaaguggccagggugaaucuuggacugacaguggugauacugaaggagcuugagaaagaacacagcugguggaagacaggcauuauuacauugagugucuugcuucugugggaguuaguaaugaugccuggugcauguugugcauaggacagugcuuuuuacuuagaacaagggaaacaccaacaagagcagaacgcuacugaccccgagaguccaggcuacuugggacugcuggugggcucugugcuaccuacagacugagaguaagccucacuagugugaggugucacuggugcguuaaggcuugcuguagguugguucacugaauuaugucaaggaugaagacuucugaccacaugagacuggcuguagugccuuuuggugucaugccaugccagcuuuagcagagcaugcuaugcugcauugugcgcugccuguguguugcucuguuuggguuuuucucaaauggacugcuggcauaaaacaggucugcaugugaccaguggguuaaaaauggacaugagccgggcaugguggcgcaccuuuaaucccagcacuuguggggcagaggcaggugaauuucugaauucgaggccagccuggucuacaaagugaguuccaggacagccagggcuauacagagaaacccugucuugaaaaaaaacaaaaacaaacaaacaaacaaaaaaauggacaugaaggugggccuaggaaaaaggagugaugauguugcaggcucucuuuccaucuugaucaucgucagccacauuguauuauggcuucuuagaauuagacuagaaacauguaguuguuuuuuaaagaaguccacuugaaauagggguuuaggcuguugcugucugucuucaugguauggccauacuuggaguaguagcuuuggguagcacagaacuucugugauuugcuagagaugcuauuguaugcucucuagggcacagaagguauggcuggcuucuuagcaaauacuugggaugcuuacgcuggggcuuuuuuuaagguuuauugauauuaugugaaugaguauuugccugcauacauguauauuccuauggaggucagaaaagggcaugggacccccuggaguugaaguuagagauggcugugagccaccaaaugagugauaggaacugaucucagguccucuggaagaauaguuaagugcuuuuaaccuuugagcuauugcuccaguaccuuugagguuucuuaauugugagcaguaaaugccucaugucaucaaaaaacaaaacaaaaacaaccccuuuccuuccuauacugcuggaaauggcuagaaacacaaugacaagcuaaagcaccuuuuuuuggccauggcaguggggaaggggaguauucagcagaugaugucagaaagcucaaagcagguaugggaggcagcuugaggaaaggaggcccugaaguagacgacagcacaagagagugcugcuuggcaggugggagugcagcugcuucucuccggccucagcaagucaugacugggcuucacugguggaaacaaggaugaggauguuuggugacuccaacagcagcuaacuagagagagccugaccuuaaauacgaguuaucauaugggggcuggagugauggcucagagguuaagaacagcuauucugacaggacaccugaguucagcuuucagcacccacaugguggcucacagccaucagugggaaugccccuggugcaggcaaaccacuacuguacauaaaucuuugauuguuguuugguugguuuugguuuagguuuuuuuuugacaguauuucucuguagcccuggcuguccuagaacuugcuauguagaccaggcuggcuuccaucucagauccuccugccucuaccucccaaaugcucagaauaaguaaauauuaaaaaaaaaaagaaagaaaaaaauauugucacugacuccugcuacugcccagacacauugagagauaucaaguauguuuacuaaguguaaaauuuuaaauauuggcacaagcagauaaaauaaggcuaaauugaaacucaaauacucuucuaaagaauccuccagacauaaacuaagaauugauucaaauguauaagaaaaaguaggaccuuuguuucuguacagaccugauggggguacaaacaauguguuaucaaaggaaaaauguauugaguugagcuauacaaagugcacuuuuacucguuaaaaagcaauaacuaaugacccuguaauaugcaacggcaguuguuuaaaacuucccaauugccuggaaaagcccaguacuggauagcuuuacuggugaauucuauuagacauuuuaaaagggaauacaucaacucuacacaaacuuuucuaagaaauaaggaagaaagggcauuuuuuuaaaccucauuuuugugagccuaguauuauucauagcaaagucagacagcaacacaugaaaacuacagaacaguguucuuuaugaauaaguacaagcuaaagcccuggcaguuucuacaucugagcuaggcugguaucccaagcacuuggaaaguagaaguaggaaaaucagauuaggaagucuauaguuagucugggcugacacuccucaaaauaccaaaugaauauuaccccagaaaugcaaaguuaguuuaacuuguggaaaucaguauaaugcacauauuauuggaauaaaggacagagaccacaugaccaacuaaagaaaugcagaaaaagcacuugacaaaguaacaccuauuaaagcuaaaaacaccaacuucuucaaccuuauaaagggcuucuaaaaaaccagcauauuaacauacuaauuguguuaacaguaaauuagcuuaauugugaacaguaaaugccucaugucaucaaaaaacaaaacaaaaacaacccccuuuccuuccuauacugguggaaauggcuagaaacacaaugacaagcuaaagcaccuuuuuuuggccaugacaguggggaaggggcuagggguauuaacauacuaccuagccgggcgguggcgcacgccuuuaaucccagcacuggggaggcagaggcaggcagauuucugaggucgaggccagccuggucuacagagugaguucaacauacuaccuaacaucagaguugaaagugccccugaggucagcaacagcacugacaccacuccuuaccacuuagauucuacccuuggucuguagguuguagccagugcagacagacaaggaggccaacacagccagagcagaaagaaagaaggaagaugacaugaucaugggugccuaaugcacguuaucacacaguuagacuuaauaauaaauaguucaucgguguugcagaguacaaaagcaguguauaaaaauaagcuauauuucuguacccuagaagugaccagccuaaaacaauuuuugauuuacuguagcacaaaaauaauacggcauguacgaauaagacaguauuguuagguuaacauuacuuccugaacuaaugcgcagaguuagugugagcugcaucaaacucucagcuggcuucccccccccccgcuagaaauuggcaagcugcuuguaaauccacaguaugagucaggaacccaaaccagccaagauaacuuguaaauagugguuauagaacuuggaguuuuggguuucaaaacuccuuauggaggugugaccaggugauauuugcaaaacaauaggcaaaucuacccaaauugaagguaggcauuuauuuauuuugcauugcugagguuugaucccaacacuguacaguuugaacucaacaccuugcugagacagcuggguuuucacauacaaaguaaaguugggucccuacaucaaucauacacaaaaacuaaaagucaaagaaccagaugaaagaucuaaaauuaaaaacuucuagaaagcuagaauaauaucagcgauagcgauagcucugaccuugagucuggauucucuaucccugagcacaagccuggguggaagacugcucuauggggagcugugaacaugagaagagauuauacaugcugaaggcccauauauggccuuugagagcugauuggauuugggacagagccccagugauaaaguuaggguucuuaggguuuguauuucugagagucuucugcaguucaggcugauccugaaguguaguuuauguccaaggaugaugaaguuucuacguuuugcauuuuuacuuuaaacauacuucuuucgagauuuauuuuaaccccuuguuccauuugccauuuguuuguuuaggauuuuuugacacaggguuucuuuguguggccuuagcuacccuggaaguaguaaguguaucacacaucugugccccaugucuguggagucuagaagagaguaggggauccucuacaacuggauacagacaguugugagcuaccacacauuggugcaguaagugcuuguaacuguugagccaucuccaguucuccuuuugaauauaaauauauuuguucauuuucacccacuacccuauccccucuuauccuaucaaaucuaucuucuuucaacaagucccccuagucccccuacuuauuuuguuuuauauuuuugugaacuaguaaguuuaauuuagaguugcuugcgugagcaugggagggaauuaucuacuggagcauaggcaguauaccacugaagaaagagauacccacuccugcagcaaccucuaauugccaguggcuccuuguggaguguagggcuuuaugaaccucuucucaauccaugaugggauacuaaugggccccaucuugugcagguagccacagcauucuuccccauccugugacucuuacauucuuucugcucccucuucaguguuccuuaagcuguggagggggugacacacagaugucccauuuagggcccaguacacaacagucauguacucucagcacuuuggucaguuaaaugagucuuugcauuaacuguugcuagcuacaaagagaagcuucucugaccaggacugagaacagugcuagucuauaguuauagauaguuagaaggcagcaugacagcauggccauuuagcaaagcagcuauaauaaguuucccacuagggaaccagccauaaacuuuugaccagguuuagaguaccgaaugucaauuccuccuauguugugggucuaaaacucagucagaaaaugguuaguuauccuagcuaacauuucacaccacuauugcaacaguggucaggucuuuccuggaagggugguaguguagcacauggguuccacagcugaguaaggcuaccaaugacuauuuuuccucucuagcaagcaggcuauguagcaccuuccagcacuguaugaaagcuagccagcaagaaggaagcuuccagcucaguucuaucuugauuuucuauuucugccaccagagugugcgguguuuucagcaauggggucuuaaccauccaauucugauucacaaaccaugagcaauggcaguagagccuguauuauuuuagggaccucuaggacuugccuggccaacaacuggggacaacuggggagggaucccacaucuggcacuggaauuuucauuuaauaaccuauggcuuugggagcaauauuauucaccagugcaaagugacuacauucaaaguguuuuuuuaaauuuuuauuucaguguuuaauuagcuuacaaaauggguuuucacaugacuuuuuaauacacccuuaguuuugguuaacccucccccaccccuucucuuccccaucucgccuuaaaccuuucugccugagucacuucccuauuuacugccauaucacauguguucuacuaucaagugaucuuggacuuucauucuccugcuugaguacaagcacucgggcauaugccaccuuacuugguucugugugcugcuggggauagagcauagggcuucaugcaugguugucaggcacugcauucuugugcagcacugguccuagccuggauuaacgugggcuuauguguggcaugcacgaguggagaugagaacagcauucaguucucuuucuguaacauggguccuagguaucaaacucggaugaucaggcuugggaacaaagccuuuaccacugagccgucuuccucugcgugcauaccaaaagaaugugaggucauaacuaaccaccaagagugucuuugccagacuuagcucagccagccgcucaaccgugcucagagacuugcaaccuuuuuaacuucauguaguaaagacuguuuguguaagcuuccugagaugaccaaaagagcugcuuacaaaauaggaagaaacauuugcaaaucaccucucucguaagagcuaguauuuagaguauaugaagaagucuuacuguugaguaauaauuuaaauuuuaaaaaugagcagacauaguagauaaagcaaagauuucaacaacgcaagcuggacgaccagaguucagauccccagcacccucccacaaaaagcuaugaugugggagcuuacuuguagccuaccuaguccuagaggcugagacagggcaucccaaggcaacuggcuauguagacuagccaaaugcccugauaaaauagagugauuaagaagacaccauuaauaccaguuucuagccuguacaugcuggcccuguguaccuacaugcauuccaaaaccuaaaacaauucaaaggcuuucuccagaaagccacugggacauacuauuuccuucugcuagaauggcuacagaagaaagauguggagaaauuauaaacccuuagacacuguugauaggagugaaaaacaguccugcuaccuuuuaaaacaaccuaggcauuuauuaaguaguugcuguccauacaaggaacaaaagccuuacucauaaccgccccaaaguacauguggucucaauuuguguacauaaacugagguauuaacacaggauuaugcauccagacagagagcagaacacuguucaucaugguuacauuguggaucgguuucugaaacaacauuaagccaaaggucagggaaagucucuauaaccuaagguuucaauugugugaaguuucaagaacagagacagucaugucugcgugcuugugucuugagggauggcuaugacaugauuaugaaaacacucuccgaguagauaguaguaaugauuucacaaccaugcaauuacacuaaaaccuuuuaagugguacguucuagggggaguuagagucugugaauuauauaaauaaaaauaacagcauacuccuuuuuuuaaaauuugguaaggauuagcuuuacugacaacagaaaaggugcagcauggcugauuggcugguguacacggcucugcauaaugagcaauuuucagaauaggucuguggauugauggggucaagaaaccaggcauggucugcggcucacaucacaucugcuccacuuguggcccuugcacaucaguaaugggaaucuuagacagugaagaguuacucuguguguguguguguguguguguguguguguguguguguguguguguaccauccucaaucagggaagcuaugaacacugggaauguuauaugcucugaguuaagaggacucugcuuuuaaagacauaguauaaagagggggaaaacacaauuugauuguauaucuaaauuaaaauaucuggauuccauugaauuaaaauauauuaagaacagauuucacucucccaccacgggguguuggcucacaccuuuaauaucagcacuugggaggcagagacagguugaugucugugaguucaaggccacccuggccuacaaagcaaguuccaagacagccagggcuacacagaaaacgccuguauggaaagaggagggcuucgcuucccugcccugcagacagccuugcuguguagcccaggguagccucaaauguaugauuucccugcccgagugcugugaguagcugggauaacagucauaaacugccuugccuggcuucauguaacuuguuauuaugauaaccaaagcugugggucucauggugccuugcuguuuauagaugucuuacuuuaugauggagguggggggucaaaccuggagcucaguucaugguagcuagugagcuuuuuuuuuuuuuuuuuauuucugauauccagcguuguuuauaaaaagaaagcaguaguugugguaguauaugccuacaauauaagcacuuaagaugccaaggcccaaggauuaugaguuuagggcaucuugggcuacaugaaauccugucucaaaaaaagggcaaguaggcacuuguucugaaguuucucuuuuuccugucuggauuuauaauaaugguaaugccacaaacuuagccauacugucuaauuugucccauuuccugugucuuuuuuuccccucuccuucauuucuucccuuuugauacauugauagggauguucuuuuguguuuguuuguuuguuuguuuuuucuuacaaaaccauaguucauagccacauucaguugaggcaaaugaaugccucacacauugucagaugcagcugggugugcagugcccagaggaguccugcuguuaguuggucugugagagaagagcuucccagggagcuugcuucugggaacacagcugugagccuagucuccacuccuuuauacaacagugguuagucccuuugacugacaguuccuguggauggggcaccauggcuucuuuacuucaucccuguugaugagcauugaacugggccaucucuuccuuccucgaggaugggguuacugaaucaucuugugggagucucuuuccaugagaaacugcccaacuuugcagagaauuauucaagugccaacaggggucaacuguuucucagcuugauugaauugcucuuugaaccagaguucucuagagaaccagaaucaaugggauguguuuauagaaauauuaaaaauagugaauugucuugugggagucugaaggcagggagauuucaagauaccuggcaaaccagggcaugguguauucucagaaaaaagaagguccaugguagaguucuaauccaaagaugugcagaucugagaccuauguaugauaggccagaagacugacagcagcagcagcccagcugggugcacacgggguuugacuuaugcacucuguuuacuucuucaccugguugaacacaacccacaccuaagaagccaucagcucuacugaggacuggccuacuggcucauccagaaacaugcucaugaaaaugugauaccugggcuggugagauggcucaguggguuagagcacccgacugcucuuccgaaggugcagaguucggaucccagcaaccacaugguggcucacaaccauccguaacaagaucugacccccucuucuggagugucugaagacagcuacaauguacuuacauauaauaaauaaauaaauaaaucuuuaaaaaaagaaaacgugauaccuaagaguagccauuguccauuuucuuuuauauuuccuggugacaagcagcuauauagaucuuccguaugucauggaaggcauuucuuuugagcucucugacuuguuuugagaaugggguuuuugcuaucauaauuaaauuuuuuuuuuuuuuuuaggcauuccauauuuuccuuggaaggggucaugcuagauguguaaauuucuaauggcuucuuuccggugucugauucuguucucuuugcuuaggugguugucugucugcagggcagaagcuuggcuuuggugaagacuguuaaugaugaguuuucauuuauaguuugugugguuagugucauuuacaaggcuugugaccucuucaaggucaugacagugacuuguuucuuccuuagaugauuuacagggaguuucagcauuuauguuuagaucugugaucuguuucaggauggucuugguagauagacuaggcauggcuugguuuucacugcucucagggaguaccuaguccuaguauuguugcaaaaacuacuauuuccuuugccuugugguuggacauguauggguggauguggggcucuauuuguguguuuuccaccuucauuugacccauagcuaaucucagaccagcacauugcuaaggggauagaccaacuauugcaaagguuaauaguuauuucuuggccuuugagagaugagauggcucagcaguuaagaguacugacugcuugucugaagguccugaguucaaaucccaucaaccacaugguggcucacagccauccguaaugagaucugaugcccucuucugguguaucugaagacugcuacaguauacuuagauaaaauaauaaauaauuaaaaaaaaauuaguuauuuccuuaugcugucuguggcuuggcuugguguggugugguggugauauugagauggaauuacuuuuaugcagcccaagcucaaauacaguauccuccugccuuugacuccugagugcugggaucacaaagguauguaugcaccgugcucagguauaauaguguugauaucaggucccagucuaucagguuguauucuaucaaaguguuaguugguuucuuuugccucagacucauuauauagucagcaaggaucugaucuugaacuucugaucccccugccuccaccuuuugagugcugggauuacagguguacagcaccacuaugcacaaucuguuuuuguaaugagcagggaucaaagucagagcuuaauauugugcuggacaagcgcugucagcaccaacugagccacaugucugucugucuaucuaccuaucauccaucucucuaucaucugucuaccuaccugucuaucuguagugaaagcacagcuuagaauuguuaccuguacaguuugugcuguuccuugcgugugcccucauggucucuggaacauucuauuuuguagaacugaaauucugccguuagagaguuucacuaugcacccuacuuuuguucucucagagcuugaucuuuuuaggaaucuuguucaguggacugaaacacuugucauguuguggccaguucauuagcaugauacccuuagguuucaccuguaucuugguguauggcaggcuuuuccauugucaagccgaauuaugugucuaugcugcguuuucuugguucguuuguuggugaacacucagauggggauguugcagugaacauguaugccaacaucuuguagagaugugcuccuaguugcauaccaagagugggccugcuacuaaauacaguugucuguucauaguaauccucuagugguucagcagcguuccauccuugccagcaagacacuuuguggauacauucugugguuugggugugauuuuguuguugcugcuuugagauaggaucagugucuggaacuuucuguguagaucagacuggguguacagcacaguuaauacuagccauacuugacaguagagauaugagcuguggcuguagcuuagccugucacagagguggggcaugguguucaggcauaguuuacuuguguugugcucacaguuggccaggaaaugagugaaaaguguggagagagguguggcagugauucucuggaaaggcagaaaauaccuuauuccucacauucucuucuuuauguaggaaauggguugguuuuguuuguuucuugcaaucgcaauaaaaacauucucauggaagagaaauguuaauguucauauguacuuccacaugaaauaggaugacuucacauuaacccugaaugaugugaagcuuuuggacucauccugacuguccuguccagugugauccucaccuccaguuccccacuugccaaauggggagaagccuccuucucuuaccuccucuuuggucacuuuuuaaacugcuuuucuagaugaacuuuggaguuauuuuugcccauaaaggagcggggggggggggggugugugucugucugucugucuguguaaagacuguggccuagcacugcucaagggcuagggcgucgugugccugucuuaggucagccuccccuccaggcucuggacugccucuagucaucauacuuuguggggccuggucagggugcugugaguuguaggcugccugugccagaugugaaggaggcccaugugcagggcuguaucuauauauugaaggucagggcugagguucuuugugccuuuucuugucuaggugcccuaugagacacugaacaaacgcuuccgagcugcucagaaaaacaucgaucgagagacuagccacgucaccauggugguagcugagcuugagaagaccuugaguaguugcccagcuguggacucuguggucagccuauuggauggugugguggagaagcugaguguccucaagaggaagguuuguccucugggagugggcccuggcuaggagaucugagacaggcaaacugugggcaggauguccuggccucaugcugcuagaaagagaacugaaaguguccuaagccugaccuaugaggaagcuaggacuugcagagacuacugguguuucacccuagaauuuccuagaacugucaaaaugaccuagcucugaggaugaagacaugaauaguccuuuaaaacuucuucccaaagggguuagagaacucagacagcagaagagaauuagcagucagucacagauaggagucagauauaggaaaaggccagaggacugcagcuagcugccuuggagcauuaucugaacaugugacgugacuugacagaugacuuugagcacccaggagagugggccagaaaacaacuugaaaaccuauaggaaacagaaaguauaaaaguuuauuuagaguuuuaaaaagaaugagugaaaaugccagauuaaaaaaccaguuaaccagggcugaauacuguggcacacaccuuuaaucccagcaucugggaagaagagacgaucuguuugacuuuaaggcuagcuggucuacguacuaagcuccaggcuagcuagggccacauagugagacucugucacaagcaaauaauaaccagccuuaaaguauuagcucaauaccaagacuuggaaagugguuccaaagagauuguguagaauacaguguaaauagaagagcaaaauauauuagagaucauggacuucugaugugguugcccagagaaggguagagacaggacagggugaaugauagggcuacuaaagucauuggcucauagaccugaacaacaggugaagauaaacuuaccuaguguguuacacaaugaggcgaagagcucagacugagcaaccucaacaauagccaaggaaagggcagaaagugaugguuugggaggaaagaaagccaguaggggccugccuuguggucucuugcauuuagcuauuagcuauaugacuauaaaaaguuucccuuaaugacaugagaccugguuccuuggugacacuggccuuucagaaauucagugacacacaggguuaugacagccauguugggcaacagcgcacauugagaacauuuuuaccuaggauuuacuuagaaccaaguugacuuuuuaauaaacauauaugauuaaaaaccaggcuccgcacgaugacacaugcuuuuaauccuaguauucaggggacagagcccgaaggauuuuuugaguuugacgacagccugguuuacauagcaaguuccagguugccuagggcuacagaguugaguccuaucgcaaaaugaaugaaugaagaaucacuuuauaguaaauaauaagagaggaaguacacaaauuucagauucuaagcaucugacaaugcagcuuaaaccaaaacaaaauagauauuuaugguaaaccuuuuugagugaaaugaggccucccaugugcuugacaagcacgugaaguggucgauggugugucauacuucucucggucaucacugucucauacaaauucaccccaaagaaagguagaauccgauuucuuuuauuucuguaucuaguccuacaacguccccagcuuuuacuuuuccuugcuuaucuuuuugugagcauucagaggagaggcgcauacauacguuuucaugguugguagugugguucaugggacaaaccaucucaacugugucugcuaugacuuaggcaguagaguccauccaggccgaggaugagagcgccaagcucugcaaacguaggaucgagcaccucaaggagcacagcagugaccagccagcagcagccagcauguggaagcggaagcgcauggaccggaugaugguggagcaucugcuacgcuguggcuacuacaacacagcugugaagcuggcucgccagaguggcaucgaggugggcuuuuccaacucccgggccccucccggggugugagcacuauugcauuccuuucuguuccuaccuguagugggugcccaacagucagcgacagucacaggauacaauugacuugacaacuugaacuuguuagccuuguggugccugaggaggccaggagguuggugcucuagacagagcucucuggagucaaugacauggacauagccagggaaagguacugcuugcugccuuugccccugaccagaccacuauuagggccacugcugcuagacacugaaaacccagccugugcuuggccaccacagagugcaucacugggcccauggguuacccuauuuuuuuuucuuguaauccauuuuuuuuuaauuuuuauugaauuuauuaugucaugaugaauuucuugggaaauuugcauaucuuugggcaaucaugaauaucuuuugggagucaguuuaauccuaccauggaaguuguggggcuugaacucagguagucaugcuugguggcaagugucuuuacccaacugagcuaucucauaccaucacucaagucugcuuauuaaaauuguuuaucuugacaugggaaaaaauaggagauuuuuauuaugauuccuuuuacuuaaaggcuguuucuacaccauguucagcaaauggaucugcaugcccugccuagccauccucuggaaggagcggcccauaacuucagcucccuccccuccccuggucauugucaugcauguauaguguccaguggugggauaugauaguaacaucaggucucuguagauccuagccagagcauacugccuauggcucagcuagaaauuaucaguuuucuugugcugguauucuccuuguuaguugagaaacguuuuuguuagaguacaccucagaaagaaauuuugcuuuugaaaugauguuuucaggcugguaacauggucuaggagguaagacacuuguugccaaaaaguaacugcuuuugagcccuauggacuacaugguagaaagagagaacugacucuugcaagugguccuccgugugucugcccacuaauagauaaaucagugugauuuuuaaaaaucugaaggcauguccauuuucuucagauaacuuuucugcuuuuccuguaaugugcauauaucucauuagcccagccccucauuuuuugcuaaucuugaugggacccuuuuccugaccuuggaugaauccuccagagcucagcagaugauccgucuuuggcccucuucaaagagcauagccacuagggagaguguuguaucacacacacacacacacacacacacacacacacacacacacacacacacacucuuucaaauguguucagaauagacaaagcaaaacauuaguguguaggcuguagaagcauuguacaccuugcugaggacuuggaggagguuauaccuuauguuggggaccugguggggguguuaguuauuuuuguuguugcuacaacaaugccugacaaaagcagguuagugaaggaaggguuaacagaguuccaggagauaguacauccugucagagaaggcguggcagcagaaucaggaggcagcugguuauguguauacauagucaggaaauggagguaauuauuagggcucagccugcuuucucccuuuuuagucuugagacucauagcccuuggaaugguacaaaccacauuuuaagaugaauuuucccaucucaguuuaccuaaucuacauaaucccuuaaagauaugugcagagauuaauuuccauggugauucuagaucucaucaaguugacaagauuaaccauagagagccugaagccugcugggagccaguccuggugugcauaaugcuuguguuccuuguugguccuuuacuaaggcaggaugguucugguuccucuagccaguaggcaucugccauaugucagcuucccaguccucguggaccauuuuucuucccuggaaucuuacugccuugucuaugagcagugcccuagacaguuugggccaaauguagggaguacuacggcugagccuaaacucagggugggaggcuggggugaagacgguagaaacuaguugccccugcuuguaggccacaggcacguugugaccugaacugccccuuccucuaaggaccuugugaauaucgagauguuccugacagccaaagaaguggaggaguccuuggagaggcgugagacagccaccugccuugccuggugccaugauaacaagucccgacuccggaagaugaaggugugugagcuuucugggcugggccuggugggaauggacgggucucuauuggaggaggccgagguuggguggaagcaguguuaccuacccagaacuaccauggcuucaccugcuguggucuuuugggucgguuuuaguuugugaggcagagguguuggguuuggaauggggacggugccuccucaggaggagccucuuguauugcuuuggucagcagugaaguauggagcccuguuagguguacagcauguuuacuccgcugcacuuaaaguugaggcagccuguggauuccccacacagucagauaagggcugcagaacucuggacuguggugucuaccaaauauacacuuaaagcacagagccacagaaccuaaaccugcucuguuuuguagcagaaauguguuagcuuuaauuaguaggccugcuucccccagaggagcuauguuucuuguguucuaucuaagcuaagcgcugcuuuaacccaucugguuaagguuuuuggggugcauagaguuaccagccaagaaugccacugccacucagggcuccauaaagaaaggaucuugguacagaauuccuaaaagaaaugccagaauugacacauaagucuggccugcucgguucugcccgcccaccugcccacccucuugugugagugaucuuccuaagcuuuguucucuucagggagcagucuacaagcuugccaaaguuacuguagguguuucaugugggccagggauaagcaaauugaggugcugaaugagugcugagagaaggggugagcacugcuuuggugucgagaggcagguauacgggaaugcuaccaguuguccagaaacaucugugauggugccuagggacaggccugcccaucacaacugccuguaugaucggaaugugcacaugcacguaugcucuccucucccaucagucaggguagagagccacacuguauguacuaaggucuuacagaucagacacugauggaugggacgaggagcaucucagacucaguuucacuaaguugggaauaccauauaacagggcaccaagagaugaucucuaauuuagcuuagaacucuagauuuggcaggacacuaaagaacaaccuggccgggcagugguggcacacaccuuuaaucccagcacucaggaggcagaggcaggcggauuucugaguucgaggacagccagggcuacacagagaaacccugucucaaaacaaaacaaaacaaaacaaaacaaaaaucugcuuuuccuuuaauaccuuuguuuuuaaacaucgcacuggugcccaccaacuauagaaggaacaguguuacucuguagcuuacagggcucuaaugugcaggcuuguguggcuuuaaagugaacagagagccacgagcacuucuccacacaucaguggggccagacuggcccuguggagucuugggauacccugucuuuuccugaucauuucaagcuugcuacccaccacucaggacaguuccugcucuggguuagacugugcugugcuuccagccugcuuugccuucagccucggugcagaggguacagugcagggaucagaaggagucgacauuccccuucaucuugguauccccaugcagagcaauguagguacgguuacauuguauugauggaauacagugucgaagcagcugccuuguguagcuguguggaguauguucugcugggcuuacacugaaaugggccaugggaguugggcacacagaggcagcuagaugggaaaggaugcagcacugggggauugaauuuaagucuuauaugcggucaaggacaugauaauuagucuuagaugaguuuuuauguccucauuccuguuucuggcaggaaguauuuuaugugugcugaagguuuugaguggcuuuuaggggacauugcccaggcuaaccucaaauuuccugaggccuuaccucuggccuccuaggugcuggauugauaugugguuuuguauaugcugggcaagugcucugcugccuguaccugaagaucuuuagauucuugcuugcuucugugugagguggucgcagcugaucuuucugcugguuggcuucuuuguuaaggaacuugugcugcacuggauuguagcacugcugucagagucagcucagcucugggcuucuauauaaacugcgucuaccagugcacccuguacugucuauccuuaagagucacuucagugcugaccuuagagcuuccucacaacugcaaaucguggagcuucugccauucacaggacccaccuauucuggagcagccaccagcucaggcaguuacaggacagacaagaaaugugcugaguagaagccuggugguaaugguagggagggcacuuuauuuuuauuuauuuauuugaacaaguccucuuuacacagccgcggcuguccuggagcuaacuacucacuauauaaaacaaucuggccuugaaaucacaaggcucugccugccucugccucuccugagugcugugauuaaagaugugcaccaccgugccagcugaaguauguuuagaggagcagugcucuguaguauuugugcacuaugggaccuggaagaccucugcccuuuggggaguuggcaggguuuccuuauacagucacucaccuuaucugauguacucugggaacugaugacagucccugucggcugcccauuuggaugcagcauggcugccucgggggacuaggcucaccaucugcauaaugcauuggccugccagaagaaaacuuuugccacuucugucagaauagaagcugugguaaucccacuucuucccgcacccggagcuucaaugguagaaauugugagaccuguggauccuaggccauggcaaugcugacagguggcaccuucuaacucuugucuuuucccucagagcugccuagaguucagccucaggauucaggaguucauugaacuuguccggcagaacaagcgccuggaugcugugagguagguaggauaugccauauacaagguuucuaugguaaggcaggacacuccgugccauugccucuucuccacccucauggcuggagugcuggacagggaaacacaugauaugcacuuccaguuugauggccucagucgugcaugccuacuaaaucucuguguucccaagccagagauuagguugagguccccugcucaucgggcaguuucauguggcacuguagaccccaauagcugccaagugagagcuaggcuggcaucccaaccacccauguaaaccugugugauccuguggguuagaauaguguccugcgucuggcccaccauggggcuagagcugcucauggagguggacuuaggaaguuugcaugcacuccaugccauuguaggguagccauugugcugugaaaagccguaggacacugcuccagggguggggauacgcagucugagguccccugggaacugcugguguugggcuuggauucucgggcaccacagacacugcugggugccuugaaagauccagcucugggguccccaaguugcacggaggccagggacagcagguucucacucucagacacugcuggaugcuguagaaaugcugagaacagagugggggccugcgagcaggcucuagcccaggacugaagggaaaagggugggagaagagaacucuggcugauccccucagggaggagagaguguacugggcuugcuucggugggcugcuuggcuugguggagacagugucugggaacacagggaggccugggggguugggggguggagauuagauacauggcucuuuagaggaagaccuucuccauugcuccagcacaguggucccaaugggaagaggcaguccaugguuuuaaggcauuuauuguccuggugggaaggagagcuaagagggaaguagaggcugaccauggucacauggaaagaggggaggaagggcauguggagagagggggagcaagagggcaagagagagagagaagaguaagagagggaggaggggacaagcagccucuuuuauagugggucaggccuaccuggcuguuggcagguaacugucgggauagaguccagacagaacaccgggggcuugggguguugcccuaugggacugauggccacagaauuauggagcugaagccucaugucaggagccuagugucugggagcauggcaaacuuucuuccaucccuugcagaguuaucuucugggucucugggguuuaaaccuagcucagccagaaaacaggcugccuuucacggucccacaugaucuaggcacugugucccaucuuuuccacuugggaaauaguccucagcuuuaaguaacaaguaugcuccaagggaaacugaacuggucaguucaaaguuucuguucugauguuuucuacaugaccauuugagagcaugcucacaauaggaagauuaucugagggcuuucugcaggcauaucugagcuucugaggucuauuucugcccuaaagguacaggaaagaguggcuggcugcccauguggccucuacccucacagauagucucuacccucacaugggucucuagcagucaagcauaagggccagccgucauuccugcuuacucuuguuugauugaaauguugcagagaguaccaugcaccaguuuccauguggcaguuuccuucuccugacccacuugcauuuagucagcuuuguaaagccuuccuggugucucuaccaggugucuagucaguacaugccaaagcuggagcagugacuucuguaguugggguucuucaauucuagcuuucccaaggcuucugaucaguccuggagugugagcagggaagaacauucagguggccgugaguaaaacgucagaccaagcaacugaauuggugggccuacuuguuacuuaaagcugauaacuauuccucagguggaaaagaugggacauagccugaucacaugguuuacaugguuugguugggaugccagccuagcucacuugacagcuauuaguguuuagacugccacaugaaacugugugaggagcaggggaccucaugugguagaccuuggacuugugcugagccggugacauuuccacugugauugcugagacucagcaguaacgugucccaccagagaguccugcaggcccagcccagguguagcuuuuaguaaacccaggacugggauuaaaggugugugccaccacugcccagugagauuuuauuuuuauuuaauguaugugaguacacuugcuguuguugccuucaggcacaccaggagagggcaucagaucccauuacagaugguugugagccaccaugugguugcugggaauugaacuuaggaccucuggaagagcagccagugcucuuaaccacugagccaucucuccagccuaacaacuuucuauggaaaauacuggacuagaagucccuggacaugaaggguaagcacucagggcacuuggaauaacucaaggcucaagcaguaauucuagcccuaagugaaccuaucuccugauaucuugaccacacacacacacacagccccauccucaucccccagcacaugggauuccuuugugucacucugaaagaccuguuaguccagauccuuaaaauuggagguuugggccuuagagagagucuucagcagcagauaaaaguacuugccuccaagccugacacccugagguuaaccucugagaacuacaugguagaaggaaaguucuaacucuugacaaguugucuucugaccugaauuguuuguuucauuauuaaaaaguugggaauauaaaccuaaaugugccaaaauguugauuuuuagacaugcaagaaagcacuucagucaggcugaagggagccagcuggaugagguccgccaggucaugggcauguuggccuucccaccagacacacauaucuccccauacaagguaaugcucaugucccuauucaucuguguucuugcugguccuuggaggcaggaguccugugggguggguuagagagugcuggccagcuccuggggcuggcccaucugcugccauagcuuguucuacucagcugugcugcucucgcuuccuucccaucuagcuggugagaacguugaggcagaggccagaggcuucggccugaaagggucugggucuccucccccugccagccuuccuugguguucucuuccuguagucuuucugucaugucagcagccuggccuucuugcuuuuucuauaaguccagaguuguaggucuacagagcacuagagggucacaguggugaucuugcccuccuuuggcugcuccuggucucuuuccuuggugcaggucuguugcuuucagccccuguugucuggcccgugguggaagagguacaaaccucagcccgagugaaugaugucucaccaagccgagaccucagaaggcguuaaguacgggauuugcucauagaguuacauacucuguucccugagccuugagacuggccucugucaaagaccuuugugucugcccuacagccucauccacaguuggcccaacucuaguagccagcagaggagagcuauuuguuccuuccccagauaauccaguuaauacugcuagguuggcucugggcccuaguaaacccauauaacuuugugaugugggacaucuuguauggaaauaucaucaggccagagagugucagaaauaucuaaauucguauuuuaaauuaaugucuuaaauuucucuucacugcauugguguuugauuugggccugaggcauccgaguuggaagaugaaccaucucucagaugcaagguguuaugguucagggaggauuacagcagguacaugguacauagauaggcacauggaacuuauaccugcugucccaccagugagcacaaggagaagccugcucauggggucaaagcuagcaggguaacaggcuuagcccaucaaguccugucagugacagauuuuuggugacaugaaagagaaagaccaagaucacaccagaaacccuagucuuaggggcagacaggaaauuuagggugcagagagcuagaagagaacugaaagaauggcuuugauaaauuagggagggaagaaccagggcaguagugagggaggcagagaggaagcuuccuuuagaagaaaguugggguugaaccucagaaggacccugaaggcugaugcugucccuuuuauuuagagcuugucaaacugggcaccguccuccacugacugcgucuauagaaguaaugcugaacagugcauuuaugagaaagguggaggugaaguguguugcuacccuaaugaucuggaggcuuuaucucuugcuuuuguacaugugcauaccguaucugccuaaaucacaacauuaaccagggauaguucugagcugagguuguuuguuauugucugucuagcauuucuucucuggagugaccucucuuucagcuuuaauucucugcaauucuguuucauuguuucaagaccacaggauacaaaccagggaguguucuccaagugucaccaccaagugucuuguauggcuguuggggcaucuguacuggcugggccuccuaguaacugccaggggagggucccagcaccucugcuuugucuuucaggaccuccuggacccagcccgguggcgaaugcugauccagcaguuucgauaugauaacuaccggcugcaccagcugggaaacagcucagucuucacccucacccugcaggcugggcucucagcaauaaagacaccguauccuucuugcucuaccuuauucucugggguaaagguugagagggccugaggccuagcagcuuggucuuucuuuggucuguguguccucuguggcuuuuccauuucaaauguugcugguaccugauacuggcuucccaagaguccugcagacuuguccagccaguuugacuucucagcuugacucauaauggucaggacuccagaaagguggcagccuuccucugcaggaaagacaagaaaggcugaccucuccuuguuuauauuuggccuacuauaccaugaaggugacugacccaucccuuguaugacuccccauugcauagcugaccuauuccuuccugagauggacaccucccaauccuccaaccccccacuuugacccucccccccaugguagauauucaucuucgguguggcugaucuuguuccuuguaugguugcuucuugcucauauguuugauuccaucccuugguauggucccuauagucagaacucaggcuaaccucuugggucagacaccaccaccaccaccaagggcgacucuccuuuguauggcuaaaccucucugacugaaccugucccuuaagugccuggccugguugcuacauguagccaaauccauucuguaugauugccccagguaaagguagugacuuuucuggcaucacagcugguaccuguuaaugcucugcuccaagcucaggcucagggaccauccuuuucuccaucucugguggacuggagaguaagcaugugcuugccugccaccuucuggcaauccaccagaacaucccugucucacacuuugccugcucucugaagaaacuucaguugggugugagggugccacugggugacaaaaccaauggcucucugugaacauugauagugaaugacuaugcauucuuuuaauuuggagguuagcucugucuguuuuucugcuuggugucccuguggucauaaggaugcccuguggcuagagucacagcauuccugccuuauugcugaucuuguugguacagccuuuccuuaauccuguguacagacagugcuacaaggaggauggcagcucuaagagcccugacugcccugugugcagccgcucucugaacaaacuggcacagccccugcccauggcucacugugccaacucccgccuggucugcaagaucucuggugacgugaugaaugagaauaacccacccaugaugcugccuaauggcuaugucuauggcuacaaugugaggggcccgaauaucagggcugggcugggcugggcugggcuggacugggcagggcagggcagggcagaugugugugaggguaagggcaccaggguggggccaugccacaugugacagaagugacuuuguaggauuagauggcuccauaguuaagagaguuuguagcucuugcagaggaccuggguuugguuucaaauaccugcuugguggcucacaaccaucuacagcuaucuaguuccaggagugacuugaguuucauggggucugaccugcuguucugauuuucacaggcaucagacacacacaugcacacaugcagacaaaauacucagaaguaaauaccauuaguugguuuauucuaugguagcuuacuuuuuggaaugaaccuuaauucagaucuuaguuugcauggcauuuucucauuuuaaugcguaacucugcucuuguuuuccagucucugcuuucuauucgucaagaugauaaaguuguuugcccaagaaccaaagaagucuuccacuucucccaagcugagaaaguauacaucauguaggccccgaguugcuaugggcacgcccuuggccagaggcgguggugggugggagccaugcccuccugcccugaccccugaccccagaccccagccugcaucgacauuuguuucuugcgaccaaagaucagugagcaacgacaaauacucuuagaaaaagaggaagugagauuuaauaagucugugcuugagaacagcguuugauugguaggauuuguaacauaagucgacgaugccucugcagggucuugcaccucucaaaggaaacuuucucuacagugugaccuggagguucacccaggaaauccagagcaucucagaaguaggaauugguucaucgguuauuucccuguguuucuccguuuccuuccuuuugcuagugaugggacucaggggagcuugaggagcaggcuggcccuuugccaacuccuguuggucacagcuugggcaaggugcuggccacaccagguuggcugcagugacuugugacguggugccgaggccuuuccugacuucacugucuagcugcugccaaagcgccgugcaccacaugcaccugggcugcuacuugaggaggcucugcccacguggccagugucuggggcugugucugcacagguucagcaucucaccuuccagcaccgccuuaucuccugcuuugagaauguauucacgggaaagccacuggacugaguuucugcagaggccuugccaggugguuccguaguccuagaguguacaugcuuuucauuacagaaacugauaguucagcuaaaauaaguacugacggguuuucaaaacaaaugaaccauuguaauucacacacacccauauuguagagguuuguaucuagcgcuuauuuuugcauguugauguugauuagcuaaugaacuguaaauguaaaguguguuaauaaaauagcuuucuauuucucauuu

SEQ ID NO: 2412 - RNA, 29296 nt, Mus musculus
cgucggcugcgguuuuguuccgcggugacugaggcucaccguccccaugcgcggagcgcggccugcgcggccggcgcccugccccagcuacggagcucggugcucacucgccucgcggagagugcucugcgccgucguucgccugcucaucgcuaagagcuccagccaccgcaacgccguguccuugcgcugcgaucccggagucuccguacgucggccggcgccgcgcagccgcacgucgagagccgggugcaucggcacagcgcgcggaacacccucuagggccagccggcgucucagcaccuuaagguccccgcgcgccccgggcccagcacuguccucgugucccguguccccgacauccuaagguccucggggacccagcaucugaaagaacccugggccccagcucccuagaguccccugggccccagcuccccgaacucguggcgaguccggggaccccuccaauuaggccaggccccaagcauucuguugugcgcgcuccugcacgccaggcgguaaggccugcccgcugcgccuggggcgcgcugccacuuguugaaucacuuuucaugucgacuuugagaccuguugucgccaugcugaguccgugggcccgugaacccgcuguuguugagacucagugauuguuauuuuguauucaggaagcaggaaguuugacgagauaugauggucccuuaagggaaucccaagagcagauccuccccaacgaccuguggaaggugacuuggaagucuauuccgaagccacuuuccugcguagacugaggguguguaagucccuuuaagacuuccuguguggaggaugggaugugcgauguucacaauguauuuuaccgcuccgaaugcuauugccuuuguacauuagucuuaauuacagaucugugaucuaucacuccaaauuaaaaucacuuuaauuuuuugcacuucaagguauuuaaucauuagauauaucuuuaaguaugaaucuaagcuuauucuaacccuccagccccacuacuuaaguuuauaaugauguuucagcucugagaauuuugaagauggacuaguuugacuugaaagguguacuuuaguuuuuacauuaagaaauuugacuugugcucacugaugcugcugcuucaaauacauauuuggucaucuuaggaaagugggucuuggaagggaaguucagcaucucagaacaagguaggaccgaggauaguuuuuccaaauucugaauauuacgccaagguggaaauugaaauugauuaggaagaguagauggacuuugcuguuuugguuagugguuggucguucuuucugaugacuccucuggcaccuguucuccucuuuacgucucuuuguuuagugagcauagcaagcccggucccuucucauggccugauaaaugauucugcuugcugucccuggagcuuagaucuugguucuggaacuuuuuccucuggugugugagcuuguggcuuggacuggagccauaccaagucacauggccuuucagaucuuccccuagguuggauuuggcaaccguaaaagagagaauuuuaguugcuacucuugagacagaagaugcugaacaauccuuuuuuuuuuuuuccuuuuuaaauuaaaacacuuguuucaugggugugggugacuguuuugccugauugugugucuucaucacgugcaugcuugguguccuuggaggagggaagagagugguggucccauaggacuggaguuacaggaguuuaugagccaucauguaguuccgagggaucuaauacaguccuccgcaagaguagccagugcucuuaaccagugagcuaacccuguagcccaaacaaucuucuuuucccuuucuuuuucuuuuucuuuuucuuuuucuuuuucuuuuucuuuuucuuuuucuuuuucuuuucccuuucuuuuucucuuucucuuucucuuucucuuucucuuucucuuucuuuuucuuuuucuguucuucaggacaugguuucucugagaaccaucuaccccugccucugcggugcugggacuagagguguggaccaucacugcccagcuuccuuuuuuuuaaaaguaguuguacuuccaacuucuaguuauagagauuauauagacacacacacacacacacacacacacacacacacacacacucgagcacucaggguucaggaauaucaagaacuccagucugagaaugaacaugauuuuauugauuuaaaguaaauccuuagguauuuuccauuugugcuuuggaaacacuuaaaaauuuuuuuaaauuaagcaauccuuuacuucccagguggugauggcagacaccuucaaugccagcacuugggaggaaaaagcaggcaaagagagauuucugugaguucaagucuaaccugguauacagagugaauuccaggacagccaggguuagacaaagaaucgcugucucaacaaaacaaaaccaaacaaaaaaccuuaguguuuuugagacuugguaucccaauguagcacaggcugaccuggaaauuguaaccccccaccccugccuuucaaaugcuggaauuauauguauacauuacagugucugggagccuuuauuuuugggugcaguuuuagguuuacaagaaauugaacucuacucuuuccuccucuacuuagucuauacuauuaucaauaucccuauuggagugggauauugauucuguugauacuagacuuuuuuuuuaaugucucuuuuaaagaaagaugcuaucucuuuuuauguuuugaguguuuugccugcauguauguaugugcaccaugugugugccuggugccugcagaagucagaaggggauguuggguucucuggaguugaaguuguggaugauuuggagccaacaucugguugcuggaaauugaacucugcuccucugcaagagcaacaaauacucuuuagcugcugagccguaucuccagcccagaugcuaguccagaguuacuguguucauuccuucagguuuucccuguggaugacccugugguuuuguuucuuaagcuguuggcuuuuuaauuucguucuuuuuuauuagaacuaacuagaacuuguaguaugauuuugaaaaaaacgaugaugaggggacauuuuugcuuuagucucagugcuuugaguuuuuggcuaucaauuaggaaugcuguuggguuuguuuuaguugucaguugacuuuuuguuaaacagagucucauuuuuaucaaguucucauuguagucuugacuggccuagaacucacuguguagagcaggauaaccaagaauuuagagauccaucugucuaccuccuaagugcuagaauuauaggcaccaccacaucugcccucuagcccucaguguuuuucuuuguagcucuggcuaucuuggaacucauucuguagaucagguuggcauggaacuuggagauucucuugccucugccucuugaguucugaguuuaaaggugugugccaccaccgcuguuuggcugucuuuuuguguuuuuaauggggacuuuuuugcauagacaugauugaagcaaggacaaccauguuaaaugggauuggacacaaagacagugaccucaugcuggcagucuccaugguagcugcccagauucuugaagaugccucucuugagcacauggacaggaccaguucuuaagggggaaaccuugcuaucuaaagagaacuuaguauuagaguuucuacuauuaagucauuuggggaaaagaucuuagcaggugagggagaucagagacugcuucuaagaccuguucuaaccuuauacuaauaacuuagguaauaaguccaaaaacaugaaugagagccaaacuauauauguaaagcauauuacacugaguacaaacguauauuacuaguucuggaggcugggaaguucaggacagaagucauucagcaggguggaccacguccaaaugaagccuugcaauugcaucuucuagauggagagaaggaugcauucucgccuggugggagugaggaaggccauguugucaugaggcaggagggagaaggcuauggccuuacaaaguuuaaggcaggaggaaggcugcccuuaacgugguaggagggagaaggcuuugccuugugagaaagaagaggcauguccuuccuuugugcaauagauggagaaggcuauaucuuuacauggugugguagaggaggccauguuuuaacauaacacgauggagacaggaggcuguguucucaugugauagaaagcagggagaagcccauguccuuaaugcaguaggauggagaagaccauguccucacauguacuggagggaggagaccaugcuuucacaugugauagaggaugccauguuuucauguagugugauagcgggagaaaggcaugucugucuggugcaagaaagggaggcauguccucacauuaggaaggaaggacagagucaugucauuuugugauugaauggaaggagaaggcuuuguccuuauguggaaagggagggaaagguuuuguucuuauaagagaggggagggcccuguccuuauguaguagaaggcaggggaagaccuuguucuucugggaagguuauuucucuuguagaagggagggaaaaaccauguucuuguaggaugggagggaagggagccuacaagaaggagguucaguccucaugagggaaagaaaagagaggaaaugccgccucaugaacuggaaagcaaaacggugagcugcagaaaccucuuacauuucauuagggaagaguucucaugauguaauaacacugagacggccugagauauagaagggacccuccaaauaguaacacccguuuacccucuuccuuuuuuucuuuuccuccugguacuagggagugaaacccagauccuugggugugcuaggcaucuguuccugugggguuuuguuuccaucuauguauguauauuuuuuuaaagauuuauuuauuuauuauaucuaaguacacuguagcuguccucagacacuccagaagagggcgucagaucuuguuacagaugguugugagccacuaugugguugcugggauuugaacucaggaccuucagaagagcagucagugcucuuaaccgcugagccaucucaccagcuucuauuuauuuuuuuaagauacaauuuuucuguguagcucuggcugucccagaacucauucuguagaccaaccugccucuguagacucagagaugccucugcaucucaagugcugggacuaauggagugcaccaccaccugacccugcuuguguguguaugugugcgcgcgccccucugucugucugucugucugucuguuucucugucucucuguguguguuuauuacaaauagguugucuccugcauuuuaucaagugcuucuuggcaucucuugaucccaaagugugguuuauuuuauuuuauuuuauuuuugagcuugugagggaguacaugaauugauguuuacuccucuacacuuuuuacauagacacccugcuggccaagucagcuagucauggguuuucauacuaucaagaccuugauuugccuugcugggggagguuuuguccuucccucauuuuguuuugaaaaugcuuuccaaaaaaacuuguacaguuuaucaguaagaccagcuuuguggcacccaaacaaggcuuuguuccagacacuccagaaucagcaugacaucuaaauguaacauuucggccccagcugaucagugacugccaaagaaggacgguaaucuaaguugguagucuguacuguuuucguuugcaagccuuguguggcacaugagauuccagcccuccaucuucccugguuuccuguaggaguggugacuggccccaggagaagaacagggcauuguuugggcuacuauggcagcauaacaaaucaccuccacaguugguagcuggaaacgguaauaaucauugauuuuuguccauuguugcugggguguggaauucuauagcagcuuagugggguagcgccauguuuaggaucucaggaggguuggucaggugggucuggcuagaccucacauacauacagggauucccuaggccacugucacaugucuccucgcaugcugccuuugggauuugucucuaagagccuggcagauggaguauccuuuucacuuuagucuguacugccuagcuucugaccacugucagggugguaauagacucugcuuuuccugagaggaguguaggugucucaggccuguucuaacgccucugcucaugacuugacagguauaacugaugugcagucagauuauugguuauuuuucaagugcucuacauuaaaauuauuuuguguguguguacgugguuucuuuuuuuuuucuuuuuucuuuugguuuuucaauacaggguuucucuguguagcccuggcuguccuggaacucacacuguagaccaggcuggccucgaacucagaaauccaccugccucugccucacaaguacugggauuaaaggugagugccaccacgcccggcaugguuucuuuuaaacacagaaauaaguugaucgugguggcacgugccuagcauucuggagagagaggcauguggaucucugugaguuugaggucagccugauaguuccagaauauccagggcuacaauacagagaaaacuugucuugaaaaacagaaacaaaaacgcacacagauguacuguuuucauuuuaaucccaggaguggggaauauggugcuguuuccagcugucugcagugauugacugcuuugccuuguguuuuagcagaggugugguuuugccagcugcagauaguuucuguaauugugugacauuuggaauucugggaacuuuucagaggguauauaaauguuagagccagaagaggagguggcugguuguuagucauucagggagaggaggugguugguuuguuaguagucguaagauauaagaaauaaguuagauucagagaucucucucuccccucuauccucuuucucucuuaccuacugauaggaggugaaacuggggaggagugugauaaaaggugggaaaaagaagaacccacaaaguaguaaagaccagcuauaguguaggagucaauuuucuaccauuuccguucuaggaaaucaaacuuggguuguuaggcucagagguaagccuuuuacucacucagccaucuugcuggccaucuugcuggcccuccuacguuuuuuuuuuaagauuuauuuguaugugugagagcauuuugucugcaugucuguaugugaaccaguugcaugcuugauguccugaagaggccagagaggucauuggaucuccuggaacuggaguuacagauaguugugcaaacugccaugcaagggauuggaauauaauccagguccuuuggaagauugacaaaugcacguaacugcugagcccgucucuccagucuuguauaucucuauaucuaccuauaucuuuaccuguauccauauccguaucugucuauauuuuaagagaugaaagucucuaucuguugcccaggcuaguuuccggucacuagauuugauacuuuuccugucccagccucuggaguagcugagguuauagguguguaccauugugcuuaacuuucagaugguuuuuugaaagaaaacuaaagaaagaaacugaaaaucuggcauuguaugccuguguuuuggcugccuguuggaucuugaauuugagaugacuuugguguaacagaacuaacuggugggcuucuuuguuagaacuaccucaggcuaugugcuuuugucuguguagugggagcagcaugaugcagauaauucucuguugccuaguuuuugugguuuaggcuccagguuuugugcuuaaagucaagcuguuuaagcaggacuugaacacuuuucuuccuauguaauacguuaggagccagaauggagacgauggaguagcuuaccaagcguagauuugaacuuggugucaaggucuguguuggcuggguaccugcuuugagccugcugcucaaaggugacuuucuccaccuguccuugcuauuuccagacuggucuggagccuguuguucacacagauccuauugugcugcaaauccuuauuaaauuccacgucagguggccugccuguggaagugccaagaugaguucuucccauucaaaggguuugugacccugcaagcuggagaacccucugcaguaugguggcaguggaggcuucuaucucauggaguaaacaggaugacaaacaucagaggaaauuccugccugaaagccuagaaguccagggauccugaagucuguagaaugggagcaguguggagaaguaguguagcagguuagguguuguguaggcagagaggagagacggacaccaaagcagcagagaugaggacgcacugggagggaggccaggcacacagggugcuuaauugucaugaaucagaaagcuuaggaugaagauguggaugggcucuaaaaagaagaacaguggcaaccggaaagauuggagagguggcaggagagacagaugaauucaggggucugaauagaacagucugggaccguuuccagaagagcacugaggacacucaguagccaccaagugucugaggccccaagggacuuggaagauaccugcaguucuugcucauuauccuaacccuggagagaaaagauacugaagccaggcaggagccagagguguaagcuuccugugagcacaaagaagcuaccuuguuugggggucaccauuccuaggaagcugcaagacgaggccagucacaguggguaagaaagcacugcuucccaagaugacacagguaacuucagugagccaauagaaguuagccuaagagcuuuacaauccugcuggagacuugugggggagacuacuaggcagaggcauuguauuugaaaauauaaaggacuuaggagcagaccucaguaugucauuuaauuggacuguuugucauagugugguguugagaguaguuuacugaaaguguucagagagagcuggcaagauggcucaguggguaaguaccuuucaguuugauaacccaacuugaagcuccagaacccccagugugggaagagagaaccaacuccugcaaguuguuucugaucucuacacgugcugugcaugcauacaaaauaaauacauuaaaacuucauuuuauguaugugagugcuuugccucucugugugugugugugugugugugugugugugugugugugugcaccacauauauucaugaugccugaggaggccagaaaagguaucagauucacuagaauuggaguuccagcugguuguaagcugcuauugugaguucuaggaacugaacccaaguccucuccaaaaggagcaagugcucuuaacugauaaacaaucucccugguucccaaauaaauaaguaaagaaauguuuaacaaauuuuuagagaaugcucauaguggcaggccuguaaaucccagcacuugggaggcagaagcaggugacucuugugaguucaggaccagccuguacucagccuggagaguaaguuucaggccagccagggcuguacagugauccugccucagaaagucuuaaccccaagaccucagaauugugaacuaaguuuagaaaugggguuguuuuacaugugguuaguuaagucauacugguaugggaugagcucuaauuccaaaugacuggaauauuuuguacaaaaugggacauuggacacagagaugugggaacauggagacugugagccagaauccugaacucauucauagagucuggggagggacuguucaacaaaggugggacuuuuacugcaaccagaggacacugauaguguuauacaguguccagucaacuccaugugauaaacugaauuaaacaaacaaaaaauagagaaccuacuuugaugcuguuuuugaggguaguuccccagguaaugaggucucugccauugguggagcugaguuggugggcacuccuguacugucuuuguagaguaccugcucuggguguaccagucuuggugcuggcauggccauaguuugggauggagaagaacaacuugggcuagggugaggauuuugcucuguauccaggaguccuggaacaaugacugacagagacuggagcacuagccucaccugcugaggucagguucagagcugccacgugggucaaaggacugccuuaggagucaguaguagccaggucuggaaggcugaauaaggugcaguggggagcuggguagagcaucauccaagccacaggcuuacuggcaaaacaguuuuggugaauguauugcagagggaagggaagugagcagacuguagcuuguccuuuguggcaugcucacucuacaugaggaguugacauucaggaggggugggugugggucuggauguauuucccugagcgccugaguuugcaugucuuugucaucagcucucaucagaacaccugccccucucuccugggcagggcuguuuaguuccaucaucugagccauauuucucugcuuuggcuaucuucccuaugucuaccuugguaucagucuuggucuuugucccccucuucucuugcuuaccugucagucuugguuaacaccaaagaggcuuuuuuugguuuacccuuuuauuuauuuuauuauuuuuuuuguuuuuuuguuuuuuguuuuuguuuuuuugguugcuccuuuuaaauuggccuuuugaacuauaccucauuuugugcauucagguuucuguagauucacuuggcauuguggguugaauuguaacccccaaaacuauauucaagcucuaaccuccggaucugugaguggccuuaucuggagauugggucuuugcaggaccuggcuaguccauuccauauguauacuagagucuguuuugcaaugguggggauggagcucagagccuugagcaccuagggacaggugcuaccacugagccacacccuaauuccaugagcugcuuuugaguugccccauccuugugaccuguguugcacacgucucccucagcaguuuccagcagacucuuuguuccacguuuuaaacaucugugauuaugacagggugacagucuaugcuucauccauuccccuauuaagcagcaugcagagcuuccaaauauccacgccuugccuuacaccaggucacugauaauaauagaaaauaaugccaguaauauguugucagcuaacagcaauuagucagacuuuggacguagucucuuugaggaucauuauuguacauuuugugcccuucagccugggcgggccuuguucugcuuuuucaugacccagcauuuauuuuaaaaaucuccuggggagauuuuauuuuuguuuuguguuaggggugucuuggcagcaauauuucuguguacaugugugugcauugcuuguagaggccaaaagagagcaucagauccucuaggacuggaguuuacagaagguugugagcugcccuaugaguucuaggcauugaaucuggggccucuggaagagcagucaaugcucugaacuccuaagacaucucucuaaccagacgugcugcuucuaaagaacuggucagcucuuuuguugauugcuucacuggguuccccugauauucugauuaaauugagguucugagcuuuugugaagagccccacugugggcugugaucuccuuagagucuccucaggagucuuguguccauauguuguggcacuggcuauagucacuuugguccugugguucagccugguuuuguuauuuuuuuccuuuguaguuaaaugucuuaugagaagguaguuggacacuucacuacucuguugaccuucagaacucacagaugguccuugauggagauuucuuauauaggauauuuguaaaauggcagacuuugaaguguuucugauauuguaacuguugguaguuauaacugugcuauagggaagaauuucacuuauggggacugauuuuucucagacauugacucauucagguagauuuaggacuucugguucauuuuguggguuggauuaaaaaaaacuuuauuuuuaauuuuuuuuuuuaaaguugcacuguacuucuguggccuuucuacauugaugugugugcuuugugugaugagguuacaacaagguaugugaggacuggagagaaggcucagggguuaagagcagugucugcagcugggccuuggaggcugcaguacaaugacggcugcagcacacaccuuuaaucccagcacucagguagcaaagagaggugggucucugaguuggagccgcuccgguccacagaguuccaggccagccugggcuauguagagaagcccugccuugggccagcagcuccucauccaaaggagcuagguucagcuccccacccucauggcgucuaacgccugucuagcuccagguucagggggucugauaacucucuggccucaguggacacugcaucugcauguagugcacacacacacacaauaaaauuaaaguaaaucaagguguuugagaguccaugugguggcacgugggccaggagggaccacuugucauuacucuucuugacagaagacccugcaaagcccuuacccuguuagggcauggcucagagguuggguuggggcuuucaguuuagaugagcagcgggccagacugcccguggcccugcgucccagcuggcucugucuggcuuacggaggaucagcacuucuccuaggacauggcucguucagauucagguuccuuuauuugaaagaaaggaaaacaggcugacccugcucuguuugcuccuccucuagucuaaauuggagaugguauucacugugcugggguagacuagacuaaaugcuguugucuuuaggcaugguagaugagauuucaggucagagagacuaaacaggaauaguaugugaguggugugauauaccccgggcugagaacauguguuagugggaccuuuuauugaacugagcucacaugugggccugggcuggguaccugcuuccugcauccacuaauggaaacucacaagcucuaggcuagccagugugugguugguaugcuguuggugacaugaggcccugauuccugugcuugcuacgugucaaccuugccuuguucagucacaugcuggcuuuugagccucagguuucaaagucacagggggaaguauuuguuguuucuguugacagaauguauauauauuuucaagaaugaaaaguugguauuugaucuuauuugagaucuuucugaucucuguaaaaauauccauaugauuuucuccuguugacagagcccuagguuuguacccucuuuguuugccagcaugaccccuaccaggcuugugauguuacuuccagcagguguggauguuguggucauacccagugaucuugggcaaacacucccaggauugcucuccuuuggagugccuuacuggguggaaggaggugacuugaaccucaggguguuuuuuuuguuuuuguuuuuuggguuuuuuugcucauggauacacccugcagaggcccugagguaguucuguuaggcuaacucuuuugaguaaugugcuuguucugggguguugcaugacagugcaucauguugaggcacagcugacuccugagauauuucauauuuauagguuuuuuuucuuugcacucuaagcaaggggucaccacugagcuccacuuccagcuccauguguuguuuccuaguuugccauguuuucccacccuguguucuggguucuuugcuuucugaucugguagcccuuguucacacacccacagugagacaagcuccacaugcacagugggauggaagcugcaaagggcgcagggcuucuggaugcucuuagaugcugacuuccaggacugaaaagcuaagagcccauggccucccuuuucaccauuaccauggugauccuggccccuugccucaggcuggaccugguguaguagagcucugugugugccucuagcauccuacccuucauuuuuuuuuuuuaaaagagaaucccagcaucaagggcuggaguuagggggcaguuuggucaaccaguagcuuacugcugguguucucauuggaugcggcugcuguuguuucucuucacguguucauugcccuuugagggacggagccugccaggggcuuucuugcugcuucaggagaggccucggaggcugguucuaauaagcaucguguccucugaucuucucuagagcagugcuucucaucuuccugaugcugugacccauuacaguuccuugugguuuggugaccccaaccauaacaucauuuucauugcuucuucuuaaagauuuauuuauuuauuauauguaaguacauuguagcugucuucagauacuccagaagagggcgucagaucuuguuacggaugguugugagccaccaugugguugcugggauuugaacuccggaccuucggaagagcagucgggugcucuuacccacugagccaucucaccagccccucauugcuucuucauaacuaauuuugcuacuguuaugauuaauaaugucaauaucuguguuuucugauggucuuaggugacccccacgaaaggguuguucaacccccaaaggugagaaccacuauucuagaagauauugcuagaggcuucaggaaggaacauacuugguuaucuuagaauuaggaaggcauuugucaaagagggauauuaggaacauuuuuuaaaaacaggauguuguauauauauaacaggaauauggacugaaguguauggucauguggcaauuucucuuuacagagacaaagcccugaagagucuggaaauggguccgcaucuuuaagucagagcuauaacccugaguuuuggcacagaccugauggcuugagccugcugauguccaguguucuggaaauccagugcccauagauguggacuaaggaagagcccggccauggucacucucaucacagagaagcugcagaaccagaguuuggaugaccucacccgcagggccugugaggcuggcccggugagucagcuugggggucagagggggcacagcccaugugcagagccaaaggcaugaggcgcacacuguaggguggaggcagagcugagcugggggcauugggcagaagccagugucugucacgaucaucacuacaaaccaaauaaacuucuaauacaaagcugcccuacacagaauucuguggcugcucaccagaucggccagaguaaguaagucauccugugauccugcuacccguguccagaacccugucgcacaauuugucaacacagauucauucaccugcguuagcuuuagggagugggucuuucugguuuuuauuuuuuuaaccaugaagucaauuauuuauuuuauuaauuuauaacuauuagauauguuguuauuguuugagacaggguuucacaguguaaccauggcuggcgagaaacuagcuuuguaaacuaggcuccacuugaacucacagagaucuagcugccucugccuccugaguggcgggauauagguaugugcuaucacaucuggugguuaccuauuuuuaauguuuaauauuuguaacuugcuuuucgccagauuuauuuugauguuuugucuuugugccuugacuugaaacuaacacagauacacucugaguacagcuagggauuccagaaagacaaagcaaagaaacuacgcaggcaacucuuaaacaccguccuuaaggccgugugugaugauguugcccaaguugggcaguguucaugcccagacugcaggcagaagucauccuguauuuggguguuuacucuucccaauacauuuuucauaaaauuuacucuuggaaaaguagauucacuuuucaagcuagccuaaacguaauuaagaguguucuugagccaggcgugguggcgcaugccuuuaaucccagcacucgggaggcagaggcaggcggauuucugaguucgaggccagccuggucuacagagugaguuccaggacagccagagcucuauauagagaaaccuugucucgaaaaaccaaaaaaaaaaaaaaaaaaaaaaaaaaaaaaaaaaaaagaguguuguuguuuuuuugagacaggguuucuuugcauuagccuuggcuguucuagaacagacuggccuugagcuuaccugccucugccuccugagugcugggauuaaagugugugucaccaccauccagcgacaguuucuaauaacaaaacugaauauaacuuuuaaaaguaaaauuucaaagaguuaaauuuuaauaaagcuaaaagucauuaacuauucauugucuccauugcuaugacuguggugcuggucugggugguuugugcugccugcuugagccuccaugugcuggauggggacgacuuguaguggcagcaguucucguacuugggcuaccagaaugauccagcuuuugaaucccaagucagcugagcugcagggaccucaccuagucucugggcugugcuggggauagugucugacgucugauauaauggacgcugucauuauggccucacgaugugugccugguccugguccucugguccuucuucaaagccaguguccucuaauccucuugccaucccugcuaucugugucaauuuuauaugguuacgugggcuccucuuuucccaacuucuacacccugaaccugaggcacacucaguuuuuccuaguuugcuuuuauguacuugaaggauagugaauaggccagcuguuacagaaagacuggaaaaaugaguaguuaugccugauucacugcuaccucaagggaagagaggcacagaugguuuaugaccauagguggagaauuggugaaugcagugggcuccuauauugaugcugccagagacacagagagcaucugccguaugguuuggaguguacguugaagauggaaggagugagugagggguuuggggcagcaaggaaggaacaguugacagguagugcuguccuuguuuccagcucuuauugucagcacgagagagcggaccaugugauguggcugagcugggagcaagcagcacagagcaucacgcugcuguccagauggauguagcacagcugcguggugcccuguguguuccccggccuguccaucaguaagacucugcuaucucagcauccacugucuuaucuccaaggaggcucagcagccgccaugucucaaggcccuaggaugugguauaauauagaggcugauccuugcaaaggaaugcacucagcacacuguucucuugcguuacacccacuguccugagugucugugccuguguccucgagcuggucaccugcacaccucaucucucacccagccagagcccuguagguaccugcugugaggugucugucuaucuaugcugugccaguccuugaaugugcgcugaguacaucuuguuagauauagguccacagcuccucaagguuucuaggagcuguuucuguugacuuaagaaaagccuguccuuccuggaguguguuguguucucaugguggguguauucuuaggcacacuagggaugcaggccagggggaggagggcuaugaagacagugcagguacuuacuugcucucgggaagugguugaaccucagcagguggacugcuggcuggaguggcuaccagccagauggaaggugaaaccaauuuucuggcccaaaguuggagcauuugcagggcuuugaaagguguagguagcucacuaauuaugcacagugguguaagagcuuccaaccaugugcaguaucucuaaagcaguuuucucuuucccuuugagccugaggugguccagugcccacagagcccaggcuggucaccacccccauucauucagcuguauuagggggaacauaaccuacugcagaggaagaccuaucuguugaugaaggggugcacuuuccugagucucaaccccaacuuuuaauucacucgcucuuucuuauuuauuuauuuagaauggaguuuuaccuagcccacuuggcuuuaaacuugcuaguagccaaacuccuggcccuucuguuuccaucucuguggagucccaagugauggauuacaggcaugugccacuauacuugucuuguuuauugauugguuggcugguugguugguugaacagaguugucaaguagcucaagauggucuggaacuuggagucuuccucuugccuuggccuccuugaauguuaggauuauaaauguguaccaaacaccugacuuucucuaugugaagcaacaaaaguuccccaaaacuucaggugcaguugguaaucucugagacugcuaguagcuuaucuaccuuccuggaggcgggucacccugcugucuggacccuucucaguacugcgaccauuaggcuagggcuuggaucuuauauauggacugucacgagcucuugggucuuggcuuagccuauuuuucuaaguuauuuauuuuuauuuuccauguaugaguauuuugcuugaauguaugggaaucauguaccuggugcucagggaggccagaagagggcaucugauucccugaaugguugugagcgucugugucagugcugggaauugaauuggaauccucuaaagaugagccgaugcucauaacugcugaccuaucucuccagcccucaggucuuucugagaagugacuguguggugagguuugaaagaccauuaauuagcacaggucauccacaggaaaaggccagagcuucaagaguaauccgaggaagccugcaguggcucaggacggugcccauuuguucugcuagaguuuguuagguguuacaaaggcuuguccugggccaguaaccaggcucaguggugaaggcauuuguugccaagccuggcaaccugaguuugaucacuuguggaaggaaauaacugauucccauaaguuguuucucguuuuaacauguucacuguaacauaugcacaacccacucuauaucaccccacacaaaauaaauguuuuuuuuuaauguuaauucuuuuuaagaaaauauauuuucuagaacucagugcuuuuaauuuuaaaccccaauggacguguuagggaggaauagcauuacugugguaaacgcuugaguuuucacaugaguacugagacuucucucuugucacuuuuaguauucugcugagaagcugaacaaaaguggccauuuguucccuuuggagaucagcgguaagugucucagaagcccagggaggguagucuaaggcugaaguagcugaugauggagcaagguggcacugggucuuuggccaggaggggggcuuggagcuggacugaauuagauagucagagaagcuucagggagaccucugugugaccuacaugugggacaggaagaucaugagccaccacccucccugcucacaggccaggagucagaacuggucucucagcaggaugugccagggucagggcucagcagagccucugcucuugcugcugaugguggugugggaagcugaggacuguuuuaccaugcugagacaugggucuacgugugccuuccuucaacucucaagagaaacgauggucaggugguaugugguucuggcugccauucugcuguaguauacacuggcugagugaguacuccugacacucacuuccugacacauugcucuuuagcaauuagagaggauaguggucccuaaguguggagauaaauccaagcaaagacccuggguuggaauuacucugugcugccuugacaguuggaacaccuuacaugguagaagcaugucagguucaccuugcugacuaccagauuucuaaaguauugucaaccuuuucacaagcagccagaaguaagaggugaagucuccauuugguucccacuucaccuggcccgugcuuucacuccucuuggcuccuccagucaucuugcauaugagaccacauuaaguaccucagucccugcucagaguuucugagggcuucuuaugcacuccugucuucccuucuuuccucagucucuugucuuaccuucuuucugucucaggucaccccaaggcccuugauguaucuuuccccagaggugaccuuggcugugugcuauuggucucuguggccuguacuuuagugucucguagccugucagugguuggaaggagcagggagaagcugagugaccuguuggaugaccucccauuaagagugucagagcauccucuggucaggucauuggauauuugaaccuuacagcugggcugaguccauuugaagacacccacauacuugacuuugcacuucuguuagggagggcuagagugggugccugcucuuacagccaacaagaggaacuaagaguagggccauggcagcucugagaagcucaugcaggguuugggugccaaguuguacugaguggucaagcugaccagaggggagcuggacuaggcuggacagcuguguagagagcucucaugugggcuaugcccugggggaaguagauuuguguuagcuccuaggguauugagucuugugagcucagaugucuuaaggacuccuaauccuccucaagggaugugauggaagaagcagaggaaguguuccuuaugcugcucuuaccugugaugucuugggcacaugguuuuacaggaugaccagccaccaaggcacauugccaacacccugcguuagggccgaagaaguagaggguugaagauuaucagggaggucucugucccaguccacuguccagcaggcagauguccaggccaagucugagacaggaacucacuguguaucccagacacagagcgcaaaugcucaucaguccugcaguugccucacaaggacugagaucucaggggugagccauacaccaggcucagcugaguccucugucuguaggaagacuuaagacuggcuguccacuugggucauuaagaaaggaggcuauuuucaggaaguagcuuuguuugguucuuagcuggcaaaggucugucuuuagagaugggccagggguagugguaaauaaagcauuauaaugacacauugcauuaaugaaaugggaguaauaucaaucagauuauuuucaggaaauagguagggagaccacuccuuacgaccagaugaagccagguuuggugguauaugucuuuaauuccagaacucaggaggcagaggcagguggaucuauaacuuaagguuagccuggucuacauagugaguuccaggacagccaggacuacauggagagucucagaaaaccaaaaacauaacgaaaaaggacuggaugaagccuggccauucagaugccguggcccaugugagcaguggcguuuuuguccauguguccgugagccugggaagggaggcagcggguauaccuauugcucaccguuucuucucacaccuuuguguuucccuaguggauaaaagucccuggaaggccuuacguggaggauggcccacuggaagccaggcagccucaggccccuucucagugggcccacauggugugucucacaccgaaggucucaaguggcagcuggaauccccagggcccauggaugugggccauuuccuggaccuccaugauagcacagggccaccugcagcaccaccaaccaagcgacacugccggucccugucagaaccagaggagcuagcucgaugccgcuccccguggcgcccugguagcuccaagguguggacucccaucuccaagaggaggugcaacaguggugggagugccacacuucagugcugcagcggcgugggcaacccuacucugcagggcacucuagucccuggccuacccaggaggccugugucacccgcuggcccuaccucaccccugacgccccggccagcuucagccagcaguggcuuuguggauggcagugagggcaguacaagcucaggcccacccuggcuuucuacaggacccugcccauuuucuuccaggcgccgacugucccucucacaagagcaccuuguagauacaggugcuugccugccuucagccagcagcacccccacuuccacaccugagcuaggccggcaccauggccugcuccggugccgcucacagccuuguguauuggaugggaggaggguccggcgcaagcgaagacgggaggaggaugccagguggacacgcccguccuuggacuuucugaaaaugacacgggugaggccacaucuuuguucuugggugcuuaggaagccuguguuuugccuuauauuggucuuggagugagcacuaugucuauggacagcucuccuguaagcuuacuugacuaguuucuucugagccagcuugucagggaacauggcguagcuuggguuggugaggauggccuuucucaacugaccucaaaaaccucagccauacccugcaggcagagcccccacauguguguccuggaccuugagcucugagaggacaaggagggagggacuucauuugauuuagccucaucucuugagagcccuaacuacaguuuggggugacaguuguuuauaaaaggggaagcuaucccuggaggcugacaccaaguuugucaccacugaaaaugcagucuuuuggcuugugaugguuacagaaaccagagcuguuggcuugagcugugccucauucagagaccuggcugugugagcucuccuggcacauccuggagauuuugagggaacauuuuagcugguguuguagaccacugugucuggcaauaccacugccugcucucauguggaucccagagaggugcugacugcuggcagugggggagagaacaaugagaccgaccucacuguggccgcgagggcauguccucuuggcugcaucuggagccugggcagaguuccucggccccucucugagagcuggagugggcccagccguucugcuucccuccggguuguuagggaggaggagcagaaguaauagacccucgugcuguuuuuccccugccagggccucacuauggagucuuggcugauuuggaauucauauagaccagaccagcuuagcauugaagucagagauuugccugcaucugccuccugaauguugagauugaggcaugccacccugcaggaaccagaucuguggguauugggggagacaguguugucucuucucugggugacuagcauuggcaguuuccagacuccccauuguccaucccuuucccacggcuuuuggccugucuugucuccuauaggcauuacuguggaugcaugucagacucugaguuguggguggugccagggcuguccugagcagagcugcuuuagugugucuguugagcccauauggggauggugcagauaggucagccacugccaccagguuugggagaagccugucuggcagucucagucuugugggagguagccuggcucuacagaugcugcagauggcuauugugcagccugcugaugugacuguugacucugucugacagguuuuccagaggcuucuugcugguggcugcgagggguguaagcccauucuuucugguaugacugaggagggcugacagaaaggaagugguggugcuuugaaugugauguugacuguugagaaguugguaacaaguucuggauacccaggcuuucccuguuagccagugcuaugggugugguuugugccaucacccugugguggcagaagggggacagcagcauaggaugaggcugcuagcagagaaguccuugacuuggugcuuuugggaacagggauggcucauaacaaagaugggcugaugaccaagggugguccugaucuggagaugcugugaacacucugggcuccuuaggagguggagggaaguaaaucaggccagggugaugcuggggcuaggacauuguagaugggcucauccugaggggccccaccucaucucugcuccauuguucaguccuccuccugagcugugccuguuacuuggauguucucuggucuguuccuucuccuucccuuccccgcuuuuccgccucaggacucagauguccucuguuccugacauggacacuauucuugccagccucacuuaguccccacaucacauuguaacuuaaacucaaaggucaggauugcuguaucguuagcuguugcuggccgagccaugcugccucucugucccucaggucaugggacaggaagcucagcaggaagguucuggucauacuuggcugcaggaccuacugcccagcucccuccgguggcuccugaucauuggccuuuguggacacauuaguguuuuuuaucuuuccagagugggugaucucuagagcuggcagggagacacuguagugucuugagggaccuaguuucugugugucaugucguccacaugcaccacacugaccugcuuaaaggcccgccuugcgguggcugugguaagcgcugcguucagagcaggcacugucucagacaccugggauuaugcagacagaugguguuguagggacaggggaagugguauaggaggcucagggagaauagcauuauguuuuuuuuguguauuuguguauaugcuuuuauuuuuauuucuguuuguauuuauguguggguguucaugugaguggugcguguggaauccagaggucaaccuuggucauauccucuacuucauuuuuuguuuuuguuuuuguuugagacaggauuucuucauguaucccuggcugucuuggaacucacuggguagaccagguuggucucgaacucacagagaucugccaccucugccuccagagugcugagauuaaaggccuuugucugccaccacaccagucuuccacaccaauuuuuaauuuuuaauuuauucuuucauuuuugaguuuauaauuacaucuuuuccccauucccuuuuccaucuuccuccaaacccuccuauauaccccuccuugcucuuguuuaaauucaugaccucuuauuuucauuaauuuuuguuauguggauauacguauaugcacacauauuccuguuguucuuuguguaggcuugaagccugugguauuugccugguccugucuagcauguuguacuuguuuagcucaugucuaggcagucauauggugagacuaugccgucugacacuaguaggaaacagucucacagcaaacuuccugauucuuugucgcuuacagucuuucugcucuaucuucccugauagagggaaguguucccggagccuuacgugaaggaccuguucuguaaaugugcccauuacgcuggacuccacaacucuauuuuugauuacuugugauucucuaucuguuguagagaaguuucuuggaugaggggugaggacuacacuuaucugaggguacaaggaaaaaauuuuaugauacuguuagggauuaugcuaauuuaguaaccacuucguuuguuuuaauggaacaagguuucucaguuucugucugggaccugggcucaccaguuuggcuaagccaagugaucagaggcccagggacccucuguguccccagugcugggauuacaagcauguaucgucauacuuguuuuuuuaacauaggugcuggaugucaaacucaggcccucaugccuguguggccagugcuuucccggcugagcaucuucccagccccccgagcuugcuuucuuaagugccucucacacaaugacuuuacacuuuuuucuagauuuugaucaauuaagauguguugggguggagucaguauccugcucauagggcugaaacucugcuuucugccugacaggcacaugccauuucugacauugauacauacucagugucagacuuuugacagugcagccaagacagaggcacaggccugugguuuuguauuguugaagcuaccaucuucuuaaucuuaccaucagaaaucuuucaaauuaaaauaacaucugagacuacuaaagagcaaaguuugugccucuccccccccccccaaugauuggguaacacuuuacagugcuuucuucaguugccuuuuuaaugaacagaguggcacuaggaccucacagagcuaaacccugcccuagcuugggucauacagucuaggugucuuugacagcugugaaguaccauaggggcaccguuagucaucccuaccccuugucuauagcacuguuuggguuagaggcccucaguguaagcagugagagcagggcuuccucucccucacagguaggaguucaugcugacucacaggugaaggauccagccggcaggcugugucuucagaccugccaccccugggugcuugucucaccugucugugugaagcugccucaucauaagcuggucccacauuucuccuugccccauccucugcucccucucggucccugagcuaaugguucccaccccuccucauccuugccugcugguguuaacuuuagaauugucuacuaggguuuuguuuguuuuuuugguucacaguuaagaugguuuaaacugugugguggcgcacaccuuuaaucccagcacucaggaggcagggcaggugaauucaguccagcuuggucuauauagugaguuccaggcaaccagaguugguuauauagggauauacccugucucacaaaaaccaagguggagguggggagaucacauuuuguagagugagguuucugcacgaugccacagcaccaguguguuggauuuaugaauccgcagcucauugcaggacagacccagcauauucacugcacucaaggacccaccucuguccuuuuuuacucauugaugcugggcucuuguggcuacaucugacugguguguggcuaccagaugcuguuaccuuguucugcaacagcugucccacccaggaaaguccuguuccaucauuuucccuguaggagccaguggcugccugguguucugugggguguggcugugguuaggguaccaggcuugccuuuuccccagucuguagugggguguuaauggaucacugugaucaccaugguggucagcuuuacuguguaccuaguguggaguacuaacugcccucacauccccuucaggccacucuuccaucuuccugagaccuugaccaaccuuguguuucuguuggaguagcacuugccugguggcugagcaucgacuucugggaugacucuuuugaauguccaguuuguuggcucuguucuguccugucuuuguuaccaguacacuugacucacucugguuucuucaguggugcuggggcgcugagcccucccugagcccuucauacccauuccugucaacuuggugucagucugcugcugcagugguucuucuggagggcucgggaugucucaccucugcagacacucugcaccuuauugggagaggaugaacacugggugugggggguccuguccuuacagcuugcuuccucccaugcuuguucuggcaugcugucagguggcauguuuuuucuaguguuuggcaguagcugccauugcuccuguuugacacaagagucugagcacaccccaucuuugaguuuuaugguuguagacuaauguugggacucguguguuucuggcuaguucuuuagcgucugagucccugggaagacugucagucucugccuggcgaguggagccuucuggagcuucggcucuacauuugggguagagguguucucacuucccuuuuccccacugcucuuaaaaccuuauccauuuuugaaauuaauucuuuccugagaguagacuucucuucuuugacagagcuggggucagacacuguagggugacuuugucaucugccaaggcauagaugcuccacguaucccucaggcgucuguaaugugggacagggugauccugccccucccugacaccugaggaaggcccucuugguuguguccagaugccuguuggugugucuuggccauccuaggaucuuguccugacacagacacacggcuaggcucuaggcuggcuuacucaacauggcucagacucuggcucuaccuugggcuguggagcagcuuugcuggcaggagguagaacucgugaacacagguuuaggugucuuccucagcacauggagaggaaagcucuggggugccugcaacagcagugucaggauagcuguaggaugguguuguucuaggauuccccuggcuucaucauggugaggaaguuugcagugguaacuggauacaacagaauauuccauuuugagaucccgcugcccugcaacucuccugagcacuagaugacagccaugugcauagccaagugccguaugccuagcagagagucacuuucgaacauccugcaguuugucuuauugagacaacuaauuccugcaaaaacacagcucuaaggaaagaagcucuguucucccuugggcuuauguguuuacguucauuugugaugggccuguuucuagucaaaaaguagauuuuugccaagagugguagcaaaucucugaaacuccagcauugagaagguagaaggagaaaucauaaauucaaggccacucucaguuacaaaccauaguggcuuaaagccacccugggcuacuuugucugucugucugucugucugucuguccuuacuccagacacauuuagggugguucucuuuuuucuguuguuuuguggcccugguuucugaugaggcuagggaugagaugagcagaguccaggaaacaguucuagggcagugacuggugucuggugacuggggugggcuagacacccuucuaggcaggcacaauguugucuugcacaucaccuaccagaaaugccuucaguccguguguuuucuguugcagacuuuaaaaaacuccaagagccuuugcucccuggacuaugaagacgaugaggaugacacccaggagaagacucuuguguccuccccguguaacucacagggccucgugggcaucaucacaccgagcucuagcccaaggauucccaggccuggcccugacagccccaguaucugggcgucaggggagccagaggccaacccaggcgagggugggagcaguggggaccccagugacugggacagugcaggagaggagggcaucuucccacuggaccacggcgaccuggacuuggagcagauugagaacaacugacuuuggcugagcaggaugacugugguugcugucugucaccuuggugccugaccaguggaaauaacuuguguguuauuuugaaaauugaggcguaauuuugauucaguuuuuccuaaagaaguauuuugcauuuuuauggcuucuacaguuugagagagcuucucuauuuugaaauggguuucagagggcauucuauuaaacaugauucugccuagagau

SEQ ID NO: 2413 - RNA, 329 nt, Mus musculus
ggaaacccuuucuccucguugggcgucugaaggcaagaugggucaccagcagcucuacuggagucacccacggaaguucggccaggguucccgcucuugccgugucugcuccaaccgccauggucugauccgcaaauacaggcugaacaugugccgccagugcuuccggcaguacgcgaaggacauaggcuucauuaaguuggacuaagcaaccuugaauggauucgacugacuacuaccaaguggaaccgaucaugcuaguauuuguacacaaagaauaaaaaugugaagaacuuuaaaaaaaaaaaaaaaaaaaaggaaacgagggc

SEQ ID NO: 2414 - RNA, 319 nt, Mus musculus
augaagucaaacuucagcgggaagcccgagaaacacaggagagugagagaaagccuccaccauacaagcauaucaaggugccugucaggaaugagagggagaguguguguguguguguguguguguguguguguguguguguguguguguuuucucaacagagcagugaacguggcauuugggcugcugacuuuuuauauccagguuguagcuauuagaaggucugucagaaacuaagucuuugagugcaaugaugguuaguaggaugcaugucuccaaguggguccuugaggggcaguaugagugugcagcguccagg

SEQ ID NO: 2415 - RNA, 39480 nt, Mus musculus
ugguuccaaauuauuuuauagucuuucugaaggaaaugauuguggacauguuaagacaguuuccccuuucuaaaaguauuaaugaauaauaacacuaacucuaaaaaccaaccgaagaccuauuuacaaaucuggggugauuggccuuuccaacaggccuagggcugugacucugggugugauagguguccugaaucugacagagauguuucuuucugaauaucaacuccaguuucuucuuccuuaaugugacauaaacaaaugaaaacugcccaucuuccauacuacucaggagccuuggcaucccaaaccaggcaggagcugcucccuagucagcacacacccguguguaugcuucugcagaguggcagcagcccaggauccacagccaguguccacaguagcacuggccuaggagaauguggaaccacagcacuucagaccuaggcaccuguagggcagugcaucuggcacgagugaggaggacccaggugccaguuccuaaggaacagccuggcacuaguauguaaggacuccuugggucucaggcaggcacacucagguuggcuuuucugaggacuuccaagugauaccugaugaugugugaccuccagagcuaccuaauuuucaagaguuaaaggaaaaaaauguuuuaaaguuaaugcaaacaccugucaguugccaaauaacuucagcugauaacuguuagaauaaaaugcuguguccauguguaucauggugucacuguauccuguugagaugugaaaugcccuaucagaaauuaaauaaguuuaaaugugccaauuggugucuaaacuucauacaauauaaagucagguuccuuuuaggaaugcugggugcugucacuaggucugauagugaaggcuuaaaaacuugaaguuuggggggaggggggaguuaauacugaaauauagaugagaauuaccaguuggggaagaauagcauuuaaaguggaaaaucguguuuggaaaacuguaaugaguauuuuuuuauuaaaaaacuuuaaaggccuuuuucuuacacuuauuuaauauguaacugugucugacuccacaacuuccugggugcccacaguugcucuacccauuuaccaaccuuuauuuucagguagccuuaccuccaacccugccucuccucucccagguucugacagcuguauaugcagggguuuggucucagagcagggagucaagcucgccugaaacacagcucugugggcuuucuuuagaaaaacuaaacuuuaauacucaggucauuuuacaaugaaaauaagaacccagacacagguuugaaauguuuacaacuguacaaaagacauacaaaucccugguaaauaguggcaucaaggcuggucauagccccccucacacccuagacuuuccagcugucaccuuugguccccucaaccucaugagggagggcaugcacaaggagagagaaagaaagcccucucagccaguacuuuuuuuuuuuuuuuaaagaagaaauaaaaaagguaaaagucgaacaggcacuaaaauuuugaaguaacuuuugguuugcauucaaaacauaauauugaauaaaaaaaaguaucuuaaucacacagaaaacuaacucauuagaauauaaaaaauaagccuaaacucuccagagaaauggcugggcccaggagccuguggaucacaggugcuggguggagcacauccuucgguaucugcucaggucacucagcacaaccagcaaaccuuguccucuggucugaugagggucagcagcagagauggcacuuaggacacauuggucauaggcuuguacuucuugaagcguguccacuggccuguggcguaguucaucucgaacacuguguccacuagcauggugguacugcccuggccgucugccuugggcagauccucuguguguucacugagcuugaucuggaucacaucccccugcuccgggcauggguucucuguagggagcagggacugcugggcaggugccuagggccaagcaacccaucccccaacccaugaggggcaccucccaagcuuagcauuagcacagaccguaccucgagagccagccaugaagcccaggaugagggccuucuccggccgagugaccuuguuugccgucuugaacaucuccugggcagcaaacaucuguucucucugugaaaagaugaugugggugccucuaccauuggccugaacaaaugacuaacccaagcuuaugucugccccugaaagaaucauuccucuacagaauaauaccccuuggcugcaaacaggcaaagcuaugcuauccaucuaauggccuugggcccugccaggguacuuacagugagggacagguucuuuuuagguugcugcugaacaggggcuggagccugggucugaggggccaccauggccacuggaggugucugagcaguaggagugacagcugggggaguaguaggugucagaggugagguaggugcugcaggugcugguguagcugggcucaggccacuguuauacauaggugcccuuuguuuaaacuguguuggcagugugggacuuggagcgcuggguuccucagguggccggcuggcuucccgagaggguggagcuguaggcaaagcagguuuauuaagaguuguccaggaaagggagucuucacuaaucuacuugguccccaggcucccugccccaggcaccauuuucuggagaggcaauaggcucagcuccacuucuccugccccgacaacuaccccauauccaccuacucuugucuuguuccaucacugcugcccagaagcccuuacugaccuucguagucagggacaugagcccugugcacuacuauccagcaaggcagagcccauguccucaggcauuucuagacuuguaguuuaaguugucuaaggcucugguuagguccugguguaugauguuacccauauauacccugauacugguuacaggacgaugggaagcugcuccccaagccuagcacacucugccucagcaaggcugcugacccuuacauguccugaggaaaacugaacccccaaccuacagagcugagcccaguggagccaacacccugaacaaaugacuaacccaagcuuaugucugccccugaaagaaucauuccucuacagaaugccucaucugggaagagaaaauccuuggcuuccccuccuagcacccccacccccaaagaacagggugcccaaaguggcaaucuuggcagcuacuuguucauucaaaucaggacuucuggcuuauuucuuggccaggagauccuucuguugccugggaucagaagacaaugggacgggugcuuuggugcugagcaguaccugugagcuucccagguugguauaccaggcuccauccaggggucaaaaguaacccuguaagcccagggcaaguccuuaugugggcugagggaaaacggauuccgcauacugcuggguacucaccugggggagucucagagcuggggauguaagaugaggcagguaccacacuggguguagagggcagguaacuuguggagggcaguguuggcucacuguucagagacccaaguuucuggaagacagagacaaugguuccuccaggcagagguaaggguuucaguacaccuuccagggaguagccuggacagccucauucagucauugcccaucaacagagcaagauggcaaguacuucuauccccagggccgggauaguggcuucucuaaccauaagccccugauuuuagugaugcuggacuucagacuuaagccacagccaccacccuauguucccaaacugacaucuagggaaaauaguuaagcaaugcaaaggguaccgcaaagaaaaugggcucagagaucauaccaagaacggccacacugccuacgcacacacaaccuacgcaccuggcucuaacuacucauuuccacagaccaacccugggaaagagcuacucuggcucaaacacccuucccacaugcaugccaugccuggucugcagagcaccugggccucaagcaggaaccauacccacuggacagugaggagcuugagguaacagugguauggagacaccacaggcaguaauccuagaaugaggcagguauuuguuccaaacacgcaaccgaugcccaagucaggcucuggcuccuucagcuacuagcauacauacacguucauacaugcauacauaucugcacacauguacacacauacagaacauaucucaguggcuaccuguguggauaccaggccagcagcauagucagggguagcguuuucaacaaccgucucuuccuuggugggcuuuucuaccacuucugugucugccaauaaaggaagagaaaaggcugguuaguggcucugacccagcuccaguucaagucacaaguauucucugugaaggccaaaugcaaaauagcacuaugcacuuaggucucagggcaaggaaaugauauuauaaccuguaauccuaguaguuggaaagcuacaagcccgaggccagacuggaccacaguguacagaccuugucucaaaaagccacaugcccccacucuauacuggcagaagcaacuacagcacauuaggcugcacugcccccguccucccuccaaaccuucaaugauccacacaccuaaagucuuccuccuccucuuugccucucguccagcaccaacuguauucagcucagaaauauccagcagcugccaaaauaaauacaugccgcacuuuauuauagagcaaagaaucaaugcuuagccuuggcaggaucaugaaaagggaugucucaccuucacaccccuuucuuucugcaguggcguccucgaaggugguauuggaguccgguucccagaaggacugaagacgcuggguguggugggacuucggaagggggcuugcuucggaaugccuuugagaggggcuacagaaaugacacuaauaucagugauaaugucucuggagggccccagcagccucuugagcaaggcugccucugggaaaccccacagaaaguuagucuucuaccacauuguggacuuugcacauuucauccugugcuaaaaagaacucaaggggauggagcaauggcucugugguuaagagcacuggcuguucuuacagaggacccagguucaauuuccagcacccaccguuagcuccagucccaggggaucugaugcccucuucugucauccaggagugcugcacacacguacacagauauauauccagacaaaacagccauacacauacaauaaaauaauucaaaaaacaaaaaaaaaaaaaaaccacucaggcucuuugucagcaucacuauggugaagaaccaugaguucagaaccuacaagccuaaugacaucccugaagguugggaagacccaggcuugacgcucuaaaggugcacgacucauccuuucugaguacgcuagauaauagaugcuaacagcucucuaagacaaaugagaccuccagacuuugcaggacaagaacuauccagauuucaagcugcccaguaauaacaccccaaacuaacauuuuugcuaggaagaaagccaaagaucuugaacuaggugaccuuacaguaccaagccucucagaacagugacauuccuuuucuuucugucccucaggagggccacccaauguccucagaggcaaagaaagcaagguggagccuacacuacagcaacaggccauaccaaaggaagaaccaugcccuguaguaauaaugggagaauggucggucagccauaccaaggcuuugcacuaguuaugugccagcuuuggaguuuugggaacuugguauuccaagaugcaagaugaaccaagugggaggaccaggcaaggcuuucccuucauucuaaagcuaucuugcccacugggcccugaacauuguucuagaggaguccucucuuguaccugacacaagugcuaagugcacauaaacacaggcacaugcagagccagacuacuguguggcccucuaacuuggaaacuugcccugggcacauggcaccugccauaacugugacacucaagaggguagccaccgauaacagaggggcuaaagcaaauguugccuucuagaagcucuggcaacuacaaaguagcaaaaauuucccacuuaauucuuagcuuaauguuaaauuauauaggcaaugauauuauaaauauauaauguacuauaaaaacaaauaccagcugcuucagcacacacagccuccuuccuuuccccaggauaaugcacagggccuugcuuguccucgcacaacuucucacgauagagccgugggccuccccucucaggacuaauguccaagugcauuuucuggugaggaaaaauccuaccuuucaaggcaaacccucccgccuggcagcaacggcagcaccacccccugagagcacaggagccuuacuuguaguguccaucuuucgaagcagcccccggcccuuagcguggaaugggaccccagcacuucucuucagcugcugggcugucucgguagcugugagaauaaaagccacaagaucagggucacuuagagcacagggccucucagcauauaaagcaacuauaacaagaaagacuuuaaaaauacucaagguaacuccuuuauauaacccagcaggaaugcacccagaaaugcugaaguuuauagcugauaauuccuucaaaaaacaaacaagccccaaauaaaacacaaaaagaaaggaaggacuguuuccugguauuuguuuuuauaauacauuauauauuuauaaugucauugccuauauaauuuaacauuaagcuaagaauuaagugggaaauuuuugcuacuuuguaguugccagagcuucuauguggucuauuuuucuucaaucauuguucccaaggcagcaaaguggacagaauggagacaggagaaaugagcuacagcuuuugggagggcgggggcggggguggugggaagacuaguuuucuugacaagagaagaggaaggggacaauugcucaugcaucuggguugccacaucucauagcggugcuaggugcuucugaggccauacugaacggcaauaguuaaagagcaccuuaaucucuacuacagcuccaaagggacggcacuguggcuauaguccauucuacagaggccuccccuuuguucugggaaccaaaguugucuugggacaguguauuagucaggguucucuagagucacagaacuuauggauaaucucuaaauaguaaaggaauuuauugaugacuuacagucggcagccgaauucccaacaauuguucagucgcagcugugaauggaaguccaaggaucuagcaguuacucagucucacgcagcaagcaggcaaaggagcaagagcaagagcuagacucccuucuuccaauguccuuauauugucuccagcagaagguguagcccagauuaaagguguguuccaccacaccuuuaaucccagaugaaaggcguagcccagauuaaagguguguuccuuaaacucggagauucaaucuucuggaauccauagccaauauggcucaagaucuucaaaccaagauccagauaaggaucuccaagccuccagauaagggucacuggugagccuuccaauuccggauugcaguucauuccaaauauugucaaguugacaaccaggaauagccacuacaauccaccccuugucaacuugacacaaauaauaucucauguucacaugaaacaauaacaagguuguaaauacgccuaacaugauauaacuaucccucguacaaucgcaaacgcauuaguaaauuuacaaugggcauucauauuacuuuauaauccucguuucugcaacugguuacguggccuuaauugguauuuauaacuaccuuccucuacuacccauucuguauuuccuucuccuucagccagcaccucagcaggucuuggcucuuuuccuggaggauugacccauaccuucauuccugauggaucugcguucuuugucauccugcuuggauuaggcuguuguaguuucccauugacuuuaaucacaggacaugguaguacuaagaggcgcccuaagggaucuccuacacuccagacauaaucuugcuuaccaccauugugaagagguaauccaauuucuccaugguaaucuggaucuaucaccccuccuaacacuguuauuccuuuuuuagccuguugguuuaagggcauuagaagcccaaaaugaccagggggaagucugagcuuccaguucaauggaauguuuguuguagcuccugguaggaggacuccccucucuggagccaaaacuucuaggccagcagaaccuagaguuauggggacaggaagcaaaaauuuuccuagagggucacuaggagugauaguaaguggaacuauuccguuuuccaccccuugauuccuggacccaugaauccuggcuaugggugaaacuguaccauauaucgagcgcugauucaaagcauauacugccuucugaagaacucugccccaaccuuccaagcuguuaccaccuaauuggcacuguaacugcgucuucaaaaggccauuccaucuuucuaucagaccagcugcuucaggaugauggggaaugugguaagaccagugaauuccaugaucgugagcccacugucguacuucucuggcugugaaaugaguuccuuggucagaagcaauacuguguggaauaccaugacgauagaugaggcauucugucagucccugaauggugguuuuagcagaggcuuuacgugcaggaaaggcaaauccauaaccagaauaaguaucuauuccaguaagaacaaaacgcuguccuuuccacgaaggaagugguccaauguagucaaccugccaccagguugcuggcuggucaccucgaggaauggugccauaucuggggcucaguguugguuucugcuguuggcagaucuggcaaucagcagcagcuguagccaggucagccuuggugaguggaagcccauguugcugagcccaagcauaaccuccaucucgaccaccauggccacuuuguucaugugcccauugagcaaugacagggauggcuggggagagaggcugauuguccacagaacgggucaucuuauccacuugauuauugaacuccuccucagcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugaaucagugaauaauaguacaucuggccacuucuucuugcaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucaguugaucauagggaacaccccaugaggcuauaggcgcaugcuuggcagcagauggcauuguaacaggaguagaaaccauaggcauuugagcaacuucuucauguaacuugcuugugccuucaggaccugcucuggcccgaucacguauauaccacuuccauuugauaauagacugcugcugugcgcgucccacuuuaugacuugcagggucugauaguacccagcucaugauggguaguucaggucgcauaguaacuugguguccuauugucaaacguucaguuuccacuaaggcccaauagcaggccaagagcuguuuuucaaagggagaauaguugucugcagaugaugguagagcuuugcuccaaaaucccaaaggucuuuucugugauucaccuacaggggccugccagaggcuccaaacagcaucucuaucagccacagacaccucaaguaccauugggucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccaaaauccaaauagacccacuguaguggcuauuccugguugucaacuugacaauauuuggaaugaacuacaauccggaauuggaaggcucaccagugacccuuaucuggaggcuuggagauccuuaucuggaucuugguuugaagaucuugagccauaguggcuauggauuccagaagauugaaucuccgaguuaaggaacacaccuuuaaucugggcuaugccuuucaucugggauuaaaggugugguggaacacaccuuuaaucugggcuacaccuuuugcuggagacaauauaaggacauuggaagaagggagucuagcucuugcucuugcuccugcuccuucgccugcuugcugcgugagacugaguaacugcuagauccuuggacuuccauucacagcugcgacugaacaauuguugggaauugggcugccgacuguaagucaucaauaaauuccuuuacuaacuagagacuauccguaaguucugugacucuagagaacccugacuaauacagaagcugguaccaggagugguucuagaguaacagaaguacaaggaugaaucuuuuaaaauucuggaauuggcuuguugauccaccagcacuuucaacuauugaaaccucuccagauucucucccuccugggagcucagagaauuuugaagacccaugguugaaacuauauuccgaacuuaaagaagcuaaugcccuugauuuucuuaaugaauuaggugauucagugcacaaagcuuucuacaagauggggaaauuggauuaccucuucacaauggugguaagcaagauuaugucuggagugcaggagaucccuuagggcgucucuuaguacuaccauguccugugauuaaagucaaugggaaacuacaacagccuaauccaagcaggaugacaaaggacgcagacccaucaggaaugaagguaugggucaauccuccaggaaaagagucaagaccugcugaggugcuggcugaaggugaaggaaauacagaauggguaguagaggaagguaguuauaaauaccaauuaaggccacguaaccaguugcagaaacgaggauuauaaaguaauaugaaugcccauuguaaauuuacuaaugcguuugugauuguacgagggauaguuauaucauguuaggcguauuuacaaccuuguuauuguuucaugugaacaugagauauuauuugugucaaguugacaagggguggauuguaguggcuauuccugguugucaacuugacaauauuuggaaugaacuacaauccggaauuggaaggcucaccagugacccuuaucuggaggcuuggagauccuuaucuggaucuugguuugaagaucuugagccauaguggcuauggauuccagaagauugaaucuccgaguuaaggaacacaccuuuaaucugggcuaugccuuucaucugggauuaaaggugugguggaacacaccuuuaaucugggcuacaccuuuugcuggagacaauauaaggacauuggaagaagggagucuagcucuugcucuugcuccugcuccuucgccugcuugcugcgugagacugaguaacugcuagauccuuggacuuccauucacagcugcgacugaacaauuguugggaauugggcugccgacuguaagucaucaauaaauuccuuuacuaacuagagacuauccguaaguucugugacucuagagaacccugacuaauacacccacuaaacguugugcuucuuucuugguuguaggaggggccaggugcaauaacuuaucuuucaccuuagaaggaauaucucugcaugcuccacaccacuggacuccuaagaauuucacugagguagaugguccuugaauuuugguuggauuuauuucccauccucugauacgcauauguguuaccaaugaguccaaaguaguugcuacuuccugcucacuugguccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguugauuugcucaaguaacgaaacuacgucugguacagcagcuacaauuggaguuaccaccugauuuaguuuucgauaaucaacugucauucuccaugauccaucuguuuucugcacuggccagauaggagaguuaaacggagauguggugggaaccaccaccccugcaucuuucaaguccuugauaguggcaguaauuucugcaaugccuccaggaauacgauacuguuuuugauucacuauuuucuuuggcagaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaaucaccugcccuccauaagccccuacuuuaacuggagggccacaauguuucuugggauccccugggaucagugucaacucagaaccaguauccagcagaccccgaaaagucugauuauuuccuuuuccccaguguacaguuacccuuguaaaaggccguaggucccucuggggaagaacuggagaaaggguaacagcaaaaccuuugagugucuuaucaagauccuuccucagcggaaccuggccaccccuucauucaagggguucuggaucugcaaacugucucaagucuggaaauugauucacuggccgagauugcuguuuaccacgaucuaauguagccuuucuuucauuuggcuguuuaccacgaucuaauguagccuuucuuucauuuguuugagaauuuuucugcuuauacagaucaaacaaauaugcaguaggcuuccuauguauuucauuccuggaaacaccaugauugguuagccaguaccaaagguccaaccgagucaugccauuauaaauuucaccucuccugugcugaccauuacuggguauguuauuauaaacauucuuuugucuacgcuguccauuauaauaacuagaaucaccuugucucgggcgauucaaugcugccaccuggcccuuguuaccucggaauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuggugaaaggcauaucuucuggaccuucccauuguggacaauuaugcuuuacacaauauauccacucuagcauugcaauuucccuaagucuuaaaaucccuucaucaacacuaagccauggaauaucaggcaucuccaagucauuucuaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuaguuuuauguuccuuccacccuuaucccacacccuuaaaauccauucccacacauauucaccagguuucugcuugaaugaauuagccaacucauuaagcuccuuaguaguguagcgaauuuccucauggacuauacuuucuaccuccccucuaggagccuguuuugcuuugagucugguuacaggucuagaagaaacuauuggugggccgugagcagacucugcaaaauuaauuuccucauguggggaaggcauuauuucaagagguggggcugaggguacuacuuccucagguggggcaaacccuugagaaucugaggauucaaaauucucagcuucaacauggucuucccacacauccccgucccauguuguaggaucccauucuuugccaauuagagcccuuacuuuaacugucgacacacucugaggcugagacuugaauuuucucuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauauuugaaagugcugguggaucaacaagccaauuccaguauuuuaaaagauucauccuuguacuucuguuacucuagaaccacuccugguaccaacuucuguauuagucaggguucucuagagucacagaacuuauggauaaucucuaaauaguaaaggaauuuauugaugacuuacagucggcagccgaauucccaacaauuguucagucgcagcugugaauggaaguccaaggaucuagcaguuacucagucucacgcagcaagcaggcaaaggagcaagagcaagagcuagacucccuucuuccaauguccuuauauugucuccagcagaagguguagcccagauuaaagguguguuccaccacaccuuuaaucccagaugaaaggcguagcccagauuaaagguguguuccuuaaacucggagauucaaucuucuggaauccauagccaauauggcucaagaucuucaaaccaagauccagauaaggaucuccaagccuccagauaagggucacuggugagccuuccaauuccggauugcaguucauuccaaauauugucaaguugacaaccaggaauagccacuacagacagaaaaccugaagccaacacauguuggcuggguugccccugacuugacugucuagucaagucacaucauagacucucaagcuccugcucaacucugcccgauuccgucagggacucuguggcaauggaagaauaauacuacagcuaguauugcagguuuucucuuccugugucccuuaauagaaaacacuaaauuucccucgaaacugugugcacuggcuuucuaaagugacaaccuaauccaagaaaacaccaccgaggguagugaugggcauuugagucagcagcaagggagacccuuccucagcagagugaacgccaacuauguuaaagagcucaauauuaaaaugaaaugauugacgugguaauaaaauugaauaccaaacaauaaaaaccaucauguguuguaagcucauuuuguuaaauaagccuuccccuguucacggaggagcuugacaccagcucaaauauggcaaaagcuuccugugucaggacauucccacaaauguggcuccagagucgacugucauugccaccugugugccccugggaaccagggaccugagguguugcuauauuacaggucccuacagcugucuuuacagcaggcucaggucauggaguuacacauaaauaugagaaggagacaagagauuuuccuaaacuugcuuacgguccuggagggcaggauuagcccgaguccaucagcagcacugaggacuuccugacagcugggcuggagaccuuccagagcaguucagugggccugagcuccacagaccuccagacagcacagacccuagacuuguucugcugcaaggcucuuccugcaaacagggcauuugcuggccugugaucccagcacucaggaagcugaggcaggaggagggagaagucaugucacccgaggcuucacagcgagacuguuuuucaaaaaacaaaacaauaaaccaccaccacaacaaagagcuauuuacaaauacuagugauguuaauugcauagccaaaauaguuuauggaaaucuauguuuuuaauuuuuuaaaauuuuuucauuuguugguuuuuuguuuauauuugugaugauuuguauauucuuggaccagggaguggcaccaucuggaggugcggccuuauuggaauaggugugaccugguuggaaugggugugucacugugggugugggcauaagauccucacccuaguugccuggaagucagucuuccacuagcagccuuugcaugaagacagaacucucagcucugccugcaccaugccugccugguuacugccaugcucccaccuugaugauaauggacugaaccucugaaccuguaagccagccccaauuaaauguuguuuuuauaagacuugccuuggucauggugucuguucacagcaguaaaaccguaacuaagacagaagcugguaccaggagugggguauugcugugauaggccugaccuugcuuuuauuugaaagaauguggauuuugggacuuuggauuuggaaagcaguggaaugcuuuaaauggggcuuaaugggucauccuaguaggaauauggaagacuuuguugcugggaguaauuugaacuguguugaccuggcccaagagauuucaaaggagaagaauuucagaauguggcauaaagacuguuuuugugguauuuuggugaagaauguggcuacuuuuugcccuugucugaaaagucugccugagguuaaggugaagagacccagauuaauugcacugacaaaggaaguuucaaaaaagcucagcagagacuuuguucucugguuaagucuuaugaagagaaguuugaacaagcauagcaagcuuagaaaggaaaaauauaaaauauaugguucgaguauuaaagggguaccuggaagugaaauggagcaaaauccuguguucuaggaguuaacagagugggaccuuggggcaagauccuacccagcuaaauuuagaaccaggcauggugguacacaccuuuaaucccaggagacaggcaugcugaucucugcguucaaggccaaucuacagagcaagacccaggauagccaagcuuaggcagugaaggauuuggaaaacagaaagccagugacaauguaauaguauaagugggucauguucuaauuccugcaagcagcagaacuuggcagcuucuggcucuagaguuaagaauggaaggaacuacugggacaauugaugcugguuagcuggagcuaagaaauuagcagugauuaugaagagaccagcaucacugaggugaacucuucugggaaguguuuucugggagcacaaagaagcuguguuccagagauagccaagguuguaccucgugcugcagcuggacuugguaauguguaagaauuacccaggugguacugguuuugaaggcaugaagguaucaugaagaacagcugaagcuuggcacugugagaggucauggaaggccauuggagaagguauagccucagcuguaguugauggcccaggacugaaggggucaugcaaaggauuugaggcuuggcaccaugaagagagccuauuagaggcuauuggugaagccuaguuggaguggaacaccccaguauauuggagaugucaguaccaugggaugaucaccaagaacagcagcuguaguggaguggaucaaccugagcauagagugcuacagaggacagagauggagaagugaugccagcccuuaggaggagcccaaaagaucaaguggaauccuagacacugaaacaagaagcuguaacauugaaauugccuuggagacucaaagauguuacagaugccagagccaugguauacaugcugaggaaagcugcuaacagggaguggaaccagcccaggagaaagcaguuuguugcagucaacaaagaugaaaaaggaauggagaucugaagacugcuuugacauccaucaaccauggugcugcagaguuuggaguuugcccagcugguuuccugccuugcuuuggggauuacaguuaauuaguuggaugaaucucagaagagaccuugaacuuuggacuuuuaauauugaggcugcuauagacuaugagaacuuugaaaguuagacuaaaugcauuuugcauuaugcuauguuuaaguauagcccccacagacucauguuuuuaaacaaaucuauaagggccagggaguggaaugugaugguuuguauauucuuggaccagggaguggcaccaucuggagguguggccuuguuggaauaggugugugucacuguggguaugggcuuaagacucucacccuaguugccuggaagucagucuuccacuagcagccuuuggaugaaggcguagaauucucaucucugccugggccaugccugccuggagacugccaugcuugccuggaugcugccaugcucccaccuugaugauaauggacugaaacucugaaccuauaagccagccccaauuaaauguuguuuuuauaagacuugccuuggucaugguaucuguucacagcaguaaaacccuaacuaagacaauacuguuuugccaaaacaaggucuacauugccuaggcuggucuaaagucaguuuguauucacgugaucuuucuuucucagcaucucaaaaagucgugaacuagguacccagugcacccaugcuuuuaauguuauuuggcuaaagaacacuuucccugcccugucuccagccuuccacacaaacuuucauaaggcgugauuugggaaagcauuuaauaaaaccaucuaauaugauagagaccaggucaggauacaaacagcggccucacaccaacaucccauugugagggacccacaccugcuugacuggcacagauucuauuuugugagauuacaggcacuguguuugaaacucugaggucucuaaugcauguuucuaaacaucagugguuaacacagaaaugucugucuuuuugaaaagacaagccagucucuuuuaaaguaaaaauauuugaaaacuauagagagaauaucuuguguauuauauggaagccucucuugucaauaaaaaaaaaacuaugggcuacagaaaacauguagaauggaaguugggacauccgguaggcagaaagaauucucagagagagccaggcauauggaggaagacagagaccaugggagaagcugagcagagguaaccgccaugugguaggacuuagauuauaauaaaugggaaauuaaauuaugagcuagucagagaacaagccaaagcuaauggccaagguguuuguaaauauauuuugagauauuuugagucucacaguuguuauucugggagcuuggggcugggaggaaagcaugcauuuaacauauggugcugaacauggugggcauggaauccaaaucuuuugauuuuauauuuaguuauuagauggaguccaggguaaaccgaggagaacaaguggccauguugugcuacagagcacuugacugaggcccuugagccugcaguuucucuuggaccaacagcuaagcuacccuuuguucuuacuuggcuuacacuguuuuaucucauuuaauaguuaauaguucuucaacugugucuuuccuggcauacucuuaagaacuggaaugguuccauucauuuugguuuauugagacaggguuucucuguguagcccuggcuguccuggcacucacucuguagaccaggcuggccuggaacucagaaaucugccugccucugccucccgagugcugggauuaaaggcaugcgucaccacuacccggcuauaaaauuuuuuaaaaaauuuauaaaucuaaggaaaaggcuaagauaucagagauuaaaaaaauagggagagaaaauuaaggcagacuucgagaaagaagaggcugaugaaaacuuaguugcugauuggagacuacagaaaagagauucuuugaaucaaaauagggacucuucggaggaaucuaauauaaaauuuacaauaacaucaagaggcaguuccaaaugugaaaaaucuacaaaggcuuaaagaauuaaaacagcagcccaugauaccauaauauauugaguuaagaauucagauucuggaggcagaggcaggcagauuucugaguucgaggccagccuggucuacaaagugaguuccaggacagccagggcuauacagagaaacccugucucggggaaaaaaaaaaaaaaaacccaaaaaagaauucagauucuacuuauugaugcuaccucugaaaaauguuauacaauaaauuguauagaaguuggagaauuaagcuaaguguauguguugcuacaucacuguugauucaaguuaggacaguuauagaaauauaagcugagacuaauaauaacccacuauuugucucuaguaaaaugcaacaguuuuuugcauauuauaugaagcaagauguggacauaucacacaguccuacaggacaggcagcuggacagagauguaauccugcuuugaaggaaaggccuuuacagaugaaagcugauggcgccuuggccauuacuggaaucuaacaauuauuuuagacauuaugucaugaaaucuguuacagaaauaauuuacaauccuacagaucaagcaaauuauggagcaaucuaacaaaaauuucagggaagauguucauagaaggauaaaaaaaaaaaaucuagggauaacguacuggauuucagaaaggacuccugaaugagaccagcuuauagaaguccuaauuucagaauggaacaaaggaaauauguuguacuggggagaugcuugccuuuauuccaauaggaaaagaaaagcuuugucuuccauccaaauuguuggaaaucggaguugacagggaggaggccugaagaucugcuugcagacagaaagaccaacaaugcagauaauguaugcgcugaccccuuggcagcggaagaccucugagacugacugagacaugaauaaucuuguuggcuagaguccucacaaccauauuugcaugccacucuuucauaugacauggaugaaaauuaauauuacaguuuggugacauaguccaaacuaacuuauaaagaaagaugucuuuuaccugcucaaagaacaaagaaucaucuuugacucaucuguauucacugaacauucuauacauaugucacuguugaaauguguauuauuugugcgcguuucuauguuuguagaccgaagagucagauaccaagaagacaagacaaacagcauagaugacccccaggcugcuugcuuccaggacagcuucaaagaaagcagcugaccccaauccaucuagcaucacagaguguucccaucagcagguaagccccgaacuucucaguauacagaagauaacuggacagcaaaugcuacagcuagcugucuuaagacugaccauuauuccaauuugagcauuggggggcugggaggggaggaaagagggaaggcucaaaaggaaagugaaacccuaaaucaucaggaaaugguuuuaagagaacuguuuuaagagucccaguucccaagaggugggcuagauggcuuuugaucauucaguagacgauggcuguugccacuguauaaggggguugguuacaauauguuaaugguucuggucagggaagaaacaaaacagagauacuggauucagggauuucuuuuucucucucuuucuuuccaauauccuuucucuccuguguaguguuaggaggaaaagggggaagaaggaauggaaagagaaagggggaauauaggauuaauggauggauuauugaaucuacuuuuaggucaaagaacauuaauaagccaaaaaucuuacacugguauucaucuuuguauauugauacauauuaagguuauauuuguuuacauugguauagaucuuuguauauugauacagauuuagauuauauuuugcuacaacacacuaagguacuguacccacgcaauucauuauaaaaugcaaaguuaaguucuaguccuuaaaagcugcuauaagacuguuuaaaauaauuagaaauacaaguuaauagucaaucaaacauauggucuuguaggaacuucuuuauuuauuuacaaaauuaagcuuuauuuagagguagauguucucaauguuaaucagacaguaaauagaaacaauucagauauacuauagacagauggucuuuaaauauagcauuuaaagaugcuuuauuaauuuaauccuucuuugauaauaagacaggucagcuccuggcaucaccccuacugggcuucaaagaagaugcugagcauuagaguuugcuucaaaagugguaagcuagccagugggcaaggagcuacccuugcuucaugcugacagaaugcugcuguccaaacugcacaaaugggaugcagggaaguugccugcugagguuugccaagacaagaugagcaguccuuuucuauuuccuguuucacaaaaaggccugucagguauucugggcuacaaagcuacagaugacgcuccuaugacucagagaaauuugggaggcuguccagacagccaacugucucugucacugucauagucuaggagcugcuugccuacacuuccugcacacucagguaauauuuauuccuucucaggucucugaugggguugaagacuaaauagauguuuuaaagucuaugcaaguuaugguaagaaugauuuaaguacagaacucuaaacucaccaggauaggauagaugguagaguacuuuauccaaaguugccagauacauauggacuagacauuauaaauauaauucuuaccugauaauuuuucauauuuguuauuauuguauauagucuacugauggaaaauaaaagucuuuuaucggacuacaggggaacuuauagagaauauguuguauaguguauggauacaucaacuugucaauaaaaacucuggcuuauaggaaagggagaauagaaggugagacaucugguaagcagaaaggauucugggagagagccaggugcauggaaauuugccugggaacaugggggaggacagacgcauggggucugagaggagguaggcauccauguggcagaacuuagguuaaaauaaauggaauauuaaaguaugagcuaguaagagaaugagccacagcuuauggccaagguaucuguaaauauauuuugagucucagaguccuuauuccagggguuuggggccugaagggaaaaccccacagagaaaagagcaggguugcugugacccaggcacucacauuucugcagcaguucugcccgcagcguggcacucuuagguuuccgcuuuagcugaaaaugcuugacugguggggugaggggcccagcaaggguggucagggcauucuuguucagguacuggcacuccagugguagcauggcagaugccucgcacucacucacuguggagagucagaggguuagagaaauaguucuuacaaccccauagcucacauguagacaacuccaugaaggcuuucauuauuuaucacugugacagcuucuugcuuugguuucaagccccuaucguccccaccauuccaguuccaccgucucuagaacccaagaucauccaggugcaucaggaccaaagaauaggccugucgcccuagaggaaaccucagauuuuccaggggcuuuuuaaaaacaagaaaugccuagaaaagaagacaggguuccucaauuaugucagccauaagccacuggacuccaguggagguccaggaaccacaagcaucagcauacagcagcauggagaacagccuccugcauccuaacuacaaggcagauucaacaccaagaggaacaaguguguggcuaucuuaucuuccccuuugacugcagagcccuggcggucucuccugacuuccucagaggaaguuuucuaaagccacucccgugugcuuccugauucgaugugcucaccaagaggcuggagccugaaaaacuccaaagagcuaucccagucagucaucuaacuaggggaagcagaaucaugagaagcaagcugcuucacccuccugcugucaagugaaccagccaccacgguagggaugugacaugugcagaccaaugcucugagucugcaacuaaaaucaacaaaacccccaaaccuccuagggccucacaagcaggccuguaggagugugugaccucgagccuccaacuccaucuuucugaggcauaggucuucauucuccaucaagggagagagcgucagaggcacagauauuccuacucucaccucucuaaaaccacaguuuucaucucauagucuagaaacugauuuguugguauuuuuuaaugaguaucuacuaaaggacagagaauguuuuuuaggcucaggaaacauaaccuguaggguuuucacccucaaggaacuuuuggggagagagagcaauggucaaguaaaucaugaugagucagagcugcagacacagcacaugcaguggggacaggguuguggcaagucagaccgaagcagucauguguauaaggagccauggcauacuacaucaaggguauaauaaugacaacauaauuucuaaaacuagagcaccuucuugccacugcaaaauaaaguuggcuacuuaccuuuuucucuaaguucuccuaagaugucuugaacauugggguucuguuccucaagguccagauucaaggagcccgugucagggaaggacuucagaaugucagcaaccaugaggacccaggggucugaguccagcguggccagcuggaugauauccaucagagccgccuucaucugccaagaaagaagacaccaaguacaugucagcagccccacuuggccuucggaacagugacagcuuaaaauguccccugccgugacuguaggcugggauggcuuuucagacugugccuaugcuuccuaacucucucuggugggcagauauaacaaaacauaagauucaaggaaacagggcugccaugccuauacuuacggaauaugugccuuuaaugggcauucuuuuggcaggcagaauugggcucagguucaguaacauggagcaccaaggcaaguggguaacccaucauuucuuuggugcaaaggagggacagggacaagagcuuauaccaugagcaacugccacugcuaguaauagauagaugcuugaaguuacagugugcauaggagaaaccuuagaaagcugggcacauggaaugaugcaugcagcuuaugagcuauggacaccuaccagagaguuagagggggccaggaagucuuaggaagucuuugcugcagccugugugggagccuguggcugaagacaagagggauuugaccucuaccaccuacagguaagagugcuaccuaaccugugcugcuuugucacauuagcuguggugguuugaauaagaauggccaugugugggaaggauuaggaggagugaucuuacagguguguguguggggagggcaaguucuccuacgaaguggagagaggugugaagcagaaguuuagcauagccauuguauauggcuaauacaauggcuuugaaguagccuuuuguaaauagucagugauuguuuucugaggcugaagggguggcucuucugaaggauucaaagagccuuugcauaacuuaaagguauccgaaggcagagaauuacucagguauugauuccuucacaacaccuccuagaucagauaagaaguguugguauaggaaauugacuugcuaaauugccuuuuguguaacaauaaagagguucagcaaagcugauuucuauucaguccugaaggaagccuaaauuaacacaauacacacagagaaaggcauuacuaggggugggcuuugagguuucaaaugccaugugccucacuaucccuguaauuuguggcucugaugugagcgcucaacuacaucuccagcacccuccugcugccugccugccacuacccuccaagucaugaugagcauggacacuaaccuuuuaaaacuguaaacaagcccuaaauuaaaugcccuccuucauaaguuaccuguguggagauacuaugauuaagacaguagcccuggaaaagcaacuuaccaagagggaaaacaggaaauauuuucuaaaagaauggcucuuaaaauaucagguuaaaaucuaaaagaggcagucaggaacuccccacaaccaguggcacaguaucccucuggucugggccaguggccugaacagaccuugggcacaaacucugaagccagucccacaacacccagagaaauauccacucccagguacucuaacacacccaggaucauaggaugagaggugaggaggacacaacaucugccccaacacuggaaguaacugggaccagcagaaucugggcacccaagaacuccauccaaucaguggcacagguuccuucgggccugggcuggugcacagagcagaccuuaggugcaaauuccucagccagucccacaacacccagaggaagauccacucccaggcgcucugacaugcccaguaucauaggaucagagguacccugagcagaccuugggugcuauuucugcaacccaucccacaacaccgagaaaaagcuccauucccaggugcucuaauacacccagguccacaggaucccagaggcagcuugauucccaggagcucugacacacccaggacucaggaucauaagaucccagaaucauaggauuacagagacagcuugacucugaggaguucugacacaaccaggaucacaggaaagacaggcuccagucagauauaucgaggaccgguagcacuagagauaaucagauggugggaggcaagcauaagaacauaagcaauagaaaccaagguuacuuggcaucaucagaacccaauucucccaccauagcaaguccuggauacaccaucacaccugaaaagcaagauucagaucuaaaaucacuucucauaauggugauagaggacuuuaagaaggacauaaguaacucccugaaagaaauacaggagaacacagguaaacagcuaguccuuaaagaggaaacacaaaaauccuuuaaagaauuagaagaaaacacacucaaacagguguaggauaugaacaaaaccauccaggaucuaaauagaaacaauaaagaaaucacaaagggagagaacccuggaguuagaaaaccuaggaaagagaucaggagucauaggugcaagcaucacuaacagaauacaagagauagaagagagaaucucaggugcagaaguuaccauagaaagcauugacacaacagucaaagaaaauacaaaaagcaaaaagcuccuaacccaaaacauccaggaaauccaggacacaaugagaagaccaaaccuaaggauaauagguauagaagagagugaagauucccaacucaaagggccaguaaauaucuucaacaaaauuauagaagaaaacuucccuaaucuaaagagaugcccaugaacauacaagaagucuacagaacuccaaauagauuggaccagaaaagaaauuccuccugucacauaauaaucaaaacaccaaaugcacuaaacaaagacagaauaucaaaagcaguaaaggaaaaaggucaugaaacauacaaaggcagaccuaucaaaauuacaccagacuucucaccagagacuaugaaagcuagaagauccugggcagaugucauacagacccuaagagaacacaaaugccagcccagguuacuauacucaacaaaacucucaauuacaauagacagagaaaccaagauauucuaugacaaaaccaaauuuacacaauaucuuuccauaaauccagcccuacaaaggauaaaagacagaaaacaccaacacaaggagggaaacuacacccuagaaaaagcaagaaaguaaacuuucaacaaacccaaaagauagccacacaaacauaauuccaucucuaacaacaaaaauaacaggaaguaacaaucacuuuuccuuaauaucucuuaauaucaauggacuagauuccccaauaaaaugacauagauuagggcuggagaaauggcucagcaguuaagagcauggacugcucuuccagagguccugaguucaauucccagcaaccacaugguggcucacaaccaucuguaguagggucugguguccucuucugguuuguuugaagaaagcaauggugguguacucauauguauaaaauaaauaaauaaaccuuaaaaaaaaagacauagacuaacagacuggacacauaaacaggacacagcauuuugcuccauacagaaaauacaccucagugacaaagacagacacagaguaaaagguuagaaaacaauuuuccucagaguaaaagauuggaaaacaauuuuccaagcaaauggucccaagaaacaagcuggaguagccauucuaauauugaauaaaaucaauucucaaccaaaaguuucaaaaaaagauaaggaaggacacuucauacaaagaaaaaaaucuaccaagaugaacucucaauucugagcaucuaugcuccaaaugcaagggcacccacauucauaaaagaaacuuuacuaaagcucaaagcacacauuguaccccacacaauaacaguaggagacuucaacaccccacucucagcaauggacagaucauggaaacagaaacuaaacagagacacaguaaaacuaacagaaauuaugaaccaaauggaucuaacagauauuuauagaacauuucauccuaaagcaaaagaauauuucuucucaguaccucaugguacgcaugcuuuuauuugacacuauugccuagauaaugcaguacaauuagacaagaggucaugcaugcuauaaaaaugauuuaaguacacagguuacacagagacuaugccacuguacaacaggcuucugaauauccugggcucaaaacuaaucccccauaguuacugaggaauggcuauacuguaauggcagcacagguuaacacagccauuugcacacugaauaaaaauauaaacaaaaaccuaccuuuggccauacucucacugugcuuaccacaggcacugauugaaugggugauaaccaagccccuuacccugugggcaccaccuugaaagguacauguaagacaagcauccuauccugcaucuagcugcagucaaggccauggcacccauccaacaaauccaggaggagggaauagugugugccuuauguaaaccugacagaaccucaaucaaggaaaugccuccauaagauccagcucuaaggcauuuuuguagggaagaccugcaucugcacauauuguaucaaauggcuauguaggugugccccagagcuaagugcuggcaagauauuugguauugccauuucuaugguccauuaccugcuuucuagaugaaaacgcauacuuauguauuaccugaccaaaagaugauucucuagaauuaucauguuaaauaucaagcugccaucacgaaggccaaguagcccucaaucccaaaaggcaauacagaaagauggauuaggcauuguccugcugcugaucggcacuaaguaaguaaggagugaggcuuuugcagaguaaagaacuggaggcuggagcugguacagaaaaaauguuaccuguuaaaaaaaauggacaccacuacagcagaggguaccugggccccauacaguuucauuuaguuaucaucauggagcuaauuauaauauggucaguaaugaucuucuacacccuaagaaggaucagaauaaagaagggaagagaaauuccuuauccuccucagaauucacaggauuagacuuagauagggagaggauugaaggccuaguagauacuggagcagauaaaacaauaacuucaccacuagggaggcagaggcaggcagauuucugaguucaaggccagccagaucuacaaagugaguuccagaacagccagggcuauaaagagaaacccugucucgaaaaaccaaaaaaacaaacaaacaaaaccaaaaccaaaacaacaacaacaacaaaaccaaaaaaacccccaauaacuucacaagauucuuaaacucuaaccuggucacucugaaagauaucuauauaucuccuagggauugggacacugucucagauaaaaccaacucuaaaauggacuaaauguauagguucaaaaaaccagauaagaauuaagacuauguguagcagauauugccaugaauuuauaggaaagagauaacagugggaaacacagauuuacacuccuucaacuucagagacaagcuguaaaaugggagaugcucccgaugaaggcacugaaaauugauacaaaaaaguuauagacuauccaggcuguccacuggcaggccacagcagguguuggcucuccaaauuuauaagaaagccacugcugauaagaguaccagccaggcagugguggcacaggccuuuaaucccagcacuugggaggcagaggcagguggauuucuaaguucaaggccagccuagucuacagagugaguuccaggauagccagggcuagacagaguaucaauugcccuaccauuaaaauggguaacaagccuauuugagcagagcagcgauccuuaaauaaggaaaagcuacaggcccuaaguccaagagcagcuggaggcucaacauauggaagaguccaccagcccuuagaauucuccuauauuuaucaauaaaaagaaaucuuaaaaacagaggcuguuaucugaccuaagaacuaucaauaagguaauucagccuaggguucuuuacaaugggauucuccuuaacuucuuaguuaccuaaagcauggccuuaguaggugaucaauuuaaaagauugcuuucucucaauauccccgcgauaggaaauagaacaacugcugucacugugcucacauuuaacaguaagaagccuauauaaagguaccaaugcaaaguuuugccacgaggaauguuaaacagcuccaccgugugugagcauuuuguacaacaguuguuaaaaaugauucacaaacaaguuuccucaaucuauaauuuaucauuguauaaaugauaucuuguuggcuaauuccauuauacacaccuuagggaaaaaaauguuuguugaaguaaaaacaauuuuccuuugcuggggauuauaaauugcuccugaaaaaaauacaaagaggagauucuaucaauuaucuagaauacaagaaaauuuaaccacagaaaguacagauccaaagaaaucaguuacaaacucuuauuaaugguuuucaaaaaaugcugggagauauuaauuggguauggcccacuaugggguuaacuacucaaagguucaguaauuuauuucaaacuuagaagcuaauuuggacuuaaauaguucaaggaaauuauuagcugaggccgagagagaauuggcuuaugguagaaaagagacuacaggaugcauauguggaucacaugggucccaagcuugauuguauucuucucauucccccacaagaauucuucugcagaaagacaauacuauuuuagaauggguauguuuagcacauaaacagaguaaaacauuaaaaaccuauuguggugguuuguauaugguuggcccauggaaguggcacaauuagauaugagcuuguuaggguagguguggccuugcuggaggaaguccaucacuguguggguggguuuugagggcuuaugcucaagcucuacccaguguggaagagagccuccuuuugccuggcuucagaucaagauguacaacucucagcuccuccagcacuaugacugucugccugcugcuaugcuuccugccauuaugacaauggacugaaccucugaaacuguaagccacuuaaauauuguccuuuauaugaguugccuugcucaugaugucucuugacagcaaagcccuaagagaccuauauaaaaaagguuucugauuuaauugugaaaaguaaggcuuugucaauuaucaggaacagacccagcagagauuauagugccuuauacuaaugcugaaauuuccucauuuaaucagugaagauugcaaagagccugcucuaauuucuggggagaaauuaacaacaauacccuucaaaacaaaugacuucaguuuauaaaaagaacuaguuguauucuacaggucaagcaauuguuaaaagaucuaauggcacuuuaaaaagaugcucauaagcaggagaaucugagaucucccagagauaagaguacacaaugcuuuauuaacuuuaguuauuaagacauccgugaggcaggcagcacagcugcuaaacacacuggauuuuagaaaggacugcugaauauguucaccucagaauggaaaucaagaaauguguugcacuggggaagaggcuacaucuuuauuuccacaggagacaaaauguuguggauuuugggaaaaugggaaaaucuuggcugcugacacagaagguacaaguaagaggcacagagaaaaaaacaaagcagacaauauaaaugcugaucuuccuaaguaggaacagcucagagaccgaggagacauggauguaucuauuagccaugacuuuguauuacaugccaucaauuuauaacacccuauuauaguuugguuagugucuuacugcugugagcagacaccgugaccaaggcaacucuuauaaagacaacauuuaauuggggcuggcuuacaguucagagguucaguucauuaucaucaaggcuggagcaggagaagcugagggaucuucaucuuguucaggagacaaacaggagaagauggcuuccagacagcuaagaugagaaucuuaaagcccacgccuacagugacacaucuacuccaacagggccacacuucuugauagugccacucccugggccaaacacauacaaaucauccaggagcccaaacugacuuacagaugccuuucaccugcucaggcccagagcagagaaucauuaccugaucugugcacaccacacauuccauacauguguuaauauaaaaacguacauacaauguuacuuuuauaagcuaugugcuuucagagcaaaaucaccaggcaccagugaaguuaaaguagcccaacaugauucguccgaggaugcugagacagaugcugaaaugcugagacauguaacuguuccagcauccugccagguucuaguguuucuucaacuuucguauucaggacaacuucaaaguggccagcccuggauaguacagccuaacacacugcuucagcccugaacuuuuccagcggcagaugauccuuacagaaccugaacagcaaaugcaacaguccacucuucaggucuuggccagcauuccaauuuccuuuggguugcccccagccaguaagaagcaaucuaaagaacacaaccuucauuccuaggugguuauugguuguucagugguuuaugggggugaaagggaaagaagaguagauuauuguaucuccuauuaaacuaaaaaggcauuaauaaagccgggugugguggcgcacgccuuuaaucccagcacucgggaggcagaggcgggcggcuuucugaguucgaggccagccuggucuacaaagugaguuccaggacagccagggcuauacagagaaacccugucucgaaaaacaaacaaacaaacaaacaaacaaaaaaacaaaaaggcaucaauaaaucaaauauuuuagauuuuuuuagcuaccacauacuguauauaagauucaacucuuguuguuuaggauuuaugugcauauaacuucagcaugcaacucauuuaaaaaugcaaaauucuaaucuuaaaaaguacuguuauaaacuguuaaggaucauuuaaaaaauaguaaccuauaaauaaucaaauucuuugaugcauucagaaccauacuuguagucauguuagguacgaguguaguuaauuucagguauaagccuuaugaagcuuccuguuacauuucaaaacaaucaacuagaaacaaguaaaguuuguuuauuuagauauacuuuagguagacagaugauccuccaaugcuuaagaaaucugcagaauaugucauuuuagaugcuuuaauaaaaaaggcuuuuugugacagugagacagaucagcuccuggcagugccccuaaucuccuccucugaagaugaugggcacagaagaaacuccacugggagcuuacuucaaacgugacaaagcuaaccauugacuauuugcugacaacacgcuguccaaaugauggacaaguacaacacaugggaguugauugucccacuuugccuagacaagguggacagucccucuaaguuccugcuucacaggaaagucugucaagucuucugagacugguggcccaaagauggguaccccacugaccaaagaggagccuugugacuguccagguagccaguaaggcucugucaucuuauagaccauuggcugcuuggucugcacuccugguuacucaggugaaacccugauguauuugaagaugagauuagugaaagauuuaucagugaacagcagaaaccaaggcuuaaguucccuucagguauaaaaaucaggccucagguuauacuguccuaguacauccuugucuuacaguuuuccuuguuacuagauucagaaagagaaacucacaaaagagguguaaaguuuaugaaaguugaaagacauaaaagcuuaaguugugaaggcucuaagaaaauguuugggucuaagaagguguuuuaagguucauaaaugcaaguuagaaagguuggaggaugugaaaacuuaaauugugauuuaaaaacaauuauuuaaggggcuggagagauggcuuggcucagcauuaagugcacuggcugcucuuccaaagguccugaguucaauucccagcaaucacauggugacucacaaccauuuauaaugggaucugaugcccucuucugguccgucugaaaauagcuacaguguacucauacacaaaauaaagaaucuuugaaaaaaaaauacacuucagguuucuuucccuugcucauuugagacaaacccucuacagaacuuuagacucaagauaggacaaauggacuggacacugugaauauaauucuaacaguaauaguuugcacaauuguccuuacuguauauaguuacugauguuggagagaaaggcauuccuuggacuaaaaggggaagauguugggauaacccacacauacuguaucaaguggucauguagguugucucugcauucucacuuguucauugcugugccacuggugccagccuaacagcauauauaaauguuugcugcuuccucaccugcccaaaaaagcaagcugucuugggggaaguuacauaauccuuauaugucaaaaggaacacccagagauggacagauguuguccugcugcugauugguucagaccaaaugugacguuuugcauaauaaagagcuggcagcuagagcugggaaugaacaaccaggcagagaggaagugggacagcagcagaauggaaguagggcagagaaguagaacaggagagccacacagagagacaccguggcaggggagucaguugaauuagaugggcuagcuaagggacugccccagcaaacuggccaaucacaguauacuacacagauaucugugucuuuauuauugaaccccaaguuggacccccccaagccucacaauaaaaaauaaagugaaacaauuuacauaaacucuuuuuuaaaaaaggccuaaggacaaaauguagcaaauucugagaacuccaccugcuguucagugacaagguaacuguaacaacuacagcauuccuaagaauaggaacccaaaauauacaaagcagcaguugagaaggaagaacaggugaauccaggaugucaagguagggagggucaacaguacaaguccauagugaauacaguacgguuaaaaaaacaaaaaaaacaaaacccaaaaagccaaaugaaccccgauuacacagaaagaacgguuaccgucugcucuuagcccagauccuagucaccuaaaggauuucuauauaccauuagcaaaaaaaaaaaaaaaaaaaaaaaaaaaaaaaaagacauguaugaaucuaggauaaucauagaacuuaaugguucuaaauaacuccccaaaccucuagguuccaagauuuuauacuauuaagaguaggcauaauguuauugugcucuauuaaacauuaucuauguauaauucaaaugcugauuucugugcuccuguaucugguugcaauccuuauucuaaguaucuccuuccucuguaucuuauuuucugauuugucaauaaaagcugauuagccagugacugaguaggagagagaaggaagggaagggagaaaagagagaggaaguggagaguccaggagacuuaaugagaaaaaaccuggagcccagagaaccagaucaguacuaaaaugcaaguacucagggauuuuggcugggagguagccagauuaguuuagaagauuauaauaaguaauacugcucaguuguugugcccucagaacuugcuaaauaaaugggagcuagcuggguuaagaggaaaacugcaacaaagacuaaaaagcaauuaacaaugaagacuauuuuauuaacaccaugaguuaaggacauggcuaaguuagauacagugcuuccggaaguccgcagaccuaaguucagauugccauagucacauaaaaagucuugcucaguggguacauacaguacuagagauggagacaggggcagcccagggcuaugcuggcuggccggucuagccaaaagguuagcuccagauucacugagaaacugucucauaauaaaagaugcagaaccacagagguagacaccuaagcugcaacucuggccucacacauaaaugaacauguaaacacgaaaaugauacacauacacuaagacacagacugacagacagaagugccaggggcugcaaaaaaagcugaagccauuccugaagauuaagugaaggguuugcccugugugucacacaucaaaacacacuaaagggacaguaaguagcuuggcugguuaucagcaagacacacaaaugacucaaaaaaaaaaaaaaaaaaaaaaaagaaggcaggagcagcagggcggaaaagcuaaccauuugcagguggugcuggaccaucacagccaccuguaaaacugaacucagcuucacacugagaaacagacagacagacagacagacacauggagaccacaggcaccucaccucaaaaauggaguacuuccugaacaaggccauucagaaagcuaagccauagcugggaacuaggacaguggugagcaccaauuaaagaguauuccuccaaagcaacaagucaggaaaagaaaagacaauccgggucaaaauggguaacucacacacaaaaagaaagcuaagcagcagaacaagcaaauaguacaaaguucaaccaaacaauccuacuaauaucuaaauaccugaccuacuuguuuuagugaguauaauucaauaaaaccauuuugaaaggccaccugguauaauccuacugucaccuccaauguuacuucuagaguucacaugaacauguauuguaucagucacaacagaacaaacaugaaacagaaaaacacaaacacacacacacacacacacaaaaugaaugagaaaaaccagccacaaccuaaucguccauuugcugucugcuugaagaauggaaccccauaauucggaguaaaucaaacugucugcaacaacuuggaugaaucuguccagguguuuaccaacagaagacacacccacaccacacggaaaaugaauauaacguggaaaccuguugccguauuaaauucaaaugaggcaaaccccaaauacucgugugugcuaggaaugcacacacgauugauaacccugccaaaauaaaaccaaaaaaaaaaaaaaaaagccuccugcaggaaagaggaauggaggugcuuuggagggaccagccuuguuuucauguguggagauaacaggagucauuuagcuagcucucaguauuuuuuaaaccgaauaaauaugcaguuuuguguauaugguauagugcagcaauaaaaauuaaugauauaaaaauaauacaauaacuggaaauguuuaaaaacuaagguaacucgguguuuuuagcugcuaucagauguaguggcccagaccuccagagauugagacuggaggauaccaaguaugagaucaaccugggcuacacagugaaacuauacauauauuauuugcguauguauuugcaaagcauaguauaaguuagagagaugcaauguggaacaagaguacacugaaaagaagccacagaauagccgggcgugguggcgcacgccuuuaaucccaggaggcagaggcaggcggauuucugaguucaaggccagccuggucuacaaugugaguuccaggacagccagagcuauacagagaaacccugucucaaaaaacaaaaacaaaacaaaacgccacagaauagagaugaacgcaagccgacugauauuugguaaggcaaaagcaacaaaauuaaggucagcagucacauggaaaguugcacuaacagccccgaaccaagaguagcuucggagcugaagcauccagcacugcggaaggggcgggccuggcuguuguggccauggccccacgacccccgaacgcgacagcgcccagcggcuggaaguacuaagguguaggggcuaacggcgccaaaacggagcugcgcgcggccggcgggagaagggcaaggugcggcgccggagccggcgggaggcaggagcggugcuccggccggagagaggcuggcccgcguccucaccucguccacggugcggcgcgggagaugcagcgucccgagcaguagcuugagcuucacggccgaggagaggcgguggaagcagaggcggauguuaucgaugaccgcggcggugagcagggacgcgaugcuggguggcgcccacagcucguccguggcgcccagcuuguugugcagccacaggccggugucacucucccucauggaagccaucuuggcggcggcagcgcgcgucggccggcaucuuacgcggacgccuacguguccccggcgaggacccccaacauggcggcacccguuggcgcggggcggggucucgagugcaacugcaaauggccccgccuucuggaggcuucgagccgaggcgcaagaacagggagugggcggugagu

SEQ ID NO: 2416 - RNA, 1428 nt, Mus musculus
uauuaccaauggauuuuaaguaaugaggcaggugcuaguaccaguuugucagccuuugcacugcugacuggaaccuuucaugagauauugaauguuucugccacacuuuccaguaucucuacucauuuggauaaugugacaucuaauagaguuaucagaaauaugacuacuucuccaguagaagucugugucaauccuccauuuuucuuuauauuggcugaauuucaaaauaauacagaaugguuaaauuguacaaaugucacuuguuuuuugacacaaugcuggaauggaacuaauuucuuagccuuagugguacauuuaccaaccuuugucccugugccuguugaggcagauccagagaaguucccaaucaugagucuuguccggcagaagagagauuacagccauugugguggcaaucuccauuagugugguugcugcaacagcugcugggguugccauggcaaccacaguccaaacaggcacagcccuaagucaauugucauccacaguggcagaugcuguuaaucuucauaccucugcuagugcccaguugaagggcuugaagggcggauuaaugguugcuaaccaacgccucgaucuuguagaggaaagauuggauauucucuuucaaauggcccaauugggaugugaaagaaaauugggggugcuuugcauuaccagugugcaguaugaaauuuuuacccaagcagcaaauuugucuaggugauugucauuguaucuugcaggaaauuggucagaaggauuugacgagacucucgaguccuugagggcagcaguguuggcuaucaauucaaguggaccugucgcuaacagagggacucuccuccuggauuucuucagccuuuucuuauuuuaaagagugggugggaguuguuuuguuuggcgcagccuuauguuguggccuaguguucaugcuuugguuggucugcaagcucagaucucaacagaaacgugacaaggucgugaucacucaagcacuuguggccauugaacaaggggccuccccugaaauuuggcuauccaugcuuaagacuuaauuggcaucugaguucucugcucuugcaccccacagaucugcggauccauugcacugggaugagagagacucaaugaucauuaucagcccuugcacaucacugagguuucuucauugcacgcaacagggugaucaugauuucuccgcuaaaauuuuuccuuaaaaccuggcuggcgggcuggugagauggcucaguggguaagagcacccaacugcucuuccgaagguccagaguucaagucccagcaaccacaugguggcucacaaccauccguaacgagauuugauucccuuuucuggagugucugaagacagcuacaauguacuuacauauaauaaauaaauaaaucuuaaaaaaaaaagaaaac

SEQ ID NO: 2417 - RNA, 4736 nt, Mus musculus
cucucggggaaggauucagaacugcaggacgaagguaagcucugagaggaauguuuggccuugauuucucucaucucucuccucaauuggaaggugcgguggaagccuuuguucuccuuuugguuucauuuugcacucacuggggguggugcugauuuucgaccgccucuagguacagucagauggacguacauaagcugaggugucucuccuauauuuaagccucuccuguagauaaaggagcaguaugggaaccucacauucagugaucacagcacugcagucuaucuuaaagcagcgugaaauuaaagucuccgugaaaaccuuggaauccuuuguuaaggagauagaucgcauagcaccuugguaugcaugcucuagaucauuaacccucgauucaugggagaaguugaggggagauuuggcuagagagcaacagaaugggaaacugaaagcaggaacuaugccgcuuuggaaacuuauuaaaucaugcuuggaagaugagaagugccgcccagcgguaaaggcaggacagggagugcuggaggagguuaaggacaucacagcagaaacagagcgggguaaaagauuaagagcucaaagaaaaaaggguauaccuaaaaaaaaaaaaaaaaaaaaaaaaaaaaaaaaaaaaaaaaaggaccuuggauccgagaaagugagagaauggggaaaggacgcccagggagagaagagagaagagaggaaaaagaggcccccaaaaaagaagaguauccaguaaaagaacuugaggcucugggacucgauagcucagauucagauacugggcucagucccucagaagaggaagaauuagaggaggaggcagcucgcuaugagaaggagagguaccauccagaugaaaguacagugagaggguucuuaaauagacucgcuccuugguuugcccccacugggucacugacacuaccuaguugggaaaaguuaaggagaaagauuuuuaaaaaaagaaagaaaaaagaaaauaagcuauuucagagcucuccuagggacagaaggaaaacgggagacguccugcuuccucucuggcuccuauggagauauucuuagcucugguuaggauaucugggucccuuugagacaccaaguuauauucccugucugucuauuaucuguuuuuggugcaccaaauuguccauaugucugucaauucauguuuguuuuuguuuuguuguuugaaugauuguuguucuguguuucauguugaaaaauauaauugguuaaaacuuuaucugcuggcuguccauccuuuaacuuguuuaaaaggcagucucaauuuacacagcagaaagugauauaagcacuguggcugggagucagguacagcugaaaaagcccugcugagggccgauugcaaauggagcuuuuaaaggggcaggcagccuuuugcuuguaacagaaaguuagcuuaaaauugggaacucaggguuggagucauucuaaacaacaugaacaaacacaagaaaacaggucaugugcauaagcaguguacaaaggauggaaagaauagguuuaaaaaagaaauuaccagguauuugcucaaaaugugggaaaagaagacauuggguaaaugaaugcagaucaaccagaguuguaacaggaaggccaauaccucaguucaaagugcaacagccaaaaaacccaaauguauggggcacuucagaccacaguguccaugaggccacccaaagaccaaggagagccacucuagguucagcaggauuggacaucugugccaacuccagaguaauucuuacaccacaaauggggugccaaccuauucccucagauuuuagaggucccuuaccaaaggauacagugggccuacuaguaguuggguagguccucuucugcuuugaaaggauugguaauacaucccagaguuauagacucagauuaugagggacaaguuaaaauuauguguucugcaccccgagguauuguggccauuucuccuagagaucgcauugcucaauuguugguucuuccuagcuugcauaagaaggaaggacagggcuuuuucaacuuuauacugacuaaugauuacucucagaaaagcaaggaaaugauaaaaggaaugggauauauaccuggacuaggucuuagaaacaauuuacaagguagaguuucuccaguuaaagccacagaaaaagcagauagaaaagggcugaguuuuuucuaggggccacugaggagccuuugcccauuccguggcgugccucagugaccuuuacccucugagaaguuaaaagcagcuaaagaauuaguacaagaacaauuagaccugggacauguggaacccacgcaaucacccuggaauaccucuauuuuuguuguaaaaaagaagucagguaaauggagauuguuacaugaccuaagagccauuaaugcacaaaugcaaguuauggguccuguacaaagaggacucccccuacucucagcucuaccuaaggauuggagaauuauagugguggauauugaggauuguuucuuuuccauuccauuaagugggaaagaugaaccuagauuugcauuuaccuugccuucuauuaaucauacggagccugaugaaggguaucaaugguggguauugccccagggaaugguggguggcccugcaauaugucaguuauaugugggaaaggcuuugcagccaguuagagaugguuucuccucuuuaaagguaugucacuauaugaaugauacuguaauuuguggaccuaaagaagaaaguauacagcaagcuuauggcuugcuuaaugaaacuuaaaaaaaaaauggcuugauuauugcaccagaaaaaguacagcagucuaauguucaucauuuuuuaggagccacuauuacuucacgauguguuuccccacaaaacauuaguauaagaaaagaucauuuaaagacauugaaugauuuucaaaaauuauuaagagauauaaauuggauuagaccuuauuaaaggaucccuacuucagaauuaaaaccuuuauuucaaauuuuagaagaaucacauauuaccucauugagacaacuaacaccugaggcuucugaaacucuuaggaagguagaaacagcuauccaaaaggcacaguugaauuguauaaaugagcccauauacugcugcacaaaugcaaauauugugugcuacuauagaugaaugggccauucuuagaugugcuuauucugguuuaauuaauaaucauuauccuaaacauccuuuauuacauuuuaugcuauugcauccagugaucuuuccaaaggugaccgcuaauaccccuauaaagagagcuacugauauuuauacagauggauccaaaacaggaauuggaaguuaugugauuaauggaaaagcugugagguugcaauuuacaccaggagccccucaauugguggaaaguuuuuaaaagguuccuuaugcccauaaauauuaucucugauucuguuuauguaguuaaugcuguauuaguauuagagacugccagaaauuuuaagcagucuaguucaguaucuaaaauuuugaugaaaauacaagauuguauuuugaugcgugagcaucccuuuuauauucaacauauuagaacacauacaucuuuaccuaaaccuaugguuaagggaaaugcaauugcugauucagccaccagagauaugguuuuccuaucacaaaguucuauagaaggugcuaaaauuuuucaucaacuuuaucauguucaugauucuaaacugcgacagaaguuuaagcucacacaaacagaagcucaagauauuguccuacagugugguaaauguguagaauuuauuaaugcaccuuccaugggcauuaauccucacagaaugugacccccuagauguuuggcagauggaugugacgcauaucccagcuuuugguaaauuacaguauguacauguauccaucgauaccagcucugauguccuauaugccucucccuugacaggggaaaaaagcaguucaugucauaucccacugcuuagaggcuugggcugcauggggcaagccccuagugcuaaagacagauaaugguccugcauauaccucuucuaaauuuagucaauuuugcaaacaaaugcaagugaaacauauuacuggauugcccuauaauccacagggccaagacaucacugaaagagcucaucguacuuugaaacaauauuugcaaaaacaaagagggggaauagaggcuaugauaccaaagauggcucuaucccuuacaauauuuacucuuaauuucuuaaaauuggaugaugcugggagaucaccagcugaaaggcacggacaauggccucaaucgcccaaugaaauggucaaauggaaaaauguccuugauaauaaaugguauggcccggguccuaucuuaaucagauccuggggagcuauuuguguuuuuccacagggugaagaaaauccacuuuggguccugacgcgacugacaaggaccgugaaagagcaagaugaaccccaagaugaucuucuuacuccugaugauugagaccgggauaaguauacccuugugggccauagcaagaucauggccaguaccuuuaccaguacauuccaauucuucuaccuagccuuuguuuuuugcaaaggaauguuuuuuggaugugccuugugcacgauaaacuccucaagagccacggguauauaagaguacuaguuuucauuuaaauuauacacuaug

SEQ ID NO: 2418 - RNA, 5581 nt, Mus musculus
cuuuuuuuuuuuuuaaagaauuauuuauuuuauauaugugaguacacuguagcugucuucagacacaccagaagagggcaucagauuccauuacagaugguugugagccaccauaugguugcugggauuugaacucaggaccuucgaaagagcagucggugcucuuaacugcugagccaucucuccagcacccauuugaaacuuuuaagcccauagucuugguauuuggaggagggguggggaaguccugggaccagggaaaagaccucacccucaggaauaggcagguggaagggaaacaggcuguugauugacaguacuuagcuggaguccacuugaccugugggagauggauuugaguggguucccugaagcuuacaagaaucuuuuaaauucauaaaaagacaaauccuuuaaacuugcauuuaccaacaaucaaaacaccauccuagacaacccccuccccccaacaaaucucauuccucccuuauuauccuaacacuuuccuaucacaguccagguuuguuuguuucucucacauccuuuacccucagaacuuggauuuaccaaccccagaacaccuuccuggaccacaaacacuucuuauaagcuuccauauccucagaccauacaggacccacacagugagagagccgacuuagacaagccucccucugacugcuacaaguacucugugguacauguauaugcacucaguaaguaaauaagucaggugauguggcacauuucucuaaucccagcacuugggagguaaaggcaggcagaaguuugaggccagcauggucuacaaauugaguuccagacuacaugaaaucuccaacaaagccucaacaaaguaaaauaaaauaauguguaaaauuucaaauauuccagggcuggagagauggcucagugguuaagagcacugacugcucuuccagaggcccugaguucaauucccagcaaccacacgguggcucacaaccaucuguaaugggaucugaugucaugucugaagacagcaacaauguacucacacauaaaauaaauaaaaaaucuuuuaaaaaaauuucaaauauuccaagaauucaggaagcugagacaagagaucucggguuagagaccaaccuguucuauguuacaaacccuaucucuaaaaaccaaagagauuacaaauauaaaacccacaauggguaugguggcacauaccuuuaauagcacuugggaggcaaaggcaggcccgugucugagcuggaggucagcuugguuccaggacagcugggcguaaacagagaaacacugucuugaaaaaaaaaaccaaaagccccuucccauuaaaaaaaaaaaaaaaaaucccuuuucuuagacuagaagaacaaaugacuaaucuuuuucuuuucuuuucuuuuuuuuuuuuuuuucuuuuuugguuuuucaagacaggguuucucuguauagcccuggcuguccuggaacucacucuguagaucaggcuggccccaaauuucagaaaucugccugucucugccucccaagugcugggauuaaaggcgugugccaccacgcccggcucaaauuacuaaucuuauuguauuuuuaaauuuggucacuuuaacuaggauuuugauuagacucguauggccugcuuauaaacugaaauuuccuuagacauuuugagcugcauuucgacauguagaaucaguugccugccuguuaaaccugagaaucaagcuguauuuuggagugugaagggucauuagcccacucaaguggguggcucugccagccuuguccuucuccagccucucugccuugcuaauaagcauuagauuacauuccuaaagguagcccccaagguccauucccuuauuugguuacuuucuccucuugaggcugauuacgaagauagagcuauaaaaauacugaaguccaguaaucaaaagccccauuuggcucaccuaauuaacauuuccaauuaaaauauacuaccacauccuagcccauucuaacauagauuucccccuuuuuucccacaucuuaaaaaauuacaccuauagggcuggagagauaccucaguaguuaagagcacggacugcucuucuggagguccugaguucaauucccagcaaccucaugguggcucacaaccaucuguaauaggaucagaugcccucuucugguguaucuaaagacagcuacaauguacucaucauauauauaaaauaaauaaaaucuuuuaaaaaauuacaucugggggcuggagagauggcuuagcaguuaagagcacugacuguucuuccgaagguccugaguucaaaucccagcaaccacaugguggcucacaaccauaaugagaucugacucccucuucuggagugucugaagacagcuacaguguacuuacauauaaaauuaaaaauuuaaaauuuaaaauuacaccuauaaggccacuuacuucuguuuuucauccuaagucagaaagcagucccuuuaacuuuucuuccccacuuaauaaagggucuuucuuugaaaacaaguguuugggugugguuugugcugccugaacaagguaaaaagagaaccccugcucuucuggguauuccuucaaggugugccagggacuggcaagccagcuguugcaggauuugagaaagcagccucugcuggccucuugaaugucccuuuaugggagagauacgguguucagaggcaagagaguugacuguuaaacccuguuagauacaaugagaguuggaaagauuugaacugacugcucacaacuguaauuccagcuccagggauuccaacauccucaaacagagggaugaaagaccuuuaaagggaagaagaaggguaaggauauacaucauaugaaugagguugcaagcaguucagagcagaucuaaaacaggaacuuaguaauuacaaauagaaacaaauagaaaccuuaauuugcaaggauguaacacagaacaaacaggaacuuauuaaauacaaacagaaaccuuaacuugcauaggacaaacagaaacuuacuaauuacaaauagaaacuuuaacuugcaaggacuuaacuuaggacaaauaaacuuuuuuggugguuuguuuguuuuuugagacaggguuucucuguuauagcccuggcuguccuggaacucacuuuguagaccaggcuggccuggaacucagaaaucugucugccucugccuccugagugcugggauuaaaggcgccaccacugcucgcuuuuuuugguguuuuuugagucaguguuucuguauagccuugacuguccuggaacuagccuaucaggcuagccucagacuuagagaucugccugccucugccuccugaguuuaaucucugcugggauuaaaggugugggccacuacuuccuggcaagaaauauuuaacuguuuaacugcaaacagaaccuuuaaccuauaaggguauauauuccuguuuuggucucaccugauuuaaguauucaaaaaauuauaagaaauaccuacauuuuucuuacaaauguaaguucucuuuauuccuauuuauaacauuuggaaagcaugcccaaaacaucaaaacacauuuuacacuggagucagguauguauuuaucauacacacuuuauccuaaguucucuuauaauuccauaaaacgucagagauuguaauauggaaaauauuaacggucggguuuugaucugcuucgccauguuaaucaaucuuccaggaucuauauccccacagaagcaauucaaccacauuuaggauaaccuucaaaucaucugcucaaguagucugaggguccucaucuauuucuuucuaguugcuauuuaucuauggauagaucauuuuccaguugcuaaacccaucccuccaccuagcccaggagcagcaggacuuguauuaccuguuagcacucacauucuuauuaaccggcagaaguagguaaaauggauaaccuguaauaggugugaauggacugagacuugccuaaaguuauuauacugguuuucagauucagguaagagagauucuguaacaugagauguccuaagacccaauuccaggcccuggucuugcccgaggccguucuuugcauuccaugggacuuguguucugaguccugccuuucucgccucugccccgacacacuugggcagcuaacccgcagacuccugggcaugcccagcucuaccuucccccgccuuuagcacacacaaugucuaacuggacguucucuuucgucuaguccucaagcuuccuccagguaggccucccaaacguauaggugagcccccuguccagaugaugggauuccugcgagggagaguccggggaccgacaugccuaagagccuggcacuuauggugcgaaucccggccugguugccuguggaucagcagaaaauuggggccuugggcgagucucugguacgccucauuaacgaccgaggagacggagaaggguacggauuaugguuuagggcuagaugcagccguaagggccaccguauaccaggucagaagccaaacgaaaagucaaacacccagcgggcaagcucgcgacgcgccucagcaacgacaccgccaaguucucgugggaggagcgcgacuggcggcacucucgcgggaaguggaagcucccgcaagcaggcggggggcgugaccggaagaagguguauuucaaagugguaauagaugguuuucucacccaauaaaauugcaauuuauccuccuaaaccgguagagcacgggagaaaaggcgggagaggccaauaagggcugagaagggcgggccggugccggacgagcggaagugggucuucgugaggcgguggaggcuugcuugaacgggucuccucagcggcggcuggagucgguacguccuugcccgagcucaucagccgaggcgucuggcagcaaaccccagcuccaaguaaggcugggcuccgcagcauggaagcggcggggcagggcggugcgggcguggagcgcgggcggccucucggcccgcacugggguugguggccgcccgccucucgcagaaccgcgcuucuccggcuugggcccucugccgccucuuucccggagagcacgcgguugucggaacauggagcggcgccgucgucggaaguagggaaaugucuuguguggggguauccgcucgccaacccgcggccuggccggagaaccucuuucgccaaguaggaagggaaacugaggcucggcgaggguugggggucgcccaaggucacucucggggccgggcgggcggauugcagagaaccugagcgagguuuuuguuccuugcugaugacgcagccuuuguguggucgcgucgccgccccgccuuccggaggccugcgaguuugcuggggcacccgggccgcguggcgggccguaucuaaguugcgagagugccgaggacgcuugcgggcuuuggagcugaaugggguuugggcuuccaggagccacuuuugguucuaucuaugguuagucaagcgggcgauugcgaccuccauccuuagcccggugccugcucgggcccuucccucagggccacaucuguacacaggga

SEQ ID NO: 2419 - RNA, 2582 nt, Mus musculus
aguucuauucccagggauacugauguuauuuccugguugcagaaauggcuagagaggcccagcauugggcuugccucccacacacugccuuucugggccucuacuucuggagccaagccaccugccaagaggaaccgagaaucuccagcuguagcaucagcaggaacuguuaacacuauaauggcaaagggaaagccugggugccccaacagcaauaccauauuggggcccagagccacugagaacucagcccccagcucuugaguacuuaggguguguucaggccaguucgucgucauaugguguucacugccaggaaugagcuuucuguuccccuagaaaccucaaguugcuuuggcucugucaucaagggugcauaacuugccgguuugaggaacaacaacaacaaccucaaaaaaaaacaaacaaaaaaaaaaccacagaagccagugaagccucuggucccaguugauggagaggggagaguagguggugagggaguucugagagcagcccuuuccacgucuguagaggcugccaggauauuugcaguuuagcaguguucauucugcuucuagguggggaaccaaagcccaaagugaucauuggcggagggagacugaagacuuccugccagagccugugggcaggcuccagggaagcuucauguuugacuauuuccauuacucaauaugagccugaaaggaaguaagggaacagcuggaaagaagcauuaacuggaaauuuuuuucacugaacuuuauauacugucuuaguuacuuuucuaguauuugauaagacaccaugaccaaggcaaacuuauagaaaaacuuguuuaauuuggggcucacaguuucagaggguuagagucuaugacuaucauggcggggagcauaguagugauagauaggagauggcacuagaguugaaaagacacuaggaauggugcuagucuuuuaaaaccucaaagcccaccccaccccccaccucaccccacccugugauaccuauccaaaaggccgugccuccuaacccuccagggagaguuccaccagcuggggaccaaguaaguauuuaaacaugaaccuacuggggaguuauuccucaaaccacugaagagucaagcaccaaaacaaagugaccagcagggaucacuucugauaccacuaaauccauccuccuuuuuguaacuaaugagcaggugugagcaaggcuuauauuuggauagcaaguaucaucuguacgucauggcuugaggugcugcacucugaaugcaucucugacuagcaggauuacuguugacuugaggucuuuuaguuuaaauagaguuuccugcucucuaagggauucucuggcaagcacauaacggaccccaaauccacauagcaacaaguccucugguuccuucacaaaacaacagcaaauuuuguuuucuaaaagguuuuauuuuguuuuguuuuguuuuuuuccaacggggggggggggggacauuuacguuaguagcaacagcgacucuaucagccuacaaggguuuuuauuguucuuuugcuuguuuuaagauugaauacauuccuguccccuggguugaauagcucuuggguuggcaccauguuuugacaacaugccuggaagaauauuugugacaaugagaagcagaaguagucaugcauaaaauuugucugucuuaaacaugaagcuuuguaaguuguccccagauguuaacugaaaaugccuuagugucagugcagucccagacuagcauuauucuggauccaccuccaugauaaaagugguauuaguucagagaugaaugagaauuuuggccacuugacuaugcaugcucauauauacgcugaacagggccucaagagggggccagcuugcagagaauccugccaaacaguguuuucauauuggcagcacauguuagaagacuaggaaaccuggugagcucuuggaggguauaguuucugcaugaagacaguuuccagaucuuaguacuguacaaagccaacuuggaauccauggcuggggguguggggagagcuacuguggcugagguucuagagacgagacaagcuaagagccaccaaagccuucggcugucauguuucaugaguccaggcacugggucaccagaaaacagcaaggcuuucucagcauuucuuguaggcugaguaggaagacacuacaaugagaugucucauguguaaugguguauggaagacugaugacaaggacgcaguaaacaaguucccagucaagccacuaggagcaagucagugcagucaggcaggggaguuguuggcuugucaggauuguuuguccggugcccauguuugggugcacagcaaaucaucccuucacuuuggcuacuugacuaguaaacacagguugcuuucuggcacuggccauuguuguuuugguuuugguuuuucaagacagaauuucucuauguagcccuggcugucccggaacuagcucuguaaaccaggcuggccuccaccuuucagaguucugcugccucuguuagauuuaaaaguaugcuuugcuuuuagagacuagucaaggcaccauggcua

SEQ ID NO: 2420 - RNA, 2582 nt, Mus musculus
uagccauggugccuugacuagucucuaaaagcaaagcauacuuuuaaaucuaacagaggcagcagaacucugaaagguggaggccagccugguuuacagagcuaguuccgggacagccagggcuacauagagaaauucugucuugaaaaaccaaaaccaaaacaacaauggccagugccagaaagcaaccuguguuuacuagucaaguagccaaagugaagggaugauuugcugugcacccaaacaugggcaccggacaaacaauccugacaagccaacaacuccccugccugacugcacugacuugcuccuaguggcuugacugggaacuuguuuacugcguccuugucaucagucuuccauacaccauuacacaugagacaucucauuguagugucuuccuacucagccuacaagaaaugcugagaaagccuugcuguuuucuggugacccagugccuggacucaugaaacaugacagccgaaggcuuugguggcucuuagcuugucucgucucuagaaccucagccacaguagcucuccccacacccccagccauggauuccaaguuggcuuuguacaguacuaagaucuggaaacugucuucaugcagaaacuauacccuccaagagcucaccagguuuccuagucuucuaacaugugcugccaauaugaaaacacuguuuggcaggauucucugcaagcuggcccccucuugaggcccuguucagcguauauaugagcaugcauagucaaguggccaaaauucucauucaucucugaacuaauaccacuuuuaucauggagguggauccagaauaaugcuagucugggacugcacugacacuaaggcauuuucaguuaacaucuggggacaacuuacaaagcuucauguuuaagacagacaaauuuuaugcaugacuacuucugcuucucauugucacaaauauucuuccaggcauguugucaaaacauggugccaacccaagagcuauucaacccaggggacaggaauguauucaaucuuaaaacaagcaaaagaacaauaaaaacccuuguaggcugauagagucgcuguugcuacuaacguaaauguccccccccccccccguuggaaaaaaacaaaacaaaacaaaauaaaaccuuuuagaaaacaaaauuugcuguuguuuugugaaggaaccagaggacuuguugcuauguggauuugggguccguuaugugcuugccagagaaucccuuagagagcaggaaacucuauuuaaacuaaaagaccucaagucaacaguaauccugcuagucagagaugcauucagagugcagcaccucaagccaugacguacagaugauacuugcuauccaaauauaagccuugcucacaccugcucauuaguuacaaaaaggaggauggauuuagugguaucagaagugaucccugcuggucacuuuguuuuggugcuugacucuucagugguuugaggaauaacuccccaguagguucauguuuaaauacuuacuugguccccagcugguggaacucucccuggaggguuaggaggcacggccuuuuggauagguaucacaggguggggugaggugggggguggggugggcuuugagguuuuaaaagacuagcaccauuccuagugucuuuucaacucuagugccaucuccuaucuaucacuacuaugcuccccgccaugauagucauagacucuaacccucugaaacugugagccccaaauuaaacaaguuuuucuauaaguuugccuuggucauggugucuuaucaaauacuagaaaaguaacuaagacaguauauaaaguucagugaaaaaaauuuccaguuaaugcuucuuuccagcuguucccuuacuuccuuucaggcucauauugaguaauggaaauagucaaacaugaagcuucccuggagccugcccacaggcucuggcaggaagucuucagucucccuccgccaaugaucacuuugggcuuugguuccccaccuagaagcagaaugaacacugcuaaacugcaaauauccuggcagccucuacagacguggaaagggcugcucucagaacucccucaccaccuacucuccccucuccaucaacugggaccagaggcuucacuggcuucugugguuuuuuuuuuguuuguuuuuuuuugagguuguuguuguuguuccucaaaccggcaaguuaugcacccuugaugacagagccaaagcaacuugagguuucuaggggaacagaaagcucauuccuggcagugaacaccauaugacgacgaacuggccugaacacacccuaaguacucaagagcugggggcugaguucucaguggcucugggccccaauaugguauugcuguuggggcacccaggcuuucccuuugccauuauaguguuaacaguuccugcugaugcuacagcuggagauucucgguuccucuuggcagguggcuuggcuccagaaguagaggcccagaaaggcagugugugggaggcaagcccaaugcugggccucucuagccauuucugcaaccaggaaauaacaucaguaucccugggaauagaacu

SEQ ID NO: 2421 - RNA, 3573 nt, Mus musculus
ggaggugccuguuccgaagccuccgggguguggcugcuauccagggagguucccuguucauccacccguuuguccccgccuggagcugcggcacgugugcacaggucccagcuggguaggugggaagcaaagguuucgauaucgugugaggaggccgaagugguacacgaacaggagcucagggcgccuacgacuccccaaccagggauucccgucuucuccccguuacccgcuucacaacagggggcgcccugaccacugcggcccugagcuuacugcugcccuagguugguaagggagucgggccuugaagggugugccaggaccgcauuggaaccacuuccguuuugucuggcaagaaccugcaaauucagcuuucaauugucagguaaacggggccgucaucaccacacccuccuucccccagcagggucggagcuuccaccaugggcugggcaggggaugcgggcuguacgccucguccgccuauacggccucggcccgcguccgagcgucgcgugaucaucgugcucuuccucggccugcuacucgaccuccuggcguucacgcuguugcugccucugcugccugggcugcuggagagacacggccgcgaacaaguaagccccucccccaaggcgggagcucuccccaugccuagccuaucacagauuuauccagcuggaguuacuuuccucuuuacccaggacccccucuauggcuccuggcagcgugggguagacugguuugcuucagccaucgggaugccagcggaaaagagguacaacaguguccuguucggagguaugucgcugugugccaugcuggggcccacaaccuuuuuuuggagagcuaguucugccuaggcucuuggucaaucauccucccuggguuccugccuccuuuaacugaaagguguggguugguuuuguuguuguuguuguuugggggaggggguuguuuuguuuugucuuuuuguuuuugguuggcuuuuuuuuuuaaacugaggccacccgagcuucagucgauggccugugaauauagggcuaaguguggucaacacucuaggacugauccucugucucucaggucucaucggcucggccuucucccuccugcaguucuucuccgcaccacucacaggagcugccucugauuaccuggggaggcgcccagugaugauguugucccugguaagccucuggagccagcugucaacaggcagaggggagaaugcagcuguggggcuccccugccaacagugggcucccaucccuucuagagggaucuucuggccccugguguuacaccaagcuaaauacaccuaaggaaaguacagggacacaaguggcccgggucugaggguuauaugcuugccugccuugcucugggugcuuccuggccugaagugaccgauccugccacuuggccuccacccauuggcagacagguuuggccaucuccuaugcagugugggcuaccucucggagcuuuaaggccuucuuggccuccagggugaucggaggcaucagcaaggggaacguuaaccucuccacagccauugucgcugaccugggcucaccuccaacccgcagccaaggcauggugagugaacagaccuagggaacggggauugaugucugggcuucagacuccaugccuagcucaggucuuuucccuaggcagucaucgggguagccuucuccuuggccuuuacucugggucccaugcugggagcauuccugucuguggaaauggugcccuggaucagccuacuuuuugccaucuccgacauguuguucaucuucuguuucuugccagagacacugccccaggaaaagcggguaggcccggguccccggaggggugagggcuccugaggguuggaagggguuuccuuucuuaucuguaccauuggcaggggagacuggccugcccucaagcugcuaacaucacaacaccucuuggguuucugggaucugacagguccuggucccuaagcugccaggcugugugcucccagccuccuggccagcccucgcuuucucccacaggcaucuucugucacccugggcuuccacacugcugcccaccugcucagcccccuggcccugcuucgcuuugcggcugucacucacagucaggacccgccugcugagcacaguaaggaggcuuaccccggacugagcucucagagucuugaccaaccagcaugaacaacgaucaaccuguggucuguguugacuugcaggacucagaaacuuacgccguuugggucuugucuacuuccucuaccucuuccuguucucaggccuggaguacacacucagcuuccuggcacaucagcgcuuccaguucagcagguaggucuccauauuaguggcuucgagguucucagaccccagguccaggaagccuuugugguaccccucccagcacucuggcugguggccuugcccaucccccaggcaguugguggccuagggggcugggcgcucacccuccaccuccuagccugcagcagggcaagauguuuuucuucaucggccucaccauggccaccauacagggcaccuacgcccggcggaucagcccuggcaaggaagcugcagcugugacgaggguaagggacuuacuuccucuacagugagcacuccaggcaggcuggaaacccaguccugagacuucugucuucccuaggcaaugcugcugcuaguaccagccuuccucuuaauuggcugggcacacucgcugccuacguugggcuugggacugaugcucuacuccuuuggugagugggcucugccagagcugggguagacauccucgugccucuccuaggcuaacaagugccucccauacucucucaccagcugcugcuguuguggugccuggucuguccaccauggucuccaguuauggugagaguccuccccaaaaggcuaugcaggguaggagagcugacagacaucugacaaguccucucccuucagguucuccagggcaaaaaggcacaaucaugggcauacugcggagccuaggcgcccuaggcagggcguuggggccggugguggcugccucagguaagugcuagcacuuccuccugcagccuuccccagcugccugcucugugccugggggggugggggggugcaggaacgggacugugaagccugggugggcaccugucucuccacaguguacuggcugacuggggcccaggucugcuucacugugugcucggcccucuuucugcuccccuuccuacuccuguggaagcugaagcauccagcagagacuuccaaggaggaguagcugagcugccacacccaaccccagcugucuggcugccaggugggaaccugggcccagaccacucagcuccuagcacacuccucccaccgggcccagggaggcucgccacgccccuccucucucuggauggcaacccagcaggaagccugggcagcuacacccuuuucuuacuccaaaaccuuuuaggcuuccagaauuuuuuuuauaucuuauucuucugaaugaccaaauaaagcagcuauuuuguaccaagugccu

SEQ ID NO: 2422 - RNA, 21619 nt, Mus musculus
cuugcuacauuacaagacaauuuauuuuuugaacuuuuuccucuuaagagccuuccauucaccuucuugcguggccaggcuauuaaaaagcuguuuuacuuuacgcuuucuuucugcaucccuaaagagaaagagaaaaaagcaaguguuaaucuugcaucaguucucagguauuuugcuuucuucaguuugaacacuaacaguucagaaccacacaugcauggcucuacccucaguccugcaaaggcugccaaguauaucgcucaccauacuccccagugcugagaaaaaccagcggccuaugaguguggugucacaccacagcggugcccuagucccguacacacaguuccuccucaccuuuccaugauuucugagagcugcauccuggccaggaacugauuguccuuucggaucucucggacggcgccuuuaaauucccgcuuguguuuguggauuagucuuuuccuuuccuguucuucuuuacugcugccuuguuuccguccaaacucaagccuaaaguuagaaucaaaaaggcuauagaggugagcugacugccgacugcaaugucuccugucccaggcugaagcaggugcaucgcccaccucuagccuacagacaguccuggccuccacagggucccccagcacucacacuuugacuagccggggggugaacugcuucagugggacgggcuugcucuucucacacaccagcgggcggcagugcugcuucuggccuuccauugcugacaguaugcuuugagccagcuccuaaggaacauguaaaggcaugguuaagaggucuccuagaggccauacuugccacugccuacucuacacccacugggccgugucaggugcagcuuggcugcauugccauccucuauauagggaacagcaaugcaauuaggacgagcagaugguucagcauauaaggucuccugccaccaagccugaguucaaucucuggaaacuaaauuucaaaggcauugcccucugaccuccauacauaugccaaugcauaaauaaccccacacccagagagaaagcuguaaaugaaagagcuuguguccagagaguagcauauggccuuucugcagggacacacuggcaaggcaccaucagcacaauugggauuaaagcacauaagaccaccuucccugccuaggugaccugcaguguguggaggcagcuguuagagcagcaugaugcugucaggcagaacaggauuccugcucaaacacagcuaagacacgucucgcuaaagcuguggcuuccagggaagccuguagaagccagcucacugauguuggucugucccuuccccucacacagaugugcucuggaucccaauuugcuugccucccugcacccauuguauauagucuugguccaucuaaaugucaugugagaacugagaaacuacaagcuccauaacccuaacuggccagccuaaaucuguaggaccagggaucccuuuaaaaagaagggacaaccacagucauguccacagugauuguuugaggaggugcuagugacucaguacagucaaggaauggcuugcuccagacuugggggacucagcaaucaggaaagccagggucugucuucaaguggcacaaagacgaggguguaauguguacaggaaaggucagcaccaugggcaaacagcacacaaagcucugugcaggggccaggaaagagcaacugugaacaucaccaaaauugagggaaagccugugagaagcccagagugcagguggugaggccaagggaaggucacuccagccugcacuguagccugacccucugucuuuuauugugaauggagaugucacuggggggaggguacagaggagacaacaugccuuuuucuccaaggaagcugggcugguaugcggauaacugaugaugagggugggaacggcagaaggcagaggacaggaaaccagucaggaacaaggggcacagauaguaaggagggacaggguaaggacaccuagaugggauggggaccaaguauaagcaugaagagcugcugacuaccacacaugcuaaauaaagcagcaaaagccuuguuuagacacacgggggcuccaaggaccaagugaggguguccuucgaggucacccucagaaacugugggguaaggugcuuuggauggccuggaacgaguggggccauuuucccuuugugcuucugagauuguagacaguuuugguagacuucccugugaugccuuuuaagcugcaacuucaaugacaaaaacacuaagcuggugcuggguccugaacagcccgggacagggcaaggcgccuagugacuggaaggccucaccugaaguucuugggggaggcuacaaucugcaagaugcuucgacaggagggcuugauggggccugaagauggcguggaaggacggcagugccugguacaugagcacgcagugcuucaucaggcucaaacacgaggcuacgcaggacagccuacaaggacacaggacaaugaaagggacucagcucaccuuauuucaguaguuacucauaagccaaugaaaugucucacccacagcucagaaaaucuaaguggaauuacaucagcagaaaggcuaaauggcucauuauggcagucuaggaaauaguuuacccagagcagaaagaagcacaagacaugcaacaauacuuuaaaaugcggacucaguuucaguucccaaucaaauaaguauacuuugaaaacaaugcugcacauguuaggacauuuauucuugaugucccuggggugucacacauaccuggugugauuugccucagucgcugucagggugcucagucuauuugcccagugcaaggggaggcuuccccucugccagguggucacaucugcuuugucggagaccacgagcaauuccgaguucuucccaagugcucuaaaagggugcaccagaguggaaccugaaucccaagcgugacaggucagaaaggacccagguaucacaagcucagggggccugcgcuggaguagcucagccgugcaccaagcugccgggucuugcuagauaucagugagcuaauuccaacuguccaaauaagcacagaaagaauaccugugcuggguagugguggcucacaccuuuaaugccagcauucaggaggcaaaggcagguggaucucugaaacugaggccagccuggcuuagacaguuucaggacagcuaggguuacucagagaucuuggucuugaaaaaccaaaccaaccaaccaaccgaacaaacaaacaaguagacaggauaccugugaggaaagcuccagaggagauggagaaggcaguuugccuaacuuaauguagaaccugcuagcaacacacuuccuauggccuuauucagguuacacacaugguuuaagcacuuaggucauagccaagccagucuuauccucguagggaugucaugccagcacccuuacagauaaauaaacuagauauagagaaaguaaaacggauuccaaaaccaaaauagagggaagagcagccagaaugcuggggaguugguaggcagaguuggccagaggucugagcaggcagagaggaugaacaaaauagacauuggcaaagaccuagaaacaucaguuaaugauggaggaagaggaacacgcuggggcagaguucaggcaugguuaaauggaaguggcuggguacaugggggcaaguggauggucagcuuauuucaaucuccuacucggccacaggaccaccuucuugacugcacuccagcaccugcacuuucuuuuuuuuuuuuuuuuuuuuuuggaucuuacaauuuauuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuauggggugggucccuggcuagcaccugcacuuucuacugcaguacccucuccagggacccaugccaaucugugacaggggucagacuggauggcuuguucuuaggccaagccugauacccaggggcaggcaauguuuguagagcaguaccacaagggagcucugugcaggaacaucgugugacaagaaauccaagggaugguggcaacuggaggacugacugagucacugccuggcuucagaugaggucaccugauugcuggggugcucaacacuauacccgaaucucaggcugcgccuuguuucagucucaccacacacguaccagggaaagaaaccaguuaagacuuggaacucuguaguacucuggcucccccuagcucuccuuccuagagucucagcuuacagacugcacugagagggccagccagccacauacaguagagagcugggaguggcaguguauaccuggaguaucagcuaugcaggaggcggaggcaggaaaucauuugagucuagggauuuuagaccagccuaagaagaagacacgguauuauuaugguuguugcuauuauuaaauaggguuucucuguguagcccuggcugcccuagaacuugcucuguagacaagguugacccuggacccagagcuccaccuggcucugccucccaaguucugggacuggaacuaaaugcauauaccuccacagcuggcugagacugcaucuuaauaauaaaaaugggggaaggucaggggcucaauccuuauuacccuuccucccuaaagugugaaagagggagguuagauuaauuuucaucauguauuuaguuccaaauacuuaaaguuccaacccuugaaaucugcugcaauaauuuacauggcuuuagcaucagccccggagagauggaacaccccagccucaggcugguaugcaauguguauucaugcauacacacagauucagagaaagaaaguugguuccuggauugcagacuucagagguugucaauguucucucaacuuuccagaauguguauauaaacacuuaaaaaaaaaccccaaaaaccucuaaugcauauuuuuaagucuccauaaucaacucaccuuggcucuuuguguuuggaguugcuauauaaagaaucccaaguagaaaauugaauagcucggggaugaaccuccgagacagggacacguacuccaggaauaagcagcacacaaacaggcccuuuaucacaucuuguagggacaugacuggacacuaggaaggaacccacagagacaguuacugccuuggaauccuguucuaguacaggagacugggcagacaacuagcaccccacucaguaucacaggaggcccugcacucugauaaagaggcuuacugacuaugaaggcugcgugauccuggggcagugagcagugugcccauacaggaaaagggcggucugaacacaagcccucagacucgguaacuacuacuauuugcaagccugucuggagucacauucugcauaugauuucacacuguugagacaagccucccaccccagcucucuccaccggcucuaucuggaauagcucaugcagggagcucuggggcugggacaaggcuacugucugaccuuggaacuccgaucuccacagguucucacaagcccuuuucgauaaccaauuuuaugccaaaucuuaauggucaauaacuguggacuuauuuuuuguuauuuuaagacaggcuuucuauacuguucaagcuugaacugcuggauucaugugacccuugugucacuuguaauugagacuacaggcuguugggaugugaaaggacacucuuguuuaagauaaucccgagauguggggaugaccccacccaccuuuggaagaugggacccaccuuaguaagcaucuggcucauacacagcagggcaggagucacaacuggaugccagaaaucagagguuggaaacaacagcccagugauuuucaaauaaaugagcuggaaaggaaguggugcaauacaaacaaaagagaaagugauguuuaaaaaggucucauagcacaacuggucuuuaaaguccuagugagauacagcaggcacugacaagccaccacaacucacucgacucacucuaggucagggccucccucaauaccucccaggacacaccagcgcucccaugccuucccacacgcagcccggcucauuuggaauguccagaaggauggguuuguucuaccccgugagcuuggaaaggucuucaacccucaccucuagccugaagaacuggggcuucaggguaacaaaacuacuguacuggccgguuuugugugucaacuugacacagcuggaguuaucacagagagaggagcuuuaguuggggaagugccuccaugagauccagcuguaagucauuuucucaauuagugaucaaggcgggagguccccugugggugggaccaucucugggcugguagucuuggguucuauaagagagcaggcugagcaagccaggggaagcaagccaguaaagaacaucccuccauggcuucugcaucagcuccugcuuccugaccugcuugaguuccaguccugacuuccuuuggugaugaacagcaaugugagaaguguaagcugaauaaacccuuucuucaccaacaugcuucuuggucaugauguuugugcaggaauagaaacuaagacagcuagggaccugcuugccucacuggacaccaagugauauccugugucugcuugcuagggcauagccaugucucagcagccaguaccugcaguucuucuacuccaaagcauauguaaaagcaggaauagcuaaaggcaccaggaaacccuccagugcacccaaagcguugccaauuugaucaagcauaccuagaaaccagcaggcacacacuagaagaacucacuuccuucuggucaggcagggacucucucucacuguagaaugacuagagguuagguguaaagagagccuugcuagcuccauggucuggcaagcuucuuguacagcacagcuccucaguguagcagcaacagaaccacacuaugagcuacagagcuacuacuguacuggcggccgugucccagcaccaacagggucgugugaaguuuaguguaucaugaacacucauauuagcuuaucugagguaucugagcagguauaauaauuaauacucucgacccccaaccaaagagaugcugagagaggaugaagagcccacacaugaccauguggcuugaaaggacuugguacuuaaaacccuccaccccaaauuaaugucuacaacagcacccaacagcccuggcugcaauaagaagugagcuggggagggucaagaagacccaccuaacuaguaagcuggcucaggccagcuaucuuuccgcaugcauguaaaagacaucagcaaaaccuuaagcaccugugagucacugcggacucauuucaacacaagcacgagaaaaugaagcagccagcaccgcuucaaagguacuaacuuucuucaaaguuuucuuucaaagguacuaacucaaaauuguuaagauauuggagacuuaaauauuucucaacauuuaaaagaaaagaaugcaggcuggaaucauucuguagaaagugguuuuguuugucuuaaacuccaucucuaccauuaugauuuggcauagcucuauguagucucaagccagaauucuccuauacgucagucaucaagaauguacacucgcaggcuggaccuaggccucccacacauauguagcagaugugcagcuuggucuucaugugggucccaaacaacuggagcaggggcuauccuaaaagcuguugccuacacauagaauauguucuucuagcugggcugccuugucugccucaaugggagaggaagcaccuagccucccagagacaugaagugccagggugggggauauccaggggagcccccaugggcucagagaaggggaaggggaaggagagggagguguuaagggaggcagugaggaggauauaaagagaguaaguaaaaaaaaaaaucaaaaaaagagaaaagaacaaagacuauaugcucuucucucauaucuuccugcaguucucucagaucauucuagaagggcuagcaggguuguucaagcugucaccuuucaauaggacgcugacaucuacaaauguauccagccacauucaugggaaauaugggacacauggguucacaagcuggacaccucucaaagccacgagcagggaacacaaugccaaccauguaugacucaaaauaaacuugguuuccaguggaugcaaagaaaggaucugaugagcccugucucugcuuaccacauccaacccuggaaacgcugcccggccuuuggucucaaucauuucuuccaucucgugcauggcaucucggagaacaaaucuuauggagucacuugcagacucaggaaacaucuggcaaagacuauauaagugccugucaaacaaaaacauaauagagaugacuuuagagagaaagcaacaaaccucaaaacuauguuccuguacagucgcugccucuacaaggaagaacuggcagccugcagauggagcuacauuuuugcuuuaugguugcuggguacugaaccccauuucauacucuacugcugaguccacuuuuuuuaaugaugggugaccuuucuaguaguccaggugacauuucaaguaguguuuuauaauaauauauacugauuuugccauuuccuaaaacccuggucagaguguuuaagugguuguaggauaugugagguaccauggcuguuuauaauaucaauacuguugggagcauagucuaaguguucgccauagcacuuuacauauaagcguauuccucuucacaaacacugugaaagagcaucuuuguguacaugcaggggacacacaggcuaguuaugcaguacagagguggcucgagagcgcccccuccugguacagacuuucccuuaucacauagcuccugacaagagaucaguuucuucugaccuuccagccaccauacagcagcaggaaaccaccacaggggccacaguacaacugugcuaaaggccaaagcuucaauagccauccuugggcaagacaaguggccaugcucccaagaaggcacucucagacucaagcaaagcaccuccuguguggguccagugaggcaaggaccaaaugccucuaaacucacccaagggggguuggggguggggggggagaugugaggcuucagugccgaugaaacaaacacaaacuaacguaccaguacuguaaauacaguagcuuuguuuuaaaaucaacuuguugguaaugugagauuauuucaucccugcauggguagcaugagucagagggaaagcugugagcaagucauggcagugcagaggcaugugcugugcggucucuauagcgcucugagggcagucaccugccugcuaaggucacauugccacugacuggcacaaugacaccaaauguuauuguaacauuacauaguauaaaacugcaauucagcccuguauuccucuugaaacaaacauuuuuacuuacacaaccaacuuaucgauggucuugaggucuggugugcugucuguagccaaaucuccuauguauugcaagaggaagccaaacaauuucugcagggacauagauuggaagaucacucagugccaaauaccaaaugcuaagccauagccgacagcucccagaacaccugcaugcuggccagagcccacagggacaacggacuucagaagaguacaaacaaaauacaagcaaaaaaugcugcuagaaacugcuggacacacaugaggaaagacagcuaaggacaggauacguucuuuauggaauggcagauggcguguaauuuauuaaaaucaaacaaugaucgaggcaugguagguaacuccugccaacuauuucaguacucagaagcagagacagacaaaaguuugaagcccucuggucacaaaaguaugaccaacucaaaaacaaaacaaagcugggugugguggugcacgccuauaaucccagucugaggccagccuggccuacaaugugaauuccagagcauccaaagauacagcaagacccuuucucacaaauaaaauggaagaaacaacaacaacaacaaaaggaggaggaagaagaagaagaagaaggcugcauggucaggguaaagacaugauaaucccuauaaggaacggagccaauagcaacucauuuauuuaguccuggccacuugacgggcugagucucaguuuccugaccugugaaacaaggguaauggcugcucugagguagaguggagcuugaugccacauguggcuuucugcuccucauuaagugcuuucuggugucaccacagugauaacaaaugcaggcccugagcaaacaccaaggcacacgguacuauguaccuccaaguaagucuagcauucagagaaacaggacuaugcuaauacuccaauacccagcacacuuaucucagcguacuuccaauuuugcuuuguuuccuacugcaagacuuggaugguugcacuucugaauucuuuccaccaccaaaaguugcucuuccauugaucuuccugacaauaaaaacuucagcuccucaaaggauucaggagcuaucaaaaacacaaaacauauuucacaguuaacauucaacaggacaacaauccacauagcuacuuacauaguauaggcacaguuccuucacuuugugaaaaguuacuuaacuuaaauguuauauaagguguuuauuuaaccucauauauaucuacucuucuccagggagucugacauuacuuaaaugacuguacucaaaucauguacccgaggacagccccaaagcaaagaugacccauggauuucaucaaguaguaauuugccugaagaccacaaaccaugaggcaucucuguggcaaugcugguuucaguaaagaugucagacaggauuagagcacaugcgugaagcaaauccauuuccugagacucauacaucaagucuccucccugcaagccagcuuggcucauuaguuuucuauucuggaacuaaccuucagucacagaacaagucaggguuuuucucuauguuucagaucaaagaacgcuauauuugauaaaagguuauuuguuguggcuggaguauccagguguaaagccuuccuacagguggcccaggaaucuaaucuacacccugcugcagaaaggugccugcuucaucucugcggucauagaccuguggccauggaaccgaugggagaagucaugcuaauaugcaggaccacagauaccaagaaugaaagcuagccacacagcaaugacaucacaucaccagagaaaugugaccaugcacucacaacugcaucuccagggagggagacucgcaaguacgcacgguggccauuauuuagaaaaacaaaacaaaaacccaacaagccuggggauugaaucucagccugaaaacagaaaaaacuguuuaccugcaaagacauagggcagcucagcugcaacagccuuuugagcuuucuggucauccuuuggcaacuuccccccaggagucugacguugcuccuucuucggugucucguuuuccuccucacucucuauauuagauucuaggucugaguggcugucuggguccucacucucuucugaguccucauggcucucauccucuuccucacugucaucuucucccucuuucuggucauucucuugcccaucugcuuccuugcuuugcucuuccuggacaucuucaauguucaucuucccauccuagaaaaagaccaugcugaccucaguuagaacauucugcagcaacaccagaauaccauggcaacgugguaucauucuuucucaucugcuuugggcugcccuguccacuucccugaggugcccuacaccacaggaacugaagcucucccauagugcuuccguuaguuccccaaguguuucugcauuugaagcuugguccucuguggaacugugagaggggacaggggcacuaggagaugaggccuagagaaggucuuucagucagguaggccugcucucaggaggaguuagcauaguguaguccccguucauggggauuauuaaggaacauacaugccugggccuucccccuccccuggacuuccugcccaagucacauggucacuuucucuugauggauucccaucaauaaggaguuugccagggcucagcuaaagguggcacaaucccuuaaacuucuaguagagacuauugcagccucccagagaacccugagcugggaugcuggggaaaauuuggguuuugucacagagcuuaugaaagugaaaugcugaugguaucuugugagggcuugggggguagggaacagaggagauaacagugccuuggggcuggaccugcucauguaaauggcuuuuuuuuuucuuuuuuucuuuuuggguauuuuuguguuguggauagcccuggggcuaauuauauuugauguaaauucuguucuccugugagugguugugaacaaggacugagucaguacucaggugauucccuguaaaccugcuuuccaccugaauuuguaaaauaaaggagaguugaagauugggcagagagagggaagaugagauggaucggaaagagagaaaaggagguuuggggaaggguggcagaggaggaggaggaggaggaggaggaggaagaggaggaagaggaagaagaaaaguggagcagaagcaccuggccuggagaaacugcaaguucuaaggggucucauagauguggaagauggcaguguagcaaauauacaaugaaacaugacaaaaauuguuuauaagguuucaguauuccagcuauagugaaccccugaaugaacacuagaaaaugugguuuuuaaaggaggcaggggacaccuuaccuuguaagaaagcaagcgccuaucgucuuuauccaguauaaagccaucauuuaaaucaucugcugauguauguuuugguuucuuuuuauuuucauguucaucuuuuccaagcauucuucgaagucuuucagccuaaggcaguaaggaaagagaagucaccagcugcguucgucaaaucucugcagacacugagguacugaagaggccuguggcagucagcugcacaguaucugcuucaacacaagaaaccaaggcccuaagcgcacaggcacggacucaauccagugccagcgguuguuugugggaggcugguacaaagaaaggccucauauacuguguauuuuacuucauaugaucaccucacgaaugaaaagacacuuaugucuguaccaaugugaaauguaaacacagcacaauucagcccgccuuccaagauagagcagaaaagcuuagaaaggacaagccugcugcacucaggccuugagagggagcugagccucuugggugucaggcugggccaagcacucaguuacaagucacccguaccuccagcuucuugagccucucuugcuccuccuuugcuaguuccucuucuguuuucauccuguuagagggcugagccuucauuucaaagccaagcucacgaaccaucaugucauauucaucgggcuaaggggaaaauaagauguuuuucagaauuguuuacaaaaaguaaagaccauuccauuagugacuggacgucguauauaaagaacgggacaaaccaggccuaagucuuuucuucugcauagacaacuguuccuggggcuagugaauggcucaacaauugcaaguguuugcuguucuugcagaggaccagcgucccuggccccuguccuauguccacagauucacauccagaagaugcugccaccccuggccugcacaauuacucacaagcauaucaaucccccaccuaaauaaacaaauaaaucgaugcuguuguaauuagcucuaaaaacugaaaagcagguagacauguggguuaaauggacauuucugcucauaaaaauuauuuuauagacucauauauaacuuauguguuauauauaauauauacauauuuauguuauauuauuuuugagccaggguuucuguguguaguucuggcugcccuggaacucgaucuguagagcagacuggccucaaauugugguggcauacaucuuaaacccagcacuugggaggcaaaaacuauucuuaaaacauaucaccuacugggcauagcagcaugccugggaucccagcaugugggagaugguagcaggaggccaaggucacucuuggugaaaccuaucucaaaaaaaaaaaaaaaaaaaaagcaagccaaaccccacccaaacuaacaaauguacugguguaacaaagauaaacaccacucaucugaguacuaagcuuaaaacacaggaaccuacacgagucccagcaaugcuauggcugacucagagagacacacacacggccacgccgugauauaaucuaguaaaauccuauuuccucaguagaaucuugcuacuaaacaaauguaccauuuuucaacagaucuggagauuguaaaaagcgucacugucagaggaagagaaagcaagcauuaaacagaccacacaugaaugucaggaccguacggaaguuuagcuuucccuuguuucugcccuacaguacuucucaccugagaaacacuguaauucacuuaagguagagaaaaagguaacuuuuggucacuucuacccuguaacaaacaugagauaagcuaacugaaaguugggcacagcaccacagcccuuuauucuuggcaggagaaagaaguaggcagacuucugugaaacugaggcaggccuggucuacacagaguucuaggccagccaaggcuacauggagaaacucugucucaaaucaaaucaaaucgaaucaagacaaaacaaaacaaagaggaagcauuuguaaggucagcaaaauggcuccauggacccgaguuggcacacacacugaaagcccccugagcaguuaagagccaaagauguuacagugucgaagucaacagauaauaagcucacugucacuguaaccucuugugaggcgaagggugcugcccaccugggguuuuuccuuuuucucuuugucuucugacuucuuagguuuucgugacaugagaaucuguauuucuuuccagucuugguccagcuucucugugagcucaagggcaucuucucgcugagccugucuuucccucugggaagaaaauccagcaaauacaaaaucacacaccaucauuauuagacuuucacgagcggccuggaaucaaggccaaggacacacacaaugacccaccucauaugaaacgcgucgacaugaacuaaaggaccagaagcaaguguaagucugagucaaacagaaauagcuuccugcuacuacacauccaaauucugaguaguacacugcuaguuuaauaagacauacuguuucccaaacacuaaagccaacaucaacaucagagguguaagcuuaauggagaucuagaauauuccuuuucaaaaugaaugguccuauauuaaguucagauagaaaugaaauacagcugagaaauguccaugggaaggaagucugccccauuuuggugcugugcacaucagaaugguaagcagcccaccuucucuugcuuugacuuugcaaugagcuccucaaucaguuccuuccgugucuuuggcuugucuccauccucgcccuccuucugagagcuguucuuguggaccccaccaccaaagugggaagcagucaguucagcuggaaacagacagaagaagauacugugaaaccugagcucuaacucugcagccaccuuuggguagaacucugucaacgcuucuccaagggcaguuuuaaaaaccuuuuuauacgugauaugagugugggcacugugugucauggcaaucaaguagaugucaggggacaacuguggagugucaguccucucacucuaccuuuauguggguuuuggggaaucaaacucagguucucaggccacggcaaaagcagcccuggccccaucaguuucucugacuugauuacaucaugucuuuauugccuccaauguuaagacaaagcucaacuucacgcccaccccccuuuuuucuacuuuuggucucacaguaaagcuuccagcgucgucugcuucauuuuuaucucccugucuucuggcauuucccuggcuccccugcgaggucucacuaaccuacaagccagcuccuagccuucuccaucccccacucucugcagaaagggcucuacuuggccuccagccaacaugcccaggacauccucaacagauucucucucugccuucuccgacucuucgggcuucagcucuucucuuucuguucugaugacguuuguauggggacccgcggacacugggugucuugcucuacuguauuuccuccuauagccuagguacaggcucucucauugaaccugaacucaagcccuaccagccccagggauccuccugccucuguccccacagcaccaugcugagauuuuuccguguugauguuuuuaaaaaauuguaauuauuagugugugugugacuggaguggggagcaggauuacaugucacagcacacauguggaggucagaggagaacucuguggaguugucugaucuccuguuaccaggcuugaggcgcaugcccaguguucucacugagcgguccugcuggccccacagcuggccuuuccuuauaugagugcuagggaugaccaggcuugcacucacacucacuggcuugcacucacacucacugaguaccuccccaacccgugccauuuuuccugcauguuccugcuuauuugguggccucugguuccuaucucuccagcugaccuuggaugucucuccacagacuccucuaaaucuacguaaaaguuuuccucauuucagcaaauggcaauccaaucuucucuguggauuaggccaacacauucacagucaccccauuccccguucucccucauucaaaucuaauuacuaguaaauccuguuaggacgucccaucagacaauggaauguccugacauaaaugucucaguggucccccuugcccacauggcucugcuguggacuuaccgugagccaccagccuucuagcaguucccacuccagacccuccacauuuacuguuucucccacgggaagccuccuggcuccuaagcugauaguauuuguucaaacgccuucucagugagccuggcagugucuaccugauggcauucucagcccuuuccuaggacauaucgcccacugcauaucucacagacaagagaauuuagugaucuaacuguuuaccaucugagucugacaucugacaucaacugccaagguuaaguauuugguauuuuguucucucacauuucuccagaacuaagacuaacugucacauaaacuauuaacgaaugaaugaaugacuccugaaucuccugguaaauuugguuuauuugauauagugguauauuaguuaaguaagguuaacauucacucugcuucguguuguuaccuacaggcacaggcuaaauaccaguuccugcacaaagccgaucuaacaguccaacacgaaugccauagcuacaucuacuagggcagaauuuaugaacguuuagggagcuaggcaaugcagaagagcucuugcuaagucaaugagguggguuuuugcgcagcucuaacucugugcuuagagauaaaacuggcuauugugguaggaaugaacagugcuuuaucagucccaaaaggcauuggucacacauaccaaccuacagcugagacaaacauacaaaacaaagaacaaaagcaaaaacccugaccuaugcaguucaucaagagguuaaaauaucauuuccaggagaaaguccaacaagaaacacacugucccuugcuccaagcuaccaggcuucugacuuaccugacaaugccccccggucuucaguaucacugucacuguccacaaugucauuaugcuuuucaaugucagccaaggacuggccauaaugagucaauucuucaucuucauuuagguuguagauguucuuuuucucaugauaucgcuugacaaaaaggguuaacgucaguuacuuaaaauuauuguguuuauuuccuagaaaauuaguuauuuuccacuauaugagagauaugaccguacaugaucaguaugaaaauuauucuggaucauuugaaagaugauugaaauacaugcagaacuuguugagaaaauuuuuuuuuaauuagguauuuuccucguuuacauuuucaaugcuaucccaaaggucccccauacccaccccccccaauccccuacccacccacucccccuuuuuggcccuggaguuccccuguacuggggcauauaaaguuugcaaguccaaugggccucucuuugcagugauggccgacuaggccaucuuuugauacauaugcagcuagagacaagagcuccgggguacugguuaguucauauuguuguuccaccuauaggguugcaguucccuuuagcuccuuggguacuuucucuagcuccugcauugggggccgugugacccauccaauagcugacugugaucauccacuucuguguuugcuaggccccggcauagucucacaagagagagcuauaucuggguccuuucagcaaaaucuugcuaguguaugcaaugaugucagcauuuggaagcugauuaugggauggagaaaauucuuaucuaagucaacucggcuaagcuaagcuccuacucagucucccccuuggcaaugguucccuacucacuccuccaaccaacaaagcugaaggcaggaccucagccgacucugacacguuacuauuugcuauuugcucucguaaagguauuuaucuacuaguaacucuucgacucuucaaaguaccuuccccuuugucuucgcagaugggacacaccccuugagacauauccccuguacauggcaggcaaaccacucagaggugaacaaggagaagcacccuucaccauggcgggccuuguguaaaguuuagagcaaagacgucccugccauucuuuuuccauaccuguugcuccagagcaaaucucuucaucaucuuuuccucugggcuuauguugcuauuauacuccccaaagcguuugucugcgaacacauuggacuuguuccuuucuuuguacuccuuuaguaaaguuuggguucucuggaaaacacaucacacaucaaugauucucacauaaaaucucuauaaucuucacugagguggccaccagaagggguuguaaaguugagaagaauacaguuugccacuuuauuuaaugcuaauaaccaguacauguggcagguauacugcaugaaacucaaggcuuaauuagaaacagcugaugugguucuguuagaugccacauuauucuauuuucaaauguccucucugccauccuuggccuauaguuuauacuggugaauuauuagacagucauuuguauuuuuuauaaugcaugcauugaaccacauacaggacauacacaggacagugucagcuccuugcaguauggauauuuuacccaauucaaaagaaauuuccugcugggcagugguggcgcacaccuuugaucccagcacuugggaggcagaggcaggcggauuucugaguuccaagucagccuggucuacagagugaguucccaagacagccagggcuacacagagaaacacugucucgaaagagcaaaaagaaaaagaaauuuccuuacaaaguuacaaugcgauucccuuuaaggacagacccagaugugaucaaauaccauaguggugagguuauuauuuauuuauuuauuauuuauaauauaaauguauuaaaaauaaaauuuaaauuaaauuuaaaauaaaauuaguaauuaaguuuuuuuaaaaaagaaauuuccuucaaucuaaagaucucauguaaacuggauccuuuguaacaaaguacagauuuguagcugugaagggcaaaggcuaggucuuacuuauccccuuuacaaacauuaccaauaagucuaaccuauuaauuuucucaaaguaaccaugaauugccuuuuacuuacucauuucuuuuauuuauuuuuugagacucaacuggaaguuuugagucucaccauaaagcccuuaaacucagagauccaccugucuccgauuccccagagauuaaagccacagcacaaacggcacucacaaacuuuuauuuuuuaaagucaaacgaacgucagcaguuacauagagaaugccauuuguugaacugguuuugaaaggaagguacaauauacucuugagauggggccauaagaacaaggauggaagcuaugagguuauccccaaaagguacuauuccagugacuucccaagggacaagcucaugaaauucagaggaaggacaauuuccaaacauucaaagagcauacucuguaaacccuauccacgggacgaauacugucauggucaaagcauacagagcagugguacagggcagcucagagcucagaagagauugacucuuaggcccuaaaagcuccaagaagagucaagaagaauguauaccuggaagaucccaaggaggaaggguuuccagaggaagcgcauucgauaucaagcaaaggagaggcaguguuaugccucaguccugaucguuuugcuggcuaguuuaaggcaaacuugacacaaaguauagucaucagaaagaagggaauuucaauuggaaaaaaauacuuucauaagaccgggcugcaagcaagcccaaagagcauuuuacuaauuagugauugaccgcggagggcccaccuaugugcuagcagcgguccuagguucuuuaagaaagcaggcuaagcaagcuauagagagcaagccaguaagcagcaccccucaugacuucuacaucagcuccugccucuaauuuccucaaugauggaaauauauaaguguaagccaaauaaaucuuuuucuccccaaauggcuuucacuagccacugggcauaguacgcagaaccuggguagagccuauccccucaccuuccugauggcacgagcgcgggacaccccgggcaggcccacaucguggcgcgucuuccugccaaggaucuggaacuucugccgguugacuuucacuucaaauggguuuggguuaguuuucgccgggccuccggacgccccugcgggcgcuuuguggaccugccuccgcgccccaguccgcuuggcuuuccccaugacauucacuccgccacacuuuggacgacagugcguacagaccaagcaguucaagaaacucgugcauaggaugcugauguaaaaccacgcccagcuucgucucg

SEQ ID NO: 2423 - RNA, 2282 nt, Mus musculus
ugcccuguccacuucccugaggugcccuacaccacaggaacugaagcucucccauagugcuuccguuaguuccccaaguguuucugcauuugaagcuugguccucuguggaacugugagaggggacaggggcacuaggagaugaggccuagagaaggucuuucagucagguaggccugcucucaggaggaguuagcauaguguaguccccguucauggggauuauuaaggaacauacaugccugggccuucccccuccccuggacuuccugcccaagucacauggucacuuucucuugauggauucccaucaauaaggaguuugccagggcucagcuaaagguggcacaaucccuuaaacuucuaguagagacuauugcagccucccagagaacccugagcugggaugcuggggaaaauuuggguuuugucacagagcuuaugaaagugaaaugcugaugguaucuugugagggcuugggggguagggaacagaggagauaacagugccuuggggcuggaccugcucauguaaauggcuuuuuuuuuucuuuuuuucuuuuuggguauuuuuguguuguggauagcccuggggcuaauuauauuugauguaaauucuguucuccugugagugguugugaacaaggacugagucaguacucaggugauucccuguaaaccugcuuuccaccugaauuuguaaaauaaaggagaguugaagauugggcagagagagggaagaugagauggaucggaaagagagaaaaggagguuuggggaaggguggcagaggaggaggaggaggaggaggaggaggaagaggaggaagaggaagaagaaaaguggagcagaagcaccuggccuggagaaacugcaaguucuaaggggucucauagauguggaagauggcaguguagcaaauauacaaugaaacaugacaaaaauuguuuauaagguuucaguauuccagcuauagugaaccccugaaugaacacuagaaaaugugguuuuuaaaggaggcaggggacaccuuaccuuguaagaaagcaagcgccuaucgucuuuauccaguauaaagccaucauuuaaaucaucugcugauguauguuuugguuucuuuuuauuuucauguucaucuuuuccaagcauucuucgaagucuuucagccuaaggcaguaaggaaagagaagucaccagcugcguucgucaaaucucugcagacacugagguacugaagaggccuguggcagucagcugcacaguaucugcuucaacacaagaaaccaaggcccuaagcgcacaggcacggacucaauccagugccagcgguuguuugugggaggcugguacaaagaaaggccucauauacuguguauuuuacuucauaugaucaccucacgaaugaaaagacacuuaugucuguaccaaugugaaauguaaacacagcacaauucagcccgccuuccaagauagagcagaaaagcuuagaaaggacaagccugcugcacucaggccuugagagggagcugagccucuugggugucaggcugggccaagcacucaguuacaagucacccguaccuccagcuucuugagccucucuugcuccuccuuugcuaguuccucuucuguuuucauccuguuagagggcugagccuucauuucaaagccaagcucacgaaccaucaugucauauucaucgggcuaaggggaaaauaagauguuuuucagaauuguuuacaaaaaguaaagaccauuccauuagugacuggacgucguauauaaagaacgggacaaaccaggccuaagucuuuucuucugcauagacaacuguuccuggggcuagugaauggcucaacaauugcaaguguuugcuguucuugcagaggaccagcgucccuggccccuguccuauguccacagauucacauccagaagaugcugccaccccuggccugcacaauuacucacaagcauaucaaucccccaccuaaauaaacaaauaaaucgaugcuguuguaauuagcucuaaaaacugaaaagcagguagacauguggguuaaauggacauuucugcucauaaaaauuauuuuauagacucauauauaacuuauguguuauauauaauauauacauauuuauguuauauuauuuuugagccaggguuucuguguguaguucuggcugcccuggaacucgaucuguagagcagacuggccucaaauugugguggcauacaucuuaaacccagcacuugggaggcaaaaacuauucuuaaaacaua

SEQ ID NO: 2424 - RNA, 151209 nt, Mus musculus
cgcacucgccgcgaggguugccgggacgggcccaagauggcugagcgccuugguuccgcuucugccugccgcgcagagccccauucauugccuugcugcuaaguggcgccgcguagugccaguaggcuccaagucuucagggucugucccaucgggcaggaagccgucauggcaacccuggaaaagcugaugaaggcuuucgagucgcucaagucguuucagcagcaacagcagcagcagccaccgccgcaggcgccgccgccaccgccgccgccgccuccgccucaacccccucagccgccgccucaggggcagccgccgccgccaccaccgccgcugccagguccggcagaggaaccgcugcaccgaccgugaguccgggcgccgcagcucccgcccgggccccgcgccccuggccugcgugcugggcauggccaacacuguucccuguccagagggucgcgguaccucccugaggccaggcuuucccggcccgggcccucgucuugcggggucucuggccucccucagaggagacagagccgggucaggccagccagggacucgcugaggggcgucacgacuccagugccuucgccguucccaguuugcgaaguuagggaacgaacuuguuucucucuucuggagaaacuggggcgguggcgcacaugacuguugugaagagaacuuggagaggcagagaucucuaggguuaccuccucaucaggccuaagagcugggagugcaggacagcgugagagaugugcggguaguggaugacauaaugcuuuuaggaggucucggcgggagugcugagggcgggggagugugaacgcauccaaugggauauucuuuuuccaagugacacuugaagcagccugugacucgaggcacuucguacucuccuggcguuucauuuaguuugugguguaguguaguuaaaccagguuuuaagcauagccagagaggugugcuucugugugucugcaggcaguuggaugaguuguauuugucaaguacauggugaguuacuuaggugugauuauuaauaaaaaacuauaugugugcauauauaugaaagagucgacuuauacuuaacugccuaucgauuuuuuguucuauauaaaacggauacauugguggugcucaguuuucaccggggaaugaauuuuacuaguguugcagacaggcuuguuuuagaacauaggccacucugacucugacuuugugccaguaaaaguuccuguuuaguucuuugcugacaucuuauagaucuuuggaagcuagcugcuugugacuggagagaauauugaaacagaagagagaccaugagucacagugcucuaagagaaaagagacgcucaaaacauuuccuggaaauccaugcugaguguugagcccugugcucucuugcagcucaguccuuucucucaacucugggcauuuuauuucuaaucuggauuuguauaauuaauaaggagaacuuuugggaacaaccuacuaaagaaugucaucauuaaaacucacuuagaaaauaaguguucuggugauaucauugagcuauguucccaguccugagaguuuguuuuuuuuuuuuuuuuuaaauaaagauuuggggagaaaagguggcuuacuugauagaacaaaauauaggaauaaaauuuccuucuauaaggugaaaagugugaauagaaaacuucuuauccucuagauaaguaguuucuuuuugcuuuugagagucucacuauguaacucuugaccugaacucagagagauccauccuccugccucugccuccucucucugggauuaaaggcauguggcaccaugcugggcuguccaaguaugccacagacccucuaggucccuggucuucgaggaacgggauuucuuaggcagauggguaaggagucggaugaaaaugacaaucagccacacacaagagagguguugaaucugaauguaauguucugguugagcuucagacuuauauaacaacgaauuaucagaggauacaaaucacaaaaagacaagauacacugaaauucaccaguuacagcagaaaggaauuugcagggacuaauuaaauguuuacauuagggauaacaagcccugccuaggaucagccuaaugccaggcaagaauuucacacuuuaagguuaaaagcaucaggggguuguuaacucuugacaggccuuaagaguaaugugcuaucacugagcucuaaauucuuaggucuaguaaaacuuauccugucuggagaguucccccuuaucaggguaguauaucaacuuauacuugacauggaaugaagccuguaguaaaacauuucuaucucagugagacuuuuagucucuaucuguaaacagcugaguaaaauggcaagugcuuaauuguuuacugaauggguuaagcuccuugcugcuaucuggaaucuaagaacacuggggaaaggcuuuagcuauguuagaauacaauauuaaaaggcauuuacuauaaggugaugcuuaauagagugcacgugaaucuauacacuagauuaaugugguggaaauuugaauauaauggguuagggaaagagaugccauaacucugggaggaaaauuucccuggacucuuauccucgugaaacagcuuccaggcuuuucgccugacaaaccgauccaaacuggagaguuggcuuucgccagaauauccaggaggagaguccuagaaauucauuucucaugagcagcuuuuuggcauuuuugccucacaagcugacuccaccagaguacccugacacaaguauugucuaguuauuuugauuauuaccaugacucugccucugggugagaggaauuguggaaguuuacauauuccccauaucuucuauaaaccucuguguguguguguguguguguguguguguguguguguguguguaugagggagagagagggagagagagagagggagggaggaagagagagagagagauuguucugugccugcuucgaacacaaauuaguuugcaaaaguaauucauuaacaugauacagucccaaagauaaaaaugguuaaauaaugaaaacaucucccuccccauuuuccuaacuuuguacccaggagcaagcucuguuacacuucauuuguccuuccagauaaaauuugggcauauguuaggacagaauuuuaaauuauuuacaaacaaaaguauuuuggaacaaaagcuuuuaaaagcuuuuauuuuaauaaaauaacuuguuacuacacuguauauaacuaacuaacauuuuccaaaauuagcuccauuagcaucuaucucauauuucuauguacuuugcuguugaaaaaccaaguguucauuaauaauaaguaacaaacucacugcuuggaagcuuugauuuuuggcauuuuguccacuugacucaguuaaaaguccuuuuuuucgaaaugagaacagccaaaacaguuuuagaaugagucuguucugcuuuugugacucucauuguguucuguagaaccagugucacagccauaugugggccucuguugaaguagcugagaacuuguucucugcucugcuagcugcugucgaucugauaggccuugaacaguugacauucacccuuaauaguccucauuagucuuccugagcauagucauucauuuaucaauauuugcugaucaucuccuaugugccuagcauuguucuaguugcagguuuuagcagggaacaaagucaugucucaugaagcuaaaauucuugggagagacauagacaguaagcagaauaguuuguucauagugagugaugaggcgcaugcaguaaaguagggaaggggauuaggaaaugccagggcuugacauguuuuagacaggguguuuaaauaauaucugcuuaguugaaggcuuauuuuugaauaaauaucugaagagucagaaaucuaccaggaggguguauggaagaggaguauuccugcaaggggaaguugucaaaggcuuuccuguguggggauuagugaugucauguuuuugcuggaugaaaugagugacgguaagaguuguagugggggugaagcaaaggguugagggaggcuucauugguguuaucaguuacugcauuuaucuccaaauagagaacguagcaaugaaagcuacagagaacgggaaaggugaggauuuauucuaagacaaaauaaguguaggaaguuuaacaauuagaucaggagcacagacuccaagucuaagucuucauucuugcacauuuuuuaaaaauuuuguuauguguucuggauacuauuuccuuaugagauauaaguuuaaaagccuuucuguggauugccuugccuuuguuguuguuguuuguuuuguuuuguuuuguugagacaggucucucuauguagccuugacuguccugaaaaucacucuguagaccaggcuggccuggaacucagagaucugccugcuucugcuuuucaagugcugauauuaaauguaugugccaccacugccaggcuaagauuguucuuucaauuucuuuuuuuguuuucuuuugagaucaaaguuugcuauguacuuuuggcuggccugguauauuguguagucuaaguuggcuucaaaucuucauggcacagauucccaaguacugggaccauagguauggcccaucacagugggggguugggggggccaguacaucuaucucuugaaugguguggaguguauauauguguuagggguuugcagaggccaaaagaauauugagugucuuccucuauugcucgccacuucucugaauaaaccuaaaguuaccaauggauuucuaguaagcugacugaccagcaaauauuggggaucugucugucccuguucaccauagugagguuacagacgugaauaaccacacccaguuuuaacgcugaaugcugaagaguuaaacucaggauuuagacuugccucacuuucuuauguucuucaaagcauagacauuuuaaguuuugaugaaguuuaauuuugucuuuagcuacgguauguuagauacuuaauaaaucacucuuuuaucugaaaucacaaagauuuauuuacucccucuuuuucuaagaguuguuuguaagccugacucauuuugaauuugugguuaagguagaugucugacucuuuucuuuugcacguguaauuuagcauuuggcuaaagagaauguuuuuuucucauugaacuguauugacaucuuuguugaaaauuauuaccuguccauauguaaauguuucuacuuccauuuuugccauugauugugugucuguucuaugccaguacuauacagucuugauuacugguuuauaucaugaucucaaaucauaaaguaugccccccaacauugucuuuuucaauguugcuuuaguuauucugggucccuugugauucuauccaucaauauuggugaacuucaugaccagauaguaaacgguuaaggcucuguggcuauaaugccaucacagccagucagcucugccacuguggcaugaaagcagccauagaaaauauguaagagaaugaguacauagaauuggaauuucuuaaaauuuucaagucaugaaacauucuuuuauuauuuuuuuuuaaagaaaauguuuuauuuauucuuugacaguuucaugcauguauacaauguaucugaaucucaugcagggccccuacuaucucccucccaucuacaccucagcauguccuucucccacagggucccuacucucucccucccaucuauaccucagcauguccuucucccacagggccccuacuaucucccucccaucuacaccucagcauguccuucucccacagggccccuacuaucuccuucccaucuacaccucagcauguccuucucccacagggccccuacuaucucccucccaucuacaccucagcauguccuucucccacagggccccuacuaucuccuucccaucuacaccucagcauguccuucucccacagggccccuacuaucucccucccaucuauaccucagcauguccuucucccacagggccccuacuaucuccuucccaucuauaccucagcauguccuucucccacagggccccuacuaucucccucccaucuauaccucagcauguccuucucccaccuccaugccuuuuuuuaaugacccacugaauccaguuaguguugcuugcuggaauggaauguugacugguuuuuguuuguuuguuuguuuuuguuuguuuguuuguuuucccugaggcaggcuuucucuguguagcccuggcuguccuggaacuacuagcucuguagaucaggcuggccucaaacacacagagaugagugcuucugccucccaguguagggacuaaagguuuaucucccacccaguucuugugugguaaccauaacugcagugaguuuauuauuacagcagccaugccaugucuggaaggcagaauuucauugagcucuauaaaaccuggcucauaaauucucucuaccccuucccuucccugaaccugggugugggggucaauuuagaugucacauuuaggcugacauuuaucagucacuuauucucaguauacuaugaguuuuugaguugcugcccacugcagaaagagguuucuuuggccaaggccugacaguagcacuagucuguagguauaaauguaaauauuuacucuuguuuguuuauuugguugguuuguuuuuugagacuggguuuuucuguagccuggccauccuggaacucacuuuguagaccaggcuggucuuaaacucagguucacuugccucugccucccaaaugcuggaauuaaaagcaugcaccaccacaucgggcucccaaacauaaauauguagaagguagucuaacaacaugucuacuuagcaaaacagcaguaguaggguccuguuuuaggaccuguaaccuccuuccccugagucaugggcuuuugacuagguguguaccuuuggcgcacacuuuaagucuagucagaaaacuguggguuaucuuuguauucuuuacaucacuguugcacuaguggucacauuucgccuuugucuauauuauagcauucaggguccagugcuuaguaagaccauugaugucuuuucuccuccaguggccugcaaaacaccuggcauuauaaaaccuaaccagccaagaggaaguuuucagaucaguucuaucuugauuucucuaugucuucuaugcaaccaaaguguguuguaucuucaucaauaggguuuuacuauuauauaguuacauugggcaaccaagagugauagaaauaaccuguguuguuuggauaggaagguguuucugggaccuccaugacuaauaacuuguaagagguaucucaugcuuagcacauguuuucugaggauacauugucauguacauaccuauguugaaacuccuuuaaaaaacacuuauacuuuuaaauuagcuuucaaaauaguuucuauaaguuuuuuuaaaaaagauuauauauauauauacacacacauauauguauacacacacacacacacacacacacacacacacacacacacauauauuguagcugucuucagacacaucagaagaaggcaucagauuccauuacagaugguugugagccaccaugugguugcugggaauugaacucaagaccucuggaagagcaaucagugcucuuaacaauugagccaucucuccagcucuauaaguuuuuuuucacacaucauuuacauucuguaaguaaugaauaaucacuacacaaaacaacaauuguucuccugaacauuaauucuggagaaucuaaaauuaacagucucauaaaaccuguaugcaaaugauuaacagaucuagggguaauagccucaagcuggaaucaguuuagaagucgucaauagguaguuaagcuaccuaacaacaagaaggaauucagcugcugauaccugcagcagcucagguaaauaguggagauuauaggccauugagcaagcugauuccuaaugccuacucauuauaugauuuuacuuauguaucuuuuuuuccuguaauguuagaucuuugguuauuuuguuuuccccuuguggcaaaauaacaucacauaaaacauaaccauuuugaguauacaaucuaugauuguaaaaacacaguguuccauugugaccaccagccaccacuguuacucuuccuuuuuaacauugcuuuuaaaaguauauuacaaaaaaaguauauuacaauuuucacuugacauuguaauuguacaugucuaugaauagggucauuuuuuuaaaauuauacauucuaguaucuucuguugcauucaguuaacuuaagagcaggaaagacugguauagaaguccuuuucucucucucuuuuuuuucuuuuucgagacaggguuucucuguguagcccuggcuguccuggaacucacuuuguaaaccagguuggccucgaacucagaaauccgccugccucugccucccgagugcugggauuaaaggugugcgccaccacacccggcgaaguccuuuucuaugauagagaguauaucgugggcaaauccuaggccuuggcucuuuagucaaccagcauuuguaugauuaaauaaaacauugguguguguuuguguguuugcacacuggguacagccuuuccuuuauuagcccugggugugauuuucuucucugcugauagauccuuucuaagcugaucgcuucauacuuaggguggggauaguugugaggacugaggaggugaugugcgguccugucccuuucucauuuugcuagugugacugauauguuaguucuuugcaugugucuccuacucuggaaggagcuggaugggaauuguuuguuuuuuagucacuaaaucuagacuaucagguucauggcaaguucucaggaaguacuuauuacauguauagaguuauaaucugaacuugauuagacauauggcacuuuucauacuccuacuuuuguuuuucaaguuauuuuuuucuacuuaccaguuucauguuuuaaaaacuuguuucuuuuuuuaaauuuuuuuaauuagguauuuuccucauuuacauuuccaaugcuagcccaaaaaucccccauacccuccaccccacuccccuacccacccacucccacuucuuggcccuggcauuccccuguacuggggcauauaaaguuugcaaguccaaugggccucucuuuccagugauggcugacuaggccaucuucugauacauaagcaacuagagacacgagcuccaggggguacugguuaguucauaucguuguuccaccuauaggguugcagaucccuuuagcuccuuggauacuuucucuagccuccuccauugggggcccugugauccauccaauagcugacugugagcauucacuucuauguuugcuaggccccggcauagucucacaagagacagcuauaucaggguccuuucagcaaaaucuugcuaguguaugcaauggugucuguauuugguggcugauuaugggauggaaccccuagauaugguagucucuagaugguccauccuuuugucucagcuccaaacuuugucucuguaacuccuuccauggguguuuuguucccaauucuaagaaggggcaaaguguccacaauuuggucuuuguucuucuugaguuucaugugcuuuguaucuuguaucuuggguauucuaaguuucugggcuaauauccacuuaucagugaguacuuguuucuuuuaauuaaaaaacaaaacaaaacaaacaaaaaacuguguguaggccgggcguggugccccucauacuuaaucccagcacucaggaucucugugaguuugaggccagucuggucuacauggugaguuauaggacaucuagggcaacauagucagacccuguagucaaaaagaaccaaaacugaaccaauacaaaacuuugugagcuaguaaaauagugaagugcuugcuaacauucugaguuugaucucugggacccaugugguagaaagagaggaccaguuuccacaaguugucuuuugaucuccaugugagugccaaagcacacauacauguauuaaaaugugcauguguaauuguaaaguuucguuaccacugacagucagaaacgagcucuggggccucaggguucucuuccuucagugcugugggaagugcaccuuuaaacaaucuuauuuggguuucuuuuggagacaggaguuaugacagagauuaaacuuggcuuugagcaaauuucauacacauuuaaccacugaauuuaaccacagugccuauucaguuuugaauaucacaugacuagaaucguagagcuccuccuauucauaacucacacugugucaaagcuccuuuucuucaguguuguuggucacccauuuaguuugucuguuuuguaugaauaugcccuguuuuucucaucuuauuagugcaugcuuggguuauuaaacuuugacaaaugcugcugugaggauaucucauaugcuggccugucuuuucccucacaaaauggugcuuuuuaaugagcaguucccauuuuggugacuucuaauuugucauacuuuuccauuaugguaagugcuuuuauuucuuuuuugaugaauuuuucaucaacuugagaucaugagacguuuccugauacuguugcauaaauggcauauugauuugcccaaugaaguugacuuguuuuugugugugguguaaaauagacuucuuguuuguucuucuaauguggguacuucuuuuuucaccaguuuccuccauguucuguguguauuuccucccuuuuauuguuauuaaguuuauauuauuaaaagaauucacauuaaguagguuuuuuuuuaaaaaaaaaacuuuuuauuaauucuuugugaguuuuauaucauguaccccacucaucucccugacccguuuccccccucugcccuugcaucccccccuucaaaagaaaagaaaaaccacacaaacagaaaaaccaauaauguauagaaaacaucucauaguagaaacuguaucaugucacagugugugccacuguauaccccucugucugcacaucuugacaugcagaugaucauugcaaugagucacugaucugauucaaggucucugacuuaugucacaccauuaauauuggaucuucuccaggacuccucuugguuuauucaguuguuacucugugucaucaaguuccugcagcuuuggaucagcaggaccggcucuuuuauguacuccaacgguucacagaugauguagauguuggggugcgccaacucaaagcccuggaucugggccugggugguaguugugcuggucagccugcuggcucuccugcaucugcaucaccagggcuguucuccagcacugcuaggccacucgaugcuaucauuuguaagaagcagggucaugaggagggaggacaccucccugccccaaaacacacacacaccacccaauggcagaugagugaccaguccagcucucccucuaucucacccuugaggcuaggucaccugugcaccugccaccagggccagcucuacucugcugcccaguuaagauucaggaccuacucuccugaguacugcugcuggugagaggugugccagcucucuagagugccaaagccaguucuguacagauacauggcugcacagaccagggacauccccaugguuucuagugauaaugugagucacgacaucaacaucaaucccugccacugcauggccacagauccagacaugguccucaguagcagcaggaguugguacuucaccauggcuucaaguggcagggcuagcuacucacaauaggcucuuccucuucccccucaugucucaguuccuucucucuucauacugcgcaggcuguucugcuucucuuucucuuccuucuguccaccacauacuugcacauugcagagacuccugcugcaggcaagccaugaugcugguaugccucugggugaucuccucugcuugugcuguuuggcaugguggcaugcagaccucuaggugucuacagcuacccaugugacauggcagcaguguccucccccaccccucucugcaguguggcaggcaggucuucuggacuuuuuucccugccagugcccugugucauggcagugggauggcagugggugggucucucucucucucuuuuuuuuaaacacaggguuucucuuuguagcccuggcuguccuggaacucccucuguagagcaggcuggccuaaaacucacagagaucugccugccucugccucccaagugcugggauuaaagguaugugccaccaccacaggcauggcagguucuuuuggcauaauuauuucucacuuuguucugggguuguuuaggacagaguuuuguguuguagcucaugcuggccuagagcaugcugugguucuccuaucucuacucccugcauucuaggagugaagauguucaccauguuugguucuaguuaucuuaaaauaaggaccaucucuugcuaauaauacuuuucauuguacaguacauuaugccccggucugucuuaguauuugaagaaccuuuguccuucauacugauucuuaugucuuuccuagauggcaucuucugucucccacauagacaauauugucacaucguuguccuuagacaauauugucauauuguuguccuuugcuauuggaagauugaaggguuuuguugcuuaaaagaccauuuugauagucuaaguguugcugcaugauuuugugugugugaauauguguguuuaaguguaguuuuucaguauuaucacuucuugagaaaguauauccuauaguuccaaaucagauguugauuuaaccuuuuaaaaaaaucuuucuggugcuggagagaugguucaguguuuaagaacacuaacuugcucuucuagagguccugagugugauucccaggaaccacgugguggcucacaaccaucuguaaugggaucugaugcccucuucuggugugccugaagacagcuacaguguacucauauacauuuaaaaaaaaaaaucuuucuacucagguggugguggcagcacauaccuuuaaccccagcacuuggggagcagaggcagcuagaucucugugaguuugaggcuagccuggucuacagcguuucaggacagccaggacuaccugucugucuugaaacaagacaaaacaaaaacgccaaaccuuucugaaaguggucuaaguguucagcaacacugucauguaaggauaggacuugacaaaaaucagagagcaacuguugaagaaucagaagcuaugcauucaugcuccaggcugcugugcuucuuauaggcaggacagcuuccagacuucagucuugcccccaguauggaguguacguuacauguguucguggagggggaggaggaagaggaggggagaggaggaagaggaagaagaggaauguuuuaaaauuccuugagcgguucagucuacccucuucucuuaauguggaaucacauuguuaagauuuuuauuuuuaauuaggugucuauauauguaucuguauggaagucuauaugcacaugagugcauguacccugaagaggguauuggauccuauguuucuggaguuaaaggugguugugagccaccugauauagguccuggguaacugaacuuggaguuuuuuuggauuagcaauaagcacucagaaccauugagccaucucuccaagcccuguaaucacauauuuaaaagaacaaugaguguaauucuaaaguuaagaauuuagauaugggggcuggagagaugguucagugauuaagaacacugacuguucuuccaaagguccugaguucaauucucagcaaccacaugguggcucacaaccaucuguaaugggaucugacacccucuucuggugugucugaagacaccuacaguguacucauauaaauaaaauaaauaaaucuuuuaaaaaaugaauuuaauuaugaaggccaaauuuauauuuuuagaaguaguucuuaauuuguuacagugugcucuagagccuggauuuuacaugcccccacaauugugagccuguguagauugcuuuguugcacuuaaaauaguuuggcugaagcuuguuuucauuuugaagauguaguuucaagugguugaagagccaagguuguuuuuacccuauugauacaguuccuacccugagcuauuuuauuuuucauaaaaaacaaaucagucugacuuaucucuaaaaaucccaucuaauuucauaaggaaugaaauagcuacagauguuuauuuauuuauuuuauaucagauuuucuuauuggacagaaugagguagaaaaaaauguuauuucaggcugggaccuaggcuaggugugguggugagggcugcaguucuagcacuaagagccagagaugaggcaggaggaucuugacuucuugagagggcuagacuggguuccaggccagccaggagugagagaagaagaggggugggugcuuuacagaacucagcuggaagauguaugccaaacaccugcagcuuuaucauuucuauucugucucuccucuuuuuaagcuaaaguuuaaagggcuagaguccccugcagguuggagaaucuaaggaaugaaguugaaagguagccugaggucaaauugauuuguuguuuugagacaaagucuugcacuguauauucaaggcucuugucaaauuccugauucuccugguuccgucucuugaaugcugccaaguuauaauauugggaucguguucuaauuggcugagaagucuguauuagaaguucuagcuucugaccugcagaguauagcagaaggauuuucauuuucugauauuuuugguuagugucaucucuguucugagagugcauucugacucucauacuuuaaauaagaguacuugguaugcuaagaggaaaugcuuguuauaagacuguaaaacuaucuuuuauucuccuggaguaauugucuccaaggcuuacugccucuguccauuaaccuagacuuaguacccaaaggugcuagccuccauacaaucuaauuuaugccgagacuauuuucaacuucugaaacuuauugcuccauaagcucacccuuucuuguucuuucugaucucuggcugcugauucaauucaguuagcuguucuggcucagacuccucuccaagcugacugauugaaucugguuucucucucuuggcuucuccugcauuguucugcuuggccuuacacuaacuuugacaaucuguucuaauuuucuggcuccuucuuauucucuggcuuguucuagcuucaccugugucuaguuuguccucucucuauaaccugucucucuaucacgguccagggaaaacugccuccuuccucucucugcccuccucugcaaguagcuuuuuuucccccuuuuucuucuggugagaguugggcagauccuauucuagcaaaucuuucucuaauucaucacuuugucugcuauucaauuagacuucuauaaacuacuuuuacccucauugauugagauuaaaggguguguuuguauuccagccagaaguggcuuagguguaugcuaagggcuuagccacaccacaacgagaaauaaguuuuguuguuguuguugguuuuguuuuuuguuuuuuguuuuuuugucaguaaauaacacaaucuuagaguucauugugugaucaaauauccugcaacauaaggucuggauguucuggccugaauuuuaaaucuggcaccaugagagauagauucugauagaagaguugugcugcucuuagaauguacagggccagagaacagaugcaugauggauauaagaaaagaggaacaauaucauuauuguaagagcaaguagauggcuugcuuuucacacaaagcaggcacuuaauaacuauuguuugaauuuuaagucaaacuagcaacuauugggaacuagcaaaauuuuaugauauuaggaagggucaaauuuuuccugaaaaggguuuaguuuguuguaaauaguuugggaugagguaaaagagaaaacuugagauuugucuuuucuuugguugucugugaugguuuauugucccguuuuugacagugaccucuuagugaugugaaucugugaacaagugaucuuugcacguguauguuuguaugugugugugcucaugugaguguaccugcugugggccuguggaaguuagaggacaacuuuggagaguugcauuguuuguauuugucaggguucucuaaaggagcugaacugaaaagauguauauguguguguguaugucuuaguuauuguucuuuagugaugaaacacuauaaccaaggcaacuuaaacagaagcauuuaauuggggcuugcuuacaguuucagaggcuuaguucuuaucaucauggcaggauuguagagucaggcagcuauggugcugagaaguagcugagaacucacaucugacuagcaguuugcaggcagggagagaaagagagagagagaggcagagagagagagagacagagagagagagagagagucagagacagacagagacagagacagacagagacacagagagagagacaaacauagaaagagauacagacagacagguccauuaacuagaaccaaacauuuaagcaugaguccauggggccauucucguucaaacuacuauauaugguauauaaaauguguauauauguauauauacauauauauauauauauacacacacacacacauguacauuuuuaaaagggaauuuuuuauguugcuuuauaaguuguggucuggguaguccaacagugacuuuccucugacagaaaggccaagaauccaacaguuguucaaauugaaugucucggcagucccagucuguugcuggaguccuggaagauuccuagagagguguggggucuuuagucuguguuggaguucugaaaaaguagguuccaauaccaguggaggaaucccucagcaacaggauaaauuaguucucaacauuugggggguccaacggcccuuucacacgggucaccuaagaccauugaaaaacacagauauuuauguggugauucauaacaguagcaaaaauuacaguuaugaaauacuguacgaugagaauaauguuaugguugggguucauuaugacuugaggaagcuuauuaaaggaucucagcauuaggaugguucguaaccacugugauagauggaucagcuguggagagugagggcacgagggcaagcagcaaagucuuccuuccauguccauuuaugugagcugccaccagaaggugaccuagauuuagggugggucuucccaccuucaguaauccaaucaagaaagucccucacagauaugcccagugcuuggguuuuaguugauuccagaugaugucaguuaagauuagcugucuccuugguccuuuccuuucugcuguuuucaaccccucccuccuggcuuugucccucuccacucccccaucuagucaagcaauuuucuuaccagacuaaagaauuugaguucaggacauuuuagaugaagcuuuauuauuucuaccuuucuuugaucucuugauuuuagauacauaaguguaaaguuaaagaucauuguccuuuaucuucagaguugccgaagauucacccaagaaacuaguacugauaauuucuguaauguauucucccauauugggaauuuacuucauuugaugagcucuuguggaacucuguauaguauggguacugagugcuaguaauauagauaagauauggucccuucaccuucacuucuggggauacaaucuaaggcacacugucugaagaagugccagcaggagccagagaagggcccuugguaaauaagagcuucccccaaggugcccagugccucaaaaagaauuaugaauuuucauuucauuguuaagauugguauugucuauaagucauaguuugauaagcuugacuaagucgaagguggcaagccauaagaggugguaucauauucuuuguugccaccuuuauccuaugggguuaucucaugaaggagggagagcaagaaugaauaccagagaaaacuuuuuccaacucauuuguauuacuucaaagauguaagauaaaugcuccauaggccuaccuaguuuaucagacauguaguucgugugaaacuguuggguuuuuuuuuuuuuaaucuuuuuuuaacuuguggaugugugugguguuuguauggaggcagacauguguguaugguguguuuuacaguauggaggccucuaagauugaugucgggaaucucccuuaucuuuuuguacuuuguucuucgaggcaggaucucuuagucaaacucaggcuuugauagccagcuagcucaaggacucaagucccaucucuccuuucaaugcuggauucacaaguggcugcugcauugucacuuugcauuuaaauggguuuuggggaucuggauuuggccccuuuguuuguacagcaaauguuaacacuaagucaucuuuucaggucugauuuuuuuuccccuuaaauucuuuauuaauagccacuuccuccaugauucuacuaggugauacaacuccaucaguaauuuuuaacuacagaaaaguuggcauguugacauacugcuucuguggacacaugccucauaaacuugucaaagcccgaggggacguugggaaucucuuuaugacaauucccgagggcaguagucuuuccucuugaaaguggaugaggccuagaccuguuuauuugggcagccauauaccacugaucaugguggaccugucaaaaguaccuauuuaccaugcugucugaguuuagcugagucuugucaguuacaauugggaaaguuggcgagagcaaagggacuugguuaguuuggcuuuggauccgaggugacugaaaaucucagauaaugaauguuuccauaauaaauguaauuaggucacugaguucaguguugucagccuucuuuuuuuguuuacacuuuuugcuuuauuauuuaaugaauguauuagugcugugcugcauguacaccagcaugccagaaaagggcaacagaugcccuuuuugauggucagagccaccaugugguugcuggcaauugaagggaauugaacucagaaccucuggaagagcagcuggugugcuuaauugcugagccaucucaucaccaucagguagccuuuuugucacuacuugguacugguguagcaugaccccuuuaagacguguaauuucaguucauuuaaaaccugggacagauuuuuccugugcaaaucaaaggauaauggguuggugcuuuaguuugcuuccuaaaauguuuaaugggguuaguguucuggaagcauccuaauggcuauuuuaagguagguaaaaaccuaagcuguugcaacagaggcuuauuacaagugauuuagagaagaaagcauuuuauucucauaguauuuucuuuacagugugaggaaauguucuuuuugguauacaauucugagauuuaacuaaugcaaucccugugacuaccauaaucaggauucauaaauuuacuauuauuauauggugugcauguacaugucaaguguuugaguguguguuugcaugucccaugugcaaaggaaugcggguggaggucagaggacaacauuagaguuaaguuuuucuauugugagcuccagggauuguacuggcuaguuuugugucaacuugacacagcuggaguuaucacagagaaaggagcuucaauugaggaaaugccuccacgagauccaacuguaaggcauuuucucaauuagugaucaagggggaaaggccccuugugggugggaccaucucugggcugguagucuugguucuauaagagagcaggcugagcaagccaggugaggcaagccaguaaagaacaucccuccauggccucugcaucagcuccugcuuccugaccugcuugaguuccaguccugacuuccuuuggugaugaacagcaguauggaaguguaagccaaauaaacccuuuccuccccaacuugcuucuuggucgugauguuugugcaggaauagaaacccucacuaagggaucacaugcagauccucaggcuuguguggcgagucauuuuaccaucugagcugucuugcuuccauaaucaggaguuagguugguucugucgcuacccgaagcucccuaugcugcuuugcugucaucuccucacccugacauuacuggucauauuuuaauucuuacaguuuugauuuguucuaaaaauagaauggcccuguguugguugucggagucuuacuaaguucuuccucaaguguagugcauugugaucuguccuuguuuccuguuaguaguuacuuccuuuucuuagauacguuuccauuguuuggcuauugcuuuuguuuaucuuucagcagguggaugaggagcgcuugcuagauuuccauucuagcauugcugcagugagcuucuuaugaggaugggaggugugggagccugugcuucugaagaugauaaagggacccacgaugcugccgugcugcucugcacucuucuuauugucuuuauuuauauaauugacacucgaguguugggcauguuuguucugauuggaggaagauagcuuggacauucagauacaauaggaauucuguauaucacuugcauucccaauacauuuaugggaggaaguuaugugcuuguguuaggcaaauuuuggugggugaccagcaguuuacgugaccggucagaaaaagucucuuucugggaagacauaagcuacuuuuuuuucacaugucugacuuuucugagugucgugugaggaagcucuuaguagaccucaucugucgucaucccuuccucaugcugcccucuucccagcauggaguuuaugauucacuaguaguagccaaaacguacuuaggaaugaaugaaauauagaaacaaacgaaguagucaccucaguggaugcucauuucuuuuccucuuguuuuuuuguagaaagaaggaacucucagccaccaagaaagaccgugugaaucauugucuaacaauaugugaaaacauuguggcacagucucucagguaauuggcuuuuuaaaaaaaagauuuauauauuuauguauaugaguauucugcuugcaugcaugccuccaugacagaagagggcaucagaucccuuuauagauggguugcuggguagccagugcugagccaucuccccagccucuucuuuucuuuuuguuuuugguuauuuuuguuguuguuuuucuuuuuuuguuuaaaagaucucucugguaauuacugaguuggguggugguggauauaccuguaaccuggcauucaggaggcagaggcaggcagaucuuggugaguucagggauagccuggacuacagagccaguaccaggaccuacacaaagaaaccuuuaacucauaaaaaacagaaaacaaagaagaagaagaagaagaagaagaagaagaagaagaagaagaagaagaagaagaaggaaggaagaaggaaggaagaaggaaggaagaaggaaggaagaaggaaggaagaaggaaggaagaaggaaggaagaagaaggaagaagaaggaagaaggaagaaggaagaaggaagaaggaagaagaagaagaagaagaacaacaacaacaaacugguugcugggcugugguagugcauuucuuuaaucccagcacaacaacaacaacaacaacaaacugguugcugggcugugguagugcauuucuuuaaucccagcacuugggaggcagaaacaggugacucucaaggccaaccuggucuacagagugaguuccaggauggcuagagcuuacacagagaaacucugucuugaaacuccaccccaccccaaacuauaucuaaauacucuguguuuucacuauuaaugcauuaccauguucuuuguaccccuagcuaucucuuaaaaguucauuuaggcuaagcguauuuugguacaugcuugcaaucccaguauuuggcaggcugagacaggaggaucuugaauuugguauuagccugggcaacauagcaaaacccugcaucaagaaaaauccauuuaaaaucaggacguuuuaccacauuuguaguugugcuauaaggguaucuggguucucuuauaggaaauguuuucuucuugucaucuuauauaugagaauuuuagucauaugauaauugaauggcauguuaguaauuuaauuuguauucuuuuaagguuuauuuauuuuuaaauaaaugaaugaguguuuugucccuauuuuauauuuguucccuguaugugccuggcacccacagagaccauaagaagguacuggaguuccuggaacuggaauuaaaagauggucauaaguugcuguguggaugcugggaaacaaacuuagguccucucugcaagaauagcaagugcucuuaucuacugagccuccuacuuucuguuuguuugucugagacaaggucucauuuagcccaggauggcuucaaacucacuguauagcaaaagaugacuuugaguuccugcuccucuucuucugccuccugaaugcuuagacuauagaccugaucucuuagaguuucuauugcugugaugaaauaccaugaucaaaagcaucuuucacuuauacauguguguaacagucuaucacuguagaaaucagggcaggaucucauacagacuguggagggguacugcuugcuggcuuauucuucauggcuugauuggccugcuuuauagaagccaggagcaugagcccagggguguucccauccacaaugagccuggcccuuccccaccaaucauuauuuaagaaaaugcacuauagacucuucugccuaaagucccauuuuauggaggcauuuucucaauugaaguuucuucaaagacgaguuuagcuuaugucaccuuggucagaaaacuagcuaggacacuuggcuuuagaauauagcuucaaugucaaaauuccccauaaucaaaacugaaaguaaauucaacuuggggauuguauuggcaauuuauauaaauuaaaggcuuaauagucuguagggugaaccauuacagagcagaguauuauccuaauaagaaaauacauaacacacacacacacacaauacacauauuucaagaaagaaauuugacuuggcuacuacucaggcagaggcaggagguucaugacuuagagacuuuuuauagagcccucuuucaggcuuuauaaaagcaugacuucuucucaaacaaaaaggaaagaaggaaggaaucagggugggcucaauguuuauuucguguuuucuauauuagaaguucaucuuuauuaguuauuauggacuaaauguguaucuccccaacccgucuguauguugaagaucuaaucccccauucugaaacugaaaccaacuaugcauuuuaguagguuaauucaguguuuucuugaaguuaaucucacaacccacauaguuauacagcuuugucucaugggcuguucuucauguaguagucacaggcuugugggaggccacugagugacuaaucugagauuugaaugaccuuucuccuuagguugaggaguuuguggugugcuagcguggcuugcagaacucaagaaaauacuaacauuuucuggcuugcuacaaagcuauagcucaguagcagccagauuguagagacucagaggguaagguaugggagggaagcauggccccucugugcucucuucuuccagucuuccaugugucucagcauggacuucuguuaccagaaccaggagcuugauauguguuguacuuuaagcaucaccauucacauuggcaacaaaaaucaucagaauuuuuuucagagggaagacacuuggggccauaauagagacagauuaaaguggugucuuaaaaauaaaaucugaccacaauaaaaaucaaucagaaaugcaacaaaguauaggaaguuacaauuuguaacaagaacaguuagucaauguuggcccagaaauuaaacuagguuagcauacacaagcacuaaaacaguauaagaaacauuuaaacaguuuaacuuuuuuuuuuuuuaaugucuaagaagcaaaagguugaggguaugggaagaagaaacaagacaggaaaaaggcugagccugaacuaaaauaaggagacagccuacuucuuauaggaaaugccugccaaaauccagggaagugccaucuguaagucauucuauccucaguaaaaaucucuuguaaaaugaaaaggugaaauaaagagguucucagacauaccucugaggaguacccucugucugacaagcagugaguuuaagacauuuuaaaggaaguguuucaagcagauagaaaauuauaccagauagaaucuggaucuguccaaaggauugcuagcagauggauaaacauaggagaugucugucugucugucucugucccucucuugaucccucucccccuccccucucucagacaagauuauguacugauguagaacuagugauccucuugccugugcugcuugggugcugggauuacagaaaugugucucaugcaugcagcagcaaccuguugcaugacagacaacauaggaacaaauguuugcucaacucauagggaagcauuaacaaacuaaaguauagaugccucuaaaauccaauuuggugaaccaguggaugcauaaggguuacuuacagugguaugggugagugguuccuuauaggaucauggaugacucaaaaggcaucaccaaaaucccacccuggcaugggacacagcucacuaaagcuagaacccuggaacucucugcgcaacuuagacuucagcaguucaggaaucccccuccccucagcaguccuuacuacuuauauaacccaggagucuuagucaggguuuauauuguugugauaaaacacugacuaaaagcaacuuggggagggaaggguuuaucucagccuauccgucuacaucacaguccacugagggaaaggaacugauacagagauaauagaggagugcuggggggauggauggcucagcagguaagagcacugacugcucuucugaagguccugaguucauagcaaccacaugguagcucacaaccaucuguaaugagaucugaugcccucuucuguggugucugaagacaccuacaguguacuuaaauaaauaaauuaaaaaaaaaaaaaaagaguagcucugcuuacuggcuuccucucaugguuugcucuccugcuucuuuuuuauaugccaauugugcaguuccuuuuuuuuuuauauuggauauuuucuuuauuuacauuucaaauguuauccccuuucccgguccccccccccagaaccccccuaucccauccucccuucuccugcuucuaugaggguguuccuccacccacccagccacccaccaacucccacuucccugcccuugauuccccuauacuggggcaucuaucgagccuucauaggaccaaggaccucuccucccauuaaugccugacaaggccauccucugcuacauaagcagcugaagccauguguacuccuuuguuaauggcuuagucccugggagcucugggggucugguugguugauauuguuguucuucccaugggguugcaaaccccuucaacuccuucaguccuuucuccaacuccucuauuggggaccccaugcucaguccaaugguuggcugcgaguaucugccucuguauuuguaaugcucuggcagggccucucaggagacagccauaucagguuccuuucaacaugcacuucuuggcaucuacaauagucucuggguuugauaacuguauaugggaugaauccccaagugggacagucucuggauggccuuucauucagucucugcucuauacuaucuccauauuuguuccugugaguauuuuguucuccuaaggaggacugaaguacccacacuuaggucuuucuucuucuugagcuucauguggucugugaauuguggucuguaucuuggguauuuggagcuuuugggcuaauauccacuuauaggugaguguauaccauuuguguucuuuuaugauuggguuaccacacucaggaugauauuuucuaguuccauucauuugccuaagaauuucauaaauucaucauuuuuaaugacugauaguacuccauuguguaaguguaccacauuuucuguauccauuccucuguugaaggacaucuaguuucuuuccagcuccuggcuauuauaaauaaggcugcuaugaacauaguggaacauauguccuuauuauauguuggaaugucuucuggguauaugcccaggagugguauagcuggguccucagguaguacuauguccaguuuucugaggaaccgccaaacugacuuccagagugguuguacaaguuugcaaucccaccagcaauggaggaguguuucccuuucuccacauccucaccagcaucugcugucaccugaguuuuuuaucuuagccauucugacuggugugagguggagucucaggguuguuuugauuugcauuucucugaugacuaaggguauugaacauuucuuuaggugcuucucagccauuugauauuccucgguugugaauucuuuguuuagcucuguaccccauuuuuaauaggguuauuugguucucuugaguucuuuguauauauuggauacuagcccucuauuggauguaggguugguaaagaucuuuucccaaucuauugguugcuguuuuuguuguuguuggguuuuuuuuguuuguuuuuguuuuuguuuaaggucacauuuuuaaauucuugaucuuagagcauaagccauugguguucuguucaggaaauuuggggacagagagucauugugaaucugauaaacuucagggacuuccuaagauuucugggcuguuuccuuccuugagucucuuuguuucuuuguuuguuuuuugaaauggaguuucuuuaguccagccaguccuuaaauguacuauuuagaucagguuggccuugaacucacagagauuuccuacuucuuucuccugaguacugggauuaaaggcaugugccaccuugcucagccacuuucugagucauaacaagcauuccuucagaagucccugacucugaaaaagcuugcuauacagcacaaucuuuucuuuuucuuuuuuucuuuauuuuauguugauugguuaguuuuguguguguuaugucaauggguaugcauugacauagugcuuguguguaagucagaagccaacuuucaggugaugguucucuuuuuaugauguguguucugaauauugaaaucagguuaucaggcaggccugcuguuauuugcugacuacauguagaaaguauauuuuagauaugucuguugaguaauuagccuuacuucuuucuuauuauauugaugcuacuggaaggaauccugagcccaugcuuagagcugucauuaauuucuguuuuggcacugcuaagacugaugucugagggaaagccucuagugucagacuuuccgccuuucauccuaguuuauuacuguauuccuuuccaguaaggucuauggcauugcugagugacaugucuuuuugcucuguauguguugagaauuauugaucccuuuucuuucucuuagguuuauggaugucuuucaaugccuuuugagccagagucucauuguguagaucuagcuugccuagaacucauaaagaucccccugccucugccucccuggugcugggauuaaaaucacaugcuagaauuuuuuaauuagagguaaaagagaaggugacuguauagaucauaguccuuuagauuaagauccuaguacaacagucugcuuuugauguuuuagaaauggcaugccccauucuuaagucaccagaaucacuuucaaauaugccuuguguuacagguuugagauacuuuagaguuuuccacucaaguggcccaccagccuccucuucuaaugggcgggcuuagcuuguuggaucaugacauaccaaacagguuuucucaacuaaacuuacuaaaauacuuuacaaauaguacccagauugugauaccaguauucgguuucuugcaacagaaaagccuguaagccuguggaaucuagggaaauguaguuggaccuuuaugcacauugaaaguaagauugaaaagaaauaaaggagauguauugacuugcuggguuuucaaggcuucaaggaugcuaucuaaaaguaaaucuaccuuuuuacaaagcauaugauuaccugagauuugagaauccuagacaguaucuucuaaagauguuucaaugaaaucuuaaaaagaaaaggggaucaguaccaauaugcugcucaccacaguccaccuuuacgccgauauucuuaauuuuuaugaaauguucuuucuuguccuaaaauuccauuuagauugcucuuugcauuuugucaucaguucuccuagaucugucaugacgaugacaaccucucucucucucucucucucucucucucucucucucucuuuuuuacuuagaaauucuccagaauuucagaaacucuugggcaucgcuauggaacuguuucugcugugcagugacgaugcggagucagaugucagaaugguggcugaugagugccucaacaaagucaucaaaguaagcgccccauaaugaugauaauggugaugcgugcuccuguaauugucaugccuuaagagacaaagcuccagauaccuacauuuuuuccauuuugggcauguggcuuggaggaccugggguauuuucccauaaacagcuaaauguguuccugcggaacuuuuuuuuuuuugcacccuuauaguucauagguccauucugaagggcaucugugugaccacuggcugccuauuucuuaagaggaaugucucuaugggcugccacuuuuguuugggcauugcuuggagaaccucagagcccugggggcacaaagguggguguggggggaaugaagucuugcaugccuuccuucauuucuuuuccugccccucuuaguggaggucagacaauacugcuuguuggugaagauguagcuucucagguuagguuaauuggagguagcaugaccugaauggggagagaggagaguacagacaggagaauggagccaggaagcaauagccacucaggugcagugccagaagaggugaaaaggcugggcaccugucucacuaugucauugcuuccuaguacugagugcagaccacugcaacuccagucuguuucuuuguucaguuuucugcuaugaaagaagauugaaguccuccuuccccgcccucauccuaaugcaggugggcauuaggaagggcagagagaacaaugugacucuaaauugaccauauccuuguuacuucaagugcaagcagcuuuuccucucaaaccucucuucugccguggcugaugcuggucagguuggcuuggugcauguuugaggccacagaccacuguuguagcuugcagcuuuauguucuggaucuuuggcugccuaucuccacuuucuuccuguuucuuugugguuucuagucaaugucaggaauuccagcuuuuacagcacagcccugagucaggccaaucuucauucuuucccuucugcuuauagcugcuuucauguuucugccuuuucaacugcugcaauguucaggauaagccaguaagguggaccaggauccagcuauucacuaugauagaggaaaggcgaggcaagaugggagaaugggauggcuucaggccaaguguagggaaugguucacuuucuagucugggacuuuucuuuucuugaaagaauuaguguauguacuauaaagaccaauuucuagccccgaaaaugggcagauauuacuugucuuuuauguucaaaauacauugaguucugauagccaggauguguauuccugcuuucaagucuugggugguaaagugaauguguccagaacucacccaugguauaaaaugcagagcagaaagaagguaguaauuuuuuuuuuucccaagaagauagaagugguauucuggagucaggaaagacccucccauuuuuaccuacuaccuggagguuugucucagagaggagagcaggcccuuuuuaggcugugaaaaauggugugucuugagggucaguuuaaguauuuugugucuugguagaaaaugaaggccucuugcagaucacuggcuuuguguggaagccaguuuugauagggaaugaaaagaaggaccccagcugaggggaaggcaugagcuaggauggugucagaguguguuuugucagcuauguguggaggcagguugggaguuggggguaaaggaagcuauaaugagcucuauuaucaccccaugaaggacucauggaagagccaugcucuacccuuaacagaguugagcuuuuguuuucucuacuacaaaauaaaguagauuuugguucauaaacauuuauauagcucaaacaguauuugauguacucuuaaauuucauuugaaaguagucuuuuaauguuugucagcaugguuugcuucuuuuguucaaacuacagcagcagaaucagggucugaaauuuccugguggggccagagagauugguuaagaagagaaguuacugcuuuugcagaagaccugacuucaguucccaguaccauaagaugucguauaaccacuuguaacccaaauuucaggggguccugugccuucuucugaccucuguauguuccuguacauauacauacacucaggcacacauaaaaugaauuuuucaaaaaaaguugguagaauguuauacuucuucugaaucaauuuuccaaagugugccucuguuuuaccuuugaaacucauggcccagugaaugaucccuguguccuaguuucaucucuuuggcuaugauaaauauccuggcaaaaaacugaagggagaaagaacuugauuuagaacuucagguaacaguccaucauucuagugaacucaaagcaacuagaacgcaaagcaguuggucacagucgcagucaagggcagaaaggaaaagaaugugugugugcuuguugcucagcugucuuccucuacuuuaaucuguccuaggucuaaaacuuaggcagcgguguuacucauuuucagcauuggucaucucacaucaauuaaggcaaucaaaauagucccucacaaauauggccacaggacaaccugaucuagacaggaucuuaaugagacuauucccagguaaucuagguuaugucagguugacacagcuaaccaucucaucucuccuuggucucuagauaucagguuugcaugugccugaaaaggagagcugggucacuuccucacauuuuuuugacaugccauuuuagaagagaaaguucuuagggacaagaauagggugauuuucucuaauguggacuuuaugcuauuagccuugauuguggcucgaagucagauacaugaaccuuauguuuuaguuagaguuuuauugcugugaauaggcaccaugaguacagcaacucuuguaaggaaaacacuuaguuggggcugggucacaguucacagguuuaguucaucaucauggugggaagcauggcagcaugcaggcaggcauggugcuagagagguagcauagaauucuauaucugcacuggcaauaggaagaaaagacugccauuggcccugucuugagcaucugaaaccucaaagcccacccccagugacacacuuccuccaacaaggccccaccuacuaauagugccauucccuaugggccuguggagccauuuucagucaaaccuucauaccuuauuucugaguuagccccaaagugaucaggaaaggucaagaaaugagcucugaggacuguaagacuuccuagcugacacugagaccugggugggucagggaguuggggcugugagcauccucaucauuuugcaaguuuagaacuucaaaaaaagaugauucuguuguuacauguucccugucagagagaagggcucagauccuacaaguacaauccucauaucuugcuuacuuagagacuuucaccugagcuguccaggugagccagugaagacugugugcuuacucugaaagcuuuaggguuaauuuuaauuugauauuauauaguauuugauuacuauaaauguuaucuucuguuuuuauccugguaaagaccuguauuuagaauauucuguaauuuuuauauguguuuacuuuuuucuuaauauauagcuucuuauuuaguugcuguuaauguuacuuuuccuuaaaauuugaacuuuugguuaccauuuagcuuuauggguagaauuuagaucuauagguagaauguaucuucuauaacaagucucuucuauuucuuugcaggcuuugauggauucuaaucuuccaaggcuacaguuagaacucuauaaggaaauuaaaaagguggguguuugcucugcauuauugagaagaugauacuguuuuacuguugaguacccuaugagauuucuaacuugcaaguuauuaaauaacacuguuaggaagaagugccauuuggugaagcagaguuuaguuuucuuuaaaaacguacuccucauuuucauuaauugaaauagaaauuuauagcaccaccuuaaauuuuuuaaagauuuuuuuuuguuuuauuauauguguaugaguugccuguguguacaucucugcaccguguaugugcagugccuuuugagguccucugcaagagcagcaagugcucuuaaccccugagcuguaacuccuagcaaccaagcaaccaaccaacaacuuacuucucuucucucuucucuucucuucucucucucucucucucucucucucucucucucucucucucucucucucucucucuagcaugaccccagccaguucugagguugaaggcagguuuccccccccaucuacuuuuauaauauuuuaguuacaugcaaguaauaagguuaagcaguacaauagacacaaacagucaaggaacaagcuaggcaauaaagaaagucucuugaucacucccgugaugacuguuucuaagggcuuaucuggaugaccaaaauaucugggccuacuucccugucuuagcucaaagucauauucaugccugaagccuguucuagccuaaaauuacauuccugccugagcuuacuuccuugucauggccuagugucagauuucugcuaaguggucccaaaaagcucuccacaucucccccuuuuuuauuucauaaacaagacugcaccugucuuaggugguucuaacaagaaugccuuccuuacaugucguggaauaucuauuaucaaagucgugcauuucugucuuagguugguaaggcucugugcagaacuuacccgucagcgucaauggcugccggccuauuaaauuaauaauucugucuggggguucauuuuuaguuucaaaccauguauuuuggccaccaacauguugaugcuauuaaaggcaaguuuuauuacagugggcaggaauaaaaauauucccaggacaaaaagggcuaucaugaucaagcuauaugugccauucuugaagcuugaccaagauggaaauacugacauauauucaugaauaauuuuaucgacaauaccugcagcgucagagcucagcagaguaccauucuuuaaauucauaaucucaauaugcaaaauuaaaacauccagagagguguuagaauuaugccaaauacucuucaagugucuuucaauuuucccaauuauauugacucucauuguaaauuuuagaaguaacacaaaucccuugguauuucgcauaacacuugagauggcuucuuacucuuaaacucuaaaccuccucucauaauuugaauauuaucaauaaagagcauaaaccauuguuucggacaccuaucuaaaucaaucuuucuuucguucuuccuuuucuuuuuuuaaaucuguauuuuuauaauugaagcccucuggauuuuaaaaaucuuugaaguaauuaccaucuauuucacacuguuaauuuugacuuucucugauuaaauuaacagagaaagagaauguuuaacucuccaagagaggaugcaagcagcuccaauaucauagaccuagcuguagaaagugcaugugacucuuaaauguaacacaucacuuguuaacuccacuuagaauggugcuccucgaaguuugcgugcugcccuguggagguuugcugagcuggcucaccugguucgaccucagaagugcagguaaguuguaccucuguauuauuuuuaagauuuguuugguaaauagcuaguccugccugucuuuuuuguuccagugcauaugucuacaccuugagacaucauucuuguccacucuguguugccuagcuauguccugucugguugcugucagcauuuuguucuuauauuucuuuccaaagacccaucucuauuaggaauacucuuauguccucuauuaaugugcuucuuucuugucccaucauuccccaagagacuugugggauguauuuccagaguaacauagucucaccaucuuauucugugcuucauuuccaacacgaauguagugagcacucaauguguugguuaaggaauacuuacuggaugaaugacaacugucccugaucccaucagcagcagaguuagcaauuauugaaaaauaaucauuuguauaguacuuggguuggagaaguagaugaacugugcauaaaauuugaacuuguugauugucuuugacuccuaugguguuagguauuaaauccaggagcucaggcaugcuaggcaauugcuuuacugcugagucucauugucagcccacacaucuggcuuuguggcuugaguaacaaaacaggauuguaguuauaccguucuuuccuuuuucuccucaguugguaaaauguacugcguaugucccaaagacuguauccgugagaaacauaguagagugcucuaaaucuucacacuaacaaggaacaaugauguguucaauuuagguuaaguuucaguaagaauuuuauguggccagaaagauguaaccacgaaggaaguuucuuucuauagaacuuuuacuuuugcucugcugauauguuuauuuuuguguuggcuuuggugcuaaggcuaggcaugccuaagugugcgcuuccacacuuccacauuuccagcucaagugccuuacuuugaaaauugucauauuauugagguaauacaucccagguuuacaacacagcagacaaaauagcuguucaaaaguaugacuguccugucacaggcccuuccuuaaacucucuuaauuauucccuaguguuguuuagauaaaaucuagacuucccacucaaggcaagagauaauuuagccuuugcuggcccuuuccuaucucaucacuaaagaaauacuauauugauucauugauccaauuuaguucuucaaauagguuuuauuuccucaagauagcuugaugucucagaaaauaaucaccuccuucugcaagcauucuagccuccuuaucuucuaaguuguaacugauuucugccuaacaaagauggcuguaguaucuguaggccuaauugcuauauaagagggccuuggccccacuauagcagacacccuacuccauccucguuuuucugucuaagguaaggaauuguuguuugaaguccccauuuaauuugaccacuuuuuuaccccuagagauugugcagcucuccuggagagcauaaaagaaacuuguguugauuucuaauuaaaagaagcuggguuaccaaacaaaagucccauaaugucuggcaugccaaauuaauggguuuauuuggcuuauauacaaaagcacggacaacuuauaaguagcuaugccuuugaagcuucaccuccaguuaguuugccuuuuacauaacucaguccuucuaagguuauguaucccuguaguacaaaggaaugaugauuggaaucuuggggucuuaugacauuuucuuuuucuccccaaaagggaguauuaucagacuaucccauagaccuaggcaccugcucuguaguucuccuugcuuuguugucugcuuguggcuccaaggucuccauauaagucaccacagcuacucugcuucaugguagggauggucaugucaaguguacaggaaacagcuagcccacaguagcuuuuaacaugacuuuuucaguaaaaugauguccacauuuuauuuuguuuuucaaaaguuacuguauaaggguacauaccaguaccuguauauagaaagguaagaggagugucauuccugggcaugguuccucaggagcuguccagcuuguuugauaagauaaagucuucacugcccuaggaucugcugaugcgacuuggcuggcugccccuuaaccucagagaaucacugguuucugacuuccuagugcagggauuacaaaugagcacuacuaugucuggguuuuuauguggaugauagggaucgaacucauauccugugcuuggugcauaagcuaucuccuuuguucccuccaguuuguguuuuuaaaguaguaguuuuuaaucuauuguuuccuauuuaaauuauauuuuaauaauugcuauaauuugugacaaauuuuuuaaauauuuaucuuuaauauuuuuuuacaguccagucuuuaucccucuccugaucugcccucccaaaguuuuucaaacccaaaaaaagaagaaaaagaaauuggagagaucguacauuaguaacuuaacagaauaccugaaagcccuagaacagaaagaagcaaacguguccaaaaggaguagacaggaggaaauagucaaacucagggccaaaaucaaccaaagagaaacaaagaaacugauaaaagaaucaacaaaaccaaaagcuggaucuuugaaaaucaacaagauagauaagccccuagccaaacuaaggggcacagagacaguauccaaacuaacaaaaucagaacugaaaagggagacauaacaacagaaccugaggaaaucaucagguccuacuacaaaagcccaacaaaacucaacaaaacuggaaaaaucuagaugaaaugguugauuuucuagacauauaccauguccuaaaguuaaaucaagaucauguaaacuaucuaaacaguccuauauccccuaaagaaauagaagacgucauuaaaaaccuuccaaccaaaaagaagcccagggccagauggcuuuagugcagaauucuaccagaccuucaaagaggagcuaauaccaacacucagcaaauaauaauuuaaauccaacuuuuuaaauuacauuuuauuugucugugugucuuuauauguguaccaugccuuugggugaggauaacuuauaguuaauucuuccuuuccucuaugugggucccagagaucaaacuugggucuucaggcuucuccuucuuuacccacaaagccaucuugcuugucccuacacccagcuucuuaauauucuuuguaacucaugggagagaugacagacaauugaacuucaucagcauuuaugccuccuguacuuguaguugagcauuguggucuccauugaggacuaauucaccuauaaaacuagguuuuuuccugacagggaaccaugagcuuguuguuucuuaacagaggagaccugaagaaugaugaguauuccucuugcacauacaggccuuaccuggugaaucuucuuccaugccugacccgaacaagcaaaagaccggaggaaucaguucaggagaccuuggcugcagcuguuccuaaaauuauggcuucuuuuggcaauuucgcaaaugacaaugaaauuaagguauggcuguugccucuuggcaugagucuuguguggcuuuggggagaaagucauuugagauugcuucugguguccuuuuggcuucacugagagacaucucaagaacuucuuuuuacuucugcuuuccuuucaugggguaaguugucaagggaaauagcuuauagaugcaaauucaaaggcauuuccccagaguggauuuagguauacuggguuggccacuugagccagcuaaggaaaagagacuucauaggaaagagugaagaagaguuaaugggccuugugggugugggcgcccuaaagccaccaggacucgaguuugguucauagugcccagaaagcaacuuauuacauaauuuguggguugcaagauucuuggcuuugauuuuaucuuuuugaaaaaguauuuuuuuuuuaauuuauuuauuuauuauaucguuacggaugguugugagccaccaugugguugcugggauuugaacuccagaccuucggaagagcagucgggugcucuuacccacugagccaucucaccagccccaguuuuuauuuuuaaaguauuuauuuuauauguuuggguguuuugucaauguacuguauacaugccuacuguucucagaagccagaaaaguguuggauauccuagaacuaaaguuauagaugauugugcgccaccacaugggugcugcaaacugaaucuggauccucugaaagaguaacuaguucucuuaagcccugagcccacucuccagcuucuaccuuuucucauuguuuaucuguguaagugcgugugcguguguguaugucugucugucugugugucugucuguaugagccugugugugaauggaggcuagaagaaggugcuagguguccgucuuuaucacucucugccuguucuuuuugagguugaguuucccugaaccugaggcuuacuuuuuuuuuuuuuuuaaauuggacauuuuauuuguuuacauuucaaauguuauccccuuucccaguuucccuucugcaaacccccuaucuuaucaccacccucacccugcuucuaugagggugcuuauccacccacccacccucccacucacuccugccucacugcccuagcauuccucuacacugggguaucaaaccuuuauaggaccaaaggccuccccuccuauugaugucagauaaggccccuuuagcuccuucaguccuucuccuaucugcuccauuggggucccugugcucagucugaugguuggcugugagccucugcaucuguauuggucaggaucuggcgauacaggagauagcuguaucaggcuccggucagcaagcacuucuugacaucagcaguagugucucuggguuuggugucugcaugugggauggauccccagguggggcagucucuagauggccuuuccuucagucucuguuccacuuuuugucccuguauuuccuuuagacaggagcaauucuugguuaauauuuuggagauggguggguggcucaaucccucaaccagggggccaugccuaaccucugaauauggucucaacagguucucuuucuccuuugugggguauuucagcuaaugccaucccugugggguccugggaggcucuugcuuuccuggcaucugcugcugcugucaguguuauuccucccuccuuggagggguggaagcuccugauggugcagaaaugaguacugcaauacugucaagagucucugugauaacugcugucagagccaggggacagguguauacacacacacacacacacacacagugguugguucuggaucuuuccaugauauagaugccauuugaguaagguaauacuuuccuuuuuuuuuuuuuuuuuuuuuuuuuuuguauguaucuguagcuguacagaugguugugagcuucaugugguuguugggaauugaauuuuaggacuucugcuugcucugguuggcuguacuugcuccggucaacccugcuugcucaggcccaaagauguauuuauuauuauuaaaaaaguacacuguagcugucuucagaugcaccagaggcagacaucagaucucauuauggguggcugugagccaccaugugguugcugggauuugaacucaggaccuuuggaagagcagucagugcucuuauccacugagcuaucucuccgcccucccccccauacuuacuaacuacuuccuucaugaaccugugacauuuaagagaucuagucauucuucugcccauguaucauugcugugcucuagaaacaaauagugccacccuguccuacuuaucuugguucugugucagaggcaaacaauaaugcuugcuucccuggguuuagauuuuuaaauuuuacauuuguuuuuuaacuguagaagaggugaauuuggcucuaacacuuguuucuuuuuacaauaguccuguauauauugaauauguacuuuauuaugcccuuaucaauagugauggcuaaucguauaugauuuugaacaccuuuuuguuuucuaaaccuaauaauuauugguuguuucugaagucucaaacagaagugccauuucuuacucguuagcuugcucaauagauggccuaucuccuuuggcaguuaucgucccacauccugcuuaauauggccagugauucuugaguuuguaaauucugucauccuggagacuccuuuacugcucuccucuuucuggcugcugucuucugucuagguuugcuucccaaaggguugugcaggaagcaguugggauuugacaucccuaaaaauuccuuugguaugcagaucacuuuuuccucaggagaauucaaucuuuguuuuguaguacagaacuggaagauccuguccacaccaagaggcaggauccccaaggaguuaggugugugguguaaagagggacgccuguaaggaggcugcagcggacagagugucuggagagaugggguucuaggucuuauguaguaguggagucuccacagaauggacccacaguaagaggacacuugcacacaggcugccauaguacugggggugauauccugagagauggaacuaggaugaaaauugccagagucucacccugguauggacuggggggggggggggugucguccucacauaaaguguuucucgguaaacaggcugacaugaaggaauggggaagggcuagaagguagggcugagaggguccacaggaaagaguaacucugaguuucccuuuuuaccauucuuacguguguguuuauuucuauuagcacuuuuauuggucugaauaucauuuguggggugugugggaugugugugugugcacgugcgcacgcgcuauaucaucaucagcuagccauacaagauauacagagacauacuuacaaucaguugcagccaccaaugaauguaucaccaguggcccugaaacugacaauggcaguucuacuauggaaugugcuaugaagucaacaguuaguuaggcuaaguguggaaauagugagugaaugagauaaaggagggacauaggcaaaugaaacaaagacaagagagacaagguuaaauaaaugaaaggagaagguggaggggucaggaagaacauuaugggcuuauucuggagauuacuaggaauaucuucucugugauuucuuagaaagugguaugugguaugcugucaugccuauaaaguugcaggcuuccacucacagaggcaccagucuagggaggauguuuuaguacagcagcacuucugcagaaaagucuuaggccagauuaucacuguauuugucuagugcuuuuuccuuauuauugucaaguuuuuuaaaaacuuuauauaguguucuuacuaccucuguucugguauaccacgaguagccuauagacacugagacugacacagugaacaaguuccugaugaauguguguguguguauuucuuauucauguggguucugaggauggaacuuaggccaucaaccuuggcuacaaauuccuuuaucauuugaccuagcacacagccuuccuaaugcgauuaauaaggaaguaaauauacugcuaauaaauacuuggugacuauugaaaauuugguauuuuuugcuccaucuaugaaaaaugugucaucuugucacaguuuuuguccuauaaguuuuagaauucugugaaauguguaauaagcuccaugggagcuucaguuuucaucaucuugguuuuguuuguucucagguucuguugaaagcuuucauagcaaaucugaagucaagcucucccaccgugcggcggacagcagccggcucagccgugagcaucugccaacauucuaggaggacacaguacuucuacaacuggcuccuuaauguccuccuagguaagagagaaagggccugcuggcccagucuuagcaucugcucaaucuucuaaacuacacugacccuugccaucaugauuagaccauuugcagcugcugacugcuaaaugugaaguguguaggggauguugcaagcccauaaauggucucggagacuuuucagcugcggcugugucucuaggacacccagcugguacacaaccucauccaccuuccuguccuucuguaucagaggccugaggcuaugcuucagcacgcuguggguacucuagggaaacugacauuccccuacccccucucuccugucaaaaucaacaugaacaagucuugcuggaaugagcauauggacauuugauacaacucucugaauuccacauggacauuugauacaacucucugaauuccacauacaguuccacucccuauaagguccugccaagcuaaggauauauuuuaugcugcaaggcugcuuuugaucugagugugcacagccuguguuucucagucucgcuuaugucaccuuucccuuuuacugcuagguuuacaacagggcacuccuguaggucucccuuuuucaccagcauguacugugggucucugagcaguggacuggcuguugagccccuuugguugucuuugcaggucugcugguucccauggaagaagagcacuccacucuccugauccucgguguguugcucacauugaggugucuagugcccuugcuccagcagcaggucaaggacacaagucuaaaaggcagcuuuggggugacacggaaagaaauggaagucucuccuucuacagagcagcuuguccagguaagggugaauagugauaaguucaugugggacaugaaagaaguagcaucuuuccgcaagugcugggacagaggaaguagcugggagaugguguguuccuuuugcugcugaggagucaggagauguguguccacagaucagguaugaguuguuugcuuaaaacagggagcacacauguuuuccacaaagggccagaguguauguguguuaagcuuugcauuccaacuaucuucacugaacucccccagugauguaguuugagccacaaauagcccauaaauguggccauauuccagugagacuucauccacagaagcaggcacacaaugaagguacaguuuuguaugccugugaccccaguacuuggggugucaagagaaaaguacaaguucugcaaaugccuggccuauguaggaaccccaagcucucuguagcuguacgaugagacuagaucucaaaaaagccaaaauggggaguagaaagccagauguggcuguggcuagcaguuugccagucaggauuuaggggcaugcauaugcauacagguugcgugagaagagcuaaagcuaagccuuaaggcagcuuccugggaggcuuucgcucuuccuuuuuuauucuacaccaaccuuuaaaaaauaaaaugcaugguuuugguuuuuuuuauuguacauugguguuuggccugcacauauaucuuuuugagggaguuggaucuacuggaaguugauuuacagacuguuguaaacugccaugugggugcuggguuccuuugcaaaagcagcucuuaacugcugagccaucucucuagccugcauuuguuuauuuuuugcuuuuaucuuaccaacuaaugcuaggguuggcaaacuuugcaaaguaaaaauauagagugccugugaagcauugauuuuauauagugauuguauaagaaugguuaaaauuguccaggauauaauuauuuauauugcaaaauuauguguuaucugaaaucaagguuuaaacuugugggcuuuuuuccccugguaaauuuaaagaaaaaacuaacaaacucauucuuucuauaguaugguauaguauuaaaaacaccaaaaaauuuugacugccauccuuaacauguguggcuauuuucccccuggcauucagagcuguguuucugaugaucggauguccccacuugcuuccauagcaguguccauugggauuauugucuuuucuguucaucaguuuugggaaaugaagauccugaguuugcuuacugguguucuagaggaagugcucuauguauuuccaaggaguuacuauaaaugaaaauuaaaaaccauaggaauucagaaaauagcacagacaauaauaacccuaccuauggaaguaauaggucuuuacagggaaaaacuaaggcacaauuuuguugacaaagaccagugaaaacaaaagugaaaucugggaugcuuauguauuuauuaauuuuguuuuuguuuuuaagcauuuuaagauuuauuuauuuucugugugugcucugucugcauguacaccucugugccagaagagggcaucagaucccauuguagaugguugugagccaccaugugguugcuggaaauugaacucagaaccucuggaagcaccagggcagccuggauugcagaaugagaccuugucucaacaaaagaacuaaaaacuuccaauucacuaaaccagcaaaugcauucuuuucuaugaccugauuagcgcuuagcugaugauggauguugucuuuguuggcagcuggggcugagugacccaucuccuucaccccccugucauuccagcaccugcuuucucuuaaccgcugagccaucucucccgcccugggaugcauuuuaaacaugauguaagaccuguguuucugcuccuagguuuaugaacugacuuugcaucauacucagcaccaagaccacaauguggugacaggggcacuggagcuccugcagcagcucuuccguaccccuccaccugaacuccugcaagcacugaccacaccaggagggcuugggcagcucacucugguucaagaagaggcccggggccgaggccgcagcgggagcaucguggagcuuuuagguguguucucagcaaggucuucuaaccauugugcauggaggcauguuuccuucuguugcuuuauggggcuguacugcgcugagcuacccaugccgaaauuccuugcccaagcuuacaauguaggcgucuugcugcuuuugcaaauaaaucuacaguuuagaaagcuagaugacacaaugaggccacaccuuuaaagcuuggucuccugccuuucuggcuugucaccuccauuuuggaugcagugaaauagaaauauuaggcaguuuccaggacucucauguuugauugucagggaugaauagauuuuuaugucuuuuuuugggaauuuaguguucuuuuucuacuuggauccugacuuuagagaacccuuucuauuccucauccuugaagauaccucuuuaaccuggucucgucuuuuugaugcucaaagaguuugauccauagacuaggcauuggcagccugaccugucugacaugagcuagucuuagauggugggacagauaggaaucugggcuugccagccuuuagaagugaccuggcauuuagcaggcugugacaaauucugcugacccugacuuaucauggcuugccacaguauauacauugaggagccauauuuauuauagcuacacauuagagacagucugccugggaaauacuauugugaccuugugcgcuuaaaaauuugccuggacuaugagcagaaacuguuuuacugcuguccuuguuaaagaauuuuuauuuuuguggaaaguaugucauacacccugguaacuguuuccaaugaaagcuuaugucuggccuaugcuuguccaauaaugugagaucuuacaguuuuaauuuggcuuuuaaagagcaguuuauaugagcuuuuuugacauucuagucauaucuuuaaaacuguguauuugaacaugaguguaauuuucaccuuuaaagugugacacugugguguuuaaacauguccuauggaaauauguccacauugucuguuuuaggauuugaguuaagcuuuuugaggauuuuugaauuucuugcagauuuuagcagcuuguaaucuuacuuucuuguuacuuucuaugauuuacagcuggaggggguuccucgugcagcccuguccucucaagaaagcagaaaggugauuaucucaaaaucugagucuuguguugaguugaacugcuguuucuguguuugcauaaugcacuagauucugcuuauauuuccucucaggagaugaaguguauggauauugcuggaaucugacauuuucugcuguuuaaaaauuguuuauaucacauuaugucuaauguucgaggucaaaggucagcaaacucuauaagggaccagagaacaaauauuuuaaacaugcaggcuauagacucuuuuuuuguuuuguuuuuuguuuuuuuggauuuuugagacaggguuucucuguguagcccuggccguccuggaacucacucuguagaccaggcuggcaucgaacucagaaauccaccugccucugccucccaagugcugggauuaaaggcgugcuccaccaccacccagccaugcuauagacucuugcagcuguuucccuggcuugugacugcugaagaacaaugguauagaaacugcugugucuagcuguuuuccacuaaaaucuuaaagaugcagcugggcucagcaucacuuuagagagugcaccacuauacuuuagaaaaguaacuucuguuuuuugcuuguuucuuuuuaaacauuuauuuauuuguuuuauuuaugugaguacacugucgcugucuucggacaccagaagagggcaugcgauucccauuacagaugguugugauucccaugugguugcugggaauugaacucaggaccucuggaagagcagccagugcucucuccaaccuaacuucucuucuugaugaauuuuauuauuaggcauauuaaauaguuuauuuuguuugguucuucauuuuguucaugccuaguuaucaguuuucagacauauuuaacuucuugcauauguguuuucugaccuauuuuuauuccagaguuucugauaugaccugauaguuuuauauacuuggucacuuugcagcagcugaaauuucauuuuauauuaugaauuucuguggaaaagaauugcugucaucuuuauuuuuaaaaucuuaaaagaugaguuuguuuucuuugucauaauuugagcauuuaaaacuuaaagcucaguauuauuugcuauguuaagugaggguuuguguguuuuuccuuuuuuuaaguuuugagacggggccuuacuguguagugugagcuggccuugaacucaguaucucuuccuguacuucccacuugcuaggaugacaguacaccucacuuuugaguaaguucuucccaggaaaaacauuguaguugccauugaauuaagagaacauuuacuugaagaauuugggagcuagauguuacccggaggcugagacagaagucuuuugggcaacugggaagaccuugccucuuaaagagaaagccgaauguuugauccauugcuguaagaaauacugauuuuagaaagcauugccaauguuuaaaggagaguagaauucuaagaaauauuacucucuauucuugaucuaggagagaucacugggcacuugguaaaaucacuuugauaauuuacuccacagucacuuuguccagagauggggacaaaggugauguuauugagauaaguucucaucuuuacuauuuccugaaucuccugaugauuuuuuauuuagacuggugauuuuaaaacuuuuuuuguuauaaugaagauucuguuuuuuucaaguguuguguuggcuaguuuuugucaacuugauacaagguagagucauuuuggaaguaggaaccuuaguugaaaaaaauguccucauuagaaaggucuguggacaaaccuguuaugcauuuucuugauugaugauauagaaaggcccggcuuaaacucugggcacugccacccuugggcuguugguucuggguucuauaagaaagccaacugagcaagccaguaagcagcauucuccaaggucucugcuucaguuccugccuccaggucccuuccccaauuccccucaguuuuuucccaaguuacuuuuggucuuggaguuuuaucacagcuauagaagcccuaacuaagacaaguguaaucugccagauauaagauagauaaaaacagaguuguggagcacauagaccucagcaaaggucaaagggggccaggagucucuucucuguuggcagccccucuccuuuuuccaucuucaugggaucugcccugggggaacuuuucccagaucauaaucagccacugacuuggagaguagaaacugcuucauuaaaauucaaauucacuguucuugaguuuuauuugauuauuuuaaaccacauguuuuguuaauaaaagguucuguuuguauuuaugucuaguugcuguguugauuuuugcauagauuuguguucucuuugcuaauuagcuugugccuuuaauguuauaucauguaauuucauggaaaguaucacagcucuuauuacuugaagaacaguaacaugagaagcuaacagcuagauaguaucugguuuaguuuucccguguaugagaauauaccugaagugaauaacuucaagggaaagauuuacuuuggccacuguuucagaggucuuggucugucacagcagggcagauuuguucgagcagcaaccagaaggcagguuguuauaccuguguuggugugcuuccucuaaguuuuuuauuucaacaugagaacaaugcuacccacaccaagcaccagucuucccuuuuaguuaacccucucugaaaauucccuaaguauaucuucuuucaaucaagcugacaaguucaaaguguaacuugaugucaauuaauguuuauauauaauguaacuguaaagauauuaaaucugauuuuucuuccuaauauaacuauauaagcuauaagguauauuucuaaaauucuacuaggaaauauuuugucuuuucagauuuuuagcuacuguguagacuaaaaagauaauaaaaugaaagugacuuauuuauauguuggaguuugacauacaacuucguauuugccauggauauuccauuagaacauggauaucccaaggccugacugauagaauuggaccuuuucagucauaagcuacucauucauuuauuaacugguaguaaauuauuuaacuacaacaguaaucuaaaucaauaaaaaguuauuaugugguauaguucaauaguaauuacuucugccucuuaauugguuuuacaguauucuaaaaguuacucuuuuauccauccuuuaacauuguaguaauauuuaauuuaugauggauaaauuguacuaugguaaauuaaauaugccugugauuuucaauucagaauauaugcuuauuugauuuuugucuuuugagauagagccauuauauagcuuugguuuggacuaaaacucacuguguagauggggcugaccucacgcucauagaaacuggcaugcuuucuaucuccugaguguugggaguaaaagugugcaccaucaugccugacuauuuauucaagcuaaaaaaacccaacauuauuuuuagcaaaacuaaaaaggaauauugcuguauuauuuacuaggcaaagugcucuuaggagaggaagaagccuuggaagaugacucggaguccaggucagaugucagcagcucagccuuugcagguacucgguggcagccaugagcugccagugucagccucuaguuauuauccgccaucucgugcuccuuucagcaccucagccugcacacagcauugcgagcagcuuuuauaauucagcugcuuuuauaauguucacucuaaauguguuuggcuaugugcuuuucuuguuuuaggcuauucaaauauugauuuauuauccuugagcauauccuuuuggaguggaugauagauggaguugucuccugaauuaaauggucuaugaucaggacaguggguugaagaacugucuggguaauuuaacuugaaaggauauauuuuugcucacaagugguuacauaagauucuuuguguuuucuauaaaacacagguauuauuuuaagacacuaauaaauagauaaaaugcaaacagcuuuaguuauguuugcuguuagguaaauaaagauaagacaaagauccuuggggaggaaaccugaauaaugucaauggauuuucccugcuuacaagauaaacaagucacaggacagaaauuuugggcugccuagacuaguguaaaacucaagugccucugacccaguuuccuucaucacaagccacugcucauaccuuguucaugguuuugaagugauuuuguuuuuauauuuaauguuuuguuuuauaagacaaaccauccugucagcauucugaaagcucgcuuuuauugguauaaucucaguguucccaaccaucagaaccuuucauucccugcaauguaaaucaaccccccccuuuuuuuugcaaguucuuccaaacgucuaaggaugaauaaauguuacauacuggauuuuacuauuauagaauggcacugaagugacuuugaucucacauaguguuuguaagagggaauuucaaaauuaaacuaggaaaagauggaguguguuuauccuagaggagguuaggauuggaguggagaugaacaacacgacuuggaagaaagcaagcugauccuaaaggguacugcgcucacuaguguucuguuguugccuauguagaguuucuggaagucugcuugucccugccccagcugcuugucccugccccagcugcuucucagcaacacacauucuauguguggcuuuagagaugcaguaagagcuucagcuugaaaauauucacagccaugaagaauucacuuguucacccagcugaacugugcuccuugacuuuuucuucacuaugcuccaagcuguuuaauaguuagaacauucaauacagugaacuuuuugucauuuugcacaguuggauuccuuagcuacaguuuccucuggccauuugacaacugaguuucucugugucucuagccucugugaagagugagauugguggagagcucgcugcuucuucagguguuuccacuccugguucuguuggucacgacaucaucacugagcagccuagaucccagcacacacuucaagcagacucuguggauuuguccggcugugaccugaccagugcugcuacugauggggaugaggaggacaucuugagccacagcuccagccaguucagugcugucccauccgacccugccauggaccugaaugaugggacccaggccuccucacccaucagugacaguucucagaccaccacugaaggaccugauucagcugugacuccuucggacaguucugaaauugugagugggcagagggugcccugguucuuuugucuucugagcuuauucuuggaugcccacacuuggacccuccugcucauuuuuucuguguuacuacacauaauaguaagaggcccccagcucagaugguuaacagagagccuuguuggaugucuucacuguagaaauugccuaguaucauuuguauugagccauggagauuaaagugagguuacuuauaugcaccuuguacacaugauauauuuuuaauaccugauuaggccuguuuaaauaacuacuuucaauuuuucaaggagcuuguuauugaaaguaucuguggucuuaauguggguggugauauuaguacucuguauuauuuuuagcacuuuuugaccucucaauguacuuauaccacauuccauuuuaaaguaggaugugcauauuucuaucccugugaugucugaguucauagacaggaaucaccuuaaagauuauauaaucagaaaguuuggugcaagugugugcugaauugugggguauuuuuuguuuguuuguuuguguguuuuguuuuuuuaaacuugcuugucacuuuguuuuuuuguuuuauauuucugaaacaggguccuagcccaggcugaccuuaaauuugagaucugccugcuuaagcuuuggacucuugugaaugugggcaugaaccacacuuggccugcauucuaaauagucauuuucuucuccucuuccucuuucucuucuuaguguaguaaaauagcaaaauuaucucauagaucauuccuacaguuaagugguauauuaaucaccaccauacaccuccauuaagucuucaucuucugaaaccugaccuucuguaaaggcugugcccuccuggaagccaguggucuguuuuuuauaguacaaguuuaaggacuguagguccuucaugcaguauguuuaucaugaaguauuauccuucuauggcugacuuacuuaacauaaugccuccauguagcaugugugagaauuuucauuuuuuaagggaugauuaauauuccauugcauggauagaacuacauuuugauuauugucucaucuguuagaaaacauguggguuacucucacaucuugacaauuauggauaaugucacaauuaugaauaauaggucuacuaaguauuucaaagacucuguuuucaauucuuuuggcuauacaccuaaaaguagaauaguuucuacauccagcuuuaaguaauguaauuaaaugcuuagcuacuauagaauaugcauauaucuugauauauauguacuauagaauauaauagucuauauagaauauacauauauuacauaauauauaaccuauauauauucuauauagagccuauacauaggucuuuuugagacaggguuucuuuguauaauagcccugaguguccucuaccuacuuuguagaccaggcugguugaacucaaagagauccaccugcaucucccucccaaauacugggauuaaaggggugagcuaucacacccagccuagaauauuaaaaaaaaaaaaaaaaaaaaaaaaagcuggucuuugugaccacacacuuuuguaaucccagcucugggaagguagaaacacccaaaugggugagcuccagguucacugagagaccuugacucaaaaauaccauaaagaacaacugaggaaaacaccugacauugaccucucaccuccacacccaugcuuacaaauaugcauauacccacuguuugcuuguguuaccacuccaccucaaaccuccucccuccaccccccauacacauuccacauacacagucuuaguucggauuuuauuguugugaagagacaccaugacaaagccaacucuuuuuguuuguuuguuuguuuguuuguuguuguuuuguuuuguuuuuguuuuucgaggcaagguuucucuguauagcccuggcuguccuggaacucacuuuguagaccaggcuggccucgaacucagaaauccgccugccucugccucccaagugcugggauuaaaggcgugccuggcuacaacaaaggcaacucuuaagaaggaaacauagggcuggagagauggcucagcaguuaagagcacugacugcucuuccagagauccugaguucaaaucccagcaaccacaugguugcucacaaccaucuguaaugagaucugacacccucuucuugggugucugaagacagcuacaguguucuuuaaaaaaaaaaaaaaaaaaaaaaaaaaaaaggaaacauaauuggggcuggcuuacaguuucagagguucagucuauuaucaucauggcaggaagcaaggcaccaugcagagcaaguggugucucuuaaguucugggcuaccuugaucuacaauugaguuccaggacacccauugguacacagauaaacccugugccugugucaaaccaaaccaaaccaaaccaaccaaacaaaagagguuguuaggucacauacacguuaaagauguccuaagagguuuuaacuauaggcugcaguucuaucuuugaguucucacuggguuuacuuugcuguucuuuccagcaacuuuuuuaccacagaaucugucugggcaugggaaguauauauaaauuuaaugcagauaaccuauuguuagacuuaucuggaagccuugucuuuuuuucuaacuuauuguacaguuuguucaggaagacaagguuuuaaaaauauuaacucauugagaauugcaugcuuguauuuugagguuuaccccucaucuuucugacuaacuacucccagaucuacuuuccacuucucuuuccaaccuuaugucuuuuuuuuucaauuuuuuuauuagcuauuuucuucauuuacauuucaaauacuaucccgaaaguccccuauacccuccccccacccagcuccccuacccacccacucccacuucuugacccuggcguuccccuguacuggggcauauaacguuuguaagaccaaguggccucucuucccaaugauggccgacuaggccaucuucugcuacauaugcagcuagagacacgagcucugggguacugacuaguucauauuguuguuccaccuauaggguugcagacccuuucagcuucuuggguacuuucucuaacuccuccauugggagccuuguguuccaucuuauagcugacugugagcauccacuucuguauuugccagguacuggcauagccucacaagagacagccauaucuggguccuuucagcaaaaucuugcuggcguaugcaauaguaucugaguuugguggcugauuauggaauggaucccugggugggguagucucuggaugguccauucuuuugucuuagcuucaaacuuugucucuguacuuuuguaauaucaaaaauguuuacaaacagaaauuucuuuacguuuucuagagcuauaaaagguugguaugaccuucuccugggggagacaaacaaauaucugauuaccacagauaggauaccagugacagaccaaaguaaugauuccaccuaagucuaguuugacaagccaguuaguuuauuuaacacuacuucaaaggaacacaagccacggcuacccaccagggcaugcgcaacuuauaaacaucuauaccauugaagaguauguuuaucccagcgaucauuaaccacuuauauauccuuaggaaggagcaggguuccacaagccuauccccagaauguuacuuccuaucuagugcaggccuuguccagguggcaucccacagcaaagcuuuucuugccauaguagugaagagcucuugcuuguugcuuuuaacacaugcauuuaccuguggccacugacuagguaauugcccuuugcauucuguauguguuacugaugcaacauggucuuugcauucugcgugcucagcucuguugguggcuuuuccuucauguugaagggcuuuccccugacagucccccuuuaucuguacagguguuagauggugccgauagccaguauuuaggcaugcagauaggacagccacaggaggacgaugaggagggagcugcagguguucuuucuggugaagucucagauguuuucagaaacucuucucuggguaagcucuuauaugauggaaauguuuuuagccuuagacaucuuuaucuuuucuuguuuguuuguuuguuuuuguuuguccagacggaguuucucuuugcagcauuagcuguccuggaacuuacucuauagaccaagcuggucucaaacuuggaagaucuuuaugccucugucauccaaaugcugggauuaaaggcaugaaccaccacuagccagcgagacuuuuuuaucuuuauuucaaaaagaaaccuuuugguaucauuauuuuuuaaauugaaaauggcauuaauuuucauuucaauucaaaaugaaaauggcaauuuagguauaaucagacugauuuaaauugguacuuguauauuaucucuauauaaauauauacauauuuugauuggacuugucacuuauuuaugauuucuauuuuuaaagcccuucaacaggcacacuuguuggaaagaaugggccauagcaggcagccuuccgacagcaguauagauaaguauguaacaagagaugagguugcugaagccagugauccagaaagcaaggugagcuucauaggaaggaacagcuugugugugagggguuggaauuguucuggcuuuugccaauuccauuuguuccuagcccaucucuggcuuauuucuuuccccuagaaacacuggacacucccaggccuugucuguuuaugccucaccagggauacccaaacucuuaacaguugcauuaguucugccuccagagacuccucccuacacagaugcacccugugcugagcuccacccugccucauuugaggcuugugcagagcuuugcagcaguucuuguuuuugcucacucaacugauuaaaacaccucucucuuucucuguuugcuuuacaagcauauuacauauaaauuuacaguuaacuuaaauuccuuaaggucaggaauauguuuugucauuuaauuguaucaucaaaauuacuuccuuugagagugcucuagguucuuuuauauccuuucgaccuuuuuuuuuuucagacagggucucacuauauagaccuggcuggacuagaacucauaguuuucaguagacaauugugccuugccaaugugaacagccuuuccugaaugcuauguuuuagcaccuuccugucuagugaaccuucuccauacuaagcuugucucuugcugcauccuacggcccuguguuuuaggguuccaguuacguucuguuugagaucagcuauggggguggccaagcauaggcaucucugugucuagcacccugauguggauuacuuucgugacugaacuagugaaucaaauguuuacuucucuguucuagccuugccgaaucaaaggugacauaggacagccuaaugaugaugauucugcuccucugguacauuguguccgucuuuuaucugcuuccuuuuuguuaacuggugaaaagaaagguaagcauagcagaguagguacagaguugaggggacacuuacagguucaggagucaguuuguuggucuguuggugucugguuauuggggucguuuacuuuccauuucugcugucagagggagggaaugagagggugaguuuuguuccuuggaaaaggcuaaaggggccugggugguuccuuugcagcacugguuccagacagagacgugagagucagugugaaggcccuggcccucagcugcauuggugcggcuguggcccuucauccagagucguucuucagcagacuguacaaaguaccucuuaauaccacggaaaguacugguauguuacaauucacuuuuuuucaccagcuaauuuguacuuaagcuaucucacagucuugccuucuuuugucuuagaguaguguuucuagguagcuuauauguuucagcuguguuagaacucuccaggugugcauauggucauguucuuagucccaugacuccccuauguguaguuacauacaaaugacuacauaagucauaaaguagaaaucuggaaaugugaaaguuauuuauacacauacuuauuucuucuuaaaucauaagcugcauuguuaaauugcucugggccacauccauauuaaauugcucugggccacauccauguucaggcuaagccuggucaggacagcaccgugacacugggucugcuuuuggacauaguuguucuggaguagaaaguaucugccaccuucuuucuuucuuugagugauaaggcaaaucuguguuauugaguuuaaagauaacaaauauauaauagauugauuguuucugaucuuuauuuucaaaagaaaugucagaagcuugauuuuauuuuuuaauuuuuuuuuuuuuauuuuuggcuuuucgagacaggguuucucuguguagcccuggcuguccuggaacucacuuuguagaccaggcuggccuugaacucagaaauccaccugccucugccucccgagugcugggauuaaaggcgugcgccaccacgccuggcuuuuuuuuuaaucugacaaccuggaaucacaauuuagaaauccugacguauugagauaauuucaacgugagaacucuagaaacuaaaucccaaacaucuuuuacuacuuaggaaauuauagucagguccuuugcaaauguucccuuaagcuugcuucauuuguauauaaauuugaugauggaagaagguacagcugggccauuuauguccgcagaggaacaguauguuucugacaucuugaacuacaucgaucauggagacccacagguccgaggagcuacugccauucucugugggacccuugucuacuccauccucaguaggucccgucuccguguuggugacuggcugggcaacaucagaacccugacagguaacgggacaguuugcucuggugucuuuucuggauacucugcccauguucauguuucuauagagauauuucuugcucauuuuucugguuaggaaauacauuuucucugguggacugcauuccuuuacugcagaaaacguugaaggaugaaucuucuguuacuugcaaguuggcuuguacagcugugagggugaguacaaugcuuuacauaaacuguuccuugccuuagugagcuuaccauugauacaguuaaauuuggagcuuaauaggucacauuuccguaaguuguaaacaguucuuuuccgaaauuuaccacucagccuuugaaaaaacguugccaucauauuaaaauucauuaaaacuuuuaauucuuggacuccuuauuugaaacguucuuuucucuaaagauaguguuuagaaauauaccuuugcuauuuugaaauauaaaguuuguugaauaauuacaauuacuguuuuaagauacuagaauguugagcugcaaugaaauuauggguguuauuuaacugggccuuuacuaaaagagccuugauuccucaagugacaguaaggugaaacauuuccuauuagcugcaucauaagucacaauugggcauucaguagcagaaaauuuaacuagagaaaaucaaaacaaaaacagugauuaagucucaggaagggacuaucauucuuuuuagaaauguaauggccucaaaguaguguuuuucuagaucuaauuuuuuaaaaagauuuuauuuuuuuaaugguguauaugugugugugugugugugugugugucagaguaugucagagugugaguuucuaucugugaggguaauagcaacagaugccagaagagggcacuggauccccuaaaacuggaauucuaggugacuaugagccaccugauguggaugcugggaaccaaacucggguccuucagaagagcaguaaguaggcacuuuugaccagugagccaucuuuccagcccccagcaccauuggguuuuuuugcuuuuuuuuuuuuuuuuuuuuuuuaaguuaaguuuuaguuaguugugucuuuugagcaaugaaggcaugcugauagcacaggugcuaugcugauagauauaaguguguuauccuuguauaggauaacuacaggauaauuaaugccuuuaagcucugaggcugaagguccuauagcaauauaagauccaccuugauuccuuccuuguccaucaagaaaguugagucacaucuaagauacucuuugauaugggucucuucuccuuaugcuggaccugagacuucuuuucacauguggcaggacuauguugugucaucuuccucuaaaccagugguuaguguuccugagauugaggcucaagagucaaggcaaguaaucagaggcagaaagaaacaaaauauaaugggcacauuuacuuuuaaacucaagcauaauaagauaaagauguaucuugaguacuucugggaaccuguauugcuucuuguugcugcuuaaagauagacuagaacaaacaggugcaugcauaagagugcuguucaaagacgcggugcggugucugaccugaugccuucuguggugggaugggcuuucagcacuguguccugagucuuugcagcagcagcuacagugacuugggauuacaacugcuuauugauaugcugccucugaagaacagcuccuacuggcuggugaggaccgaacugcuggacacucuggcagagauugacuucagguaagggagccaaguuacaauucagaaguucaaauuaaaaauugaaaguccugaggucucugcaguuggcauggcugucauguguacugucuguucagcucaucuccaguuuaguuagagaacaugugauagucacaguacuuuuuauugaacucugaacuuggagauuuugcuauuuuaaaugagauaaguuuuucugguuguccuguuuuucuagaugguaggaguaaaaaaaaaaaucaguuauauuauuuuuaauuuuguccaaaccugucugucuguauuaggcauauggguuugugcacaugagugcaagugccugagaagaccagaggcgucauagccccuggggcaaaguaagaugguuuaagccucuuaacaugucugccgagacuacacuccaggucccuggaagaccugaacgcauuuuuaaaugcugagcuagcuuucuagccccacugaguuguuuguuuugagaaaccuuguuucagacuuuuaaaauaggcuaucaacucugcuugguuuuuuuuuguuguuguuguuuuuuuuuuuaauguaccuuuauucugauuuaagggagauagccgaauaguauuuuguugcaguuuaaaaaaauaacuugaggacuggggagaugggugguggccacacaagcagagcuugaguuugauagcagcaccuacgugaaagcagguguggugguaaccauagugcuggagaaguggaggcagcuggcuccaugggccuugcuggucagccacuuugccuagcauaguagggagagucccugucucaaagaaaaagguggcuuuucgccagcauggugcugaaagugaaguagagaacucuugccccucccaaaacugaagucaaagugaagacagggaaaguuuaaaaggcaguguggaaggugcccuaacaucagccaccuuccccuugggcaguccacauacccucaucagaacacuccuaggagaaaugaagcuugacagugccaccauaaucuagucuguccccuaaccagucagucaugaagaagcuagaagacaaguauguugauugugguugccaagaccaacaagcacaggaucaaacaggcuauaaacagcucugggacacugauguggucugauggagagaagacagcaugguugacuacuuccugauuaugaugcuuugggugcugcaaguaaaauugagauuaucuaaacugaguccagcuggaaaauucuaaauacacauuuuuuuaaccauuaaaugcccccacuccaaaacaaaaacaaaaaaauuccaaaauuuagcauauuagaucuuucauuuccuuagagcaaguuuuaguuagcaguucuuuuaacagucccuuuuagaagggcaauguuccuuuuuuuauucacuuuuuuugugugugugugguuauuguuguuugcuugauuuuguuuuuguuuuguuuuuccucuaugucuguguuuguaccauaugcauguagugcccauggaaucuagaaaaaggaaguugcaagccuuggaacuggaguuauagaguuguaagcuucuguagcuucugggaauugaacccugcuccucuggaagagcagccuaugcucuuaaccauggagucaucucuccagccuguuugauugauuguuaaagccacuguagaccuuguggguuauugugucucaucuucagacgaucucugaaagaaggauuauucuguuguugcaauuaggacuguggaacagggcacacagcuggucacuugggugggaguuucagugugcuguccucucuguauuuaagcucacucauggaacacuuacucaugaaguaguagguuuguauuuugaugaaaaacgguuuauccagucuuacuuguuuagucaagaauuuguagaagacaaauugccucagcugccucugagagacuguuuucauguugagcugagagcuacaggccagcacugugucugcuaagugaaugacaucucuguugaaugugcucuuuuguuaggcucgugaguuuuuuggaggcaaaagcagaaaguuuacaccgaggggcucaucauuauacagggguaagcaguucauuuugugagacugugggccccuaucuucuggaaacauucugagcagggucucccuggugguaugaauccugcugaaagccuguguugugcuauaucuucaacacuuuaugucaugaaacuugucaguauguggcauggauuugaaauaagucacccugaguucuuccugacuagcuuuccaaagugccuuccuuaacuaacuagauauagcagcccaugacuuuaauuccagcacuugggagagagaggcaggcagaucuuggugaguucagcacuagccaaccuuaucuaauuagugaguuucaaauagccaaagccacauaaugagacuguauuucaaaaaauccaaauucccccaaauaaaaaaccaagaaaaacaacauuauagaaauuaaaauauuuuuauuuucugucucuaaaguuucuaaaacuacaagaacgaguacucaauaauguggucauuuauuugcuuggagaugaagaccccaggguucgacauguugcugcaacaucauuaacaagguguuuuaucaguauuuauuucuuuacucuuugguugaaauauauaguaagagaaugggagaggcaaaaggaaucccauuuaauuauuuuaaaaacuuacuaaagugauaauuugaaaaaacaaaucacuauccuuuuauuauaaaacuaaugugcuuucauugucaaauuuguaguuuagagaucagcacuaagaaugaaagagaguucugcuucuuucuaccuccuggauguaauugcugugcacagcucugauggcugucaugggcauagguuggguuagcaucugggaaaagguguagugacgggugaauuucacauaccuccugaguagaucaguuuuccugucacggcaggcuugucccaaagcuguuuuacaagugugaccaaggacaagcugauccaguuguggcuguagcgagggaucagagcagugucuaccugaagcuccucaugcaugagacccagccaccaucacacuuuucugucagcaccaucaccagguacgcugcccccagcaccuugcuuuguucauuaacaggauauuuaucugagacaccaugguuugccacagcccccugugacaguuuaagucccuucucagucacauaacggugauguccucagucuugcaaugaguucuuuaaggucuucaucugauaauuguauuuuugcuugugaaugucacaugccaucugaaaaccaguccauggaaaaguuucacucuuuuagugaauuuagcuaaugagugggugggcugaugccaagggucagacggcuguguguagucuugauucucaggccuauauugcuagcacaugggcagggucuguuggccacguaaccucuucuaccuggccaguagaauggcagagcaaaagaucacagugaauguacuggguucguuggaaaucuaguuuguaaggaagauugcaguaagaguaguaaaacaugcccuugggacacuugucuuuuaaauucuuaagacuggauauacaggauaccuuucuuuuuuugaugauuugaaacaacaaaaacacaacucaaccaaaagacuuccaagcucaccugguaauuuguuuuuugguuuuuuuuuucccugaauugggaacucaacucaucaaauuuuaaagucauuacuccuaaaugacucucaucuuuucucauggaaaaaacaacuuuaaaaaaaaaaaaaaucaaccaccagcagcacacgguaaugaguguguaggggcaucuagugaaggagaagucaggccuuuuuuuuuuuuuuaaugaugaaaaacuuauuccagucuuuuuggaaagaccuuuugcaugcuaagcaagcgcucugcugcugagccagacccagccucauucccagccucugguuuacucuaaagucaaugcugcuuuccuuucuucuggaccuuaaucauacacguuuaaaugucauuugaucaugaaaaauauaugcuuuuagagccucugcauuuuucuuacuagaaucuauagaggcuauagcuuacugccaaguauaacagaugucaccauggaaaacaaucucucaagaguuguugccgcaguuucucaugaacucauuacgucaacaacacgggcacucacaguaaguuuucucgcuugggcuuaagauaauugccuugcacgucuuuuacaaugggaaggaccugugugaggccucucucucuugaggugcuuuauaaaaaaguguaguucuuucaacagauuccaaaguagcacauacucauuguaauauuauccaaucuaaauuguaaauuuauccaaccuagaaagucaucaaauaaaaguucuaaaaugggcuggaugauacuggcucgugccuuuaaucuuagcacuugggaggcagacgcagguagaaaaaaaccuaauauauaagaauccaauaaugguuauauuccaauuacaauaaaaugcuaaauaacauauaguaauauguuagacacguguugauguguugcuuuggagaaacuuaaugauauagagacauguaaccuaaguuuuaauguugaauggcagagauagaauaaaaaugucuuggaaauguaguuugauucuagguuaaaaaaguaauauucauauguguacagacagucuuuacaaacucagagaaaggacaagcaaaaaauugcuaggaugauuuuuaggguugugacuaacuuucauuuucuuacauacaguuuucaaguauucauaaauuuucuaaaauaaucacauguaacuuuuaaaaucagaaauagaauauuaugcagaauuauuguguaaugguuccucaaaagaccuuuauuuguacaauggaagaaauacuuggacauuguugagagucacacaguugagauuucagcugucuucuaaaugccuuucaaauuuaaauuuguucaagauaggagauucauuucaauugugaucugcacaugucaaagcaugggucugaucuggagguuuauuuuaaucauuuugagcugaggucuugagggaggaagagagaaccuucuagggagacuuugagucucccuggggaacuagaguuccuagcagaagcugcuagcugccuaucugucagcuguaacaguguuuuacugacaguuguguccagcucuuuuguuuaaaguaugcagugucuagugguaggaugacuacccuguaauugcuuacuggucucaguuuucauuucauuuguuguguguguguguguguguguguauguguguagguuuaauucaguaagccuuuggugguguuuggguaugauuuuuccauuccuuucuucugcaguuuggaugcugugaagccuugugucuucucucagcagccuuuccaguuugcacuuggaguuuaggauggcacuguggguauguacauuccucaguguacaagucagcuacccacccagagcaagcacagcugccgggucucucuuuucuacuccaacuucauuccccuuucucccuuuccauccccuccuuuuccuuuuauguuggaucucuuugccucuuuuuuuuuuuuuuuuuuuuuuaauauaugcuggaauccuuguuucugccgugugagaugugugaaauuggugagagaacuguuggggaugcugaagcaguugugacucuuaugaaugucaggugcuugaaagcaucuuuaggggucugaggguaucaucuguggacucauuaaggcauuuucauauacagguaaaaacuuucucauuaguuugauucuuucuaaaauuacuagguaauuuuaaagucaguuagcauccagaguuguaaugagcuauaagagugugcucuauuauguucccuuacaaaauaauuucuccaguagauggccuacugcugucuggguauaauuuaguuuucucagcacuaauaagcaagccuucauuugugcugaugaccgagaaacuuuggggauuccaaucauaucugaaaggaaaucuaaagauuucuucugaguguaaaauauauggccaacuaauggucucaugcuuugucaucuagaaugauuguucucuucuuugugagaaucaugacucaacaguuacagguuccagucauagguccugcacuuuugagcaacuuugacauuggagucugcuaagucagaaagggaagaaaauuugaacuucaucagaauaaucauucuagcucucucaaugaacucuauugugugauuucauuucccaagugacuuuugugaagucgugauuuacaggaagaguguuaguugauuagcaguuuuaaaaugauaauggcucacacuuguaaccucaguacuugguaagcagagguaggagguuugacacauuuugcagcacagcacuggcuacauaguguguuccaggccauggggacuacauaaaugagagugagacuuaaguaacccaaaccacaucaacaaauaagguaaaaagguaaaaugggugguucucgggggcauuaaagagcaagacuguaugcuuggaacuugauuuuugacuuuggaaaugucugcuuucagagugcccccacugagugccucugaugaguccaggaagagcugcacuguugggauggccuccaugauucucaccuugcuuucaucagcuugguucccacuggaucucucagcccaucaggaugccuugauuuuggcuggaaacuugcuagcagguacugacagagauagacuauuagacugaguucugauuugcugcuaagggguacucaaguuacaagaauacaauuguuauuuugggagacagcugguuuccuuaauacagauuugagauauugucuguuuaugugaauguguaugaagggaguaguuaugugcugaguauuuuuagguguguguguguguguguguguguguguguagguuacaagauguuuaauucagugagccuuugguggugguguuuggaugugauuuuauuuucuuccauugcacuguggauaaaacuguuuugaguuuuguuuucugggugcugugugccaggcaguggcuuggucuauagcagguaggguuguauucuucaagggguuauagaguagcaggagaugcagacagacaagcacaggagcagcagagcagauguacacuucuuauuuggucagauuuauagguuaauagaaaaggauacagcaggugagguauugcauauguaaggauuuggagaacuaaaaaguuauuuaauauugaauauaaguuacuguggauaucaccugaggacaggaguaagaauggagaauacagccagccaggucugaaaccagugaaucuacuuggggauaggguaccaggucuuagugaggaauauugacuuguucuguuugucauugauauguuuuauggagaucuccugacuugaguuugggcuggaauuuguagggaggaucagguguuuaugggaaaagacugagccaagaguguacuuuagguguagagaaaggggauagaaagcauaauggaggcagcauccccaggccugaucuccagcugcaucucgauugugaggaucacacccauagcuggaggagaguggugacuuuguggaagauuggguuuugggggccaaauagcacuuuuauguaaguuugagacaucuguuuagauguagagguucauccauauguuagcacagaucagugagaaacuuaggccacaaccucuucccaccuaacacauugcggguagaguaaugugugugccuaugucucagcgagugcccccaagucucugagaaguucauggaccucugaagaagaagccaacucagcagccaccagacaggaggaaaucuggccugcucugggggaucggacucuagugcccuugguggagcagcuuuucucccaccugcugaaggugaucaauaucugugcucaugucuuggacgaugugacuccuggaccagcaaucaagguaacuguuccuugggggcagccauuaucaucugccuaaugacuggacuuccugaacaucaugcuaguugucuguuucuucucuauuucuugcuauaaguaaagcuuauucagacacuguauuuaacauaaagauguaguuauuuuguuuuguuuuguuuugaugucagccaugaagcucagaagugauaauuucccuuuaauccccagguuccuucacuugcuuucucuuccccaucacagcaaagucuuugaagaaucauccuagucacaaagucccuccaucugcucaggcauggacuuguguguugaggucuuuggcccuuucuggcaggaaggacccuguuccccuucuugagccauccauucuuccacuccagucugucuggcuucugcugcccccuuucagaguacuuccugcugcggcagucaugucaguuguauggauucuuugacagccuuccuauccucugggcuacuuuuuaccccaagugauauggcuuucuguguuuuuuuuccaacauccucuacuguuggguucaguuuuucuuguccacuguuaaaggugcuguccuguggaucaucuacuuucuuuuuauucuugacuuucugcucuagcgggaauuuuccauguccauaccagccacaacaguagucacugaccacaugaggcacuuguguuuuugaaauguggcugugugacuuaaacugaacugacuaaauagacuauugaaucaggcugccgaugugccugcauccuuugggggcuggcuucaacucuguggaaccuuaguccugugugccugcuauauuguagaugcucugaggcugucucacaugugucagaagccucagccagagccuggccuucuuaucuucuucccuccucugaaccugcuucucuucucacacuuuguacuuuaucaggauagcaacgggagccaccauaguuuuauuucagcucacuauucuuuauuuuuccuacuaaauacuuuguuuaaaauuuauauaaagugaggugguagugguacaugccuuuaauucuagcacuugggagguagaaguagaucucugaguuugaggccagccuggucuacagagugaguuccaggacauccaaggcuacacagagaaacccugucucagaaaaaaacaaaacagcuuaaguauaccuacauauaugugcacaaacaucccuuugguguuaguguacauguucauugauucauaccuucucuuuucuggauucugguauaaacugguguaucugcacuggccuauuuuuggaaaucauauuauugaaguaauucauauuccauaacauucaaguauacaauuuaauuuuguuugagucuaggccaacugaccugaaaguuauguaucccagacugcccucugacacauggugauucucucaguucaaccucccaaauacuggcauugcagugugagucaccacauggugguggcgcuuguuauuuuuguuauuguguuguuguuguuuuaaauuauaccacagaguuauauggacaugacuacagucaacccuguaacuguaacugacuccaaaaaccuuccaugccccugucucuggauagccauuacucugcuuuuugucugugggugugcuucucccggacuauuuugcugauggccucauacacuugguggauuugucacagguucuuuauaccaaaaaugucuucaguuugauaguuccucaccugcccccugcagccuuccugccuccuuccaugcacugccugaccacagccauucauccugauaugcugcuugucuugucugcuugaugaggaucagaggugcuuagugacucacgcagucugggcuaccaucauuacagagccucaguggcuacuuauucucccaguucuaaaagcugaguauucugaccccugguaagucuggccuucucauggagaauggggaaugggaacugcuggagucucuuuucauaggagcaaugauccuauuuaugaggguccugcccccaugaccucauucugaagcucacucccuucuguugcaugcucuugauuucagcagaugaguagggcagaggcugaggccagaaagggagugaggagcacagcaaagaccugaugugccugccuuuuaccauguugugucuauccugugccaccuuucuucuuuguguguaggagccugauugucccguguauccuugggguugcauauuggagagcaugggucacaucugggcuguugacuuguuggguuuuagcuaucacauugagcaaguggcuuaauucagaacauuguuuccucacuuaaaaaugaaaauguaaauguuucacugugcuuacucaugugauguucacauaaaauguccugauugccuucucuuagaggggacauggccggggugccagugacuuuagguccuuuuaaaucccuggaggcccucccuucuccaacccauucucagugcugguaugaggaaguucagagccaugccugccaugugcaguuaugugggugaaaguagaauuaauuaucucuaguaucccagcucuuuaguaggagcucaaaggccaugaguagccugagcuaguacuuuccaauaugugguugaacuguauauuaguauuuuuaggguuuggcuccuguauuaauuuuaucccauuauauauuuuuuuauuuuaggcagccuugccuucucuaacaaaccccccuucucuaaguccuauucgacggaaagggaaggagaaagaaccuggagaacaagcuucuacuccaaugagucccaagaaaguuggugaggccagugcagguaggaaggcguuucuggagggcagagggcugccuguggugcaggaguguaagcaccguaaguaggaaagcugguccucugcaguacagucagggaggaguucucugggugcuucagaagugucugugguaaacugucacuuuacagagucaagccauagaaaggagccugcuuuucugugcuuacucuccccuucuuguaaggaagaacuccgcauuauuauuaaagaggcaaagaagauguguaggaauagauguggauggugauagucaaaaacaaacacaacaaaugaugaugguaugggaagcguucugauaaggcaaaugaggaaucaguuuugggagagguaacaagacaguggaagccagagaugauguaucuuuaaucuaacccucagaaggcagaguggauugagaguuugaagccacuuugguuuaugaagugagaacuuaccuaaaacaaagaggacagugacagaaagacacaguggagauagucaucugauuuggaggaaucuagaaaucacacagauguuuggaggggcuuuuguauuuggggagauaucaggucaaagggccagaguuuugucauagucgaaguaacagagucccaucuaugccccuuugggaugagaagcagagugaugccucugucuuguggcuacuuucuuucuguucauguucaucucacagcaggcuuuguagacaaguacccaaggaguugaagggaucugcaauccuauagguggaacaacaauaugaacuaaccaauacccccccagagcucgugucucuagcugcauaugagucagaaaauggccuagucggccaucagugaaaagagaggcccauuagucgugcaaacuuuauaugccccaguacaggggaacaacagagccaagaaguggguggguggcggagugggugggggagcgugugggggacuuuugggauagcauuggaaauguaaaugaaauaaauaccaauaaaagaaaagaaaaaaaaaagcuacggacuugaaaauguaacugaugaccccucaaaccaagcccuccaagugagaaagccuuagaaauuuagauagagaugaagagcaggagacugcucugcuugucacuuggcucuuuagucucaguguaguaauguauacacccuuuacaguuuucaaagcauguccacagcacuuaaugaauaucccagaacucguuugucucaaggucagccccauguaccucaggagccuuacuuagaccaaggggaccuguguuuggcuucagcccuucggucagcagaggacagcugaggccacagaugacuccaucagcugaugcccuucugcccaccauuccuuuccauucuuuuacucucaggcucuuaggauuuuacuuuauuccuuacuaccucccagagcacauacuucagaagucaggggaaagacuugaauguuucugcuagaccauucugaaaaguuaucauugcaguaauugcuguuaaacuuaggaaguuuuuuccuuagauuuaaaaguuuaauuuuuggguuuugguguuuuuguuuguuuuuuucuaagccucucgacaaucagacaccucaggaccugucacagcaaguaaaucauccucacuggggaguuucuaccaucuccccuccuaccucaaacugcaugauguccugaaagccacucacgccaacuauaagguacugcuccuugcuuauuucugaacauguauuccagcgggaugcauguccauguacccauguucaugcuuacauagaaagaagcccuguaacauaggauuuaaauuuugcuucucauuugucuucuagguuuauggaagcuuuacaaauauuuaggaauuuuguaugagaacaaagaucuguggucucuggguguuguuuguuuauugucuccccaagaauacuugguuuagaaagauaugccucaaggacuccuggggcucaguacagaguccuguuuauaggugaggcucauugccauguccugaagacacacagccaagccaagcagguuucaugugccuucucccucuaucagccuuaaaagauagugcaacugcccaacucaaaccaaaauuguagcuuccggagagaaaagcagaugcucacuauagaccuauaaccuugguguucuugucagcuaggguuuucugucaguguagggacucuuuugccagaugguccugauucagcuuuguauuggcuauuggaugauugugucuggguuuacauucuuuuuuuuuccccaugauuaucccagcauuaaagaaugauuuguagauuuacccuuauugauuugaaauccuauuuuuaucaaauguuaagaucucaugauuguauaguuucauuuauguuuuuguuacaucaguuguucacucauuuaauagcacauuuuaauuuuuuuauuuaauuaaugaauuauuuuugagacuggggcccaagcuugacuagaacuggccucaaacaucagugucucaaacucacagugacccaccugccucugccucccaagugcugggauuaaaggcaugagacacuaugcccuguagaagcacauuuuaaaauuauugugguuuccugauauaauccccauuuuucuuuagaauuuucuggauauuaccuauuuuuacaugugaaaauuugaauagacugucuaauucuaaaaaccauggaaauucuuucccuuuaggaucgugucugcugugugucuucccucagacagagcuaaucuaagggaaugguagacugagauggauguuuugaucacaggauaccuuucuguuuguuaaagcuccuuuccuuaccucagaaaucugagaguuaaaagaauuuuuaaaagaacuuaauagauuauucacauagcccugguauuucuuacuguuuuccaggugugcagcugcuucauugagaacuagugauaauguucagaacuucuguucaugaacucugucagcccauguagaggagggcacauguggugcuugcuguuugugcuuucguccucugucauuaggagcccuuucccaugcuucccaccuugauccucuuuuuguacugaaaccucaagcauuugcuuuuaguuuuggccuccccaauaucucagauuucuguuccuuugcucucuggcccugcuucuguaacuaacucuucuguaacuuuuaaguguuuugaguagcuguucugccguagugugucuucuuaccuugucuuuccuucacucuuaacucugagucccuuucacuacccacuccucuccugcuuccucuuguucuauuucuccucuuccccuucuauuucgccuuccuuguugucugugucuuaguuaggguuuuacugcaggcaccaugaccaaggcaacucuuacaaaggaaagcauuuaauugggacuggcuuacagggucagaaguucaguccauaucaucaaggcauaagcauggcagcaucuaggcagauguagggcuagaggaacugagaguuguacaucuucauccaaaggcagacaggagaagacuggcuuccagucaguuaggacaagggucucaaugcccaccccuacagugauccacuuucuccaacaaggccauaccuccuaauagugccacucccugggccaagcauauucaaaccaccacaauugggaaagaagcaugaugggagugaagccauuccucacuaggccuuugaucccacauauaacaucacugcauuguucugggcuguaggaucucaggucucucucacugcuggugucccuuccugucccugacauacugaggcugauuccagugcaccccagaccuagaccuguuagauuauauaaaagcaguguagagagacagaggauggaaagaaauaggcagaaccauguucauggcagaggaguauuuugucaccuacaagugaugccuaaaaugucuguagaagauaggaugcugccccuuauaggccagaaauaacucucauagucugcaagggaagcugggaaguauagucuuuaaguggcaaaccaucauuccuaacucuuaagaugauauaaaaaauucagagcaggggaguuauguauagcuguuuaaugcugaggaggguuuuugcuggaagcaguaguuuugggucuaaugaagagggguucucuggucauguaucagggagagucuuaacuugauuagcugagguggaucgggcuguugucuuauauuucugaagagacuuggaaaauaauucucagagggcaguaagcagaugacaugguuacagaguagaaguaaaagauuuccaggaagguugaggaguagggagaagcagagguagaguggacugguaagagacagugaggauagaauggauucaggguggcagugacugcuuccauuagcauaaguagcagauaacuagaguagcaaaggaaggaauaagaaacaauaaaaagacucugauuaaagaguuguacccagccggccaugguggcgcaugccuaaaucccagcacuugggaggcagaggcaggaggauuucugaguucaaggccaguuuggucuacaaagugaguuccaggacagccagggcuacacagagaaacccugucuugaaaaaagaaagaaaaaaaaaaaaagagaaagaguuguaccuggccuaaagugaaagggacgauguugcuuuuagucagcuugccucaguaucuaacagaucuuuuuauagauauaucaggagcaaauguagcuguuguaggaugagggcuauugggaaagcuuacgucaaauauuuaguuuagguguaagguaaaguucaguaagcaaaacauuuaaaagacaggucaaaacauaaauauaaguauaauaaggagaaaaagagugaucuaggggaggaagcacggugggagggaaccagaagcccacacguaggaauaggcuuguaguggacgcuuuuucaaagaaguuaagauuuacuggccuggaaacagcacguucauagaagagaacacaaaucucaucccaguguuagaccuaguccuuuuaaauuuugaaguacugcagcagucaaggagucaagcuggcccuaaaggauauuuaagcugaucagagcugaugagacagagggguuaauagaugcaaaugucuagagugguaagaagaaagaugaguuagauggccggugcccauuaguucccucucagaggugacccagauugcuuuuaugggcuuaaggggguggaucuuuauaacuaccucaaggcugaccucugagggggcagcaguuagagugucucagaugaggguccauccaaggggccacaauaaaaccuaacagaugacaaagauguagggcauaagucagaagguaaugacugugcaaccuugugaggaaauuaagagacaaaaguuaaaugaauaaaacuuugccaucaagauuaacaugaaucaaaauaagguuaaauuauaaauuuaacauaagguuaaaugcaaucauacaacuggcuggaccauguaccagagcuauguaguaggauaaaguaacuuuuguuagccguuggcuuauaucagacuccugaaugaggagagagcacucaggaccuuuggaaaagaugccaguuaaagucaggguccaagggaagcauccgaacagagcgucuccgugauagucgcugcucccaaguacgaggaauuuuguauguugucucaaauauuaauaauaaggcuauuauuuauuguugcuuaguuccuugaguuuguaagcuuucuauuguuuuguuguugauauccaucuuuaauccaugguaguuugaugggauacaagaaguuauuucauuuuucuuguauauguggaagacuugcuuuguauccaaguacguguccauuuagagaacgggcuugagaagaagguguguucuuucguguuuggaugaaauguucuguaagcaucuguuagguccacuugauuucuaauaucuuagcuccaacauuucucuguuuaguuuuugucuggauguccuguccguuugugagagugggguauugaaguuuucccuauaagugugugagggucaaugugugauuuaaguuucaguaauguuccuuucacaaaacugagugcccuuauguuuggggcauauguuggacauaguccugaguucaauucccagcaaccacaugguggcucacaaccaucuguaaugggaugcccucuucuagugugucugaagacagcuauaguguacucacauacauaaaauaaauaaauaauucuuuuaaaaaaaaacugaaaugucaucuuggugauuuuuuuucuuugaugaguauguaguguacuucccaucucugugauuaguuuugguuugaagucuaucuuguuaaauaguaaaauggcuauaccagaucauuuacauauagaucauuuauagauugcuucauagauccauuuauuuggaaauuuguuuccauuauuggggaauugagaccauugagagauaucaauaacccuugauuguugauucaugcauguuauuucuuguuauuaugguggugguggugguggugguggugguggugguggugugcauccauuuuguuuuugcuggugugagauuguuuauuuccuguguuuucauggguguaguuaauguccuuggauuuuucuucuagcaucuucuucagugcuggauuuguagauucauacuccuuaaauuugguuuuaucggagaacuucuuauuuuuuccaucuaugguaauugaaacguuugcuggguaugguagucugggcuggcaucuguggucucuuagagacugcagcacuuuuguucaggcucuucuggguuuuaggguuuccauugagaagucgaguauaauucugauaggucggcuuuuguagguuacuugaccuuuuucccuugcagcuuuuaauauucuuucuuuguucuguaugucuaguguuuugauuauuauguggccagaggacuuucuuuucuuucuuuucaggaccaauuuauuuagugauuuguaugcugcuuguaccuuuauaggcaucucuuucuugagguuagaauuuuuuuuucuucuaugauuuuguugaaaauauuuucuaggccuuggagcuggguuucuucucccuccucuauucuuacuauccuuaaauuuggucuuuucauagcaucccagauuuccuggaugauuuauaucaggaaauuuuuaaacuuaacauuuucuuugacugauguaccauuucuucugacaucuucaaugucugagcuucucucuuccauuucucauauucuauuggugaaccuugccauguaguuucucuuugaguuccuaaauuuuucauuucuagaauucccugguuuuuuuuuuuuuuuuuuuuuuugcuucuauuuccauuuucagguccugaauaguuuuauucauuuccuucaacuguuuuuuuuauuguuauuguuuuccauuuucuugacuuucuuuuaagauauuguuuucauuuuuuccaauuguuugugguuuucuggcauuauuuaagggacuuacuuguuuucucuuuaaggaucucugucaacuucauguaguugguuuuaagaucuuuuucuugagcuucagcuguguuggaauauucagggccuauggugguaggacaggugagcucuaguggagauuuauuguucuggcuguuauugauuguguuucuaacacaggcuucuaggugucuggguuuggugugauuauaggucuaggugcugacuucuguguuugucuuuguugguugggugcuuuguugcuuguuucucugguguguucagcugguguguucccagaguaugccugauguuguuggaagcugggauguagugaagaguagcagaaggaggucaggaggugaugguccaugggaugcaugcccuauggcagcaguggggaaggaggacugcagcagugcuagggaggagacggagguuuguggcaccccaccugguuuucugacaagcaugaccuaggugagcaggaauguugcccaaguuaggggcugggauucaacaaugaauugaggaagggaagccaggagaagauggucuauaggagccauggauaggggcaagaaagacugcagcugguguuggcugcagugcuucagaggagacugaagaguuggcucuaggugaacagagaguucuaaggaauuucuugaaccuggguguguccugccaguguguuauaaauuuaauucauuuuacuuaagcauucucuuuucauuauuaauuuuauauacuugauuuugaauauuguucuacauuaauuuaaacacuguaaguuuacuuuaaccuuguuuugaguuaccuguuucaggcuuaauuuugacaauauauacagaauauuaggugauagaagauagaaguaacucaagcucgguugugauggcacacaucuuuaaucccagcacuuagggggcagaaguaggcagaucugaguucauacagccuggucuacagugugaguuccagaauaguuagggcuucauagagaaacccugucuauaaaaaauaaaauguaacaaaacaaaaguugguuuuucccuccaacuuuauauuccuguaaaugaauuaauuuuuacuuagcaugacuacaaacauaguucugagcacauugaguaauuuguucauuuauaagauaaccgagcauuaacuuguauaucuuaguuaauuaaaauaauuuacaauauauaagauuaggguuuuauaauuuuauaucugauauguuuaaacuuacauguaaaaaauuacacauacacacauauauuuuuuaauaucaaguaaacuuuaaacauaaauacaguccagagagacuggccucuuauaguguacuuuuauaucagcuuuuuauaugauuuaguuucuccaaauagcuaaagcuuaacaaagauagcaaaaauaucacagguuuuuuuggaugacccaguuuuaagacaaaccaucuuggaagccugguguugccuuguuaguccaaaaaaaauaggauacagugguaagcagagggauaugacauacuuagcugaggucacaugucauacuuuaacccugaugaagucaccaaccaaaauguugggaaggugagcccuucugcauuugccuucugcauuucuaagcuagaguugaauccaauuuacauacaugguaugcuauagcacauuaagguuagcugaacauagacuuuuaccuauuaacccuuuuuuguuacaaauuuuaaguuaacuuuuguuuggaauuuuaaaccauacuuaaugaacuuauaaauccugagaugcagaacuuuacacagugcucuuauaaagccugagaugaaagaaggucuauacuuuaguaaaguuuuagagcucagauuucccauuggcaccauauguuaaauuguuaaaggaauuguagagagauggauggauggauggauggauggaagggagggagggaggaaggaagaaaggaaagaagaaaggaagggaagggaaggaaggaaaggagggagggaagcuugguuuaaccuuaggugaccacaguaaggggaauauuuuugucacccacauguggggauggccaaaaugccuagagaagaugggauaccgccccauacuagggcauaagugacuuccauaguccucaaggguagcuggaaaguguagucauucaacaggaaacuaucaagacccauucucauuuucuguucaguaucuuuucccugcauuuguccaguauucucuucaucauaggagguuagguucaaguucaguggacagauucucuuguaaaguuuuuugaacugguucuuugcaugaucagccccuccccugccaucagaaucuguagaaauaggggaauuguuauagacuucaguuaagccaaagcuuuuagaaucuucaucauccuaagauuaauuugacuacaucuagaauugacagugaccaccucccacccccaccccacccccgggauggugagagucuaggucagcaugaagaagcaccuccccgcagcagacggcauuugugucuuuguuguagauaaccagacuucgguggugccaguaaccgugugcucucuccuuccaccuugccaaggucaccuuagaucuucagaacagcacugaaaaguuugggggguuccugcgcucugccuuggacguccuuucucagauucuagagcuggcgacacugcaggacauuggaaagguuuguguguggucucuuuuccuugaaccugggucagaguaccucagaugauaccuagucacaugguguaggcaggggagacugcauccuauuuguguccuaguacuacaggaugccagggcaccuguguuaggucuguuaccagugugucaggucuuauugccacaguuuuucauucagucuagaacauguugaaaauuugcuuacagaauccuucuucucucccuugagcuuuuaaauggaaagagacaaaaccagauuaacaaagguaacugaccuacuccuuccauagcccagaaagcagaucuaagcucauucauguucugugguucugaguagaauaaaucuuccucccagcccauaugcucacacuuaauccugccauugcuaacaauuuugcuugcacuccacuagaacaucucguuucuaauauacuccacagugaguuagacagccaucuucaacuuacaucuucaagugaaauauaguccagggccugccaaccacugaugucaaaauccauucaugcuaacgcuccuuauaugaaaugguaucaaauuuugaaagccuacccacaucugcuuauaagacugagucaucuugaaaugauuuacagccucaagcauuuguaacaguuccguguaguuguuauucuguauuguuuagggaauaaugguaaggaaagacaccugcacaaauccaguacagauugaauccugcuuuucuuccucauuuguuuguuuguuugacccauacuaucaggcaacacacuauuuuacauuuucgucccuucauugcaugcagcagugccugaacuauuaacauucaucaaacauuuggucaguaaacagauacucuuuucaagaaucaguuugaaaguuggguauaguguucacaucugguaagcuagguauaauggcacauaccccuccgaggcugaacugggggagcugugguaggagcuaaaagacaauccauaucaaaagcaaaugaacagggaaaauugaugugagugucucauagaccuuagagccgugcuccauguaugauuagucugugucaucacaugacauugauaaaaugcuuuccuuuucccacuguccagaucuuguuauuccauacuaauuuuuauacauaauugaauguauuaugugcgaguuuugcuuagauuauguauaauacacauuuccccacauaucuccuuacuguucuguauuguuuuccuaugacuucucccaagacuucauacuauuuuugagugauuuuacuaugauuuagcuugaugugguuuuccuuucaguuguguuucuuguacucagguuuguugcguuucuugguuuugggcaaguauaguuuucuacaguuuagaaagguuggggcuacuuccuuauaucucuccaaccuuuuccccucacucuaucucuuaauuaccuucuaaaaacccauucuugguuacuuaaaauugcucuuaguuuacuguugcucuuuuuaaggauuuggguuugauuauucuagauucauuuuuaccauuuuuaauguguuuguguguauguaugugcgugugaguggagguguuggcagaauucagaagagggcaccagagcugcugaaguuuuaguuguugggaguugugagccaauuaauguaggugcugggaacccaacucagguucucugcaagaaagcaucggcucuuaacugucuuuccagccccuccuuuuaggucuguuuguuuuuaaucacuaucuacuuuuccuuuuguaguuucuguuacagucuuuagguucucuaaguuuuccuuuccccacaucugcucuacuauaaaaucccaucuguuauaucuuuuaucauuaacauuauagccuuucucacuagaaguuugauuauuucuuuucaaaucuccuaucuuuauuuaacuuaaauuauuuguuuauuauuuauuuguguguguguguguguguguguguguguguguguguguguguguguauacacacguguuuguuacgugggcaccuguccacauggaggccagaaaaguguuagaguccuccacuacaacucucaaccuauuucuuuaaggcagagucuuucccuaaauuagacacucccauuuuuucugcuguucuggaagccagcagguucagccuugugugagugccuacugcuccuucaaguucuucugaugauugcuucucaggccuugguuuuguuagcucccuuaguaucuuugaaguacucaaggaacauccucccccaaucuccaggggucucugaaugacuuguuuucuuggugccauaucauuugagcugccauuuucuuggggucuuuggauucacugugcccucacagcuugccuucuguccccuuguugugccacagccugggaaugcucucagauccuuaucuagggccauccuaggacuuugucuguauuuuauuuucaggaucacugauaucuauggcccgauguucaguguuugaaaacuaugauaucaaagcuggaaucuuuaaaauacauuuuuugaucauuucaggcaggagaggguaaaugcagagauggaagucucucaauauuacauuguauagugaugccugugguaguguccugauucccuguaacccuggagcuccuggaaggacaggaauuacauucuuuaucuguauuugcagcaccugguaucauuucuacagcacacaaaguguucuauacagacuguggugaggcucauuggcaguggcucucacaguguucuguucagccgaucauauuuaggacucuacaaguacagggcuuuugacuccuuugcacacuccauaaugccugcccugaaaacagguauuagauauagauacuugauuauuuacugaaugauugggugacagauugguuguguaaauguacaagaaagcaguuuuuacacaauuguagauacaggaguucuugugauuguuaagaugauuaauugaaagcauuacucagaauuucucugacauuuauauaguuuauauggucacugucuauuucugaguggcaacaauaaugggucaccuaugagucacugauguuguccucuuccuuucacaguguguugaagagguccuuggauaccugaaauccugcuuuagucgagaaccaaugauggcaacugucugugugcagcaggugugugucauuuccuaucuuuugggauuugagcuaaccccuuugggccaagugacaaagccuaguuccuuuuuggaagcuggugcuguggugugguaugaggaagaguuuggugccccuagcuaucacucccgcgugcucugugauugggacuguggggggagagggcaucaagaagcagcucuggcccucacugcuucgccuuugccaccgcaccccagugggcuuguuucucuuagaaccacagagaaucucaggcacaggggaccacauggugcgauggaucuucugggaugcuaacuccuagggauucacaacaaagccuuccaucauacguuccugcuggauuugcuacugggaaaggauugucccggcggauguuuacuuuugcuuuuguuuuuuucccuuuuauuuuuucauuagugguacuaaugguugaaccuggcuuaugcauuccaggaaagcacucuaucacugagacuuuuaaauuuuugaaauaugaucucuguagcaguucccaguuaaugcuacucagucgaucuugguggcugugguggugcuccuccuugcuacccacccaauauuuuggguuccugaaugagagacacauacaugcagccuuuauauuuuuauaugucuuaaacaccucaagaacugaaccacuuccuaaccaccauguggcuaacccacccuuugauauccccgaguuauugcuuacuacaucuauauuuuaucuuugcugcccuggacccagauguguaguccucuuggaccacaauccccugauuccuacaugguggcuauguucucugucaggcauggcaucuugguucuuccucucccaacauaguggaucucucuuuccuuucucucccuguccccagcccuggaauccuaaaagucccaccucuguaugcccugcccagccauuggcucucagcaucuuuauugaccagccagaaccaacuguggggagggucucuuggugucuuaugugugaggacacugcaaacagguuuuuaacaugauuagcauacaagcaugcauuagaccaaacccacaacauuucccccuuuuuguccauuaaaaaggucuuuucucucagauauauauugaacauaauuauaacaguuauguaaaauauaagguaugauauauauuaguguccagucauucaauuuugucaguuuaaauaaauuauucuaucaucuaucguaaccuaaguugcccaggcuuuccuggaacuugcagauugucuauuuccauccugaccacugucuauccuaaccgcuguccacuagcuggcauugcagacaggccugugcugcucaucuacauuaaauuuauauuaagugaaguacugauguuuccauucuuucauucuagcuauugaagacucucuuugggacaaacuuagccucacaguuugauggcuuaucuuccaaccccagcaagucucagugccgagcucagcgccuuggcucuucaagugugaggcccggcuuauaucacuacugcuucauggcaccauacacgcacuucacacaggccuuggcugacgcaagccugaggaacauggugcaggcggagcaggagcgugaugccucgggguaauauuuauggugcaaguuugucacugaugaugcagacacgaguuaugugcagcccuuccuugaaagucauuggcugaguuaugguguagucagcuauccagaggugacaggcuagagaggaggaacccaagcugccugugaagcauagguucuaaguuccgaaucuugcccuaaacuagaaguggcacacucacuguccucaccuguugagaguguuugguacuugcaguguuuauaguaagguggcuugugucaguggugcuucucuaugcugugacucagaggaccaccuucaaaauggcacacaguggugcucguguuuagaaguauugaagggcauaaaauagucugggguguguuguuuuuuuauuucuauaugaauuuauguuaaucuuuuucaguagcugaaauuuggaaguccuuccgucccuuucuccuucccuucagggcuuuauaugguaggcguguacuuuaccacugagcuacauuauagcccuagaagguguuuuguaaacuucuuuaccauaauuaucaaauacuugagauguuacucaguguaguaauguuagcagcauucuuacuuuccuuuuuuggaugaccagacaauauuggaaucaaggaaaaugcuccuuuucuuggauuuaucuugguagugugcuuuuaugugugugccauaauaccugcuuugcugucuuuucaaacauuuuaugagaugguucucucucuacauugccuaggcugauguugaacuugugaccuccaucagucuucccccaagaaaaccgaaugauaucaccuaucuuugaguugauuuucaccucucucaagcccucuuagagagugugcuggguagugaguuuucuguagcauugcacacucaauugaauccucuugucucuagcacaugcuacuccuaaacccaauggccuuucuaacucucauuuugaaaugaucugauuuuuuugaacaugaaguugaauugauguauggcugaguaguacaggggagaugauuaaagauauuuguuuucugcuuugggccauuuggcaggugguuugauguacuccagaaagugucugcccaauugaagacgaaccuaacaagcgucacaaagaaccgugcagauaaggugaauggcacugcagcuagagaugacaugcggauaucacugggguggaaacagagcucagacuuuucuagauuaguugccagaagauucuaauugcaacugugguuucuuucacuuuuuccuauagaaugcuauucauaaucacauuagguuauuugagccucuuguuauaaaagcauugaagcaguacaccacgacaacaucuguacaauugcagaagcagguuuuggauuugcuggcacagcugguucagcuacgggucaauuacugucuacuggauucagaccagguuugucucucggccuuguagucacuauacuuucuccuaacugaauacaaauuacccugaaaagacaccacccaagacuggcccguacuccagugggguuaggcuuuagaaauuuccacaaguuuucuacaucuguauacccacucauaacuuuauaauaagcugucuuuaacuuguaagauagaauuuuagauuuauucuggugggccaggucauuuaugcaaaauucagauuucuguaaaacaggugaucaucagccaaacagugguggcgcacgccuuuauucccagaacucgggaggcagaggcaggcagaucucugaguucaagccuagccuggucuacagaaugaguuccaggauacccagggcuacacagagaaauccugucucaauaaacuaaaaauaaauaaaacagaaacaagugauggcuuugcucagagaagcuucuuucucagaggacaguggucacauaaguaaguggucguugaguacucaacccuaaaugggacaucaggccuccucuccccucagggagcacugcugaagagggggauggaaaaaagagagagcuagaggguagggaggaaugcugugaagugugaaaugccagagcugucauagucacgaacucacagcaguuguggucaccugcacaagaucaaaccagucaaccucccagcaugacugauguuggggcucagcugauggcuguuuggggaggaaugucauuuuucuuugcaggggaguagcacauaggcagcacuaauucaacucaauggauuauaagaaaaauaacauuaaaacaucaagauaucauuuacagacuauacuuucaagcacugauguaaucaacaggcccaaucacuuuuacaccauucugggggcuguguaacuuggaucagaaccccucuucucaaacucuccuugccuuccucuugcaguuccuguggucauaaaguuccaauaguccugcuuguaauacaaauucuauuccuagggagaucuucuauccaugccuucacugagaagaaauuaucuuuagguuguugaaaauugaccaucauuuuugugcucugauuguggccuacccuuucugagugaguuacuaggaugagccaguuggggagacuccuuggcccucuuaggcucauggucauagugcaaaauguauuuaguucaacuucaaaagcauuuauagucuugcagucggaaaguacaaaguccuguuugagauuucucaauuguaauacccuuggauuuguaaaaucaaaaauuacauauuucuacuauacuaugauguagaauauacauucccauuccgaaauggaggaauggggauauagugaggaaauacuggaccaaaguaagauugaaaccuagcagggcgaacuguaagaccugaaguuagccuguaagccccaccuacccaaggacuagguaacuucccggaauacugagaguuguaguauuacaaaaaaaacaacgccacauuggggcgagcgggggguagggggggugagggggggugagggggggaggaacagauggccuuugaguuuguccuuuugugagauagaguccuaccacguagcccaggcuggccucaaacuuccaucuggcugccuuuugcccaaguccugagaacuugccugaggcuauaauuaaaaaauagacaaauuucuuugauaaagugaauuucaaagacaguauaacauugagucuguggauugguuauuacagauaccuuaugcaggucuacagugaaaaagagcaauuaggauagaaagagauaauagaguuuggagagaaaaagagcacugggaaguuuugcguuccaccucacucaugcacgagcuaggguaguuggcauagguaagugcuguuaaccagaggcuuccaggccuacaucuaccugucugccuugaccacuguguucccaaaggcaugacugaaggcacucugcacuuagcugacuucacaguagcuuugaaaaugugguuauaaacaagcuaaucuucuguguaggggcuugggaacaguacacagauggguugaagaaaugacccccgguuuuuguguaagccugugacugacggcagcuuuucucucccugcauuagguguucaucggguuugugcugaagcaguuugaguacauugaagugggccaguucagguacugaugcuuaguuacuugaguuguuguccuuguuauguacacaugugcagcccuagguccuuacagugacaggugcuuuccacuuucacacaucugaccacuugcagaaagccuuucucaagacuugcuuagaaacaggucuaaucuagccauuaguguguuuucauuucacauucauaguaugugaugaugguaacaugucacuaagugccaucuuacccagugggucccuguucccuaacuuuagaggaagcacuuuuaggccgugguuuaguaaagggagugauuguggucuuuaguugcauuaucuguaguuuuucuuguuggacauuaaaguuuuaauaaucuugcaguauguauaacagauuugcaauuuuugaaaauuacaguucuuagcaaguaguuugaaaggcgcaacaauggagaguuuugugaguuucccugagaucgagacucagcucuuguucugauuaugugacaccuugacucuguaguuuuaaccagggaacauuuucuccucggugucugaauuuuuucaggagaagaaaggaaagugaagagcuagaaaggucuuaccugcuagcauccagugcuuaaggugcagcuucacaccguaaccaucaggcucuccauguggcagaggcaggaagaccaaggguacgggugggacuaaaugaggucucagagucugcuuuaauuuaggacuuucuccugggcuugacuuguaacuuuuuuuuuuguauauguagauuacacaucuuauuuuuuaaaaaagaaaugucuaaauggguguuuuuguuucuagggaaucagaggcaauuauuccaaauauauuuuucuuccugguauuacugucuuaugagcgcuaccauucaaaacagaucauuggaauuccuaaaaucauccagcugugugauggcaucauggccaguggaaggaaggccguuacacaugguaaugugugcaucucugcuuguuguccucggucauccacuuugacugcaagugcuguguguauguguaugagggcucgucaugcgugcacauggguuagagauguuuaagaagaaaaaaggaacacauugcuuacucauaaaauuuguaaacuacuuguagaaaccauaaaaaauagugacaucauuaagguauagauagauucugauaugugccucuauuuaugaagaaaaauuuuuauuuuaccaucuuuauuugcuuuggucuuuuuuuuagagagggcauaggcucagaucugggcccucacaugugcuaagcaguuuaccuccaaucacacccuaaacucacaacauuuuacaucuagcuugucacagucaaauuuuaacuuuuguguuauguuuugucuuuuguuuguugguugguuuguuguuuguuuuucauuuguaaaaacuuguuuggagucugauagcugucucucaugagucauuuccaccuguggucucacuugcucccucuucgcgccuauagcuauaccugcucugcagcccauuguccaugaccucuuuguguuacgaggaacaaauaaagcugaugcagggaaagagcuugagacacagaaggaggugguggucuccaugcuguuacgacucauccaguaccaucagguaagaggaaagcacagggauacccacaucacagcauggagagacacgccauagccggguccuguguguggugagcagucucgggaacacugggcucucuggcgcgagggagaaagugcacuaggcuaggagcuggcacagcccagaaggcuagcagacauauggcugaccacuagaguuucagucgagaugcuaaugucacaggggcuguuuauucucaaauguagcucaaggaucaaguaauugacaguguuaaucuaaaccauuaacauuuuaaaaauaguaaaaccgucaaaucugaaauaaguagauagcauauuuaccucuaucuuaacguagucaugguuuuuguuuugguuugguuuguuguuguuauuguuguuguuguuuugagacaggauuucucuguauaauagaguccuagcuguccuaggcuugccuucuagaccaggcuaaccucaaacucacagagauuugccucccgagugcugagacugaaaccauacaccaacgugccuggccagccauguuuuuuauuugugcucauauagucuugugucucuuaagcaugagcauggacuuuacaugcuucaaucagcccauguguagaaauaguuuuuaacauuuuuguccuuuuaaaacuuguacuuuugauuauuccucccuuauuuuguuagcuccuuucagcagccuguuucugaaacuucauaaaaccacaagcuuuucuuuuucuuuuucuuuuucuuuuuuuuuuuugagacaggguuagccuuuuucaaagaaacaguacuuucuuuguuucauuuauguuuugaucaaucuuuauaauaguuaauuaaauauuuaaugcuuaguuaagccaaggcauaaaguaguuugagaguaagcacaugccuuugcuaagcacaguggagcuaguagugccuugggaauaguauacgccuugugcaugcucaucagggucugccccguggagauccucgagggcccaggaaauaagggcuugugugcauaggcaguguacauggaccuugaagcaaggcagcuuuggggauaagguaguugggcuaggcuuaacguuguauauugucucugagguggugugcauuuuuugguuuugguuuggguuuuuugagacgaaaagaacagcuuaguuuuuguggacuuccugaucuauuguagcacagaagugaauacuugaccaugcuccucuaaaaugcuaucuacaaaaugggcagugggccagaugucucuguuaccagccuuugccaggucacagguuuaucuauuuagaaugaccaaaaugaccaccaguaaacucacacucagcuuuguaugacuguuggcaagugagggccacucaacaauaaaaugccuuugcaaagagcacugaaguggauuuaaaguacauaggaauauuagauuguuccacaguauuuagucaagggaguguuugggcucuccuacagauuaauguaaguuugauuuucacuugaucccuucuuuaugaaaugucgaaauacucaucaugagucuuccggagcccagcacagcgcacucauccccuuggagguuacugcaucucuucuauggcuuuuuguucccuucacauucacauuucacagagugaagauugugugcuuuccucggucuucccuggggauuauaucucuuugaaccuuagaguuaccagcuaagcugggaccgguguggaacauggggaaguugagggccccugggccaggaagcauucugauccuacccaaacauucuugcaggugcuggagauguucauccuuguccugcagcagugccacaaggagaaugaggacaaguggaaacggcucucucggcaggucgcagacaucauccugcccauguuggccaagcagcagguuugucuucauugcccugguuugccauuauguagugugauuuauuucagaguggacugagaugcuuaugaagguugguugugaucauuauauccugacagguucuugcucugaaaguuggucuuggugcugguugugggaaaaguggcuucuuuuauuuccauuacccuuugagguugaauugucuucucacuuuccaagugagggaacacagagucagagagguuauugagguuuuccauccucacagagcuggagggugauaggucuauaguugcuuggcccaguguugacuugaaaacuaaguccuuucuuauuuuauuacccugacuccuguauucugguaagucagguauuuuauuugauccuuagcuuucuuuucuuuuuuuuuuuauuggauauuuucuuuauauacauuucaaaugcugucccaaaaguucccuauacccucccuccgcucugcuccccuacccacccacucccacucauuggcccuggcguuccccuguacugaggcauauaaaguuugcaagaccaagggaccucucuucccagugauggccgauuaggccgucuucugcuacauaugcagcuagagacacaagcucuggggguacugguuaguucauauuguuguuccaccuauaggguugcagaccccuucagcuccuugggugcuuucucuagcuucuccauugggggcccuguguuccaucuuauagaugacugugagccuccacuucuguauuugccaggcacuggcauaaccucauacaagacagcuauaucagggucccuucagcaaagucuugcuggcauaugcaauagugucugcguuugguggcugauuaugggauggauccccgggugggguauucucuggauaguccauccuuucgucuuagcugcaaacuuugucuuuauaacuccuuucauaaguauuuuguucccuagucuaaagaggaaugaaguauccacacauuggucaucucucuucuugauuuucuuguguuuugcaaaucguaucuuggguguccuauguuucuggguuaauauccacuuaucagugauugauuaucaaaugacuuccuuugugauuggguuaccucacucaggaugauaucuuccagauacauccauuuguccaggaauuucauaaauccauuguuuuuaauagcugaguaguacuccauuguguaaauauaccacauuuucuguauccauucuucuguugagagacaucuggguucuuuccagcuucuggcuauuauaaauaaggcugcuaugaacauaguggagcagguguucuuauuaccaguuggaacuucuucuggguauaugcccaugagagguauugcgggauccuccgauaguacuauguccaauuuucugaggaaccuccagacugguuguacaagcuuguaaucccaccagcaguggaggaguguuccucuuucuccacauccucgccagcaucugcuaucaccugcauuuuugaucuuagccauucugacuggugugagguggaaucucaggauuguuuuaauuugcauuucccugaugauuaaggauguugaacauuuuuucaggugcuucucagccauucagguuuccucagguaagaauucuuuguuuagcucugaaccccauuuuuaaugggguuauuugaauuucuggaguccaccuucuugagcuauuuguauauauuggauauuaguccccuaucagauuuaagauugguaaaaauucuuucccaaucuguugguggccuuuuugucuuauugacaguaucuuuugccuuacagaagcuuuguaauuuuauggggucccauuugucaaugcucuaucuuacagcacaagccauugcuguucuguuuaggaauuuuuccccucugcccauaucuucgaggcuuuucucuacuuucuccucuauuaauuucagugucucuggucuuauguagaggucuuugauucacuuagacuugagcuuuguacaaggaaauaagaauggaucaauucuccgaugcucauggauuggcaggaucaacauuguaaaaauggcuaucuugccaaaagcaaucuacagauucaaugcaauccccaucaaaauuccaacucaauucuucaacgaauuggaaagggcaaucugcaaauucaucuggaauaacaaaaaaccuaggauagcaaaaacucuucucaaggauaaaagaaccucugguggaaucaccaugccugaccuaaagcuguacuacagagcaauugugauaaaaagcugcaugguacugguauagugacagacaaguagaccaauggaauagaauugaagacccagaaauguacccacucaccuauggucacuugaucuuugacaagggagcuaaaaccauccaguggaaaaagcuggcacaacugguaguuaucauguagaagaaugcgaauugauccauuccuaucuccuuguacuaaggucaaaucuaaguugauuaaggaacuccacauaaaaccagagacacugaaacuuauagaggagaaaguggggaaaagccucgaagauaugggcacaggggaaaaauuccugaauagaacagcaguggcuugugcaguaagaucgagaaucgacaaauggggccccauaaaauugcaaagcuucuguaaggcaaaagacaccgucaauaagacaaaaaggccaccaacagauugggaaaggaucuuuaccuauccuaaaucagauagggaacuaauauccaauauauauaaagaacucaagaagguggacuccagaaaaucaaauaaccccauuaaaaauggggcucagagcuaaacaaagaauucucaccugaggaauaccgaauggcugagaagcaccugaaaaaauguucaacaucuuuaaucaucagggaaaugcaaauuaaaacaauccugagauuccaccucacaccagucaaaauggcuaagaucaaaaauucaggugacagcagaugcuggcaaggauguggagaaggaggaauacuccuccauuguuggugggauugcaagcuuguacaaccacucuggaagucagucuggagguuccucagaaaauuggacauaguacuacuagaggauccagcaauaccucuccugggcauauauccagaagauguuccaaccgguaagaaggauacaugcucuacuauguucauagcagccuuauuuauacuagccagaagcuggaaagaacccagaugccccucaacagaggaauggauacagaaaaugugguacauuuacacaauggaguacuacucagcuauuaaaaagaauaaauuuaugaaauuccuaggcaaauggauggaccuggagggcaucauccugagugagguaacucaaucacaaaagaacucaaaugauauguacucacugauaaguggauauuagcccagaaacuuagaauacccaagauauaagauaaaauuugcaaaacacaugaagcuugggaagaacgaagaccaagguguggauacuuugccccaucuuggaauugggagcaaggcaccuauagaaggagcuacagagacagaguuuggagcugagacaaaaggauggaccaucuagaggcugccauacccggggauccaucccauaaucagccuccaaacgcugacaccauugcauacacuagcgagauuuugcugaaaggacccugauauagcugucucuugugagacuaugccggagccuagcaaacacugaaguggaugcucacaaucagcuauuggguggaucacagggcccccaauggaggagcuggaggaaguacccagggagcuggggagaucugcaacccuauagguggagcaacaauaugaacuaaccagugcaccaccaccaccaccaccaccaccaccaccaccaccaccaccaccaccacccccagagcucgugucucuagcugcauauguaagaagauggccuggccaucaguggaagagaggcccauugguccugcagacuuuauaugccucaguacaggggaacgccaaggccaagaagugggugugggagggugugggggacuugugggauagaauuggaaauaaaauacccaauaauaaaaaaaaguguaaaaaaaaagaaaaaaaaagaguggaucaauuugcauucuucuacaugauaacugccaguugugccagcaccauuucuugaaaaugcugucuuuuuuccacuggaugguuuuagcucccuugucaaagaucaagugaccauaggggugaggauucauuucugggucuucaauucuauuccauugaucuacccaucugucacuguaccaguguacuaugcaguuuuuaucacaauugcucuguaguacagcuuaaugucagacauggugauuccacuagagguucuuuuauuguugagaauaguuuuugcuguccuaggcuuuuuauuuuuccagaugaauuugcaaauugcccuuucuaucucagugaagaauugaguuggaauuuugauggggauugcauugaaucuguagauugcuuucggaagguuagccauuuuuacuauauuaauccugccaauccaugagcaugggagaucuuuccaucuucugagaucuucaauuucuuucuucagaggcuugaaguuauuaucauacagaucuuucacuuccuuagguagagucacuccaagguauuuuauauuauuugugacuauugugaaggguguuucccuaauuucuuucuuuuuccguuuaucauuuguguagaaaaaggccauugauuuauuugaguuaauuuuauauccagcuacuucacugaagcuguuuaucagguuuaggaguucucugguggaauuuuuggggucaguuauauauacuaucauauuaucugcaaauagugauauuuugacuucuuccuuuccaauuuguauccccuugauguccuuuuguuguugaauugcucuggcuagaacuucaagcacuauauugaauagguagggagaaaguggacauccuuaucuagucccugauuuuagugggauugcuucaaguuucuuuccauuuaguuugauguuggcuacuggucugcuguagauugcuuuuauuauguuuagguaugggccuugaauuccugaucuuuccaaaacuuuuaucaugaauggguguuagauuuugucaaaaucuuuuucagcaucuaacgagaugaucaugugguuuuugucuuugaguuuguuuauauaguggauuacgcugauggguuuccauauauuaaaccaucccugcaucccugggaugaagccugcuuggucaggauggaugauuguuuugauguguucuuggauucgguuugcgaggauuuuauugaguauuuuugcaucgauauucauaagggaaauuggucugaaguucucuuucuuuguugagucuuugugugguuuagguaucagaguaauugugacuucauagaaugaagaauaggguagaguacuuucuguuucuauuuuguggcauaauuugagauuaguuggaauuaggucuucuuugaagaucugauagaacucugcacuaaacccaucugguccuaggcuuuuuuugguugggagacuauugaugacugcuucuauuucuuuaggggaaaugggaauguuuagauuguuaaucugauccugauuuaacuuugguaucugguauaugucuaggaaguuguccauuucauccagguuuucuaguuuuguugaguauagccuuuuguaguaggaucugaugauguuuuggauuuccacagguucuguuguuauaucuccuuuuucauuuuugauuuuauuaauuaggauacugucccuguacccucuaguuagucuggcuaaggguuuaucuaucuuguugauuuucucaaagaaccagcuccugauuugguugauucuuugaauaguucuuuuuguuuccacuugguagauuucagcccugaguuugauuauuuccugccaucuacuccucuuggaugaauuugcuuccuuuaguucuagagcuucugggugugcugucaggcugcuaguguaugcucucucuaguuccuuuuuggaggcacucagggcuaugaguuuuccucuuagaucugccuucauugugucccauaaguuuggguauguuguggcuucauuuucauuaaacucuaaaaagucucuaaucuaucucuuuauuucauccuugacaaggaaucauugaauaaaguauuguucaguuucuacgggaauguuguaucuguugaggccuguuuugugaccaauuauauggucaguuuuggaggagguacgauguggcacugagaagaagguauauccuuuuguuuuaggauaaaauguucuguagauauuaauuaaauccauuuguuucauaacuucuguuaguguccaugugucucuguuuaguuucuguuuccaagaucuguccauuggugagagugggguguugaagucucccacuauuauugugugaggugcaaugugugcuuugagcuuugcuaaaguuucuuuaaugaauguggcugcccuuguagaguuccucuugguagauuuuaccuuuguugaguaugaagugccccuccuugucuuuuuugguaacuuugguuuggaagucaauuuuauucgauauuagaauggcuacuccaacuuguuucuucggaccauuugcuuggaaauuguuuuccagccuuucacucugagguagugucugucuuuuucccugagguagguuuccuguaagcaacacaauguuggguccuguuuguguagccagucuguuagucuaugucuuuuuauuaggggauugaguccauugauauuaagagaaauuaaagaaaaguaauuguugcuuccuauuauuuuuguuguuagaguugggauucuguucuugcggcugucuucuuuuagguuugcugaaggauuacuuucuugcuuuuccuagcguauaguuuccauccuuguauugguguuuucccuuuauuauccuuugaagggcuggauucauggaaagauauugugugaauuugguuuuaucauggaauacuuugguuucgccaucuaugguaauugagaguuuggcuggguauaguagcuugggcuggcauuuguguucucuuagggucugcauaacaucuguccaggaucuucuggcuuuaauagucucuggugagaaguauguuauaauuuuaauaggccugccuuuauauguuacuugacccuuuuuccuuaaugcuuuuaauauucuaucuuuauuuagugcauuuguuguucugauuauuaugugucgggaggaauuucuuuucugguccagucuauuuggaguucuguaggcuucuuuuauguucaugggcaugucuuucuuuagguuugggaaguuuucuucuauaauuuuguugaagauauuugcuggcccuuuaaguugaaaaucuucauucucaucuacuccuauuauccguagguuuggucuucucauuguguccuggauuuccuggauguuuugaguuaggaucuuuuugcauuuugcauuuucuuugauuguugugccuauguucucuauggaaucuucugcaccugagauucucucuuccaucucuuguauucuguugcugaugcucgcauauaugguuccagauuucuuuccuaggguuucuaucuccagcguugccucacuuuggguuuucuuuauugugucuacuucccuuuuuaugucuuggaugguuuuauucaauuccaucaccuguuuggucguguuuuccugaaauucuuuaagggauuuuuguguuuccucuuuaaggucuucuaccuguuuagcaguguucuccuguauuucuuuaagugaguuauuaaaguccuucuugauguccucuaucagcaucaugagauaugauuuuaaacccgagucuugcuuaucggguguguugggguauccaggacuggcugaggugggagugcuggguuccgaugaugguaaguggccuugguuucuguuaguaagauucuuauguuugccuuuugccaucugguaaucucuagaguuaguuguuauaguugucucugguuggagcuuguuccucuugugauucuauuagccucuaucagcagaccugggagucuagcucucuccugagucucaguggucagaguacucucuguaggcaagcucuucucuugcagggaaggugcaccaauaucuggcguuuggacuugccuccuggcugaagaugaaggcccgauagagggccugucucagaagcuguguagcuucuguaguccacacucucaccugcgcagacuagucucugagggaaccaggacgaaagauggcuuccccaggugcuccagcagagcccuuccaggcgggguggauaccucuccucugucggggaaggugcccagaugucuggaucccgaaauggggucugucccagaagcugugucgauccuuagcuuucuuuauguuuauuuguuuuuucauagcacuuacaaaguaaccuagcaauaauuuaugacuuagucagaauuucuguaaucagaugacccuuacuaguuaauuaagaaaaugcaguaguccggcugugccauaucuuguggaaacaaagagcccuggcuccuggacugugugguccucagaacacaggaaccugugugacucucaccaaagcaccauuacaacagaagauagaacacagagccugucuauacacaguccuaccaggaagucugagcagcugccagauggaucucuggcuaugcuuugaaugaaacuccuaacagaugacaaggcacuacuuugaaauagguucuguagaaagcacaagggagccauguuucucggcaucucauaaacucuuuuaggcauacucuauugguaguugcugucugcauaugcuaggcagaauugcaggcacugauaggaaaaauuucacugaagaaaauguauugaaaagcaguguucucccaccuagauaacaaugaaauaaauacacuauuaaaguauauacaauaucagaggauaguaguuuugauggcagaggaggaggguaguguaggguagagaaugcauuuguuguucuaacagugacaaaaugagaaagccuuuuuuaggaggugacauugaguaaacaugauucuagcaguuaccugcaagagaguguuucagcagagcagagagaaaagcaagucccugggauugcagcaugacauuuggauacaagcuagucccaggaaaaggaaggaugggaggguagacauagagaaauaguguccugaaacuuugcuaagguuacugcugagaguaaaaugcaguggauacacugcugaaaguaaaaugcuuuuaacuuuuaacugcgaggaugauggugauugugugccccagaggcgcagugaugacgugugugaagcugcuauucccaucguauuacagacauauccaugaugcuuaauuccacagaugcauauugacucucaugaagcccuuggaguguuaaauaccuuguuugagauuuuggcuccuuccucccuacguccuguggacaugcuuuugcggaguauguucaucacuccaagcacaauggugagugucaccauauguuugggaugcacuggaggaagaucccagcccaggucugccacagcuggugagggaggacuugaggguuugcguuuuaccaaaucuccaaccgagucugaucugcuucucugggaccauacuuggaaccagugcucuagggacuuuucuguugaaugauuuucuuccaugggauugacaagcagggaaaauuuaaucuuuccuuagcuuuagcauaugcauuuucuuuuucuuuuucuuuucuuuucuuuuuucuuuuuaggcaucuguaagcacugugcagcuguggauaucuggaauccucgccauucugaggguucucauuucccagucaaccgaggacauuguucuuugucguauucaggagcucuccuucucuccacacuugcucuccuguccagugauuaacagguuaagggguggaggcgguaauguaacacuaggagaaugcagcgaagggaaacaaaagaguuugccagaagauacauucucaagguauguuuucugucugaaccuguaaacugaccaugucuuuuagcugauccuauggugucgcagcagcaguagccaacaauaaucacuguucuuuagugaggcugauaucacucaccuagcuuuuuuuuuuuuaagaaaaaaaugaaaagauuuguuucuuuuuauugauuguguaugaguguuuugccuaugaguaaguaaguauacuuagggugugucucauacccauggaggccaaaagaaggcauugaaucucuggaauugcaguuucagacaguugaagugucauucucugaacccagguucucugccagaucagcaaguucuuuugaacccugauuuuucuucuuaccuuccucaccuuuuuuuucaugucuuuccuaaggucuguccuugugacagacuugacaagaguggcucaccaugauuaaggagggguggccuucccugcaugcagcccaguaaggggugaauugccuguagcauggucaaagccuaggguaagccacugagaagcagcccuguacuuauuuucaccaugugcuacuugaaggaccuuucguugccaaggucaauagcaucuaccagauaccugcaggaucagcucacaugcuacacacacacacacacacacacacacccggugugcuagugccucaagggcagugacaggggagacugcuuaucaacgcucugcacagagaaguaucugugacuccuagaguuuucacuaaguuagagcugugcugcagaugugcuccuuaggaccucucauuugcagggguaagcaccuguagucucugauaaacacacgaugccuuuguguuugcagguucaacuggcagcccauugcuuucccuccguuagguugaaggaguggcuaaaacugauguuacacuaaguuucuuuuuuuauuucuuuuuuuuuuaauugaguauuuauuucauuuacauuuccaaugcuaucccaaaagucccauacacacucccccacccucccacucccacuucuuggcccuggcguuccccuguacugaggcauauaaaguuugcacgaccaaugggccucucuuuccacugauggccgacuaggccaucuucugauucauaugcagcgagagacacgagcuccgguggggugggggguauugguuuguucauauuguuguuccaccuauaggauugcagaucccuucagcuccuuggguacuuucucucgcuccuccauuggggcccuguauuccauccgauagcugacugugagcauccacuucuguguuugccaggcccuggaauagucucacaagagacagccauaucuggguccuuucagcaaaaucuugcuaguguaagcaauggugucagcguuuggaagcuuacacuaaguuucuauggcgaauuaccgucuuauauuuauguaacacuccuacagcugauaaagcuuaaaaaaauacauugucaauuugccuugaugggccuuugaaagugguaugauuaccauuucacauuuaaagaagguaauagagagaaggagagacucaguccacagugauggucugaaacauuucacuugguuuaguguacugucuuuguguuuucuuacuuuacaaaaaccaauggucuuuauuucacacugugcuuagcacagcucacugaucauggccuaaucugcuguuaugugcucccuuucuuggaagguuucuuuuacagcugguugguauucuucuagaagacaucguuacaaaacagcucaaaguggacaugagugaacagcagcauacguucuacugccaagagcuaggcacacugcucaugugucugauccacauauucaaaucugguaaguggauccgauuagacuucauaauacuuuguguucccugucuccagcagugcccgcuucucauagaaacuguucuccauguuccuugugccaugugagaaaauguugauaguaggagugaaucugauaccaugugguccagcaauuacauugauaggcagauaccugacaggaugaggagcagagugcuuggaagauagcuguauacuaaucuugauaguagcauucauuacauagcugaaagaagcaacucugacauccaaugcucagcugguugauaagccaaauauggcauauacauaaguuauagagucaaaugugucuaugugggauauuuuucagccugaaaagguaaaauaguucugacauaagaaacaacaugggguguuggagacauagcuccucaguuaagaguauuugcuguucuugcagaagacccuccuucacuucccagugaagaggcucaccauuacuguaacuccaguuccagggaucugaugcggucuuuuagacucuaccagcaccagacauacacaagcugcauauccauacaugcaggcaaaacacucauauacauaacauuuaaaagccaacauaggugacccuugaagacauugugcuaagcaaaauaagccaggcccaaaaagacgauggaugagauacucagaguacuccaaaucuagagacaaaaaacaaaaugguaguugccaguggcuuaggagaggauuuaaugacuuuggauuuucaguuuuacagaugauggugauauuguauaacauaagugcauuuaauaccagaacuguauauuuaaagauuaucaaggugguaaauuuuauuuuauauguauuuuaccacaauaaaaaauaauuggaggcccauaggccuuaguagauagauguuuguaagcaacccugacaaccuaaguaugaucucuaagacaaacauggcagaaggagagaaugaacugcuuccaaguuauucucugccuccagguacgugcaccccaccaccaccaguaaacaaauaaaccuaaagagucaugcugggaaugcagugaauccauugguagugauugccagacacguacaaaacccugguuuugaucucuaccuaaccuaaacgugauggcaccccagagaaucagaaguucaaacucaucuucagcugcauagagaguuugaggcaggacgaucuacaugaagaccugucuuagaacagaauauuuuuuaaacuuguuuguuuaauuggugggguguaggugggagugugauaugguggcuucauccuguagucuucguagcauauuuccacauuccagcuuuaguuucuaucauggccuugcucuuugggggacucauuucauguggcagaaguagggccucuagccaccguggucugagccucugaaguaugcugauuagccuccauucacccauguaggccauaugagcuccuagcugcuccgaccaacuugagcagccuucuuuugaaggggguguguugccuccugggcagaaaggaaaagaaacagaugaugagcggauaguuugggccagagaaacuguuagaacacuggaggcaacuucuagaaacccagccagaagugccaggaaauggacgauguggcagaguguuucuccagucagaaggugugcucuguauuuggaguucuaugugcauuuuauguacauaucuuggagaaaaaaguaguuauuguccuuagccuucauccaacaggacuuauauucuuaccuguugcuauacugggcucugacguacuggguugagacaagcagaugugcuuuuugugcccuuguagagcuucacagucaguggggaggguaguacagcaauacacaaccacugucccaggaaguucauugguacacauuucugagggugccugguuuaucugguuuacccaaagaggucagcagaaucaaccuuuggaguuggaagaacaaacuagagaaauggaguugagaagagaguagagaguaaagcaagcugcucaggugaacagagagaaaggcauuauguagacugccucccuuguaucuggcacccuuggcauaguagugugccagaauuuaauuuugauaauggguguuaguuucaaacuauauuuauuccuaauauugauuuagguauuguuuuuugucuaaagauuuauauacuuguuuguugugugugcaggagagagacaggcaggucaugugcaugccaggaugggcaacuccucaggaaucucuucucucuuuccaccuuguuuugaggccgcuucuucuguuucugugauugcacugccaaaaagagcuuuucaccaauccuccugucucugccuuccaucuugccguacaaauuaaaugcccacccccacaucugacauuuuccauggguuuuggggauuaagcuuguacaguaaguguuuuuacuaacugagccaacugucuggcccuuaaagaucuuuugauuuaugcuucauuggucacuguagcaaauugaaagucaagaaguaugccuguuuaugaauagcaaguuguuuuuaguuuguuggucacuuuaauauuuuccauugguugguuuggaucugauaccagaagagcuuucucuugccuucuuuggaugguagaugucuauguuguguccugcucaccuggugggcugccauguguggcugcuauaugguuucacuacuuacuauccaguugcucuagcuucucuugcuuccuuuuucaggaacaucaaagaggaaaaagauucaagggcauauuuuuacuguguguugugucaguguuguccagcaaagugaccuuuagcugcccagugacuggguagcuaaugcagauagcauaucuuagguacuuugugacuuuguuuaacuucagacacaauggcuuaaauggcuucauguggucagugguuccacuuuuuuuuuuuucaucaugcauacauccuucuggaagaacauucaaugguuagacauacaggcuuugcccuagugcugauagauuauauauaaaugucuauuucuuauuuaguaugacacuaggugucagaacuacuguuuggguauuugcuuggucuuaagauuggguugaaguaaacagcuauguguuuauaaagauauauauuuaggucucuugacaguuauccuguuugcuuggguagccccuugugcuuccgucugcuggcuguggcucaguucuguguucucccagguguggccugaauccuuuccccuguguuggcuggcucuuucuggccaccugugucuaggccuccacagcagcuguuuuggggcuccuaaagaauguggcaauugagccuggcagugguggcgcacaccuucaauccuaguacuugggaggcagagacagggggauuucugaguuggaggccagccuggucuacagagugaguuccaggacagccagggcuacacagagaaacccugucucuauacccugucucgaaaaaacaaaacaaaaagaaugugucaaucaucagaggugcaaaaguggacugacuuguuaaguaaguugugccuguuucugcuuagaaaaguuagaguuuggggcuggggaaaacccuaaucagagaagugcuugcagugcaaagugugagagcugaguuuggauugccagcaccuuauuccaagcguuccuuggcagccaguauaucuaaucagugagcuccagcuccagguucaguguaggagaccuugugucaaaaaaucagauagagaaguaauauugacccuacaucagcuuuuaacuucagcacauauguacccagguacacacaugcauccucacguacauagaagcacaaguaugcacacacaaaggccacaauuuucuaagugccaagugcuauaaaaguauggaaaaggacaaugaauaguccuuggucaccugguacuggaccagguagaacaguagaggcauaccccauaaucuguuuuucuuauuuuuguuugguucuaggaauguuccggagaaucacagcagcugccacuagacucuucaccagugauggcugugaaggcagcuucuauacucuagagagccugaaugcacggguccgauccauggugcccacgcacccagcccugguacugcucuggugucagauccuacuucucaucaaccacacugaccaccgguggugggcagaggugcagcagacacccaaguaggugcacagcuccccagggccaggccccagcccaguguuuggccugaggcaaagcugcucugagagcauucucauuuuccauucuuuauaaagcuuuguaaaauucaggcugcauauuaaucuuucuuucauggguacuguuuuguagggaaauguggucuggcuacaggcauucagaccaaacuguuugacugugauuuucuuugacaagcgcuuugacacuguuccaucguuugggcuaugcuugucaggcucuaucccuccugccacguccuacggcucucauugguucuacagccagacauguugcaaugucuuaacuuuguuaugaguaaauguguucuggguauucuuagauaaugaaguaauuauuuagcaaauuucgaaacugauuggaaguauuuuauuaauuuauuuuuacuauucagauagacuguuucugguuguggguggcccucuuuuuuuuugcaaagaguuuguagucuuaaaucucagugcccagguacuaacugacugacuugcucagucagcucuaugagcauguuugggagcuagaagcugugagccccgaugagucggucuucagugugcuuucuggacaguuuaugaacacuuguggggaaauuuuuccuaaggaaaaguauagguauuguuagcucuucagcuugguguagggagaccagagccucccauccagacaugcuuuuacaucccuguguccggcauuuuuugcccaucugcugugugcucuuuauaaugucaucugcaaaggaaauagaaacacuacuuccugcccccacgugugaucacuuggagagguacccacaacaucauuugaaaugcuuagaggaucucuuaagccugucacauuaacugaucauuauaagagcuaggacaggaagccagcuacauagcucucugguucuuacauguacauguaaaucagcccugaaacugcuuaaagcauuucaguccaggaagcuucguaggggcuaggaguuugcacauauucuaagccccugcugcugccagugcgguuguugcacugaugcucuagcacagggacagcucagcaccaccaguguuccuuccuuucuucucuuucuuucuuuucuauuuuuucaguuuuuuuaaaauuuuuauaaaaauguuuuuauuugaaauagaaucacaucauuuccccccuuccaacuacccuccaaagccuccucuauaccucucuucucacauugauagccuuuucuccaauuuguuacauaaacauguaaaugguauguguguguauguacaguauauauaaguucaauuuacugugucugauuuuguuauuuguguuuauauggauucauuguuggcuacucuacauuagacagccaguaagcaggcucaucccuggaagaggcuaauucuccuuucaaaaaguuauuagcuacuuauauuuuuugucuagggauaagaucuaugaaaacuucccccauccauauuaauauacccaugaacacugccuuuauuguagucuuauuuguguauccauuucucuccuagaccgcuucacagcagacuuucugguauucuggcccuuacaaucuuucugcuccucuuucauaauguucccugagccacagaugcaggaacugugauguagauguauccacugggcuagacuccccuacaguccauggaucucuaguuuuguccaguugugguuuucuaugauugucuucauuugcuauaaagagaaguuucuuugauaagggugguagcuacaaauugaagcucagagcuguguauaaugaagucuaucuuuaaucucagccuucaggaggcagaagcagguggaccucagucaauucaaagccagccugaucuacaaaccaaguuccaggccugccagugcuacacagaguaaacuugucucaaguaaauaaacaaaaaccuggcagcuuugaccuuaguaaggagacucagugcauaaaggaacuuccugcuaagccugagacuugaguucuaacccuaagacccguaugguaaaaagggaaucuguucccauauguuguccucugauauccacaggcacaugggugcacaggcacacaaaucauuuguuuaaaggcuuaaaaaacaaaaauaauuggggccugagaacuugcaguagguucccaggacagucuaguaaacauccaagccugaguuguguuggguaagacacgggagccuccauuaacuauggaugagccaagaaggcaggagaagguaagaauggcuuuagcccacaguaagccauaauucucagcaacaucugcccacccgguugguguauaauaguguugaagauuaaaagacauacuaugguuuguucaagaggaaaauggauuuugaccuuagcugauggaucuuuuaccaagaugucuacuggacacgcugaaacaucugugguaaaagaugaaaguguuauguuaauagaagaaaacaaguaggacaagugaauuuauuuuagaauccuuggcugugcucuggaucuggaauauaagacugcuagaaugauuauuauuggguagucauaaauauaaggaugaguuuucugugagugauggcuuuguagcugugaacauguuugggagacaacugcugcagaguuuauagugaagugugcucuggaaucauucauccguguugcagccaaagaaaugcaugugugcaaguauucagacugcaauaacguuucacaugagugugcaguguguguagaguccaaguaggauauuugguaugaaccuagucugcauguguaaaguguguucaugaauucaaacaugaccaauauuaauaguugaauauaggcaaaaaucaagggcuguucauugaauuguuccuucaagcuuuucuguuugacacuuucaauaaaccggggaagaagguggaaaagauagcaaucagagucagcucuuaggccuuacuauaaggggauuggaacuaugagaauugggaucauaguuucuuuucauuuauauuugugugugucucucucugucucucugucuguuuugucugucugugucuguguuaaugugccugagcccacauguagaggucagaggacaacuuugaggagugacucagucuucuucuuccacuguggaauccagggauugaacucagguugccaggcuugugcagcaagugcuuuuacuuguugagccaucuugccaguucaagaggggauuucuagugauagaaauaauaguaacauuuauccaaagggcuacagauuggaguguacagaagaagcuuccuugaguuggugaaugugggauuuggacacaaacauugguuuuauuguaguaguuauugguaguuuuucaaaguugaaauuacaguuucuuucuuuccuuccuucuuuauuauguguguugguauuuugucuguaugagggugagaucaccuggaacuggagugauagauaguaguaggccaccaugugggugcuuggaauugaauccacuggcuggaagaauagccagugcucuucaauacuaagccaucucucuagcuccaaaauuaccacgucucaccauacacaauauauuaaaaugagaaaccuaucuaucacuuucaguuuuuagugcaguauucuucagagaagccgcccaugcuuuuccucauuugcuuagaucucaaggucugcacuuagguaacuucugcuccucaguagcaaggucauaauugagcauuauuugugugaugauuugauuaguagcugucucuucuuucuaugguugcuguuauauuccagucaguaccauuucacauucaaaccauaacaaugucuccugcuaauuauuuaauugcaaauuucaccuauuguacgugaguaguucuucgcuguacauguggcuaugaguguaagcuacaaagcuccagcugugaaagggcagggguucuguauauguuuccuaacugacagagggugccuggugaaaugccuuuuguaccaucuguugucagauacaaacaguaccaucauuccaggaaguucccucuugucccuuuaucaccaucccuucccuuguccauaagaaccuccgugaauacucugugcccagagcagaaauccauggaaaugaacacugcauccgguuguugaucagcaaccauugaucaguuuaaaguuuauuucccugguggugaucuguggucugcuccugcauuacugaguugaucccacuacagauacacuagguuauucauccaucugcuaccuaggaagcagaaaugguuggcagcuuuaacaaaccuuuagcuugcagcacaaguuuuaucgauaaucuauuaguacugaggacuuacaggacuggucaacaaauuucaagugugcuuucucuccugugacuucugucccuauugagacugagcaaaagacuagaaauaugucagacauggucuuuuaaauauuuggcuauaacugaaagucuccaggguuauauuuagaaagaugcaaugagaaaggaguaugaguggaguaaccacugcaguagagaagaagcacuuugaacaguaauuccacaaccaugacuuucucaguaauguuuuugaaaauuaguaggaaagugugaaaugaggcuucucccuggcacuugaagguguuuguagaacaugagaaauaucagaacaacugcuccauuaucaaacauggccagugugaauucuggaauggacaugcuauuuggaauugcagccuuaaauaguggguuuugcccuucagucaagcacuguaaucaucuggcugcuaaacucucuguguccuucaaugauuucuagggacagaagucugaggugcauaaacacacaccaccagucugauagagcaauaucuggaauaacuuguggguuugagaaggaaaauccaucauagcuuuguucaauauugugugucuaaguuuguggcuaucccagacauucccucauugcauauucaugccuuguaggagacacagucuguccugcacgaagucacuuaacccccagaagucuggcgaagaggaggauucuggcucggcagcucagcugggaaugugcaauagagaaauagugcgaagaggggcccuuauucucuucugugauuaugucguaagugcccacaagagcucuuaugguagaggguggcauagaugcugcuuauaugcaccugcuaggcaaccaaauuauucacugugccacagauauaucaaagcugaggagagguagcaauguuuacucuggaguuuaauuagagcagucuggugacauuuuuccuuguauugggcagcuguguuuuuugauucaagaacucuaucaaaucuguggcauuuagagucuguuuucuuuacuaagcauugcagacagaguaaguagaacagcccaugcuaggcuggccugcaaccugguagcaaguuguauuccuacauggggcuuccuuuguucccaugcaugcaaacuccaggccagucgcuagggagggcuacaccagagugcucaccgugcuccugugggcaucuaccucuugacuuguccaaggagccaauucucugauauugaggcauuugcuggugucucuaggagcuggauguugcccuugguucuuggcuuccuguggccucuaccacaugugaucagagguguaagguucuauaaguuuccuuccuuucucucauuuacuuauacucagacacuugucuucaccaaggcaaaauuuguauuucaaguguguuuuuucuuacacuuuguagccuucuuguccacuugaaauauaucuuuuauuauaucuuucuagugucagaaucuccaugacucagaacacuuaacauggcucauugugaaucacauucaagaucugaucagcuugucucaugagccuccaguacaagacuuuauuagugccauucaucguaauucugcagcuaguggucuuuuuauccaggcaauucagucucgcugugaaaaucuuucaacgguaagucuuuagccugccaguuugcuuucuccaacuuaaaaaugggauacugggauuuugucaguacuaguuaucagucugaggaauaauaaauuucguuccuucucaacauuagccaaccacucugaagaaaacacuucagugcuuggaaggcauccaucucagccagucuggugcugugcucacacuauauguggacaggcuccugggcacccccuuccgugcgcuggcucgcauggucgacacccuggccugucgccggguagaaaugcuuuuggcugcaaauuuacagguacugaaaaugguaauuuauaucaaaacuuagaaagucaaucaaaacauuuggucuauugaccuggucuugauuggccacugauaaagagcauguaugucauauuuguuauuuguguaucugaccaacggcucuuuuuagauauacuguguauaguaauuuauccuuuuuaagugggugugagguuguauaucacaaaagcccugauguguucuugucuguguagagcagcauggcccaguugccagaggaggaacuaaacagaauccaagaacaccuccagaacagugggcuugcacaaagguaagacugcagcgugggguccuggcacuugggcaaccagcguauuaacacauagauauguucaggaacaaauagguagacaaaggaauuaguguacagugaguuuacuacagcaaugccagaguagaaaagacuaucuaaauaucagaugaaauuuagucaugucucacuuuaguagacaugaagaaguggcacucaaauaccuguugcacagagaagggacuccugaacuuugugacuguugaagggauaagaaguauguuuguuaccucugcuacuggacccugacugagugggaauaaagcuagaaccuaauugccagguuggagggaguaaacaugagagcacuaccuggcucuuggcaugugcacauuauguuaagugacaucucuucauagcuauucuuuugccuaauuguuugaaagucuuuuagaagccuuuauuagaaacauuuccaucuguaguguaaguguaguuccuugacuacaagauaaauuaagaaaagcuuucaccucuuuuccauugcugaagggggaagggagcauucgagagggucucucauaacuuuaaucuucagaggauuuuucaugguguuucauaaugggacagggcauggucuggaugauuuuucucaaucugcagagccacaugaugcugacauuugaucauuugacauaugaaguaucacauugacucuguauaguaagagaauaaauuaucauuguguuugacaguaguuguagucauagaccaagauaaggaagauuaugacuucauaaauaauuuaggccagaugaaaugguuuucugugaaaugaccauuucuaauggaaugaauugugucauuauuggggauuaaauggaguuugugcacuuggaucuuaaaauuuaucuguuuugcacacauuacaaauacgauggcuaggauuauguaauucagugguaaagcacuugucuagugugcacaagucccuagguucaaucucuaauauugccaagaaaagaaagaguagaauagaauagcuuuguuagcgguuauauaguucauugccuaauggaauguugagcauaaaugaaacuucuggaaaauaucagugagguauaaauuuugguaauuuaaaguaacuagggcguaaaugugcaucaugacuuuagaauguugaagggaaaguccaaaaccuguugcccugucuuaagaagcuccuagugcuccuugguauuacauguuucuagaacucaucugugcaaaaacugagauuucaaaccaaagaacaaacuacucuggcuuuuuuauuccagacaccaaaggcucuauucacugcuggacagauuccgacucucuacugugcaggacucacuuagccccuugcccccagucacuucccacccacuggauggggaugggcacacaucucuggaaacagugaguccagacaaaguaagugucccgaaugucuaagugugaugaccaggaacccuguggagacaaugacagccucugucuacaaugaggauagugguggcugucaguauacaugggaccugacacucagcucaggucauuagaugcccugcuugggauuagagugcaggauggaggccaagagguccuacugagaacaggagugcugaugugaggcuuuuguggaggacugugggggcaagucagguggcuagucagcaagucaggaaaaguugguugugguccaggaccuaugacugcagacauuguccagcacaugcugacaaaacuuggccugccucccccucugaaccuucuaucuccuauaaauugaugcaccuacugccaccagcuauauaauguauugucaucuguacccuuucucauucacacuugagaauuagaaacuguuagggccuuugccuuuuaggcaaggagaugagauuuuagaagccugcagcccaugacagaaaacacacauuugccccaggcucacucuccagcuuugugggaggcauuucuuuggcuuuggcugcugggaaagaugagggaggcagauacuccaguauaguauagauggugcaucaucuagagugcagguagagcaaaaauugugaacacugagaacuuggcugaguuugcaaggacugcuggaagguccacagguggaaaagaagagggcauucaagcacagaacaagagagggaagacuagcugucuagagaguguaagcccaagaugugucugaugucuguacagccagccgucggugcuucuaucacagcccagagaagccgaagugccuacccagucccauucaauuuucuuuucuucucaggacugguaccuccagcuugucagaucccaguguuggaccagaucagauucugcacugcuggaaggugcagagcuggucaaccguaucccugcugaagauaugaaugacuucaugaugagcucgguaggcaauaauccguugaguccaggaaauccucagcucugcuugucagaaaguuagauuugugucuuaguuaggguuucuguugcuaugauauaacacuaugaccaaaaagcaaguuggggaagaaagagcuuauuuggcuuaacaccaucauugaagaaagucaggauaggaacuuaacagggccagaaccuggagucaggagcugaugcagaggccauagaggaguacugcuuacuugcuuguucuccauaguuggucagccuacuuucuuacagaacccacgaccaccaacccagggaugacaccacucacuaugggcuggguccucugccaucuaccacuaauuaagaaaacacccacaggcuuuugaugacauuuuuuuucuuguuuguuuguuuugagacaggguuucucuguguagcccugguuguccuggaacucacuuuguagaucaggcuggccucaaacucagaaauccaccugucucuggcucccaagugcugggauuaaaggagugcaccaccacccccuggcuugguggcauuuucuuaucugagguuuccgccucuuagaugacuuuagcuugugccaaguugauaaaacuagccagcacaauuugucucaucuuugugugauuaauauaugggaaaccugaguucaagcaagggacaccaucaagcaaagcacaugggaggcucuaacaaaaaauggcacacgagagcuauaauccagaauagcuagcacaugagaugugaauaggaugccguuuuaaacaaacuagaauccuaaaagaagaaaauuguuuuaacuugaucuuucauaccuuuaaagaaaacggguggucauaggcuauggucaguugaucauucauuuccugacuauaagaaaguauuguguguucauugucuucuggaaauugaucucuaguaaccccuguauuaauuacuuucucguugcugugauaagacacugaggaaaagcaguugagaugaggaggguuuguuuuggcuuacaguucaaggguacaauccuuggcaggggaagcaucacgguaagcuugaugugucuggucacauugugcccgugaccagaaagcagagagaagugacugcuagugcugaguuugcucugcccuuuguguucaguccaggaucccugcccacaguuaaagugggucuuccuaccucaaccucaucaagauaggcacaccaagagguuauuaucuccucagcaguuguagaacugcuacgcugacaucaguauuaaccauuacacccaucauguagugaggcaccuugucccuguagauaaagaggcauucugucauguagugagguaccccguccucucuagauauagaggaauuaccucauguagucagaugcccuguacugucuagauacagagcaauucuccuccacuuaccccucgaauaccagaaagcauacugagagcuggugcaggccuugaaagcauucaauucccuuccuugucuucuuugccaagcacucuuaggccacuaccuuagugggguucuuuguugcccagugaagacaaggaccucauugccccuugauacaugccaaaugguuauggggaagcaggaacugagcagguuaauagaagguguguguguuguggagagagaggguucucacauaggaagauaucuaaagcacaggacccaguuuguuauauuuuccaagucguuagguggacuauuagcagcuugcaaguuccauccaugaccauagaaauguuugauuugggggaacuaaugaugaaauacaguguuuaauauuaaagcuuauguucuacuugaaaaaauugugacucucucuaaauccuuaaauggcuuaaaauaaguuuuugacaaaacauaauaaaaacugucauaugaggccagacaugguagugcauaucuuuaauuccaauacuugggagucagacacuugaggaucucuguuugugacaugucugguugacuuaaguuccaggccagccagggcuacauaguaagacuaucuccaaaucaaaaaaaaaaaaagaaaauuaaaaguuuuuggcaugugaaauguuguguguguguuuuuuuaagcagauuuuugucuaauauaagaugcucugugugccuucucaggcugcagcauugcuuggcaucccacuggauucuuagauggcauauuaaacuuggugcgcugucuacaucaauuaagauuugucauccuagaauuauuucaaugaaauauaagaucauaaaaauuaaaaauauugcucuuucucucuuucccuccccccucucuccacguggccauggccagucucucucucuuucuaccuucucuccuuucucccugacuuucuacaauaaagcucuaaaaccauuuuaaaaaauuaaaaauauuacuuuaaaauucaaauaugacagugaccagaaauauuuauuaagcauguuaaguggaguuguugauauauuuauuaauauauauaacauaggauauacuuuuuaaaauagagaauucaacuuaguuuuaucugucuuuuaacuuuauuuguagucuaagaucuuuucuagagaguauuucccacuuuuauuauuauaaguuacuugagacaagcuacaucauaagagaaaaagauuuauuuugacugauaguucugcacauacaacauccaagggcucaucuggugaugacuuuacugucagagucccaguguggugcagaaaaccucccauggcaaacaauaaggagcuugagugucucuguuucuagaauauucucagaagcauuccuuacaguucuuuggucuggauuaucucagaaacaaaugcuuauugcauuaacuguguguguuccagccugaaggaaagcuuacugucuuugcuguuguuugucuugcauguaaacuucugacccaggaguucaaccuaagccuuuuggcucccuguuuaagccuuggcaugagcgagauugcuaauggccaaaagaguccccucuuugaagcagcccguggggugauucugaaccgggugaccaguguuguucagcagcuuccugcuguccaucaagucuuccagcccuuccugccuauagagcccacggccuacuggaacaaguugaaugaucugcuugguaauuaaauacaguucccuuggaugcuugucugucuaucuucucugucacucugucucucuuuaugggugauaggaauggcaguagcagaauggacaagccagagggacacugagucacacauugaaccuagagcugccaacucugguagaucagcugaccaagccucuaggacccuccugucucagcccuaagugcugagguuacagguguacacccacagccagguuuuacauaagaucuuaaauuccaaacucaaguccucaugcuugcacaggaagcacuuauccaccgacucauccucucagcucaaguuaucuuaguguuuuaguuauuuuauauuauguuauaguugucugcauguaugucuucaccagaugcauacagugcccauggagacagaagauggcaucaaaucccaugggacuggaauuacagguggcugugaacacacuauguggcagcuagagauuuaacuuagguccucuggaagugcagcucaugcucucagcucccgagcugucuaucuagcuacaaguugucaccguuuuuaaaaguauuacagauucagcaccgugcuuuuccucaagcacgcauauagucaggacuguugaucuaaaaggcugacaaaaauagcugagaaacugcaccaaauccuuagcucuaaacuucuuucuuuguugcuugaccuggacauagaaagucagguucuaagcccuucaggaucaguggguuagacucagggcaaaccauguccugacuuuauguagcacguaugagugagcauguacagaugugcuugcucucuuggucuuggcaaccucaaauucacauaguugugugaaggcuucugaaggggcgggccugugcucacagucaaagucacucaugucagucucauguuucaggugauaccacaucauaccagucucugaccauacuugcccgugcccuggcacaguaccugguggugcucuccaaagugccugcucauuugcaccuuccuccugagaaggagggggacacggugaaguuugugguaaugacaguugagguaagagcagcucugaaauuaugugucccugugaggacaggauaugugaguagcacuaagaugaaaguccuugaaaaccgacaguguggaguacaauagugcacacauuagcccagcugccuuggaggcagaggcagaauuguggguuccuggucuguaaggaugugccugaguauacagcuagacccuauuugaauaaacaggaaggcagggaauaccuauuggcaaagucugauucaccugaugguacagagugccuuucacccucaccacugggaagcaaggaggucuguaagacauccuguuaucccuacacuauaaaccuaauguggguccuaaauaaaaucuagacaguguuacauuuuaaauugggcagugaagcuggacauuucacccagaaacacuuggccccucaaaauguaucuauacgugcacuauaguuuuauuaccuugccaugggcaugcugggaaagagccucacugugccagagcugugcugccaauccugaacaaggguugacaccuuacccuaagagaagaaagucaguauccugaggguguaugguacaaaggcaccaggugaaccaggcuaaguuagguggucuuugagcuugucuuagcccagugaagacaggaaagcaaauguguguguaaaguauuggguggcagcuccuagucauacucugcgcugcacaggccaugccaugacacuuguuuccuauaaaaacucuguccccauuucacacauggggaaagaagcucagagagguucggggacuugcuagaagucacuagucauaaaucauacuccaaaacucaguguugugacugagauacaaaacaaaacacauucuguuucuuuaaaaaaaaaaaaaaaaguccaauguuacaggagcccucaagacccuggcuggaggcuuuguauauggcucagaucaaguuucuaugggcacccaugguucuaaaggaaaaagacaccuaggguaagguugggcauucuggcagagggaaggcuggaacuugggguauagguggaucaggacugaauauuaagaaaacuaggaaugacaaccuagaaaugugggucaggggccauucuucugcaaggagguugucugaucuccugcccucuccaucuauccauggucuuccauaucuuuuauuggcacugcuucccuagaggucccugagauagaguccugggugagcauucuaacacagugcuucccuuuaggcccugucauggcauuugauccaugagcagaucccacugagucuggaccuccaagccgggcuagacugcugcugccuggcacuacaggugccuggccucuggggggugcuguccuccccagaguacgugacucaugccugcucccucauccauugugugcgauucauccuggaagccaguaaguuuuugucuaugaaugauuuucuugucuucacacagcucaacugauaaucagcaauacaugucaggcuggaauauuuuuucuuccugucuuguauuucccaagaaccaaguuaggacuugggguggaauggauagauuguaggugcugccuucagaaggcccauuuguccacccccagaccuugucauuacacuagaacuuaacuugaauuugcuuuucuagcuauuuuguuuuagaguuuggaguucuagcucuuaaaaaauauuuuuuaaguuuuaucccuuugaucuuuagucuuaguugacuauuugauguucuuaguccuagaugauuauaagauuaauaagauuacauucaauagaugacuucuguuagaguugaagugugugcuugcauacugcauuguaaugcuaauauguuguaaaauaaaagggauucauucuuuucaaggaacaguguccucaacaagggucauuagcuaaaaauuuuuaaaaauuggacauuauaguuuacauguuagaggauguuuugaaguuuuauguuuucaaauuaaacauuauagagugguguuuugaucuuucauuguuuaaauuguuuucaucugugcauuguagucaacuuggaaacaaagauccagggauuaauuuuaaaaagcuaggcuucuuagucaaagugacgcuuuuagcaguauugaguugugaauagucugauaaaaacucucaggguggagauggcagacggugcauuuagaagccucagugcggaagcacaagucuuugucuguucaugacuagccaaagcacuggugccugcaucugcuguucuccagugcuuuucaguuuuacagaaacugcuucuagaaaucuagcccucaguugaccugucaucguacguuucuaugaggcuguacaggcaugaaguaccuuaaguacaaagaagaguuaaaguuuauguucugcuguaauuucaguugcaguacaaccuggagaccagcuucucgguccugaaagcaggucacauacuccaagagcugucagaaaggaggaaguagacucagauauacaaaguaagucuuaggaccauuuuuuccccuucuguguuucucuggagccuuccaauucauuggcaaaagaaacucacgaaguggacucugggaaacauugcucuugcuguccugagggcucaucuagacuuuaaggggcaagagggcuuuuugaccauggcugcauauauguuccugguuuuguaagcccuguuuuucuagugaagauuccccuuuccuuaaucagcuggucugacucauccugcauccuuccucacaaccuggauuuguaccucuucccugagaagcacugccucaccccccugucuuagccucagcacuuaggcuacuuuaggauaaauaucuuuuccuugucugugcucucaagguugcugcuugguuugcuguaagugacuggcaaauauguauuaaauucugaaugaguaacucaaaauuuuaaggaauuugaaguuagugcagaugcuauaugauauacgguaaccuuagugacuauuucagacaucucuuuagugacauuuguugacauguuugcuuugccacagggucuuccucuguagcccaggcugacaaugaauucaugacucucacaccucaaccucuuaaguaguagaugcugucauuacuuugaaaaauaauaaugaaaucaccaucuagacuuaggaacaaugucuuuuucugaucuuccuuaugagucaaggguagcuguuaucuuaguuaacgauuuccauugcugugaagagacaccgugaccaaggcaagucuuaucaagaacaacauuuaauuggggcuggcuuacagguucagagguucaguccauuaucaucaugggaguaagcauggcagugugccagcagacauggugcuggggaaacugagaguucugugucuugauccaacuacaaccaggagagacuaucucaugagcagcuaggaggagggucucaaagcccaccuccacagugacacacuuccuccaauaaggccauaccuccuaauagugcuacuccuggaacaagcauauugaaaccaccacagcucucuuacugugacaguuguggcaaggccaacugaguucuugacuccuaacugccaggcuucuagacucuuuuugaguuacuugaucucaaaggcucaaauacuauagcuacaccacuucuuccacaagcagguaacaucgaacauuauuuuuccuugggucaccaggagccuuuguaaucacaaguauaaaacugucuagucacagcccaauauuaugacacaggccuggaaaugcagcacuaaggaggccaaagcaggaggaucaugacuuugagucuacucugagcuauauaaugccagaaacuauuuuaaaagacagggcuucccugucuuuagcuuuucaauucuuucucaagauuauauaguugcacagaggcccaugagcaacgccaucuuaguacagccugggcucucacuugguuucugacuggagcccuucaguuccuggaguucacuucaccucauagucuggucguuuccugagcaacaacucaaauuauucugugcuucugguaugaggauaagacacacauaaggaaaucagaccauggaaaacacuggaauaaaugcccaccaucuugagaauggguaggugggcccaguggcaggagaggacuuaauucaggcagaugaaguuuugcuuauccucugugacuugaggucaguuaaugaaguucuggucagaagaagcaaccugcauuuugcuuuaaaaaaaaaaaaaauuggguuuuuguuguuguuguuguuguuuuguuuuguuuuguuuuguuuuguuuuguuuuuuugagacaggguuucucuguguagcucuggcuguccuggaacucacucugagaaccagacuggccucgaacucagaaaucccccugccucugccuccugagugcugggauuaaaggugugcgccaccaugcccggugcuuuuuaaauuuuuaagucacauccauagauuagcauuuuuuuuuaaaaaaauguuauaugugaggguguuuugccugucuguaggucugcaccacaugcaugcagugcccagggaguccagaacaaagugcuagaucccaugggaauggaguuauacauuguuaugagcuacuaugugagugcuuggaauuaagcccagguccucugaaagagcagacagugcucuuaaccacugagccaucucucccaucuaagcugguacuacuagaaguuagucugacacacaucauuucuuuuagcuuggggcuaaauuccuuaagcucaaaaaggauccuuuuucuguaccaggaagugccuaaauuguugaaucucauagacaaggguaacuaucuguuuauuuaaacuuucaccaacuaaacaaguuguucuuaaauucuaugcuguaucaagacucaguuacuaugaacagucccugcccucaagacucuuacagggcagaugggugguuuucaugcuuucucacuccacugcuagaacucccauauacggcugaaacucaaguucaaaaccauugcuguauuccugguagaaauggaaagaauugcaggguuuagaugcauacuaaggaaguaaaaccucaggccuuaagugagcagcccaaaaaucugagucaacuggaagggcucuuaggcugggguucucuauggccaugcagaggaagggugacacuguauucuuacagacuucucucuuuaucaccauugccuguguagaccucagucaugucacuucggccugcgagaugguggcagacaugguggaaucccugcagucagugcuggccuugggccacaagaggaacagcacccugccuucauuucucacagcugugcugaagaacauuguuaucagucuggcccgacucccccuaguuaacagcuauacucgugugccuccucugguaaguuggaucuugcucaauuugauauguaaccaggcagcaaacuugggauucuccucucuaccucccaaagcuagaauuacaugcccagcuugucacauagucuucauuauugugacacucccugugauagucccagcauuuucauaugguugugacacuguguugucccccaggcauucuguguaguagguauuaguaaaaauacugcauuucaaaaaacugacugaaguacuaaacuucaaaacuucaaaagugucaccucugaagagauucguacagagcugggcauagugguacaugcagaggcaugcagaucucugaguucuaggucagccagagcuacauagugagacucugucuagagagagagagaaagaaggauugauucauacauuuagggacaaccacuauugugggucuucucuugaaauuuucuucaugaaucaacuuaaaauaggcugguucuuagguuuuguuccacuucacagucauggaaauaggguuaacaacagcuaggcugaccucagucugcuaaaauagcacaccagacauauucuuuccuacaaaaauccucaucaagaaagcaaagguggcccgcagcugauuugaaucauagcgcagagccagaccaggaagccagauaagaaagggugauuuauucugcauagauagggcauaugccugcugcugggccauagcuacagcgugugugugcuugcauguaagauccuagaaaaguucacaucuagaacaugacauucauuggaccuuagaguugcuggggcccagucugagugcugugacccaccuaugcuggaagugcuucuagaacagagagguguggacauugggaagagagcaauagaaagccaagagaucaucuaacacugcugcaugaggcucagcccugagcaggaguauuccuuauaaagacuguauaagaaggugguauggggucauggaaggcucuuguggaaucuaccucauaggcuaugugcuguagguaaaucuccaucaagagcuuuuaauccaggccaggcagugguggugcacgccuuuaaucccagcacuugaaagaccgagacagguggauuucugaguuugaggacagccagggcuacacagaagaaacccugucucaaaaaaacaaaaaacucuuaauccgauaccuugagugcccugggcagaaaaguagcuguagcaaacacugcagaaccuccccugggcaugcuccagagacuucugugggugguguaagagauuuauagaagguugguuguguuguagaaaucuggggagguucccuuagguccucguugcuuuacugaggcacauagcugagcuggcuagaugguccugccacuggaacagcgugggguauaccucagggcuuccuuugugcauggugcuuaucuacauaucgaauggcaaaacucagccucucacaguugauagaaaugagcagugggguuguccuugagacugaauuucauuaguguuugccucuuuuccaacacacuugauguuuguggguagcagcauuuccuacaaggaauguggcuguguacaggcagccugagggguguaacaagcaggugaugggcuggccuugggggaguggggggcagggcagagugcugggagucaagcuuggcauugaagguucuaggcacaagggugggagccucugugaaagggcacaggcucuggacaaaucagaguaguaaaggggggggagggcaguugagagacaagggacacuggacgcugggggucucuuguccuccucaugccaucuccauccaccuggcacgcuuuuuaucuucucagguauggaaacucggguggucacccaagccuggaggggauuuuggcacaguguuuccugagaucccuguagaguuccuccaggagaaggagauccucaaggaguucaucuaccgcaucaacacccuagguaucccaccacaguccucuucaguccccaugugccaccuccgagaccugaagccucaggguagggccaucgcacucggcaacugaaaagguucuggggugguaaugaugcaguacaaauagaauuauggugaaaaguagaccuagguguagauggaugaguauaguguggggguugcauaccaggcuucuuuguaacugucagaggaagccaguucugucuucacauugucuauucaaacuaagccauauagguggguuggggaugugcuucacuguaguguuugucuagcacgaggaagcccaggcgucagucuccagagccgcaacaacagacuaaguaguggaagucauguccucaugucuuccugcuugccacuuugacauuguguucucacucgaaucauuuuucuuauaugcagaaugagcagcuugggaaaacauggcaagcuaggugucacagggacagagugauagaaugagggaagguagauuuggccagacagcccugcucaucccuuugcugacaggguaggaucuucagugcugugguccauagaauggagacugggucuauuuuuuauguuugcuacggaugugaacaugaaaaauacacuuagugucucaguaagcaguagcaugaguaguuuuccugucaggacucuucugcuuucugaagcacagucuaaauugcugcugcugcugcugcugcuuaucauuauuauuauuauaccuccuccucccucucuuccuccuccucccucuccucuuccuccuucuuugauuccuucuuuuuugcccauuuucuggaugagggugugucuuuuguuuuuguuuguuuuuuguuuuuuggguuuuuuuguuuuucaagacaggguucucuguguagcccuggcuguccuggaacucacucuguagaccaggcuggccuugaacucagaaauccacuuuccucugccucccaagugcugggauuaaaggcgugcgccaccaccaccugccugaggaugugucuuaaucacuguucugugaagagacaccaugaccaaggcaacucuuaugaaggaaaacauuuaguugguggcuuacuuauaguuucagaaaguuaauucauuaucaucauggcgaaagcagacagucauggugccggagcaguagcugagagcuuuacauccuaauccacaggcagcaggcagagagagggagauagagauagagagacagggccuggugugggcuuuucaaaccucaaggcccagucacagugacaaaccuccuccagcaaggccauaccuccuaauccuucacaaauaguauaucaccuaguuaccaaggauguaaauguaugagccuauggacaccaaucugacuugguuuugugguuauaguccucauagccuuucccuucugggguauuuccuaagagucuggucaccagacccacugccugguccaaguuaggcccuagggauucuucaaguuuucuuauucggaucucagcaaccuaccucuacuucaucacugugcgcaguaacuccugagaaggaauccggcaccucccaugaaggacauuuuacuuccaaucuuaguugcuuuucugucgcuaugauaaacaccaugaccaaaagcaacuugaggaagaaaagguuuauuucucuuuauagcuuauaaguauaucacugaaggaagccagggcaggaacacaggacaggaaccuagaggcagaaacaggagcagaggccauagaggagcgccacuuaccagcuugcucaccaaggcuugcucagcccgcuuucucaaagcacucaggacugucaccccagaggugguucuaccaauauaggcugggcccuaccacauugaucacuaauuaagaaaacucccuucaaacuuacuuauaggccaauauuuggggguagcuuuucaacugagaguuccucuuccuagaugauucuagcuugugucaaguugacauaacuagccagcacauugccuuugcuccugcccacuuaugccuucccugggcaguuaucaguugggucugucuccuggugucaguauucacuugaaucugaguuauaccccauguuccaggagguccuagcacuugaugcucuacuuuucugcuccucuuuacugcauucuggccuuacaaggagugcuguagauauuuuugggucuuggugggaacaucaagugcagcuauuuauugaacuuucucugauuggccuccuagacugcuagagugguccuagccugauaccaugcuuuuuuuuuuuuuuuuuuuuuaaagucugucuccgggguggcuuucacuguuugcauuuacuuacuuuguggaggcaggacccacgugaacaucucauagugcagcaugcacauggagggcagaggacagcugacaggaauugguucccuccuccuuccauguggucccugaauugagaauuggacucagauugucaggcaucucgcuggcagucuguuuaaucucacugguuuuauagagacagaauuauuaucucuaugguucuguggucugcucugaggucucacuuaaggugagacuuuuaaaaugcuucgugggcaggacuagccuaggugauuaaugccuuuguagacagccugucacuguccuauacagugggggauugaagggcaaucuggccugugccucuuggccuugauagcauaacuggucuccaugugcugcuauauccuuuaugauagauggagagaauggcagcccucaugcuguaggauugcucugaaggugguguccuaggagcagcacugaugggauuacaucgucagugucuccucauggguuuggcgagucaggaaacuaauguaaugauugauucccaggguggaccaaucguacccaguucgaagaaacuugggccacccuccuugguguccuggugacucagccccuggugauggaacaggaagagagcccaccagaggugagacuuccauaacuaggggguggcuaacuggaauccuauagcugugaaagcuggugacucuguguuuugaaacagaaaaacaggcugaucauguaccaacugauggugcagaguaaagacaaaugcccugagaggcuuggagacugaggcuuccaguagcuagguugugucuuucacuacauacauuccacucugaugaucaaugaacugguucuucaguacuguuauguuuuacuuacuuaccaugaucugaaagaaugucauugagcuaaaacaaaaaagacaaugaaucuaggccaugcacauguacuuguuugguuggguuuuauugcuguuguuguuuguuuguuuguuuuaacuaacuuauagguuuugcuuuguuagcuuaauugcuuuguuaguauuaauaugacaugaauaaccgccauauauuuguaaaaugaaggagguucugaauguuaaaguacugggauauaagcccuugauucuaagaaauauguaguaaacuguggaaaugacagagaagaagguaaaucuauauagaucacaggccaucaguauuaucuucaaacucaucuguaacugccaggcugccauaggcaguguucuaaaaugaugauagaauuuaagaacaauuuucuccaagguaaauuucuauuuggaguucuaugccaaacauuuggauacuccaagucucagguauguagguagguauaaccagugcugagcaaacuuggacuuaagacccuggcugugggaagccauagcucuuaagugaucugauauuccuguaugaggccauguggccuaugggcacugugugaauuagaggcaggaugaguaguugguaucuucuuaucauguugucaauguguggacuguuucucuaggaagacacagaaagaacccagauccauguccuggcugugcaggccaucaccucucuagugcucagugcaaugaccgugccuguggcuggcaauccagcuguaagcugcuuggagcaacagccccggaacaagccacugaaggcucucgauaccagguuugccugcguucuuaugugggccagugcagaggauggugagguagcccacuuccccuagcccucuccuuuguaauaagaauugauguaacaauuaauucuuacugguucuuucaguacuguuaauuuuuucgucuguggccuugcccugagauacagauacaaaagggauuuuugucaauggugacaacugagaauuuagucugauauguuauggacuucacuggguguucuggcucagacuugugggucaagaaugagcaccuacugaaggguuuguuuuuuguuaaaccagcugcuucaggcaagugaaagauaauuccugguggcuuucacuucucugauguuugaaggaagcaaacauguuuuuuccuugguucugaauuuuagauuuggaagaaagcugagcaugaucagagggauuguagaacaagaaauccaagagaugguuucccagagagagaauacugccacucaccauucucaccaggcgugggauccugucccuucucuguuaccagcuacuacagguacaggaagaagcuagaacaauaguguggcuuaacaaggaggcuuugugcugaguguauugcccccauucacaagucucaugcuucgucuagaccaccaugagcaucaggguguaucaccucacuuaaaugaaaagcacuuucuuuccauuguguauguuaauuguacaaaguuuuguauuucauaaggacauuuucauacaagcacauaauguauauugaaugagccacccccaaaaccuccuuaccauucccuuugcccaucuucccuucccuuugcuguccccacuauguuauuguuguacaaacugcuuccaucucauaauuacuaaauuguuuuaggaauuguuuguuguuguaaauuuaaguaccuugaagacuuuauuugggaaaguuuguguauggaaaugcaaugugucauuuaucccaaaacgguuuuggcagcuuugaaguaaacagagcacugagacuuuaaauacucaugggacuuagaccgugaggagcuucuuucugugcagguagcaugggugagaaauggcauacuugcucuggaacgucuugagagagguguggauagauggcauggcagcucagaguacagcuguggggaggacaguagaguaccuugggggagggugggcagugugagauccaauggaguuaacuugaggcagccaucgaagaagagauagucuaguuugcccacugggccugacagcucaacaggcugcaaacggacaguauuccaagaccuacagccucugcauagcuggaguauccugccuguggggagcagucucauugggcaaauaucuguccaggcaggagcagggucucaugcagugcugugcugauguuuggcaggugcucuuaucagccaugacaagcugcugcugcagaucaacccagagcgggagccaggcaacaugagcuacaagcugggccagguaggucaguuuuaccaauccacacccuucuauaaggacuguaggcuggaauuauaaccacuuugagcuugagccacauaccacauucagagaaaaguuuuuauguacuuuauucuagauuuuaauauauuuuacauauaagcauacagauguuuauaaaacuugugagacaggagagaaacaagaagcaugaaaggucagggaggagagaauggagucagcugagugcugucaggcagaugcacuacugaaaguuuccuggcugcuagcugagaggguagcuaaguauccagcucagcaggcagcuggcaguuggacaguucacuucauucagaacaguagggauagcugacagcuacugacuguagggucagggagaugugguaccugcugccuuucuagacaaacucuucugugccuuccuaccuuuacagagaaacuuccacccuaagauaagucacagugaugguuagaaugugaugugcuuuugaugcaguguuucugaagaugaggugaugaguaagaugccuggggcuccugggcacaugaucauauucuagguuccaugucccuguugucacauugucccuuauggcuguguugaacucaucugucuguuuccuucaguacuugaggccagcuccaaugucugcaaccugaauguaguaggacuguguggggccaaaguauagauuuagcccugccuugccugggauaccugccagcuauuaaaaaaaacugccgggcugcgcugccacuccauuuuggggaaagagaugguagaaggggcugggcauggagaacacuggcaccuggagucacagcucacagcuugucuucacugaagcugagaucugagaucauaaggaaaaaugcaggaggauuuguagaggagcaaucaaaacggaagucacuguucauccugagaaugcaaagaccacuucaucugcaacuacauuuaggagcuuggggcucuuggcugcuccuuauaccuuccuaaaacaaacgcaucuccuucugcauccuuggagaaauuucuguaaccaagcagcccagaaaaucagguuuuauaauuggaaaacacaaaugagugggaccagguguauaaaauccauguaugggcauucucuccaggguguggucagcugucacuuagaagcacuuagugucacucuuugguguugcuuuuacuucauacccucuccagacacucauucaggcuuugaaccugaggucagacauuggagcuggccucaaguacugaaggaaacagacagaugaguucaacacagccauaagggacaaugugacaacagggacauggaaccuagaauaugaucaugugcccaggagccccaggcaucuuacucaucaccugccaacaguuuagaacauuuaccuuacuacccagggguuccacugauaguaacauuugggucugagugaaucauuacuguggccauaugugcucagaccaggaagaccugauuguaccuacccaagaagaaccugaggccuuuaccuauguccuuaucucuggugccugcuucuaugacagguguccauacacuccguguggcugggaaauaacaucacaccccugagagaggaggaaugggaugaggaagaagaggaagaaagugaugucccugcaccaacgucaccaccugugucuccagucaauuccagguuuacuggcucuuuuuuuuuuuuuuuuuuuuuuaauaagaaauuugagauuucuucucagucacuuauuugggguccucuugaggcuaaccucucauuucuguauggggaaaauauccauguuucacacucugcagaaaacaccgugccgggguugauauucacuccuguucgcaguuucugcuugaauuguacagccgauggauccugccauccagugcagccagaaggacccccgucauccugaucagugaagugguucgaucuguaaguuugcuuuccccucacccagaggcaucuguacaccauacacacacacuugaacgugugcauacacacacacacaaucaugcacaggcacauaugcacacacguguacuaaauacaagcgacagacacauuacacaaacuucaccuauaugcaccagauaccauauacauaaauacacacaugugccaugcauucaccaaauagauacacagacacauacacacacaaauauauacaaauaaacaagcacacacagauacgcacacauagacacauacacaccucaucucuaaugucucagaaccuguaaaggacuccugcaggccucccagguauggagggacagaaugugugaaguugguggcgagacagauauuuuuuuuucagauccagaucagguaaauacucugaaauguaacagcagugaguggugugccuuccagagacccagcgugucucucucuuccagaguaguaacaaacaacugugugccuuauccuucuaagccaauacucuccaagaagcacugguucagaagagcagugucagagaaggaguagucucauuauacuucacuacuccacacuucccgacagucccaaacaaagggucgucagugacaucuuucaauaucgucagggcuggaucgaaaggcucuaagacacugacuuggucugaaagugauagagggagcuggagagagugguaguuaagaggacaacagcugcuuuucugaaggacccggaucuguucccagaacuuacacaggggcucacauuuuaggcugccuuucuaacaucccuccagguguaauucuuguucugauucuccaugucuccagcuucuuguagugucagacuuauucaccgaacguacccaguuugaaaugauguaucugacgcugacagaacuacggagagugcacccuucagaagaugagauccucauucaguaccuggugccugccaccuguaaggcagcugcuguccuuggaauggugagugaggguagugcagaggccgcccccauugaagcugcuugggacugcacugcuuugggaccuuguauuggucacaugugcuacaugcaucugcauaguucagaguccugucccaagccaagcucccuggcacauguggaccauggcucuggucagcuaaaagacuucggugccuuuuggugcuguucccacagagacugggauguggugagcauggcuggaguacuugucucccuuggcucacuguaugcuguuacagugagcaccucuccagaauacagaaugcagaagguaugguagcacuaggacagcacagagugaaacugggucacacuucugccagucugucacuuggcagccccacuccauuucucugguggggucuagcucccacuguacugcucagccuacacaggcuucccuggugagcuuguugucauaguaaccuuucacuucuacuuugagaaauguagaucuugauccuuaacaucaugauuuucuuggucuaguuguguugcugucacaaaacaccuuagacaggguaaauaaacaacagauaggaacugcuuauaauucucgagacugggaagccccaaaucaaggugcucugggacgccuggugugcaccuccuggcuucuccagcucaucggcauuucccauuauuuugcugccgaguuaucagcauuuagcuaguacuacuugguugucuuucauauguacauauuuuuaggugcuucucagaacaugguucagacauacacgugaaaguaaucgccuauggguucugccucuuguuggagcauauuggagggcaucaacacucaggaaaggggacagaccuuagacuguugauauuggcucuuuuguccugucacuuacuauuaaauuauuauuguguuuuuaaauuauguuaaaauguuaucauuaaauguugaaaauuaucauguuuuuaaucucuguuuccugggauccaauuuugugacaacauaagaaacuguuuagggauuggaaagauggcucagugguuaagagcacuugguucucuuacagaauaucuggguucauucuuagcacucacauugucagcucauaaccggcacccucuucuggcuucuacaaguacacaugcauauuuaccauguggacacauacauguauaccacauauaaaaauaagaguaauuuuaauaaggaaacuucuuuguucauagacacgugaguggcugcuaugugugauguaguuaggacugcuggcaggaguaguguggaagagccugcuggggaccauuccccaugggucauaugugccaugcccucucuuguuaguaagacagugcuauuaucacuguggccacaauuaucugauggcaucuuuuacauaccuguguaacccugugcagucucacagagcagcaguacacauagaucauggcacagcaugacucccaccucuccuuacugcucugcuagaggaucuguugucacugaaccuaggggcuagaacagguauacagcauggguggccauagcaccauccagagaacaggaacaaugagcacuuagucccccuaugugagcacacucuucaaagcaggcguccucugggugcugucaggacugaccgugugcuugugggagguccauuuuccuucuugggguggcuucaguggcuuaacuuuccuuguaacugugguuuugugcucaagcccaaguuccucaggcaaaauguaaaucaaaugcaucaggcaaauaaagaauggucauuuuuaagaaacgaccccaaggcagaauggcaaauggcuccaguucccagcucuguguauacaagcagcuugcuugaaggcagugucuucugagaggcuuccagccuguuuugugcugcuacaagcugugcugcauugcuuuuccaggggaaagggacgcucaccucagaugcgcuacugaugauccaagcccagcuugugaaucacuguauuaacuggcuuuccucauaggaacuugagugaaggcuuauuuauuggagcugagggaccccaaaacagcugcauacuaaaaaauucuaccacggcaugggugauaauacucccaaagcuacauaaauagagucauagucuccuccuucacuuaaccuuucccaagaccaggugcagugggggcaggauggugugcagcaucugauaagggaacacuagaauccugugcuugggagagagagucugguaggaauacagguaaucccagcuccucugauuucuagauggcauaaccaugucauguccagaggacaguguuucacaguaugugucagauugucacuuuucuuugcccgucauuagaucugcagccuucaacaacguauccugauguuaugcuugcaggaguguggccagagcccuagguuguacuguccuuaggaaggacucacagcucaauggggauagccugggaagggggaugagaaggaaguaacuggcaaagacuguuaacccucuuuagccugacaccaucagauacagacuccccuggagggcuagaugaccagaaggccucuuacaucaugagaucaaaugaguccuuagccagccuuuccuggggguggggcagucagacaaugaaaugcugcccuuggauugcagaacacaacagcagucuucagugcugaaggagucauguuucaagguguguacucccacauuuagaaaaccuaguggaagugauaccaugucagucaagguuagcacaaauuaaugucaggagcuucacaacuaccaacagaggauccagaccaagguuuauuauagugaagagacaugaggcaaaaaucagcugaaggagaagguuccuggguaaagccuagaaaaccagugugaauacuauuccugaauagucauacagaucacaaaucauccaguagguagacaaggagcagacaacauauaugagcuguugcuacaggggccagcagaacucagaauccaggguuguuagaaguagcagguuacaggaacacccgcugcccagcacauaccacagcuccaaaagagaaaguaaguguggucacaaaucacauuuucuucauaagguaaacccucucucaacuugaaguguuuagauaggguuggcacuguacaccaacaucuccuggaugaauuucaaucauuuuguggacucugcuaugugcgcaacuauugcuaggcucuuucaaccucagggaagcaggcuguuggcaaucagccaucagucugccuccaacagcucaugucugugcuuguauccaggacaaaacuguggcagagccagucagccgccuacuggagagcacacugaggagcagccaccugcccagccagaucggagcccugcacggcauccucuauguguuggagugugaccucuuggaugacacugcaaagcagcucauuccaguuguuagugacuaucugcuguccaaccucaaaggaauagcccagugaguggggcugguugggugggcuacaggcuuugguguggucuuaacaaaaacagaaaaaagaaaaaagaaaauaaaagucucuaauucgauuuucaaaguauaugccagaacagacaugguaacaaaugcuuaugauccagcauuuaagaaacgaaggcaggccagguggugguggcgcacaccuuugaucccagcacucgggaggcagaggcaggcagauuucugaguuugaggccagccuggucuacaaagugaguuccaguacagccagcagagcuauacagaaaaacccugucucgaaaaaccaaaaagaaagaaagaaagaaagaaagaaagaaagaaagaaagaaagaaagaaagaaagaaagaaagaaagaaggaaggaaaggaaggaaaggaaggaaaggaaggaaaggaaggaaaggaaggaaaggaaggaaggaaggaaggaaggaaggaaggaaggaaggaaggaaggaaggaaggaaggaaaggcaggaaaauugacauaagcuugaaaccagccagggcuacagaugagauccugucccaaaaagaguaacagaguguaugccagguccugguaaguagcagacaggaaacccagggaaauaguaguuaugagacacaggacacaaaucuacaucagaugguuucuuggauuuuucuagcaagaugcucuccacuggcacuuagcacacugcuguguggauagcagccuuaucccgugcugccagacucagccuccucuucaguuuaugaucagcaccuuguuuccugugaggcccuuuucccugcucugaucucccaccucccccuaaagacagcucacaugcagcuguaccuggauauguugcugguccuuuugaaaauacguuggguccaucacagcucuaucuuagaagcagaaggagguguuauggugugauggagcauagcuaggcacucagaggcacgagcuagggaugcaacgggucuuggaggaaaaguccagguguucugugacgggauuguagauugagagguggagaguaaauuuggagaugguaaagucuuaggcugacagacagcuacugggaggagguggcauucugacagaugaucagaagugcauuuugggggcccaacaggcaguggcaaguugaacuggaacagagauaguggcuuguagccagccuuccuuguaguccuuggcugaauaguaaccuacuauguacagggugggcaagcagccacccauugccccugugaucacacauccuggccuggagcagauuuggguagguucugugaaaucauaaucugugcuaaggaaugaagaggacacagaggacugaagacagguaggaggagcuuacaaguccaaaucagauaaucacauagaccuugcucaaugcuuugggcagaggguccuguacaaaacaguggccaguuccuaggaguggcagugucauuugaacagaucugaaaggggguagaagagauagaguguggcuccuuuguuuauggugccauuggucuaacucauauuccagccaggccccugcugcugccauugggcaaagaggcaccaacuggagaucccaugaguuagaguguuacaaguuagcaaaugcauggagcaaacagacacccugaagaacccugacuaagaacauaaagaauguucagggagagugaaguggucuauggacagguacagaauuggagauggcaugcuaagcuaaggccaugcagcucuggaguguaaucccuaggccauccaggugaaaaggccuggagaagcugacaugaccccagagcucuguacucaauagauguggguggauaaugcuuuaaaacuguccccucugcagacaggcaggggcugcuguaugugacuggguaugauuaugugucucccauucuuagcugcgugaacauucacagccagcagcaugugcugguaaugugugccacugcuuucuaccugauggaaaacuacccucuggaugugggaccagaauuuucagcaucugugauacaggugagagggcucuauugaacauaggcagguuaccauauuaacuguaccagugggucauugugcuuuuggggaagauaagaauaagccuuucuucuugucuagauguguggaguaaugcugucuggaagugaggaguccacccccuccaucauuuaccacugugcccuccggggucuggagcggcuccugcugucugagcagcuaucucggcuagacacagaguccuuggucaagcuaaguguggacagagugaauguacaaagcccacacagggccauggcagcccuaggccugaugcucaccugcauguacacaggugagugaguuguaagggucauagacucacccaaagacucaagccaggccucaugguguggcagucuuaguguggcccuaagacauccuggucaccuuuccagaaauuuagggcucaaggcaagagaguagcucacaugauaucaccaaguauugauaucagagcugccucuggccacugcaucccugagaguuggaagaaaguugggcuggguccugccuugcuagggacuguaaucaccuguuuuugaaggaucucugccuaucugguaaaguccuguuugagccacugagugcagauuucaaaacucuugggcuucuguucuguauagccuacuuaguguuuuuguuucaggaaaggaaaaagccaguccaggcagagcuucugaccccagcccugcuacaccugacagcgagucugugauuguagcuauggagcgagugucuguucucuuugauagguaagacaugcagcaaaucucuaccucuaaccucaguagucauugacugcccuagagccacagccagagcaguucuucuguguguauuuguucauucucuugaacucuaaaauguaucuuugcagccauuuuuccagugcaugcauauucacagagcaccaccugcaaaccagacucagagacaacuggacccaugcagguguacaaccaaaccacugcccugguggaucccauaggccacugcugaggaaauagauacuccuggaguauagccaagugcugugguggggcucaggccauauccacaggaaggaggcauggcuaagggucugagucacuuguguacuucucagcuguauaccacaguuguguggcauuaguggaauaaucauaggucagcggucuuuaaggaugcugcugagguaaggguaaaguguuggauguugagagaagaaucaacaggagcauagauggguguccaauuuugaagggaagaaaaguugcugauugacaguaguacucuggguauuaggacauacaacagugaaaaguuuugguacauuuugauguggagagucucuucaguaauaucaccaccccacccuuuugcugcuauuccuuuacaaggcugucccacaacugcauuauucuccccagagugggaaagaucaccuugugcccagaucaaucagggcagcaaaagaacagccuggauaucaucuuuggcuuuuaaaacucauacccuaguuguggucugagccccacuuggaacauuccugugggucaaggaccucugagccuuaguccaugauggcucuaugggcaagguugagaggccaagagccagggugaggcucaaaucagcuccucucauuucaggauccgcaagggauuucccugugaagccaggguuguggcaaggauccugccucaguuccuagaugacuucuuuccaccucaagaugucaugaacaaagucauuggagaguuccuguccaaucagcagccauacccacaguucauggccacuguaguuuacaaggugaggguguacuugccuugugggguaaggacagagcaggaggaggaagggggagccaaucccacacuugccguaggccugucaucagggcuagacucauccuuuaagaugaguggcagcuguggccccaguccccucaccccaccccacagucugacccugugcucagggcucucuugucccuagguuuuucagacucugcacagugcugggcagucauccaugguccgggacugggucaugcugucccuguccaacuucacacaaagaacuccaguugccauggccauguggagccucuccugcuuccuuguuagcgcaucuaccagcccauggguuucugcgauguauccuuccuuccaugggacuuuggccagguuccuuguucacuuagcauccaguucagguuucacugaauguuuucaaaccuaaacucuaaagaaccucacagguggguggugguggcgcacgccuuuaaucccagcacuugggaggcagaggcaggaggacuucugaguuccaggccagccuggucuacagagugaguuccaggacagccagggcuacacagagaaacccugucucaaaaaaacaagaaccccacaggugaugcuuacccuucccuaaaauguugacagggacacgaaacagaaggucuaaccauuugccagccaggguuuauggcaguuuuacugcugagggaaagggaaguccaaagggaggcagggcagcucaggccagccagccacuggcccugcggcugccccaucaucuggcauaaucugucccucugagguuuucucaaugcugcuucucauuagcucucaucuuuacgcuguggucacccuccuggggaaagccguaaguaaagcugcaguucccgcccuaacagugaugccaggaguuccucuuggcagccuccuucucaguagaccacaagaguuacuagcagcaaagcugucuugguggugacaguacagccucacccuaaguacugggaaagccuugcaggcagggugcuagcuagcucugcccucccugcacuggagcaguuugagcaggaacaccagccacuagcacuguguggggagcacagcccagguaagugcuguugugcagagcacugggaaccagcauccugucugcacugcaugacucccacuuccugggccucucugccuacccaccccuguccuccugggcagacagcaagcugcagcugagaaaggauuacaggcagcugcugcuguuaauguggucuaggcugcccucuauuuugguugcccucagucuucccugggccucuugguggacuuaggaggggaaccgcuuggggaggcugucuuuccacccuugccaucguuccuccuuaacucuucuaccagccuuccacaugucaucagcaggaugggcaaacuggaacagguggaugugaaccuuuucugccugguugccacagacuucuacagacaccagauagaggaggaauucgaccgcagggcuuuccagucuguguuugaggugguggcugcaccaggaaguccauaccacaggcugcuugcuuguuugcaaaauguucacaaggucaccaccugcugaguagugccugugggacaaaaggcugaaagaaggcagcugcuggggccugagccuccaggagccugcuccaagcuucugcuggggcugccuuggccgugcaggcuuccacuugugucaaguggacagccaggcaauggcaggagugcuuugcaaugagggcuaugcagggaacaugcacuauguugggguugagccugaguccuggguccuggccucgcugcagcuggugacagugcuagguugaccagguguuugucuuuuuccuaguguuccccuggccauagucgccagguugcagcugcccugguauguggaucagaaguccuagcucuugccagaugguucugagcccgccugcuccacugggcuggagagcucccucccacauuuacccaguaggcauaccugccacaccagugucuggacacaaaaugaaugguguguggggcugggaacuggggcugccagguguccagcaccauuuuccuuucuguguuuucuucucaggaguuaaaauuuaauuauaucaguaaagagauuaauuuuaauguaacuuuuccuaugcccguguaaagugugugacuuggcaaggccugugcugcaugugacaaaguuuauggaaguggaggggccuucuggccgccacucccucuccuguagcuacucagucuagucgggcaggucccuccuguagcccucccaacacccuguggcacuugcacuucauacagcucccuuuucuuaugcauuccauuaagccagcacagagagagguguugguauugacugccugugugagaauccugccuguggccuaacugaggaacugaaaaacugacuuccacuguuagaguuauaagaggcuugcccuguggcagcugcccuccucuccccuucccaggcaugacugucaagcuaucuccucccugguguugaugcacucuccuagucucucagccuggguagaaacagcaucugcuggacccaaaguggcuaucccaauaaccucaucccugguuguggcugaccugcacuguagccugcccacacaccagcugaccauuguggaugcugucugucccuuuguaucuucugcaugguugggaccugagaagugcugaccugauuaccccaaaggugucucugagcuaugguuuguugguuugucucaguuucucauagucaagggaaagcuugguguccuagcaacaguuaagaauggacccagagccucuuuugccccuucccaucuugccuucugucagcccaguagaguacagaccuaugccugucagagcccagggaggacucagcugacaagaugaggcaccaaagggaagguucaaaaucaggucagccucuggccucagacagcuucccaugcuggucagagccaccucuucccaaagcccaagcccagaguaaccaggucauguuaaugaaaaugagcuaccuucauuuccuggcuugguuugggaacucuguuugcuguuugacuauaugaccaagcagauuuucugcuguuccgcuaagucauaucuguauuucucagcuguagaguaggggaguggaauaguuuggagauguuucuaggcuacacaggaggaaagagcuugcagccugugauuaacuaacugugcuucaguccauggauugcuuucuugagacccuugaauuucccucuaucuuuccaucaugacaaguagccuugcugcugggaugcaagguucccuaccaaacacagguuguggggagccucacacuuggccugacucuccuccuaucugcccuggcaaaaaccaccccaaggcgugguaacaggaacaguggacauggauuaggucuuucaagaggacguuaagggaagcuacugaauuuuaaugaaagaaauucaccaaugccccuuugcugauuuagggcuucuucuugucacccucaauuucccgccuagaagugcucggggaccaugugaaaguucuuacagugcugcugccacacucugagguugguccaaccgcucugagaugagcauggugcaggccugauuacuccucaugguagauguucauaaggaaacucaauauaaaaucuagagccauucaccaggggauuauaucagugagcucaaccucaaguuuaguuggccucuuguuuagugugaucagaaacaauucuuaguauggggcaaggacagccucugccacaaaguuguugucugcucaugggugccacaaccuagagaugcaccuggguacaggcagguauguauuuguguacacacauaaacacacacacaauccucaaagacauaugcaaggccucuaaaaaugccugccuguuuuuucugaaagcagacuuuucuugcaacugccacauacagucagcuuugugagucuagcaucugagaaugggacucaauuuuuaaaaguccauagcucauuaaagucucacuggagacauugccccaccugucuaacugcaggagggacuaaaacuuuuuaucaaauuccucaaaaaucuaaagauuuccaagcuuuauuuaaaaacaaaaguuauuuugacuaugagguuuuagggguaggaggugggauguuguuucuguuuccauggugguacugucaggaaagauuuuaauaaaaccaggguagaacuuuuggcaaugcacuucagcauguuucuucuccaaaaugugccucccucccucccacugauggcccccuugacauguaggugacuuagccacugccaagugcccuuuaugguucucucauuuugucugcacauguacccuucaggagggaagaacuggaguggaaccaccuccugcccuguagaaugcagugccagggaagggaccaauccuaacaggugccuucccuggcaggaaguaccuucccgugagugagugaagcagcucugcuuccggcucaugggacagguuuuauacagcaauagcuugucucacagccacgucacaaggagucuugccucccauuguggggcugcagaauuggucuccuugccaccugugagcauccuuccccacacagucuccuucccucccuccuucccucccucccucccucccucccuccgucccucccucccucccucagcauugagcacuaggaucauggcugcuaccaggacaggcaugaagcuguccuccagggauugguaugugggagucgaagacacugagcugcugaugcugggugugggcucaggauaucaugguugggaaaagaauuguuccucagugggucuggagccuccaggaaagaagaaccaaugcugagcagugugacaacuaaagaugauaucaagguucagggccacccuccaugugugcuugucacacucuagagccaucgaaggaacugcuccccucaagugucucuggaaacacccucugccgcaagcuggguguaagauaauagguggcagagaccuaucugcagagauuuggcugcauucuagggggcuccuguccaagccuugcugcuguaugccaugggcuucacugggaacuaggagggcugugaugggugugccccggagcccagccuagaccuggcuguccauuuccaaaaggaaggacugacaugaaauguauauuuaaaauuuuuaaauugcagauauuguacaguugaauuaaagaagcgauuaaaccaccuguuguugcuguuugaggcuugcuuuacuuauaaaaccuccuuucuagcauuugaggagagcauccugcuuaucuccaguggggcaaggauacuaccagcagccaucuugacacuguaaagaucaggcaauacuagguauagaaugagacugugugccuggaauugggaccaggccuaggaguauucgcagacccuauugaaguggucucccugucugggagauauggugugccaaguucucauaguuauuggcauuuuaagccugucgugugagauccuagguauuguuucagcuuccacacauugcuccaggguucuagagggguggugaggcucuguccucacacaggacacaguuaguaguccuuggagucuuugcaugcucuccaccagcccuucugccuuucuggacaugcuccugaucc

SEQ ID NO: 2425 - RNA, 3235 nt, Mus musculus
cagaaccgauuggcuagcggccggggaggccugccugggcccugcuugccccggcagaagggccgaagcauggguccgugucccagggcaggggcccaagcggucgcugugcuucggagcugccuggcucuucuccggucugagucggaagguucgagggucugacuccggaagccucugaagaucuagucuaaggugagcgccagguuccccgcggaccaccgguuacaucccgccgcccugcgcgccucgccggcuccggagcgcgucgccuccccgcgggcugcgggucccaggggcgagguccucggcgcggcggaggguggagggccgaggggcggcucuuaaggaaaagaaguugaaucaucagagaaaccauuaggcuaaugugaugugcuguaaggcgugggaucaaugcggccaggccgcugggguggggggggggguggggguugccgccgagcaugcgaggcuccugcccauuugggggaaauggauuuuagaaauuucagaaagaaaacucaauccaaaucuagauguaaaggcgcugugguugucaagcuucgagagccauuuaugucguguaggaacagugaccucgguggggugaagccaacaucagguggguacagugaccucaaggggcgaagccaagagugagguucuaaagaaacagaugaaagagaguucugacacuggaugagggauggcagagcuccuggggaagugacaguggcuccucagcuggacauuuuggaaccuuagauucccucagacaguggcuucuacuccuccauguuugggcagagaguuggauacuaagauacccaaaccuaugcagagcccacucugagcgcaagacccuaggcuuaggggcacaaugcucucccaacuaguccuauguugcuacgagggacaucgaaucccacaguaaaggcaaggcucaggcccuggaucagagccugggcacauggcuccaccagguaggucccaugauauuaaggugggugaauagaggccccagaaaagaaugagcuucuucaagauuugaacagcguccccauuccauucucucugucccccaaaagcccuucuucuugcuggcccaaaguauuguucccuucuagaaaaaagaggaggggugugggcugcgacauaucuuggggccacaauggacuuguacauacaaugaccagguaagacugggccuggacacugcuggggagcggggaugcucagaggcaagccucccguucuucacagccgcccuuaggagguaaaguggauccggaaaaugauuaaggucuuuucuccacaaccaauuucggucagcccuaagggcacguggcaucauucugcuugcuugcuuaucauuguuugcugucugaacggccuggaggucugaggaaguccuacuaggcuccgggugaguucuagcuucugucuccaagcuuuuaaaaaggaaacgaaugaauuccaguguagggcccucagaucuacucccugguguagagaacucucuggaaggaguugagagacagugggcucucccacuucuggcccccucauuugcccaguugaaaagaaaucccaacauugcuuccgucucccagaucacgggaugcgugagccuuggagucagacugggacugauuauuuuucgaacacacaacuaggauagcaccccugucuuuugugggggcacugugcagcugcgaggcucggcgcucgcagucuuaagaugggaguaucgggccccaucccagccacggggauccaggaaagacacagagcauagugagcuucccccugcccccugugugcuagggaaggucugugcccagggaccaggcugagcuccucccaucagguggguccaucuucuguucucggccaaggcgagcguugccuggacuccaccagcacccgcguucauguaccuccgccucauucccgaugccuuccggaccucggcguccccaccuccguuacaugcccucggcucggaaaggaaccuuuacuaugugacugggcaccuagcccgcguaaggacacgcaggaugagguggauaggagacgagaggugaggacggaggggagggucugcagaccgcagcagacugcgagacgccaggugagcggccuaggcgggaucggaggggcgccgcgggccgggcggggcugggcccggcgcgggggcggggcggggcugcgagccacagggucccuugagacugcccggagcgucuaagcccaguaaggucggaggagggccggcgucucaucccgggcuccgcaguacgcacccccccccccccaugucucucacuccuaccugauggcgaaacagggccucguggcaccagcggaaaggugcugacgcgggauaugcagccgcguccgcagcccggugggucgaagcgcgcggaguccgggacccauagugggaggcaggaccaagaaaccagagcgcccgucgcagggaaggagucacuucccgcauggcaggacgcgugagaagaaggaucacggccacuggggagagucgagcgggagaauaacgucgcugugucccgggcgaaccaagagaaccagcaggcggagggcggggaagggagacauuccagggcgagcgcagaaccauggcuagcaggcgucuggauccgcagagguggugccccugcaaucccggaucacgcagagcccacgggugcuuggucuguuuagcggucuccagcccagggcuucccggagguccggaugcagcccuucuccauccacccuucgcgagugucgccugugggccccgagccuccuucccgcauucugcgccgcagauccccggugcuccagaaacagaagaccuagaucccagaccagaaaggcggccgcagggcacuaccccacacuguguugcaaggucgcgaccuuuaagcccuuuugcccccuccaaggcgcccggaccccgggugaggaguccggugcggucaccgugaccagagugagagggaugaaaccccggaaagcggcguggggagaaaaggggguuguuugagaccaaaauaguuguaaagcuaaguaugugagcuuuaacggucaaguucuagcuaagccgcgaggaugcacagcuuuuuaaaagccgaguuuuaagugaacccaggugagacucagauugggugaaaauaaaauuggaacguacugcagcuucucggguggaaagucacccuuucuccgc

SEQ ID NO: 2426 - RNA, 2550 nt, Mus musculus
guuuggagaaagcaucuaguuuauauaaacuuguuugaucaggcuccccagagacccuaucgauccccaagauagguuuugcugguccugguaggucacugggugcuagucucuaagugaaagaacuugaggacaucucuuaaaacugucuuaacaucccuaugaggcaggcacgauccucccagucuacagauuagaaaacugaggcucagcagacgacuaggguggaccucuugcuacugccauuccacaccccucagggcuuuccccaggacucacccagcaggguuuuuuuuuucuuuuugauuuuaaguacaccccagauugcuuagcaccagggcggcucaagucugggugaguagacaaacuccucuuggugggacaggauaugggcaagagucauauaaaguccaagugucccuuuugggugguagccaaugacucaggacccuuccucagaaaaguccagagucacucaugucccagcugcaccacugggagccagcuggagagauccuagccugagaauacccaauuuccaccccagagccauuauacugacuagugacaguccccuccaccuaccuacccuuaccuacuugcucucacccuguaagggaggccgcugacggguuucuccaggccaucagcaucacagcaugacaggagaggguggcuuacuggggcaaggggggaagaagacuccccauuuguagcaggaguagagggggcagauaggacagagacagaaagacgacacugcccaacuuuagggaaucaugguuuugaaggucagcuccacucugcccuaccugcacagagccucaguuuuuuaucuaugacaugggggugacacccacuucauaggguccccuugggaggcagaagccuacgggugggcagacuuuggguucugguggccacggucauggcugcucguugauuuuggagacgggcuuuuuccacacgaggcgcuggcaguguuccagggcauuacacauuucagcggccucugggcucuugcaccagaagcuggggcccaugacgcacugaucugugccuagaaguggagucuuagggccguggcaggcccccaucuucuugcauagguccgugggguucaucaugaacuugaggcucucuaugagcacagguucauacucggccacaaaacgguugcacugcaucacauaaggcaacggcaggauccggcagccaccuuugaaggcauucagaaugucccgcuuggugcucuugugguccagauucugggaagacaugcccagcagccuuuugcacccuuggcagaagcugcccugguuuuccucauccaccggcagggauggugugguugccacagcccuggagauggaccuggcccgccuuuugcugccacacagcuugauggucucacauacuuucucuggggugacuuuggacaugagcugcaccaauucagggcuguaggugucuaccagggugaugcacuguuggacuagaggcucgggcacuacggugcacacucgcuccaguguguggcugaugagagcuucugugcuguuggucacaagccacuuguccagcuccuggaccaaguucaagcacacgucgcacgucaggcccaacugcaucugcaacucauucguccucggcaucuccaucuccagagaggggacuccauccacagcggccacucgagucagccagugggcagacucucucucacagaagccccccuuccugcagaccuccuguggggggagacccugcaauguuugcuuagcagggacaaacugccgguggauguaguucucgcagagggcagccaggccaggccccauggacugacacugauucuggacaguuaccucugccaaggucaaauuagacucuagagcauccuggagcaaggagaucagcuggacacaaucaugacacacagcaccuucaggcaucugugauggguggaagcucaacgccccguuggauaagaauggggccaucaccucauuugcauccuccugggucagcggucucuccgagguagucucagcuaggugccucuguaaugguucacagagggugagcgcagugcacacagaagccaggucagucuccugagcgccacugagcaugcucaggacagcugcgcugugguuguucaccauccacuugcacuuagcugaagacuccuggcuuggaagccacucacaggucuucauuacugaugucaaaauauccgacucuguagcaccuggguucaccccauugccagcagccgcggccacauccuggcacacacugcagggcagggacuugacugugggcuuguuccagacagcacucuggcagugccucacggcccgacacuuugcagcugccugcagguccugacaccauaccuccgaacccuuggcacacucacggggaacugagauggggcuggcccuggcagcccccaggaggccagaccagagaaucagagcgcacagcauagugcccaugguuccacuggcugcucccucugcuuggcucucgcuauaaaacuag

SEQ ID NO: 2427 - RNA, 11913 nt, Mus musculus
gaagccucagucuccgcccaccggagaaggaggaaacagaauuccgucaugacucguaauuauugguggaaauggucuguccaucagaacaacagcggucacggauuagcuaaaaagcagcaguaggugggaaaaccgguguaaggggcguccgcgcaugcucagugugggcgcagugacgcgaccucgggggcagucauggcggcucggugugugaggcuggcgcgccgcagccucccggcuuuggcacugucguucagguaagagagcuucacuccucugcgucggccucacucacggccgagagcucuggugggggguuuagcggcaggacugguccccgcaggcggugcccgugcacccugaagucacauccucaccaucgagucccugugccuguucucaacgcgcggcuguccugguguuuacugugcggcacugcgcgaacugggcucaagagacgagaaguggggacgcuggggcguaaaugcggggaucugggugaugcgucagguggaaggcuccgccauuuguuugucuggugacacacggcacucucucgggcauaggggcaccaccccuccuggaauugcaaaagucaagcuuagaagcgggagacuugcccaaggucaggcagccaggcagaagcccgcccgaccaggggcugggguugcuaaucccuaauccaguccaggauguguacugccugguuugugggcuuuuuccacucacauuccuucccccacuuuugcccuccgcggaaugugagguccaaggagcaagaaagccagugugugugcaguuuauuuagacaaugcccauuuuugccaucuuuacuuuuacccguggcuucagguuuuugagucgcaucuccaaaguuaggcucaguaucuuuagcuuguucccugcuaggaccaaguuuuugguugauuaaaaaaagagagacuuugccugagucuuauggaaacggagugaacgggagcuggccuuuucagcgggugagagugagcaggcggaugaucucguacuugugacuaaaagaugaaaacaggucuauguugugcaaagcagggaggagucugaaguauuccgggggaagcacuuccuauuuguggugcucuguuuagaguugacaggaaagaacccccauuucccaucccauccggcccugucccaucccccagcuugguucaugucuaucucugaaauugugguuuugaagaaagaugcucuaguaggaagucauaacuccacaguaucccauaagcuuggcuucccucuuuccuccgagacauagcccuaggaauuccugcccugaaaggaucuauacagcaaaacugaucugcugaaaggcugugguggucacuccuagggguggaaauaauucauagugaaggcagccuucacauuuuguagguuuuuauauucuuagcauaauuuugcuucucagaauuaauuacugaucuuucuuuuuuaaacuuacguguguggauguuuugcuuguauguguauguccauguguaugccaagugccuucagaguucagaaaagugucagauacccuggaacucuuagaguuagguaguuguuagcugggaaucaaagucaggucuuccacaagaggaacaugcucucaaccacugagcccaacucuccagcccagauucuuagacuuuuuaaaagcgugaaaguaaaaauaaaauuaaaagaucacugcuggagccagagagagauggauggggcucauugguuauacacuggcugcuuuuguggaggacccagguuuaauucccaucauccacacuggguaggucagccaccuguaacuccagccccagagaucccacaccucuucuggcugccucuucagacucacuuccaggacuccuuuggacuucucuucccauuuccucugcauacacucccacuuucaucucucuguccaagugauucccaguuccugagauguaucucucuuacccacccuacucuguaacucaccugggccugcuguggaccugugcacaagagcacacacuguaaucccaggacucagcaccugggagacugaggcuagaggauugcaaguuuauugccagacucaaucucugaauaaacaaauacaucagaaaagaaaacuaggagcuggagagaagucucaguggcugagagcgcuugcugcucuuguagaggaccuaaguuuaguuccuagcauccacacugggacagaucacaacugccugcaguuccagcuccagaguauccagugguuuuuggcuuucauaggcacccaaacuuauguggcauauacuuacacagacacacacagacaaacuuauguggcauauacuuacacagacacacacauauaaacuuauguggcauauacuuacacagacacacacauauaaacuuauguggcauauacuuacacagacacacacauauaaacuuauguggcauauacuuacacagacacacacauacaaacuuauguggcacauacuuacacagacacacacacacauacaaauuuauguggcacauacuuaacacagacacacacacacauacaaacuuauguggcauauacuuacacaggcacacacacacauacaaacuuauguggcauauacuuacacagacacacacacauacaaacuuauguggcacauacuuacacagacacacauacaaacuuauguggcauauacuuacacagacacacacacauacaaacuuauguggcauauacuuacacagacacacacacauacaaacuuauguggcacguacuuacacagacacacacacacacauacaaacuuauguggcauauacuuacacacacauacaaacuuauguggcacauacuuacacagacacacacacacauacaaaggcacacagacagacaaacaugcacauaauaauauaauagcaauacauguuuuucuuuuuuguuaugucaguuuguugggcauugugguccacaccuuuaaccccagcacuugggagacagagggagucagagcccuguugaguuuggggccaaccuguuauacauaucaaauuccuagccagccaagguuacaagagugagguccuugcucagaaaagaaaaacagccuccugggcuucccugcagccauaggucacuguuuuggguguuuacuuuuugcugucuggcaacaagauuuuugcuuaggccacugucaucagcaggagguacagugggucuuauucuaugaaaggggucugggugcuuggacucaaggggacaccauagaauacaugagaagauaaauaggggacaccggccaaggguggauuacagauuguacauagucacaugucacuuaaugacagggcugcuuucugugaacuguuuugucaggugauccuguuaguugguggguaucagagugcauugauaacaccuaauggggcagccacagccaccuaugccauguacuguuaaagacuguuaggauaggggcagaaauagagagauagcucuauaguugaguguuugcuucuuuucuguaggccccaagcucauauuggacaguucacaacuaccuguaauuccagcuccggggaucuaguacccucuucuggucuccuaggacacuucacucauguggcauacacucauacugacauaccuaaaaaggcauccacauucuuugugugguguaugugaugugagcacauugggaaggcccaaggucaacaccagggaucuugccucuauuccacccucauuuacuuauuuguugggggccauagcaaauguguggaaaucaggacaacucguagaaauuaguucucuccuuccacuauauagguccuggggacugaacuuagguaaugacugucuuggcugcuaguaccuuaacccaauaagccagccugaagguugugauuuaacuagaguggguggccaguggacaggaaucugccugucucugccaccucaagacuaggacuacaggugugccucuauucuuggcuuucuuauauggguuaugggaguacaaacucaggucuugguauugcacugcagggucucaccuauugagacacuucccccagccccauagcacaugccuuuuguaugucacaguugccuuugugagguauaagucuuuucuaguaaauaguuugaaauuacacagauuuauaauuuuguuuuaaacauucccuuuguuaggagaagggcuugcauaucuguacaaugaguguguguggagauugggacagcuugugggaaauuggcucuaccauguggguccugcaaauagaacucugguugucaggcuugguagccaguauccuuacccacugagccaucucaaaagcucaaauuucuaaaaaucugcuuuuuaucuuuagcaugcugaaaggcugucuucauuuaugugugggcuuuuuccuaggccuucuccucgcuuguugugcacagcuacgaaacagaagaacaauggccagaaccuggacgaggacuugggucauugugagccaaagacagauccacccucugcagacaagacccuccuggaagagaaggcaaagcuggaagagcagcugagagagaccaugguaaggacccucagggugugcucacugcuggauugcugccugcaugggccaaguucacagaugacagagcaaagucauuuauuuaauaauuugucuacuuccugcugcagacccagguagcaagcugucaaacgggaauuagaauucaaacccucuguggcucugcuucugaccuggggaguuucuguguugacucugcaauguuuucucuacaaaugaggaauacuuguuacgauugagcugggacucaggaagggaaccaguaaauucuauguauaggaguugaguaugggagucgugguagcaauuaccacucuauguugaaaagcaggcaccagucaaguuccuuaaggguguggacgauuuguagugucacuuaccuagcuggcacuguggucccuucauggaugaggaaaaugagacacagaaaagccacuucccaagucaccaaggcuagaacaggaugaguugucuuagagccuugcuccaagacugccugaaaacugagaucagagguauaggagagaccucuggaguccaccaauggacauuaagcuggaaauggucagaauagguagcgacagggacaguggagagaggcaaggacgguaauuaucuggcuagguacgugagauuuccuaccaagugaccuuccuuccucuccugggaggcaggaacugagguuggugaccacuagugaugugcuuccacacccucaagugggacaagaaaauagcauucuucccucacaggugacaaagguaucagucagcacuuaaggacuuuggcucuuucccauugugggcucggguagaacguucccugcuucuuguagacacuagcauaaguauaaauuacucuucuaaacuguccugguuuugucuaaaaucucaguuaaugacagguuuuauuuauguucugauuuggaguauguugaaucauuucaaaaucagaauggcuuucuuacacauguugguacauaauuccucccgcccccuuaggaaaaauacaaacgugcuuuggcagauacugagaaucuacggcagagaagccagaagcugguagaggaggccaaguuauaugguaagcagacauugugguuucaaggggaaggagcagggcugcggcugugaccagcacguagcgugaugggucuuccacugccuucaccuguugcuguucuacugcucagcugcccaugaccugccaccuugguuugggagccucaaggacacuuuacuacgcuaauuucccuuuuuaccuguguuuucuuccuuuucuacccauuuuuagcccauguuaccugcucuuaucccagagaaggcuccuuuggguguuuuaaauuauuaaaguacugugguauacuuaaugauuucaccaggaaucaugaacaucccuguguaaggagcccaugcaauugagacuuacgugcagaccaucuuuuccuccaugcaggcauccaggguuucugcaaggacuugcuggagguugcagacauccuggagaaggcaacccagaguguuccaaaggaggagaucagcaacaacaacccucaccugaagagucuuuaugaagggcucgugaugacugaaguccagauucagaagguguucacaaaacacggcuugcucaggcuugacccaauuggggccaaguucgacccuuacgaacaugaggccuuguuccacaccccuguggaggggaaagaaccaggcacuguggcacuaguuaguaaggugggcuacaagcugcacggacgcacccugaggccagcuuugguggggguggugaaggacgcuuagcucccucccucaggcucuggacuuuguaggucacuugcuagaacucgaagggcgggcuuguaauuucucaucugugaauucaucugacccuugcccagccuuguuggaaaucuuaaguaagcuaagcagaacaugaagcugcuugcacagucagggacucugggagucuggucacugaauuuagcauuaccuacuucagaagagggccaucaggaccucgggaguaguaugcuaacauuguaucuguuccaccuggugauuaguacuuuacacaaauaaaaggucuuuggcuauaucuaugcugcacagucuaccucugaguaccaaggcacuggaagggaagagccagagcaggaacacuuguugccagcgaaaauaagaccuucaagagugcauauuccuuuacaagucaguguaaaaguccugagauuuggacaccugcccuggcucugaaaugacacggaguccugguauacuuagugaugagcugcuugcacuauaccugggcaggguucuuucuuaucucuucuaacccgaccaugcugccuaccacccagucaugugcccaguuaccugcuaucuuagucuugcccuggcugcuccugcuccguucaaccucauagugacacucugcccacuuucuggccagccauuggcugaucaggugacagaaagcgauuuuacacaacacagacgggagaugcuugaugaugccagcaucugggcuacaaccagaucuccagcacaguagucagcaucugaacacaguucacaacuguuccccaucagacaguauucagcuauugugaauguuagccuucagacagggaaaagaagccaugaauuugaacauguuuagcucuuucccuguuuauacucuuaagcuguaacuaaguaguugcuaaggacaucaagcccuauccagauagaccauauugacuguaaagcugcauggcuggcaugcuuaaacauugccacuugggagguuguggucaaggggauuagaaggcucgucuuuuaucuucccacuuucugguacuggauuuugucaucuaauggagaucugguaggcuccugaggagaaacccuggcuuacucagcucacagcucuucaagcuuggggcugcagaagccugggcucuacgcuggccuuacauacaguuauaauacagcucaugggagaaagccaggcagccaaagccacgacacacaugagaagcugacuuuaggcucccaccagccaaaagauucuucccuguuauugcaagcucagaaaagcugaugaaauggugauguaaaggaagccaugcgacagcagugaguacggccuugaguauacccuuguguagaagccagggcagaacaggcaaagccacagagguagggguauucuguuuuguuacuaaauuugaacaauacaaguaauuuuccccaaauucaagcuuccaucaucaccgaguuucuuccuuuaagcugccuugaacuauugaaacaaaacaauagccagguggagggcagccugacagcagaggcagugccuucacauugcauaagugaauacaccauuagacuccuuuucagcuaaagcugcugaacagcacagagcucugcaaggucucgucagcuccaugucagacugaagacaaucuuucagaggccagcaagauuacucagccaggaaaggugcccgcugccaagccuaaugaccugaguucagucucuggaaacccaugcagggagaggagucccacuaaaccacaauaaugaagucucagaaugguugacagcaaacaugaagaggacuuuuaaguuuguauggcauuauggagacugcacagauccauggagacagugccugcuguuuuguaggagccacuugcauacucugguuuuggugaccuggcaccaucaugacuaaccuagaugugauauuuguaaguuaaucagucaacacuaacaggaguugugcacacauuuccccuggaaauucaggucuugcuccgccacaugcaagccuagugacuggaagcagcaaggucauagcuggcaaaguuguugaguuuggcuagccagaggcagcuggaaaugggcccugcuccauggaaaucaucuuuggcacuuugaggaucagacucaccgugauguguagcugcaugguccucaagaccuucugcuaugcuacagcagcuugucaccuugggucagaagcugguuuaacagcagagugugcugagaaguuggaggaucaagaagcaaacagacacaacucuguucucaacaauuuaauguaaaagaagaauaaaaaugguaggguuucaguucuucauacauucuuggaauguuggccucccagagagcauuauuucaaacaguugaagaauuaucuaacuuuucugacucaaagacaauuuguugaaauuugaaaagacuugguuccaugggguuguaguagcuaauuuaucaagagaauuaaauacaaacaugucaaugucucagcuaacaaaaaauaauaugccagaaacagcuggggcagacaggagagcaaacaauccuaauauuacuuuucccuuguaacaauauuaauacuugaacauaaauuaauuauacauucauuaugguguuuuaaaacagucacgcccaaauaaauuuauaucaucgaaagauguacacacacuauaugccugcuuaagcacagcuuuuuguccaacagcccuuggccacauguugacagaauccucugcuucucaagcuaauguagauguggcugucauuuuguagaagacacacugaaacuucaaaccucaccaagcugggauucuggugcuggaaacaccaggacaaaaccagugguucucaaacuugagcuugcaucccagccaccgggaugguuugaaaaacacccugcuagucccuguuaaugaagcccccaaaucucugcuucgagauuuaaccugggguaugacuguauuucugacagugccuggggaacccuacuuugagaaccacuggcucaccuaggcauugaguaccaaccaccccauugcuguucagucacaccagcuacuguccacuauucaacugcagggggcaguguggagcugguccuuugacaccauugcucagcaucuucuggugucaagagaaaucugggccugcuggcccacaaugcacuuuacaacuaaagccauuuacaguauauuugaaauguuuuauuuaaugcugaaaaacuuacccuaggggacagaggauguaaaaugaaaaggcacgucgucaugucguccuuggaaaugaguuguuuucuucaaaauaacuucacuuuuacuuccgagcccaaacacucuaugagguaaacaggcucuuguaccucucagggacagggggcaggggcuguggucacuccaggacucuaaagcagggucugggcgugagagcccugagcagccggaagacaaaugccuuccucaaguuuagaaggaagguaccauaugaauccgugaaggaggccccagaaacaagcuuuucaguagggcugggaaggagccauuucugaguuuguugcaagaucacauacaaaagcagugcacaggcuccaaggcacaggcaggaugcucuguacuuccuaggcccccugccauacgcuaaucagcucacugagccaggcuagcuagcaugucuuauauuuagugaaaggggaucuacaaugguaguggaaguccucagcaccuacugcuccauuucaacauugcacacucugccuugaacucaaaagggucuuccaagucagguguacuguaaguguucacagcagcgaaaggcagcccucaucugacccuguggcccuuccguuaacugcuuucccauuuaaaggguacaggaaugugccaggagagccuguccaggcagcccaggcugggccaggcuaagaugaagcaagcacuauugagggccugaaauggcuguuguuagguaaguggaagcucauguggucacugugugcaaaugaggggcucaucuuaaguggcucaguggggagcgggccuggugguggucucuggccuccacagcagaggguucugugcacagccugccucccgguaaagugcggugugccggggcugugcuuggggugucagcuggggagggggggcagcagugggcucagcaaaggggugccaacaacagcccuccugaguaaagcuugugucaccagagaaaagcugauggcaggaacacacggcuccuggcucccacagcauaacagcuucuuaacccaaacggggaaaggcucaugaaauaaaggggacacguccaagguuggggacagucuucauaggaacacaaaggcaagcugucuucugaauggauuaccuuaggacuaaguuaaaaagacacacgcuuaucuccccuaugagucaaauuuaagauugcuacuauugcuucuuccagaaggucaugaaaaaaaaaaauuuaagccuugaaaaaagaauucaauuuguuuaaaagagcaacaauguugggggagaccccagaucauuuggcucacaagcugcuuuagcaucaucuggccucaggaagcaucccuggauauccacccacuuucugugaggaaauuuaaaauccuuuucuuuaggaccuuguccagauaacugggaaggcggcuuuuagaggggaucccuugccgcuucuggaggugaucuuuaauuauaauagucuucacagucacauagcgugcaggacucaaguucaaugaacuacagagaaccuucucccuaucugacagcagcucaaacccaggaagguucucaauggcugcaaacucgcugucuuugccauccuccuucccccuuuuggagcuggccagguuuuuguucuccuuccuccucucccguuugugucuggcggccucauauucggccgacuccuccaucuuuguaaugccauugcgccgguagcgcugcagcucucgaaucuuggcgcgaagcaucuuuucuuugugcauauuuucaaauaaaucaucaaauucuuugcaggacaugaacugguagaguggccguaguuugagccgcagcucuuucuccuccuuggugaucuuucucuucaaugucuucuccuucuccuucuuguccuugcccaggaaggcuggcaccagguuauagucucuggcaauguucuuccggcgcugccucuccuucagcuuccgcacauacaugucuacaugggcacgcuugagcucuaucuccacaucaucaucgucauaguucacagacagcccacugaugagcgucucggcauccuggucauacucuaucucauaaucaucucgcaguggcauguagcccagcugcugcugcucagccacagagauguccaauggggguaaaggugugguaaggcuaggcgagagagggccuccacuggggcaggugugaucugucacccgguuggggauggugucagggaugcaggcuuugcccaaguucccauggauauacaugcuaacguagug

SEQ ID NO: 2428 - RNA, 1455 nt, Mus musculus
accgcagaacugugagaagagcagcgagguuggcucuucacacaaaccuuccaaagaaggaaguugccuuuucuuaccccacuacuaaaaacaugaacgacaggcucauuuccaaacaaacuaugguaaauaaucuccagaaggaaaucucugccaaagaaauuuaacauuuuaauugaugugcuauaaauagaacacugacaaccauacauuaauauucuugcuuugauaaacuaagcuuccagucaaacugucaaauacaacuucaggacucccugcaacaaaacgcccaguuugcuaucuuaagaaacugucuucuuuccuuuggcuuacagucuacaccauagaaaauugaauauaauacaaaacaauuuacuaucuaucccagaaggcuacagaaaacugaaccacuguuaggauuuaauaauacagcuuuaauuucuugggcacuuuugaucauauaaauauauaaaucuuaacaaggaaacacuguucacuguaauaaaggccauaaaaauaacagcucugccguauugcaccgauaaauuaauucaguuggcuuccccagguccccaccaaagagcuuucgaauccgaacuggaagacauagagaccuacacucuuggcaucgaauacugacgaugucaagucguuugcagaaaauaaacuuuaaccuuucacaucccggcaucacauacgccaguucacaggauuucuuaacacuugggacaagagucucgcuggaguccucaugcgguggaggcgcacacgcucagagcugcggucugucaccgcagccagggaagugguccucgguccgaaacaggacuggcggcucguacgccgcgcgcuggggcccgcugggcgccgaccugaagagagcggggacgcugaugguaugcagcagccuccggaaggcccgcgggaagguccccagcucggcuucggccuuggcgaccugcuccuccauccuggccacgcugcucccgaucauccgcacgaaggccuccagcuugucgauccggccguagaugcgccucaucucggccgccuuagcguggauccggggcacgcccucgcccaccacaugcgacgaguccccgcggaucauguccagcaugcccacgaacucguccaccuuggccagcagcuccuccaggcuggcguccagcgccuccaccucuggccucggucccgcgcugggcagcaggcuggaggcguagcccgaggcggcgcggcgcagcagcggcaggucgcggcccggcgcguccucggggccgucaucgucccacggcccggacgcgcugcuguggcucugcgagacguggccgcuguccccgcuccacgcggcgcccaacggcucggccuccucgguagagaccucucgagacaggguuccgacggcggguccuuccuccauggcccgcucggccgcuuccggugcugagcgauugc

SEQ ID NO: 2429 - RNA, 1455 nt, Mus musculus
gcaaucgcucagcaccggaagcggccgagcgggccauggaggaaggacccgccgucggaacccugucucgagaggucucuaccgaggaggccgagccguugggcgccgcguggagcggggacagcggccacgucucgcagagccacagcagcgcguccgggccgugggacgaugacggccccgaggacgcgccgggccgcgaccugccgcugcugcgccgcgccgccucgggcuacgccuccagccugcugcccagcgcgggaccgaggccagagguggaggcgcuggacgccagccuggaggagcugcuggccaagguggacgaguucgugggcaugcuggacaugauccgcggggacucgucgcauguggugggcgagggcgugccccggauccacgcuaaggcggccgagaugaggcgcaucuacggccggaucgacaagcuggaggccuucgugcggaugaucgggagcagcguggccaggauggaggagcaggucgccaaggccgaagccgagcuggggaccuucccgcgggccuuccggaggcugcugcauaccaucagcguccccgcucucuucaggucggcgcccagcgggccccagcgcgcggcguacgagccgccaguccuguuucggaccgaggaccacuucccuggcugcggugacagaccgcagcucugagcgugugcgccuccaccgcaugaggacuccagcgagacucuugucccaaguguuaagaaauccugugaacuggcguaugugaugccgggaugugaaagguuaaaguuuauuuucugcaaacgacuugacaucgucaguauucgaugccaagaguguaggucucuaugucuuccaguucggauucgaaagcucuuugguggggaccuggggaagccaacugaauuaauuuaucggugcaauacggcagagcuguuauuuuuauggccuuuauuacagugaacaguguuuccuuguuaagauuuauauauuuauaugaucaaaagugcccaagaaauuaaagcuguauuauuaaauccuaacagugguucaguuuucuguagccuucugggauagauaguaaauuguuuuguauuauauucaauuuucuaugguguagacuguaagccaaaggaaagaagacaguuucuuaagauagcaaacugggcguuuuguugcagggaguccugaaguuguauuugacaguuugacuggaagcuuaguuuaucaaagcaagaauauuaauguaugguugucaguguucuauuuauagcacaucaauuaaaauguuaaauuucuuuggcagagauuuccuucuggagauuauuuaccauaguuuguuuggaaaugagccugucguucauguuuuuaguagugggguaagaaaaggcaacuuccuucuuuggaagguuugugugaagagccaaccucgcugcucuucucacaguucugcggu

SEQ ID NO: 2430 - RNA, 23839 nt, Mus musculus
gccgcgggucccggacccggaaguggaccgcucuacccaggacccgcugcccuggcagcgucccacugcccagcaauggggccgcugcgcuggcugccgcuacucggccagcuguugcuguuguggccgcgggcagcucagcccgccggcccgauccgggccuucguggugccccacagucacauggacgugggcugggucuucacgguccagguaaguuggagcguuccugagcuccuugcacaguaacugccuccugcggagugcacccgacccagccgggaagagaggcgaccugggcugcagcaccccaccccaccccccagccugauccccugcagucugagccucagccucgggcuggccacuuccugccucggaguccugauggcaucuaucuuauuagacggucccugcaaaaguuaaggcagaggaguguguccccaaaguguggauugacagguagccagucucaggaauaagccuggaguaccuugggugggguagguuuccaagcagguggaugucagcugacuacaggcaacugggcuggcccucuguggugcugacaugagggcuagccaguucagcuuccucuucacacuccuacccagccagauaagcuugguauggggccuguaaccucgagguucuuucuguucaagaccuuggacagagcgggcagggagaggcuuucuguccacuggcucagguuccuugucuauaaagagaaaguggugauuccugccacauaccccuaggucugaguacacuggagguguuaggcaccaggguacuuggucucuuguacuucucuuugguccuuuggacucaucaccacccuuggggcuguugugauggcuucugccuccccaggaaagcaugagagccuaugcagccaaugucuacacuaccgugguggcggaacugguccgcggagggcagcggcgcuucaucgccguggagcaggaguucuuccggcuguggugggacgguguggccucugagcagcagaaacagcagguaagguggggacaggagugucaggacaugggucccuaagguauccgaagugugagaggaaaguuccaggaggagacuagauagggaguuccagaugugcucaggaacaugcuagcuguaaagacaaaacaacaacaacaacaaaaacuaggcuuguggucagggccacugcccauagacagggugacgucaucuuucugucuguucuugguaggggaccggacauaccccuaagcuaggcuagcauuucucccaaaaggcaacaggaauuggugcuuaaucaacacccaggugaacuuuguccccuccccuaucugcacacacugacucuccccugccccuggcuggccguguuuggaaccccuguggcucugugacagcuuagugucacacaguacagagaaugugggcaggcuggugccugauccugccacuggcaucuguaagcauggcuuucucuucuauaagacaagauagccugcuccccgcccucagacagcucaugccaaggauucugaagagacacuuggggcuugccauuggcauguaccagcucugggggauuguugcauagacuuacagguauagccuggcagcuaccucaaggguuuauaguuuaugaauaaacagguaugguucagaaacagggcugucugacuuuagagccugccucuuccaauggggucugucuccaacccucugugaaggguguggcuuuuguguaaagcccuagguaggagucuacuagugcaguucccuggagcccaggauuuuguccgcugggaauccccaauagcuagacaccuccccauauguaaucggugccuugggguaagccaccuauagauuccaccuucagcacacaagccaaaaguaacauaagaccacucacccucaugcccagacuuuucucuaccaaccccuaaauucacuuaccuaacauacauucaccagcaagaccacacugaaccccacauaacaaggccugucucccucuaaauugucaagcccccaaaaaagacaggaugaggaguugcuccugaauuaaaggagcugaaugaaagaugaccauuuacggggacauggggucccagguugaauggugugccagaaagggacuggcggggcagcccgagagguucacagagagccuggcguugcacagcagucuuaguauucuguuuccuagucaugaugauaguacuaggcuuaccaucauccucauuccucuggaccaaccacacaaaagugcucagagugaagcaggcugcagccgguucaccggaagugcuucagacaaaauagagucagggaauagacguggaaguguucgcucaagagaacccaaaaaugaggccgaugagugagucuggggaggggugugaggaagcacuccguucuguuccuucagcuuuuuaaaaaaguuauuugaaaauuaaaaucacauuuacauguccugaccauggccuagauccaggucuccgauagcugccgugggcuaugugccucugaguucuggggacaugcuaugaaccaagacaggguccuccugccuuuguggagugagccaggaugagguguuucaugaggguccuugggaagugcugcaggcuugggaccugugaccugacugucuucuucugccugcccaugaccagguccgccagcuccugcaugaaggacgccuggaguuuguucucggaggccaagucaugcaugaugaggcugugacccaccuggaugaccagaucuuacagcucacagguuuggacgcugugcucaauucuuuaucguugcugauaaguagcugagaaaaacagccaaacuguuggcuuggccuauaguuucugaggguucagccuacagucccuggcucuguugacggugggccuguggugaggucaaacagcagcugaaccauguggauaaggacacuguugauuucgugguggauaggaaggaaccagagauaacguggaccugccccaauggcguacaucccccaauaggcccuacauccugaaauuuccaguaccuucucaugggagcaagccccaguccaugugucugugugggauacuuccuauucaagccaagccacaguggccacucugccugucacucagaggccuggaguggguagaaguauaugucuagccuccauguccugacuucugccugcuucuccaagcugagcauaaagggaaacagugaucuucuaggucugcagggguuugaguagaggggcuaagaaccagacccagagucaggaguucuaggaccaucauggccccauggaccuguggccuugggcaaaagcuguaccaucaagcuccagccucuucacugagagaugaguuugauauucuugagagaaauaagucgggauaauucacaggaaguacuuuaaguagaauauauguuuuccuaagaaauacccaguaaacguuaucugccuucaccaccaccaucaccaucaugaccaccaucaccaucauuacaucuccuccggcacaauggucacugccauuaucaucaacaccaucacaaccaccauuaucuccauugcuacuaccuuagccuuuaucacuaccaccagcacuauuauuaucguuaccaauaacaccacuaucaucaccaccauuaucaccaccaucacuguuaauaccaucaccaccacucucaucaccaccaccgucaccauccugaucuucaccaccacugccgacccaucacugcuacugcagcgccaugcaccuucucccugcguucaccuccaguugcagcgauguacuuugcucacacagcccucauggaggcugaggaugcccuggaauuccuggucucguuuugcacaugugaaaccgagacccaggcgacuagguuaaggaucauuacuguucuuaagaggaucugggugcagcuccuagaaucaacaccaggaagcucagaggugucuguaacuccagcuccagggcacccagcacccuccucuggccucugugggcaccugcacucacaaacacuuauccaccugcauucacauguuuguuaaaaguaaaucuuucuucacgucugcgcugagccaggcacauaaggaccagaacuuugggaucauauggaacgauguugcugggggcugggaagccauguuucaguuuugcagauugaaaguucuggaacugaauggcgguauguguaaauguaauugacucuaagaacuguacaucuagagacuggugguaaauuguucgauguauacaguuaaaaguuaauauaaaacuguccucugcagcccucaggacuuacccagccucacacugaagccucacaggacacccagagagccagggugagggugaugaugggagaggccacucuggugagccccgcugggugacuucugucuuugcagaaggacauggcuuucucuaugaaacguuuggaauccggccacaguucuccuggcacguggacccuuucggugcaucagcaacgaccccuacccuguuugcccuggcaggcuucaaugcccaucucaucucucguauugacuacgaccucaaggaugccaugcaggaagcucaggugugucccacgcaauaccuacugucaccuccugccgccuuccugcccugcauuuugugcauuggauuuuguggcaacugccaccccuuagcugggccugggccugggcuggcgccuuccuagaguuauucauguggauuggagcugagcugaacucugggaauguggaugaaggauuagagggacagggaggguagguucagcuggggacaucacacacauccuccauaauggguugauugugcugggauggacccggccuggugcuggcuguguucacccagcaucuccaucaauggugaagccgcguuggaggugaggugucagguacaccugggcuuugggcagcagacuugugcccugacagcgcuagaggcugggguggacguguggggggucgagggucugccuagccucucuccuuggcaugccaagggccauuuucuccucuuaccucuucuguggugugcuuaugucuacauccuccaucccauauuucccuuuaaacaaccuuucuucucccuuugucccugcuccuucccuuucccuccccucuuccucacugccucccccuccuccucucucuccuccucacugccucccccuccuccucucuccuccucucuccuccucaaugccucccccuucuccucuguccuccucucuguucuccucucuuuacuuuuuucuccucuguucuauuagcaguggggaccacagccagggccacccugcagugcucagcaaaugcuccgccacugagcuaugcccacuccccuuauauaugggcacaccaguccuguguuaggagccuccuucuuuuaaagauuuauuuuauuuuuaauggcgaguauaucugugaguacaucugugugugggugaugcguaagaaguccagagggucagaugcucuggaacuggagucacaggcaguugucacugccugacauggcuccuggaaacuaaacucugguccccuggaagaaugauauauguuggucaccauagagccaucucucuagcgccaguuaggauccuucuccauggcuuggcuugucacagccacucugcacugagugucacugugcuaacagagagcacgucuuugagcgaggcacgguuauaguuacccugccaugcagauggggagagcagggcuccagaggggaaguuaccccauacacaauugcccagggggcagugguagagcaggccagcaaaaguuacacacagguccccugggcugcaggacagcaugaugaggagcauuucggugucacuggcaaaguacaggcugcuugcugagcucaugcgugcacguggcuaaagucaccuguggauggcccuagagcacuggguauggcuucuuucagcuuuucacucagaaaccaggugguagaugggucuaggaacuuguaugguguccccaaggcagagcugagcagaacugacucuggagccccaaacccgucucaggcugugugagacuagauugcaugguaugaacucucccauggcuguggguacucaaacagaucaaaaugagcuucucugaggccuggugggagugugguggggguuuuaccugugcaccuccuaaaaggcugaucucaccgcugcaugcuggcuaaucucacagcaacauguggccaugguaucacuuaacuuguggggaucuuacagaggaggugacacaaggaguccuuaucccugagccuuugaaagaggcugaaggugugcaugcgcaauggacuugcagaggggcugagggaggagaagcgggguuccagcaaacacuguccuugccuuacccucuucuccuuggcucacagaugcugcaguucguguggcauggguccccaucccugucagggcagcaggaaaucuucacucacgucauggaccauuauagcuacugcacccccucacacauccccuuuucuaacagguaggucccccugucugcagcugcccugcuugucuguggacaucacccgcucccaggaacagcugugcaggcccuggacccuguggaucagaaacaacauuuuaguagcuucccacauccacagaugaggugucccaugugcaagccuccugagcacggggugcucauagaaccccagucugcuacuccaaaagccagggcgguugacaucucagaauagagaguagcucccaaagugauguccccaacauuguccucuggcuuccguaugcaugcacgcacaggugccugcgcacacaugcacacauaaacauauacaagaugaaagguuuuauuuuuuauauguaucgauuuauuuuuaugcaucaguuuaugugcaccacgugugugcaguguccacagaggccagaaggugguguuggauccccucugaaacuagaguuaagaggcaguugugagcugcauagugugagugcuggaagccaaacccgaguccucugcaagaggcgcucucaacuacugagccccccuccugucccaaggaugugcuuuugauauaacccucacagggacauugcacuugacuuugaugggacccugccugcuccaggccucagcuguccucauuuacaaggugggaaauuugaaccaguggauacccaggaaauuugaccccagcacugugccucccauuucagacuucccuucauagugccucagagccucuucacccccaacucuccuuccugcuucagugggguugucucuugccccagugaccagcugucucucugccucugccuggccuggaagagagcugaguuacagggaaaggcacagggcaguggauggggauggauuuuucagccaugagaacaguugucuccacaugcgccuggcuggccuggcuuugcuguagggucagcuggaaagucaguugcuagcuaagccuguaacccaaagcccucaccccaucagggauuaccauguacaggugucagggacagaaaggggcaaggucagcacagaagcaccacaccgucucauagaaccagccgucgagugcccuguggugaggaggccccugcaggcugacaacagacuaucugugcucugaagucuggagggcuugaguucaaacccuagcucugcccugugcaucugugaguucugcaugggaggggcuccaggaguggagagugagcagacaggaggcagggacaacacuuggaguguccuugucauuugcgggacugcucugcuaggcgccguguccugaagcuguuuucuauugcucuccccgucgacucauuguuuacccaggagagacagggccuagccacggcagcagguggcgcagggucuccuggcugccacccacggcuguguggcacggacagugaugguacuuccugggccucuccagaccauggagaccaagagaaccuguuagggagugacccuguugcuauagaaaccucugacguuugcucaucacagauuuggggguggaccuugagaaaggauuuuuuuuuuaauuguuugauugguugggugguuaggguuuguuuggggcuuuauuuuuucuuuagaauuuuuuauuguuuauugauguuuuuccugcauguacauauguguacugguaucuacagaggacaugggauccacuagaauuggaguuacagacauuugugcauccucccgugggugcugggaaucugacugagauccucugcaagagauggcucuggacuccuaacugugucucccagccccuaguuuuguuuuuccugauacaguuucucucuguagaccaggcuggccuugaacuugugugaggcuuccugucucagccuggugagugcuagggucacagaugugggccgucacucucagcuuugaucuuuauuuaacuaacugcauuacuuuuuuaaaaucuuaacuacuucuauuuggggcaguuuucuacccaagaugaauuucaccccgaccucaaccaagcaaggaggugacagaccacgcguagccuuaagccucuucaccaggucucuugugcucagccucugucuucccucaggucuggauuuuacuggaaugguguggccgucuucccagagccacccccagacggcguguauccuaacaugagcgagccugucaccggagccaacauccaccucuacgcugaggcucugguggccaacguuaaacagagggcugcgugguuccggacgccccacguccucuggcccuggguaugacaugcuccacugggugcccucaauccugccagggccucccaugaagccuauggaaagagcagccugcacaugaggcaggcucuaaucuagcccaucucuacccaguucucaaugcuucacccaucccugcagaccccggggccuuacccacucuucuaaacugccccugaccuaccuccaggcugauagacaaccuccaccuccaccacucacguugucuggggcugaaagccagacuaaccugcucggcucugcauacgucgggugccuuaucagugcaauggaucuauagaguuaucugccaugaggcucacgagaggggcauuccugggggacagccccauacccugucacuauuauuaagcugacugcucugcaggguauccgucuaaccgguacuucuauaagaguuuucuggaaucauuuugcagcagagaucuggggcucagagauguaaaggaacuguccggaggccacacagcugcuuagcugugcaaguagaaagggguggcaugacaggugacccacugccugcuuccccgauccugcuuguggucaggaugggugaaucagggcuauguaacaaucaucaucacaguuaauccuagugaugguuacguaagagaaaccugacagcuacgggagucuugagaguggcugggcuacugggggugucagugauaagcccucuugccugggagagggcucugcgguucccagagguuccgaccgcugcucuguguccugcagggaugugacaagcaguucuucaaugccucggugcaguuugacaacauggauccccugcuggacuacaucaaccagcgcacggcccaguuuggcaucucggugcaguacgccacacugaacgacuacuuccaagcccugcacgccaccaacaugaccuggggcauccgugaccaccaggacuuccuucccuauucuucagguaggagccucaggaggcugggggcaaucaguaucagggguccagaccuaccucccagcucaguguaaguucaggggugaggaguaccaggccgguucccuccugcucuucccaccuaaacagcuguuucccagggccacacauguguagccauggcuguggcccgugacuccugggagugccuuccacccacucuuccuacauacccucccccugggcauccccuccucacaccagggugggcaguccagugccccuccuccguguuccagcagccacccuuuccucuugcucugcucugccacugucacugugcgggaugucaucucuuuccuguguccucaggaaggccugaggacacagccucugcucccuggcugguggaagucugggagccaugcacgaagccucacaguaggaacacugaugguucuauugcaucaggcagggaccacgacccauccagucccagcucucugugcuccaagauacagagaaggcacccaacuucaacaccaacaggcuggugugcgcccccugcugguggcuacaggguccaugucugccuaguuucccugcagagagccagggcaugaagaaagcauccuccccacucgagguccaagcccugcgucagagaguauugccuugugccuuuaguguggggcugggguacagcucagugacggagcacuugucuagcauguagaaggccuggcuccauccccaugccaaaaacaaaaggcagcucuccucauugccugugucacucacuaucugugaagggcuccacuguccugcuuuuugucucuuuuugccuuuugcuuuugcuggaggagaagcccaggcaguguggguaggaugcugguuggcacccuugagcggggcagcucagagaccagaacacagccaugccugccagugagcuuggcccagccagacacucaugcaccagcugaucaguccaagacuggaggaggagccacgcuuggguggcaucuguuggcugaccauuuaguaccaugugaucacggugccacagugauaccugugagcccaagcccgccugguuucaucagugaaggauuaggggagaagaauucugugaagguugcuccccuucuaccccguuucuuucccuuccaaagaaacugcauacauaggcuccagcugcaggguccccuugacuuaacugcuauaauucucaagcccuugaacagcacccuguggguagacauggaggguacagggguaggaauguaggcacagccacaaugguggggugggcuauguuuugugaguauggaguccgagagggagagguuucaucuguggguaccagagcuccgugagugggaaugucacgugugcauggcuaaaugaagaugaccugauauaggacaggaauugggggugccaggcuuacagcuugggcagcugagccacagugaauuucuagccuucuacccacucgguuugcuggugcgauuuggacaccuaacuguggucuuuccuuggggccacgugaccggccacucacuagagucugguucugcugguccuauggggaaggacuaggaaaauagaggaagaagcuagaccuggaagagacaagaaaggaaaaaucacaaggauuuagaccuaccuucugaaacagcugauugccucccauucuguuuccaugccccgccucugucccaagucccuaagcaaccuacccagugucucucucugcuccaccucuaccucugccucccucugagggccuuggaaggaacccugcugauauucagccugaccuaggauucccugaggcccacagagucacauacaaaaguauccggcugcucagggcucuucguuucugaugcccacugaggccccaugucaccaccaccccgucuuccccggcucuccagccuuuuguguauguggaggcugcgugcuucuaaggugugcugugaacugucuucucuccuguugggaaacugaagcuccugucuugucccagugugcccagccuagcccgauguccccagcaagcaucagacccuggccagauguccuaggcccuggucucuuugugugagccagaguuccugguaucgccaccaguccugugugcuucccuggguggccuggcagagcuaauacccugagcuguccccagaucuacacucagaccuacaggcuaggcccucggccucagugcguguucccacccuccagaaccacuucaggccuggaccggcuucuacacaucccggagcacccucaagggucuagcgagacaagccagugccuugcucuaugcuggggaguccauguucacacgcuacauguggccagaccccagugggacucuggacccuaccugggcccugcagcagcuccaacagcuucgcugggcugugucugagguaaagucccuauauggccaucgugugacugggcccucucgcgguguguguuucuccaugauauagacaaggaaacggagguccccucugggcauaagacuggugcaaugugacacugggucacagcagaaccccgggucucaaggcauccacccauuggguggcuuccuaaagcuucacaccuguucuuuguccaaagaacagagaauagacuggcacuauugcccuuccuggauccaaaugacagcucucugauggccuugggcucacggcuuuuccucucugggccccauuuccccccccccuauacauucacccccacaggaugguguggcgauggaauggcacagugaccaucuccgcccaccucccuccccuguauccauggggaaauggagacacaagaagucuuguagagaggcagagggacuuuuagugugcagcagagcaguggaaugugugacuucagccagggaaacuuagccuccugcuccaccucucccugguguggugaagcuucacucccuacucagaacaccaggaggagccaguacccacaugggaagacaaugacaggggaagcuggggcucaggaggacacugacagggcauuucuaugacgacaggaaaagccaggccaggacuuuagccuguuuuccuucuguaagaugagagggaugcuugccuucccucugauguucuggaagcagacaccucccaggaccaggucugacacccgucuuccuugacucuggcggugacagguccagcaccacgaugccaucacaggcacugagucccccaaggugaagaacauguacacggaacaucucaggauggggaugcugggcgugcgcaagcugauggucuccauugcccugggcgggcccccagggucuggcacagguaagccaggucucuuugaagagccaguggcuuggcuuugaaaagagucuggggccaggagugauaacauauaccuauaaccccagcauuaggaaggcagaggcagguggaucucuauaaguucaaagcuaccuuagucuacauaguaaguuccaggccagucagaacuacuuaacagagaaauccugacucaagggggaaaaaaaaaagagucugagacagacguggagacgagaaccucacaugagccugaagcccugugaucccaauagcggggugugaucuugccggcugguucagugcuucgggcccgguucuucacccuggaauccaggauaggcugguggcaccauuggacugagcaagaaccacugcugagcccugggcguuugcugagucaggaaugcuccuguggcauuuaaugccuugcauagcccaccacagggaggcucauuuaugaaccaagggaccugagacucugagagaucacagcucagcucaggcucaccagcaagggagggcaagagccagacuuugaaccugccacccugugcccccugcugugcccaggccugcugguccagcuuuaccucucaagcccagcugggcugcaggugaccuccaggcagccauggcccggcuccuauguccagagagugucacacguguagagugacugucauacaauggugaugcuugaaaccagggaaaccaggagcagccagggacaaguccccagguccccgagcccugccuuguuccucuuuugcuuuuggcuggcccuuucuagucucucuggucuucuucacuuccaugacagggucugggcugugucuucuaccuacccuacccuuccagcucuuucuguaugaccaaauccagcuuguagguucuguccagggcuggccacagacccauccuuguccaggggacacaagucugaugggagcaacaauugcagaaagaaaagaaccuggcuugugacaucagugcuggguagggcaguaaggugaccugugccuucccaugagcacacagguaggcuuccuccaucagggaggaagaaccaaaaaguuaacuggauagaggggccagcuaggcccgaggagggaggcuggagagcaggcaguacacucaaggauccagacaucagagauggaacagaaaggacaccagaccugcaucauaagagccucuagugcuggucagacacucaaaaccuuggauccaggccacaccucuuccuuuccacaucuacacuagggacucuggaaggccaggucuuaccuaccucauuuccccucuuauccaggagcccccaaagacaucauggggccucaagugacaccuguccucucgguagacacaaggccuguaggauacuccgccucuguguacaacccgcuggccuggaagaucaccaccauuaucacccugacugucgcuuuccccaaugucagcgucaccgaugaguugggccacccggugucaacacagguacgggcgagaaguccugcuggagagcauuugcugucugccacuuggugaccuuguuccacugcaccuaugcaaaggcccccaagcgucuuaaagacgcacuguaacaggugccaagguuggggugagcucuaggcugcgcccccucugcacuccugagccacucaguaugagucacauggucucuugucauuguuguguaccaccccccaugcaccacuggcagcauggggaaggacaagacaaagaggagaagugaguggaaggcaaggccccugagauaguguauucagagccggggagugucucagagagcaaaccuguagccuguaaagauggcaugggaauccucaggagguagaaggccaccacugccugggcagacagugggcacccacuccauuguguguggccagaguuaugaggugacugagggggcuuccucuccaugcugcuggcuugcagauucagaacucuacaaaggacccuucugcauacgaccugcucauccugaccaccauccccggccucaacuaucggcacuaucaagucaugcacgcccgcggggaccaggcaggcaccagggagcuggucgcccccagggccaacacccucaaguuuagucucaaacugaggaaccagcccagccaggaaggcaagcgccuggugcccgugaugaaugacugcuauauucugcuguucgaccaggacaccaacauguuacauagcauucaggauagguaaggugaggccagugcugccgccaaagugugucuagggccgggaugcaugggcagcguccugugacccccuucugugaucacccuccccagggaaggaccaggugauagcaaggcccccuccuguucuuguguccuuaggaggggggcccugggccacugcagaauggcugccguaacugucucuucucagaguccugacccauagacaaagggaagacugaagggcuccaaaggaaaggugcucacguggucugcuucucuaaguacaaaagcagaguuguucuucgggaaauaucuacacuguuuaaaacagaaagggucuuuaauacucuguucccaccagcccuccauaucuguucaccucgguucaucucugcaccgagccagccacugcccuccauaucuguguguccuuacccaccccuggguccaucuguccacccacucacccaugucccuggggauaaaggguaugaaggaccucuggcacauggcacagugacgacuuggguuggcaugaugcaacuccacucuugugccaguguagccucugaagagcagucuggggacagugcacccugcuggcagccugugugcggccucccucuugugacgucaccugacaguuccuggcugugugugcgaccagagguuuuccccugaggccuccaguaacuuccucaaucuccugggggacauuuucuucaauccugauccccaguacacacagcccugcugcaggugagugaucuugcugagggcgacaccaaccauucuccucucucacuucugcagacagagcaaccgcacggugcgcaugacccaagaguuccuggaguaccaggccaacugggacgugaagcagggccccauuucugacaacuaccucuuugcacccaacaacaccgcugagccuuccugggaagcgguggggauggaaaugguggcaggcacacugguaacggacauaaggcaguauuucuacaggugcguuucugggugggcgggucaguguugugucuucccccagagccccugucccuguacuuggggcaugacccuggcacaugacuagucacugauagcagcaugagagaaucgaucuccucugccugugcuuuuugcauacgccugagccauuauguuguggguagcugagucagagcaugggagaagggcucucuuuacuccaugaaugguccagggcuuacauaaaucuccacaggguccauaguccucccuggguugcucccauagcugccucuuggcacccggcauccuauauggaaggaggagcuuccagccaggcccuacucucucccaugcccccuucccagguacauaacagaccaggaguacaucuauuccauccacacccgucuggcccacccgagccucgcuggagaacugcucugccaacggauagagcagcaguaccgagugggcccccuggaccuaaaccgugaggccauccugaggaccagcagcgaccuaaacagccagcaaguccucuacucugacaacaacggcuaccagaugcagcggaggcccuacaaggcuuucaagagcaaucccaucccccggguaugcuuguagcagccccaugcuguucccaggcauggcucuccugacccuguuaagcaucugcucauagcaauagcgaggccccuggggagagcuguuucaaaaguccugaucaggaucugcccugugggcucugcauccuggcauccaccuguuucccugcuaccuaauuccuuggcuuugucaggggcucauucuuggugcucuguguguugagcccuuagcaggggccgagagucccaucagccaagcuacacggcucacaagcagcucugcuacuguaccuaggagacaggcuggugucugccugacccuguauugaagcugccacugguuggcauugugucugcagaauuacuaccccaugguacagucagccuucaucgaggaugacaagagcaggcuggugcugcuggcagagcgaccgcacggugucuccagccaagggaaugggcagguggagguaagagaggccuggcugucccccacccccaccccacccccccaugggcccucacagccauccacagcauggccagggccaaggaaggaccgcaggugauuucugcaggugaugcuccaucgacggcuguggaacaaccuggccugggaccugaaguacaaccucacgcugaacgacaccuccauuguccacccggugcucuggcucaugcuggggcccaaguccaccaugacggcccugcacccaaggagugggguggcucugcagcacgggcccguuguguuguuaaaagaacuggcugacgaagaaacgcccguucacggugagcaucaccauugccuaggaugcgcccaccaggaguaguggcuccugccucaggauucugcccagcuucggagcaggaaggggacguagagucugagugcugucuguggcucccucaagcuuacucugcuagucguuacaaacagacucacgccuguccccuaccccuccucucucuccccucagucuucuccaucuccuuccuugcugugucuuuuccuuccuuaacaugauccugcaacacccuagaacuucaggugucagaagcacaccaccuaugaccuuacaauggcugcaucuguagcuguccugggccacagguuagaccccugcagaaccuaccuagccaugaucuaaagucaguguucgugcugugccucccccaggccuucugugacagccucauggcucugugucguaucugagguccuggcaugcugcguuuugguuuuuuuuuuuuaagauuuuauuuauuauuuauuuuauauguaaguacacuguagcugucuucagacacaccaggagagggagucagaugucauuaaggaugguuguaagccaccaugugguugcugggauuugaacucagaaccuucggaagagcagucagugcucuuaacugcugagccaucucuccagccccaugcugcguuuuuaaaggguucagcagugcagccucugcacaaugaggcccagagagaaugugcuuccauccucacaccuccaacugugcugucucccuacucacuggcagagguucgcguuagaauguuugguuuuucaaccagagcccucccuccccgguauuagaaggcagguggcugucacucaccccugcagggacugccucuuaaacucuugccacguguagugucuaaggugcagccuuuguccugcaguugucagggugacugagaaugggugggggacauggucauuccgagaauguuugaugggaacauacugccaagggccugccaccuuauguuugggggagcaugagacaccccacacauaccccugggguuagcaaggaccagaugcagaacuggaaccucugguugagcagagccuggggaauccauuaaguaagagccaaagccaggcauggcaagccaugccugggaucgcaacauuuggagagcauugcuguguguucgaggccagcuuagucugagcagugugaccccaucuuaaaaagagagaaagaaagggggagggaaauagaguaaggaggggcugaaugagagggcaggauggcugugggugucuagggagggagcagguauuccuggcaguucuuacacucugaccucacgcugcacacugcagacggccaugugggguaugugcucccccuaguggcuagcaucuuuacugcaggcaaagauucaguaugucugagaacucuuucccucucccucucccucucccucucccucucccucucccucucucucuuucuccuucucucucucucucucucucucuuucuccuucccucccuccuucccucucuuccucucucuccuccuugagcagcugaaagucaugcucugagguccaaauauuucagaaucauaauugagcucaagaccuagaaccuccauaagccaaccccucaucuuaccugagcugucugccuuccucccccuccccuucccccucccccacgagacgggacuauauaccuauaccuccuuggcuacucucagagaacacuugucucccaccgugugaaucagcugccugucucugucgcagaacaccugagaucaucaaccuaaaaguaagggauuuaacuuggcccacaguuucauggacuuaaucuguggccacuugucccuguugcuuuuugguggagggagaggaaggggcuagagucccagugaccuucacaagggcacagccuggugaccuaacuuccuccccuaggccucacccccucaaauagcccagaggaugggggcaaggcuuuuaucacaugggaaacaggagagccaaaccucacacugugcaaaaggagcugggacuccaacuuuguagaccugacugaagcaguccuggggacaggcccuauugguuccaucugagucaggugacccaugccuaggccaguccgugugacuggaguaugaugcaaagguggcagcgccuguugcaagucagguggagggaggggucagagggccccugggauggugaagaaaggagaaggcuugcuagagagugugaggcagcaccuuagucuccucgucuguggucugaacugaccaggugacagguucaagucccuccauagcuuaagcuguguagcagcgacuggaugugucgagagcagcuugggggcaggaaaggccuguggguguggggcaaggguaggauggggggccugaggugugaaccucacacccauugugcuauggguugcgcaugguugacugggagauggcuagaaggggcacaggcccuguguggaaagcugaauuccuaaagcaguuggucccaaagccccuuuucacugucugccuuccaggaccccacaaucccuggccugugacacugcccccaaaccugcaucugcagauccucagcguaccuggcuggacguacagcaggagccaugcccagcaccugaggaaccuucagagaggugaggcagccgaccagggugacucuccccacucucuucucuuccccaggaaguccucacagcuuugccagguccccuguccccucaucugucaucuaggaggccaaggccugcagucaagucagugagcugggacaggguggucccagcaucuggcucccagccacaccccucugcagauggagcccacacgguccccagacaguguccucaggcugcccuguguuaggaucugugucagucagccuuuccucucgcgacaaagcaccuggggaaaugaaugcaagcagccagggccggugcacagagcugauccagcccacagacauggaggguacagcccaucauggcaggggccacguggaagaucaguagcucaguucaugauguaagcagagacagacagacagacagacaaagucuacauucccugccuuccuccuuuccucuuguuuuccacuugggccuccaugagaagauggcgacauuccugauaggucuucccaccuaggcugauccccuuggaggacacugagaaagugcugugucaaucuccuaggggucucucucuccauccaaucaagcugucaaucaagauggggcaccauaugcuccuuucagacaguccuccugcagccccaaguacuauaccuccacucacccucaugucgggguugggacagccugggugucagggguuuccuuaguucucucagcagaugccccuugucagggugucgagguaccugguuucugggcccauuagacagaacaaugaggagggaagcaggcaugggggacaugccaccugccgggaagcagcacgccucugugcccacuugguguugaggcacaugaccauggcagcucaugaccacacccaacucuggagcuggcagggaggaacaggcuggaggaucugagggcccuggcgucuggcccuguggcaugcgagagguccaguguuggcacagcccucucuggauccugccucugcugcacgugagccaugugacuguggacagaugacuguuccucugagugacagcugcaggucauucagcugugggccauggggcuauccugaaggaaggcugagauacggaauaaagucccaaguguaaagccuugagcuugaucaauggagguccucacugccguguccacacccacaggccacccggagaagccacaggccaaccugcaaagggugcugcugcgccugcgccaccuguaugaagcaggggaggacccaguacugucucggccugcgacaguggaucucaagguuaacagcccaugcuuaccccaccccuccaagaaugcucuaccaaggggaagcaacccugccugaaguccuguccugagcuaccccuuagucaggggaccacugggcauguuuacagaugaggcaugcuggauucccaacauaucccucccuucagggugcacauuuccccaucagcaacacagacuacauacaguuuuuucuuguuuaauuuuguaccaagagaugggucugggggagggccuguggcacccauguguguuuguauggcuguguagacacgugcacgcaggugcacaugcugcacacacacaugugcacaugagaccagaacacauugucagggugccacccucucugucauuucucuaucuuucuuuuuugagacagggucucccauugaaccuggagcucccuggguggcuaggccaaccaccaagcuuuagagaacccccgucucugccccuuguccccaacacuguggugacacacgggacaggcacuuuaccagcugagccaccaccuccuuggugcacugcaaagccuuucaaacaacagggacagucaucugugucaccagaaaaccuguucucucuuugaaugccaguucucccuggacuuugugggaaaggugacuuagagccagagaaucuaaguccguguccagguacacgaguggugccagguucccucaguccccugaggcucagccucccuaccugcuaagcuagggagguauaaguucuuggcucaaaaggugacagcgaggcucuggggaaaugcuguggguaugguaccugccaucucucaagcuuccaggcuucuccccaucuuggggccugcccccccccccauggggggcuugcucauccagcaggccaucaugggaggcacacaccccaagucuuaguuuccuuacuuguaacagguuggcaucugcccuugcagaugagaugagccaggugugagaggcgcugaggcagagacccaggacccacgccaaagugggcugccacccuucuguucugguuaaauggucuucccucccggaucuggggcaucagcagagaccuccccucccuuugcugcugccccuacagguuguacuucgaggacuagggucuguaguggcuguggaggaacgcucacucacagggaccugggaugugcagaugcugcagcgcuggcacuggagcacaaagacugaccaccugaaagguuuggggguccuagcuaucccugccaggcuggggaacaacacagacccguccugugcuggguggccucauguggcuacuuccccucucugaaucuacaaccauuguugauuaccagauuagguuaaaacagcugugggucaauaacccuccugccagggcuccacaaagguguguguguguguguguguguguguacaucugugugucugugugagagaguauuucagccauacaaggagggaacaggcugauaaagacacucccugccaaggcuggagcucacagccccagcaggacuugaauagagcuagugaggucaggguagguugguuuuggauggucccacucaguccuuaggugcuuagggcagcccccacagggaaauccccgcccuucaggguagccacaggggaagcuaaaugauaagauccacuucagcgggaguccuagcaggagaggacagccaaaggccguccccaagagggagccacagcagacuguaggaagcuguggggcucugaagggaguccaggaggaagaaccaagcagacagaauuccuuugucauccccaggccaccccaccucuccaccaaggccaccaggaggcuccaucaucaccguguacccuaaggaaauccggaccuucuucauuaaauuccagcagugacaucaaugcauuggccccagggacauggaacuggaaaccccacccaccccacccccaaaaaaacaacgacuucagacccagagggaggaacaagcugcgcaucagacagcuguguggcagaaaguggccaugggggagagggauagcucuuauuauuuuuuuuuuuuuuaauaaaaauuaaggucugggcucuuucuucccauguucaagccagaccucucuuuucaccugaguaaccccucccucccuccccucccuccuacccacucucaauuguuaaaaagagccuuuauuuuucaaaagu

SEQ ID NO: 2431 - RNA, 3299 nt, Mus musculus
uuccagauagccuggugccaugacuucuucuauugucuuugggucagccugacucacgaguuguugagaugaaaacucagagcguccuguugacacgcagaccucggcugucucggggagaauggcuucgacagucguguguugcuaauuagcugucaguguggagaagucucagguccaccuucucaucuagugagggaaaggcagauucagugcccugcaaguguccuucuuauucauuaucucugauucuaaagucagaacuguuuucucucuuucucccuggacguaauccucuuauccuuugagguacaggacuagccucugagccacacaacugccaucuuguggcauucagcugugcccacuugcaaaagaucaccucagaugggcuuguucagucuuuggaucacccccauagaggggcagagaaggccacagaaccucaucugaguauccagcugcacuguagccccaacccauggcacaaacacgccuuggugugaauuaagauagcuagguggguuuuggggugcaugcucucgacugaguugaggguuggugugcuuuuggcuguggcagggcacagagaacucgggaaauggaaguuguuaggguggugauggggccuugagcccaagaacuagaggauuguaggauggggcuacugggaaacaggaauaaauaaugaaguagaagcuaucagggcagugaagggaucugagccuaagaaagggggagcucuagaauggggugcuggcaagugucugccagacauuuucaagaacuacauagaucuccuaaaggaugcugcuuggcucuguuuugagacucaguuacagacugagauggacaugugugggcuuggcuagaccuaguccacacacccauccuucucuuaguguacuguucagcauauccucugggcuguccacagcacgcagcuguggucuugggacaggcacucagccuaggggcagucccagcagugaccaguugcccuguuugcacaugguacguacuggagggagcauggucucuugguuccugaaaucucucaggcgucacuccaggauguaggugucucuuuaccugugccuguguacuacuccguaugauauuagaguugucugucccuacaggaccccguaggcuuuguagcuggacaaaugcacaggguucagaugagcaggggacuggccuguggggucuagcacauccaucgaauguccggugucuaggcggaucccucuguuggccagccuccccuuccuuaccugugcaccuagaaagagaccucaggcaguggcuccucugauugguccaaggguaauuucaucgcacagcagcuuccggaaugggaacaggguuuaguucuggagagugaguauaagauaaaguauaucggagguggggcccacuugauagacuacagaagccccaugguuucucauagccaucuuggcacccugggugggggacgaguauuaagccugcauuguuuguaguagaagggagauuucuagacuugguguuuaccucaggcuuucuguuaggaaacccaggaggaagccuuuaacacccaggagaccgaagguaggaaaaccuggagggguuugcaccagcuccuuaucuggggagcuuccacugugucucuaugcaacucaagucagcaacucuuaugcugcuuggcccuggauuucccuccauggacugcugucagugucucugugagcuucccccugccauugggaaaauuguucucaacucaccagggacuggagcucagggcccucuccuaaugccaucuacaaaugagauauggccaaagccucaucagaacucaucagccuggccagccaaagccccacccccaccuaugaggaaacugaguuuaggggagggguuggugaaguccaggaagagccaguguuugcuagauuagugcuccccuugcuucugucgcagaggcuuagugagccuuccuaggcuccauagccucccauuaagggguugggggagguagggucacuucguucacaucucugggucucaguuucccuguguugccugguaacuuacauuucauaacacucaacgacccaagugcuguguagauacugcaguuaauguggggaaggaaguccccacuccaguuucccuaaacccuugcucagccugcccugucucauguagcccaggcuggcuucugaaucaugauauguggcggaagcugaccucacguucuugaccuuccuucccaugucucuggggcuacaggugcuaccaucacaccuggguccccucagcuggagcugagcaggcacaaaugguagcuuugugucuuuuccuccucacaagcaaguucugguguauucccucaucggcuccugauucuugcuuuuucccggggguucuguugagaggauagcagguguggaaggugggaauuggcaggugaaaggucuucggggcugcccaugccagcagccugcaagcuuccacugagucugucuccaugccugggucuguuuuuaauaacaacaguaaugucauuauagagacaagauugaagcugcuuuucuaacuuagcaugagguccugugguuuuccaggcuuggcugcagggcuggucuuguggggcacagccugggcaguuggcaaggacccugcaccaaguuuguggggcaaaucugacuaugcuguccagucuugaaauuuccaagcacgucucuuagagcugagguucuggggagugggggccucuaaggaggugaggcuuggaacaggcuccuccucuucagggcccagcauugcagaccucgcauggccacuuguccccuacauggcccuuugccugcgguauaucucugucgaaggagacagcucugcuagacaaugugucuaaacagugacauccagagacauuaaccuucaagaucacagcauuuaagaaacuaagggugaggacaugggauagggacaagggacacccacuuacuucucuucuucacacaugcuaggcgaguguucuaccaccaagcuacacuguagguuucuuauuuucauuuugagacugguucaccaaguugcccagaugggccuugggcuuucacuccuccugccucagucucuagagcuucuuugauuuuagaguucaaauuuuaaccccgucacuccugaaggcagguggcaggaugggcccaggcuccagguucaccuuauggaaucaccuguguauucagccugaaguaaccucgggcugaggaccccauccuggugaggagccacccacauug

SEQ ID NO: 2432 - RNA, 777 nt, Mus musculus
auugcuuuuggaacugacauauaugcauucauuuauuuagcacacaugugagcaugcacguccccguggcaggagugugaaggucgaagaccacuuguaggagucgguugguucucucuuucccccacaugggaugugaucuggggacugaacgcaggaagucagauuuggcggcaaacacccuugccugcugggccaucucgcugucagcuagaucuuuaacuuuaaacgacgucuuugguguucuuuuucauccuuuaugcuuccgcuuuuguuccuuuauugucaguaucgucagugugucuugggaagagcgcaugcgugcgcagucggaaggcaggaugggccacuagcagcucuccugaagucaccgacagaaaauccggccaggguucuugcucuaaccgccacggucugauccggaaauccaagcugagugugcugucaguguuucugucagaacccaaaggacacaggcuuuauuaaguuggacuaagcgaccuugaauggauuacucaagacugucuacccagugaaacucaccaugcuaguuuuucuacauaaaggaaaaaaauaaaauaaaauuaagaccuuaaaaaaaaaaaaaguuccgccuugcuccgcacguggcuggccccaguguggagcacugugacacguccccaggcagaguaucuuacuccuuagagacuccgcagugugaagcugucucugcugcuugccaucuuucccccaucucugagucuguuucucaguuucaccuucccuuuucaccug

SEQ ID NO: 2433 - RNA, 99597 nt, Mus musculus
aguucccaggcggaggagugcgaaaucggaacgucccucagcaaccgaguucuugccggggucgcuagcugcugacgugugccuggccggcuucaggcccuggguugcgggucgcuauggcgguggacaucacacugcucuuccgggcuagcgucaagacagugaagacgcggaauaaggcucugggaguggccguggguggcggggccgauggcagccgggacgagcuguuccgcagaagcccucggcccaagggagacuucuccagccgggcccgugaagugguaagcugguugcuaugggaacggcgggcgggagcuaggggcgcauacgcuccgcggccccuggaccccaaacugggccuaucucuuuagcucucggugaagacagggagucucuagcaagacagagagucugucucaccgaccuaacagcuggcucaggguggcgacagguuuauucucacgaagggacgcauaucugggcacugaaggaaguaaguuagaggugcuuggauauccuugaaaucagguuauaaccuucugaggcagugaguucgccaagaguucccacagucugacacuuccugucgcaaagcucaccacuaucuccccucgcccuuccacgaaucuguuuggaccuccucuugcucguaggguuuaauaaaauccacgcucagcugaacgcuccuugauccuugccuccaggcauagguaggacucaguaccuccugagauugguuuaggacaucaccaguguaggguaaaagcuuuucccuucagagcggcaacacuuaagcaacacuaguguuguaacuguccucuaaacugcuuccuguucucuggacacaaccggcuucuguguccccaacauagaaaucuuuuccauaaggguaggaacauguugacaguauuucuguaugugcuacugacaauauugcuuaguaaguauucuuugaaugaaugaaugguugaacgaaugaacaauuauugauuccacuaaacaggaaaaaaaaagauuguuugcauuauaucccuuugugucuaugacacuaggguaaauguuauuuuuggaguaccagggggucauauacagucugccugucuuuuuaaagacacacacacacacacacacacaauggcccaaagcauugaaagguacaaaucugggggaucuaaacuuuaaguuucauugguuuuccaguaaacucaccucugcuuggcacauaauccauugcuugauauuucucuuuuugaggcagggucuuuccauguagacaaggcuggccuugaucuuacagaaaggugacugcuucugucucccaagugcugagauugaaggcaugggcccucagacuagauaauacucaaauauuacacacacacacacacacacauauauauaugcacaagucaaugaauggcuguuuacagauaauguugaagcacaggagguuguaugaaccagauaaaugccccucccuccaacaguaaacaucuaccuaguacuuacuuucugaccagcacuguuuuagaguaauaggguuccacuguugaguuauaguuacagugguggaggagaugcaaauauaaacaaacgcccugccgugagccgugcugguguucuguagggcacaagggaaacagugguuaaucccaccugggagaaaggcuucaugggacaaugaugucagaaacccauucuaaaagaacaguaguugguuucauugccaagaaggcuaggaagggcaucacgugcuggccgugcuccuggguggccacacagucaggaggacauggacagugcaguuagacuugauggacuuuuaaaaaaugggugugugguggggagauggggacaugaagguagggggguauagaggugagaguggauuugaaaggaguuagagggggacuggauaaauaugauccgaacacauaugcaauucccaaugaauuaagaaaauaucuuuuuugaaaagagaccaacaugcacaaaggcaugagauaguagcuuaaguugggcuugauuaaaauaagaaugugggacacucagaaaaauaaugaguguuaugguagccagcgggaaaucuagaagaucuuugcagaucacucugcagcguuugaaccuugccuucuagaccagugguucucaauuuuccuaaugcuguggcccuuuaauacaguuccucaugcuguggugacacacccccccccaucaaucauuauuuucauugagacugcauaaguauaauuuugcuacuguuaugaauuauaauguaaauaucugauauucggguuaucugugacccaugugaaagggucauuuaaccuccccucaaaggggucacaauacacagguugagaaccacugcuguagaaaguccaguauuauguagacagcgaagaagauccaggagaccacaguguugucuuaaccauuuuagcuauuagccagacucaugcuauuaggcagaacuuauuuaccuacaaaaugguucuuuuuauccaaaacagacuuuaaaacgccaauggauccaucuuauauaucauauauaacaugucuuaucauacaauuuaucauuuuuuuaugguuuuagagcuuuauuguagaaaggcagagagaaagagagaggguaaaagaaaggccagccauggccacguggagagaagcagggugggagggaggggagaaggagagcuagagaugagaguuagaaaguugagagcuuaagagcaccauguaucauguugaaggaggcaugucucagguugaaguaagagaaugggaaaauaaggugucaucauagcucuagucugagucuggccaagcuguugucgcaguguguggacggcacaguuuugguguguggaggcucuuccugggugguuuauuaaugcugcacagauuaucaguccucagggauaggggauuugggaacagaagaguuaagaugcacaauccagcuagcagcccugugaggagagagcccauggucaguuggacuguucccugagugcugaaaaugcauuuuugacaguuuucuuuuaauggccucacagaugaagauccuuggaagguucaggcagccccaguaauggaacgacaguggcacuucugaguucaaggugaaauaucaucaguggcaaacacgugggaccuguucuucucacaugcugccucugaccacagaagccagcacucauuucccaguggauccuguagcucagaacuccucagcucuguccccugagagcuauuaccaacuauugggcuugacauuaaguugaaaucugcuugauagucuacugggcaauugguucaaaaucaauuguauaccuaaacagaaccauagacuuuucaggauguacuuuuaaagguccuguaauucaucuuauucagacuaaucauuuuaauagaugggaagacuuaaaacucagacaaaugcagugacuggccccaugucuuugcagcugaggucaugggcuagagccagaggcagaaguguuuuuuauuucucuguuauuguuaucuuaaauauccaccuaaauuuuuaaaaagauuccuuuuuauuuauguauuuaugccugugugacugugugccguguaugugggggugcccucaggaggccagaagaggacaucagauucccugcacuaguguuccagguggcuguaagcugacugacaugggugcugggaacugaacucagauguccaguaacagaagagcaguaagcacuucuaaucacugagccauugcucacucccacucaauaauuucuaacaaaguuguuggacuuccugauguuaaagaguuuucuucuugaguucauagugccugggacuuggagcagaaaggcuuggguuugaaccucuuucuggcuuugugaagucaggaaguuacuuaaccucuguuaccuuuauuuucuaagaacgauagccacuuuaaaauaucacaugacugaggaaaugagaaauggugugcaagugccuuuggucugaauuuuuugguuacaaguaauaguuauuuuugaaccacccacaacaaaauauguguaguagcucacaaaauuaauggcuugaugugucucuauguagcucccauccauaaaaccccaggaaugggccugauccuuuuuggaccucaaagccuuuguuguggucuuaggaauaagguucuuugguuggcuaggucacaugucugcuccauucuguggccagugugaccuuaggaggggagugcuguguccaggaauuggagcaaagggugauagacaaauaauuucucaugguuccugacaugccugauaucaccaagcacguugaguauccauccauuacuuaucagaauagaugcuuccaucuuaccugcuuguuaucuugaaugacuuugagaaugggcugggccuggagaugccauaugggggcagcuagucuuccuuacuaauuuuuagagguuucagagacuaacagagcuaccacacaggucccuggagcucggcuagcagccgagcugcaugucuagagcagaaggggcuccugaguagcuuggaacaggaaaccaggaaaccuugacuagugcuaggucugccaggaagucacugcaaccucucagguccaguuaccacauuuaccaagacugagaacuucgaccagauagucagggaacauaaaucacagauguucugauuccacgucagguuauagugauucugaguuggcaaacaaugaugguuuguuuuuuauuaucuugauuuugugaaaguugaauuuauuuauugguaguucuuuuaaaaauauuuauuuuauuaaaaguguguaggguguguguguguguauaucuaucugucugucuaaagaggccagacauuugugucagauccccagcucuggaguuaaaggugguugugagcugucugaugugggugcugggaaccaaacucagguccucugaaagaacagcaacagcaagugccuuuaacugcagaaccaucucuuugcccccuaaauuucauagaguagcccugugccaggugacagccccaccuuucucuguccucacuucucacauguuccccuugcacuccuggugacauccaguuuucacugcuguucucucacauaccaggccccuuccugccucugcaucuuugcaucuguuguuuccuuuauguggaacacuucucccagaauccacaugggcugaucucuauuaaccucauguggaucagauguuuucuaaguaaggccuuccuuccacaacuguuuuguauaauauagcaacaaccuauuucucuuccuuguaacguuuuguugucauugcuaaugaauuguguauaguucaguuagcgucucuacuugacuuugugcucccuagaaaagagauuguggucuguacugaacccauagcaucuagaacauugcaggcacauagguucgcaguguccaucucuugaauuaguaaguacuaauuggcuguaucucuuugcuuucccuuuugggcuauucaggcuuccuucucauucuaaaaaucugaguccuaaagggacucuugacuguuucagauguugauuuauacuuagcccagcaucuguuauaaauaguagcuuuaguuuuauuaaugaaguucaggccuucucuuaaggagaagcagacacagugcuaguugggggugacugacaaguguaacugcccagcaucaaauccucagguccucuuugguuucccuuuuaggagcucugauaguacagccuaguaagugaguuggaaccaccuggauuauuaucuggaggggcuggaaauagauuuuacccgaaauuggcuguaauccuaguugaacaggauuucagugagggaacacacuucagaagcagcaucugguagcaggugcaaagagccagagagaaacggaggaggcaggagauggggccagacuccaggagcagaggaaaaacugcagcuuguagacagcaggagcagagcaggaguguguugaaucauacugauguaaaacauacagggcagaaacuguuuugcaaacaaagugaggagugguuugaguaaagcuggggugggaagaggcacaggaaagagauagucauuagcuagguuucuuuuaugccuuucccccuucuccuucagaaccccaaggaaccaacaagagggcccagggacccacuaacuggccuuuuaacuucagauugcugugucuuugugguuuacaauaacugauguuuccuguauguagaacucagugccagagacauucaugaugucagcugugagcucuuucuguggauuacccuuguggauuuugcccaggacuuaggaagacuacagcuuuugaagcuuuguuuuucaguaauugguuuauuccauuaccugauugaaaucugauaugugucaggcacugugugggcacaaaggacaacaaaaacacagauaaaggaugccuaagucuccugggccaaaauuaguggaaaccucagagagaaaguaguaaucuaauugggccaccaagguugagaaccuucauaccaaacuuaggaagggagacuauugugugagcuaagacagugaggcacagaagggccagcagagcagaagcaagacagggaugauaagggccauguacugggagaggccugagugauggaaugaaugucccuagacaugaggauguucuggauugcauagaugaggguacagccuuuggucuguaggccagacccagccugcucuuugugguuagugaagugauaguguuaauuucguucacacaggcuuagaaugccuucaugccacagcaacagcacuguagccugugaaagccugcagagcuguggggcuguguuugaugucagaccuuccugaggagugugccugcucuagcucauacacagggcuuuuuaagccuguaacucuuuucuuaaaauuguguaugugugugugcaugcacauggacauacauacagaggccagaagaugguauaaggugucucuguuaucauugucuggucccucgaggcagagugucucucucaacuuggagcuuacauuuucucagcuagucugaaaggcagaaaggcccaggacccucuucccucugccuuccuuggagccaggguuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucugggagccaggguucuagacaugcauuagauaccgugcuuguuacagaggugcugugauccaaagguuguuucacaauuguacagcaaguuucuuaaccacugagcuacuuuucugcccagaaaucucuacacagcuucagguauguagauuauaaauuagacacacaaagaaaauguucacugauaaucauacauuuugaaaaacaauuacuuggaauacguauaacuaucacuuacugggaaugaaagcaaguuuucauacuaacaugaguguuuauuuuugcaugaagagugaacucuuggcuaaguaauugauaccgaaagaucuugaacauuuucagcauuucucagaguuaauugauauuuugaguuuuaaauugucaaugcagaaaaugcugcuuuauauaaauauauaguacaaaaauggcagaaaaaaguaugcuuuggacaauuucagaaauuguuagaaauuaaauuuuaaccugaagccaaaauucauugaaugauuuuuuuuuaaaugaaacuuaauuugguaauucaaacagaauuuaccaaaaaaacccaaacauucuaacaagauacacuaauccaaagauacacuaaucuaauauuuccaugcugagcagugaugguauuagaagucuuuguuuucuguauuaaaacccuggcuccuguagaagaaaaguuuguucuguagaaucgcugcaguucauaacaugcagcagucuugccucuuagccuaaagguguuucaggcagugcuggcuagcaucaagcgaugugacagcauacacagugcugugccuuuagaaccaaggcugcagugacauuacacacuguuaugggguagggguugaaugcugccagaguacuucauuauggguuaaaguuugaguccaguuuuguccacuuugcauucagaaacuguucauuguuagcacauuuuuggucucccccguuucuaauguguugauuaggaauugguuuuuguuuggaugugaaaugcuuccuuccucccaacagucucauauuggggaaaacuuggucgacaggugguggugcucuuuggagauacugcacaaccuuuaggaagugaagcuuaguuggaggaaguuggccacuggagggcagaccuuguggguuuaucccuguccuguauggccucaguguguugcuuccuuauccaccaagauguaugcagacagcuuuaugcucccacugucauagacgggagcugccuuaccaucaagccuucuucacugguggucagcagccucucaaucuaugaauugaaauaagcuuuucuucucuaaguugcuguugucaguauuuuguucucagugauaggaauguaauauagggguacucaccuguguuuaguaugcuguuggauaucccagcacacuuuguaaucaguucucgagaaaagaagggaaggagacaggggaggagguaagggagaaugagagaauacccuagcuuucuagguggaaaauuaagcaaugcuaguuuaccuuagcaauccuucagauuuaagagaaggugcuggucacucaugucacaauuccacacaggagagaauaaauccgagacacguggucuuuggacuuaauuaagacuacaaaggauagaugucuccugauggcaguuuccugguaaaccuugauuggacauugcagaugggacccaaaggagauccuccaacuuuguugugcucaggucucagagacuaauguguacuagacagacagauauuucacacauccagcuagcugcacagguuaagaccugucuuacaaauccagaacaaauacaaaaacagaacugggcugauccuuauggccaaucagccuaucugggguuaaagcuuaggagcucuguuugucucauuguuuugguagugaugguuguguuccaugcuucuauggucagugaguugaugaaacucuucagcaugauaagaacagugugaguggagaccccucuuuccuccuuuuuagcuugcagagugccaauaguucaucaugucaccuacuaacuuagaccuaaaaucuuucccuccccuaugacaauuuuaguaagauuuuuuuuuccugucuagccucugguuucaccuugaaggaucaauaaucagauuuguuugcacacuauaaauauaaccaugucuuauggagcaguuaaucagccagccuugugccaaguugcuaagucagaauacaguuagacuucuacuucguggguucucguacagaaacuguauucauucaacuguggauugaaaauuuaaaaacugcuuauguacuaaacaugcacugauauuucuucuugucacucuucucugagcuaugcaaccuaacagcuguuuacuuagcagugagcuguauuguguuauaaacauugaaguauguaaaauggcauauuuugugccauguaaugacuuaaacuucugugaacuuugugugcauagggacucuaaaaccugccccuuguaucacugagaaggugacugugccagguuguugauuuauugcaagcacuguaacauacuugggagagcccacauuuucaaaaacuagucauuuuugaguggcuucucuaggcaggaggucuuugauuaaucucaguuaguguuucacuuuuauggguuagaccuauaaugccaaauguauaaugcugauuauguugugaauaauacaguuuuaggauuugcgaacuugaugcuugagguuucuugucauguggaaaauccauaugggcucccucuggugggugaaagaucaauggggucuacaaaugucugucauuccuacauuaggaacuccuuuuaauuaaaacauagaucaggugugguggcacacaucuuuaauaccagcccucaaauggcagaggcaagaggaucucugaggucaaggccagccuggucuauauauucuguuccaggccagccaggacuuuguagugagacucugucucaaaaaacaaaacagaauaaugaacaaacaaccucccgccaaaccacaacauaaauaaguaaaguuauccuaaagagaaacuccuugaaaaguccucuuagagagguauaaaccccaaggggugagaggcagacuuguugaaugaaccuugcaacuuaacacacagaaaacuuucgaaauaguugacaugguaaaugcugagaacuuuuucucuccuggcuucuaguuaucuaagucgggagauucuugcuuguguuucucccuauauauuguggucuagcuuaugucuguuugucaaaauguucucauccuggaacuggcaacccgggcucacccagucaauuuuuccuucccuuuucaagauguuucuaccuacuuagagucagugauaagaaggcuacuaaaacaaucugcugccuuuuaaggggcacugucuucagcucugauuuuguaaucuagguagaagagacaagcaacaagacauaugacucaugagaacugagaaaggaauuaaaaguguauguuuugaguuggaaguccuuuuggcccuaggcaguaauuagcuguaugguccugcagaccccuacucucuguacucauuguucuuaaugagagguugugcguacaugguccuugggagccuuugcaguaggauagucccaugguuuguucaguuucugaccugaaauuccuagaguauauuuuaacauucuucuggauggcaacuguucauugccuugagauauuuuccccaagucccucuaugcuuagaaauuuucauccagauuaaaaaaaaaaaaaagauuauuucaaacuuggcauuuugcaaguuuuuuuuuaacaaaugaauuuaaauaaugguauguacucucacaaugaacuacugucauuaacauacauaauugaagcugguuguuuuaaaauuugaucauaaagguaguauaugcucauuaagcagaacggacaaauaagaaugggcauuguguauaacuuucuagacucuuuaaccuaaaugaacauaaggcuuuccuacaauacaccccugguuuuguuuugccuuuucuguacucgucuauuccacuguguugcccaucaucuuucuaugucaguaugcauugcuauauuccacuaguuuauuuggcugcuugccuauuagaaaugucucauaacugauugaccugacuaccuguugaaauauugaaacuaacugcuuccagcuuggcacuguuuuaaacaaauggaacauuuuuacuaaauuuguuucagauuuaucuuaacuucuuaaaauacagcaacuagaaauuuaguuuguuuuauguuuaaguuuuuuucucaaauaaaaaguuuguauguccugauauugauaagaagaaaucgauuacuggaucauuugauagcaugaaguuacauuagaaguuccugugagagaauauggaaaaggugguaacuaguagguaggccuggucacucaagcccauaauuccaacuccugggcggcucuggcaggagaacugccacagguuugaugcugccugggccauaguaaguucuguggagccauaaagagcaaguacaggggcagggguggagggaagggggguggccgguauaacagugggugcuaccaugacaggaaaggacucuggcucuccuaggcuugagggcucuuguagccaguguuguaaggcaaguaggaguggguggggugagguugauggccugaucauagaagugaucacacuggaggugauccugaaucgauuuaacggccacuuaaaauagaacagaagcauuuacagucauagcaaaaaagaacuuuuagcaguaacuuugaaaagaaauguaaaugacccaguucuguagugaaauagaagaccuggguauauagaaagacacugugaacuugggagggaaagcaaguauuguagggauuagauaaucuaaauuagcuucuaaguuugaguucguucccaucaggauucuaacagaacuuuucugagaagaacauggaaauaguugcagaguucaucuaggaagguagcagcgaggacagguaacugaccuuuucaaaacagcagaaagguaugugcuggcagagcaggggugcuggccuucuccugcacaaagcuugccacagcucugccuaacagauacaagcagaugugaugcauucgugaggguuuuaagccugggacugugugcuuaagaguuaucaugauuucaaaggaggcagauaaaucauucuuauaugucuuaguguacauacagugugaauggacuagagauuuaguuaggaaaggaaaauagaagaaaaugggaagcaaauguuggcaaagcuugcuucuagagggggagagguauucuugagucugugaguuaccagcaccuuaauggcauuaaugauccugguucugaugauagaacguaggggaauuauuagucaaacauggcauacuaaagaguguauuagugcccaggaagaauucuuucauugucggguuagguuuaaaggucagugccuaaaguccuacauuuaaaacuuuggggacaaaacuccacacuucaagcauggagauacccacuagcuggaggaaaccauagcaacuaggcuguugcuacuugggugaugaacugugugugaccuuguuucugcuucugucauucagaauuucuuuaaugaacaaauacuacuuuuguauuaaaagcagaacagaagugaagugcccagaagaugagauuuuacuugcaguagaggaagaauuaaaagcuuuugauuagaaaaauguuaugguaaaagaaauauguauguauguauguauguauguauguauauauguauguauguauauauuaaauaugcuguggggggccuauuuaaaggaugucugugguaaagccuuuuguaaagggaguaauuuuccuguagcucagcugcaguuucaguucaaauucucuuaaccugcccaagaaaaaucacccauaaauguacugaccucuuagcuuccuggcugucacugugaaaauaagccuugauaauagccacuauaccugaguaccuacccuauguggccuuguguggcagcugucauugacuguccugaaagcuaagggccuauccugugaagaggacgagcuuuaccucccuggcucaugacuuagcacuggagaugugaaggguggugagaggguaccugucccuggcuggccugcuguaccugcaggcccucggguauacauuuucuccugagggagcugcacucuauggccucccaugagcugggugagccucugggcucugcuccuugauauauugucacaucauuuguccuuaggagcauaauuuggcccauaaaucacauagauuugaaaguacuugacuaguuugggagaaauaaaacuacuacugcugaaccaagcucuuuggggguaucuuuaaauuccuccuucccuuuccugguucuguuuuccuugcuggcucuuuuuuugaaacaauugucuagcaagggcuuauuucuuguagaugauguugacagugauauauaugugcugggagaauaggaaaaacguugcuaagaguauguaguaguugaggcaaaggaucccuaguccugaaggcucaguuuccacgcuagcauuguguucuaggauaagauuaagaaaaccaccaauuuccuggcaucugaaaggagacauuuauuuagcuuaugauugugccaugcucguugagaacaugcaaagagaagaguacccagcaaagagaagaggugaauucucauggacuucuagccuaaggggaacuuaaaguaaacaaauacccacgagacucuggcaggaaaucagaguugucucagguacucccaaggcgccuguaagugauuaggcaaagucacaggggggaacuuuugggguucaggggacaagagauuacuucugggugaaauugaaaggcaauuuuggggaagaggugaugaguaggucuuaaaggcucauacauucuccaugugugcgaaugaagagaggggagaccagcuaggagugaacagcagacuccaaggugcacucaggauggcagugcagacuuaacuuaaccaggacgaggaugaggaggcuguggaugugcuguguagcccauggccccugggauccacucugucugggccccuucccuuuguccaggaugcuuauuuuaauggcuagcaugccagcauacccuugcuucuguugggaggcaacaggaggaaguucuaugguaaugguagaaggcugaaugacaggagauggcuuggcacuuggauaccagcuuuguguucacagcacaugauuccguuugguaucugccaaccaccuagagccuuucuuauguauaucaaacaucuuguauaucaggauggguuuagcuaguagcgugauagcagccagccaugcuuagggcugcauuacagacccauucaaggugacccuggaagacagugacaagggggaaaccccauggugacuagcacuuuggacaauucaucucuguuucucuuuuuaaggugaguuuuguuugaucucuguuuugcucccuuccuuucuaacucagcauugcagaggaaaagucaaguccuuugagcuucagugugcuuuuucucagugauagggcaguuuauacuuuucuuccaaauccgaccugaaagguuagaggugguaaauggcuccauggcacacugacuauaaaucugagcugaaguggaaucuguaagccauuaucagauuccaaaucaagcuccuguggccuucuccaguuuuuguuucagugaaaguguguuuucauucugucaguggacaguucacacaccuacuauuaaaggagcauucacagugaauacuugaugugaaagagacuaguuaaauacuucaacuccaagggauuucauuaaaguaauaaggaaauuacauuuaauuuugaauggaagaaaaaauuuuuaaugucauugccauuaagcauuuaucaucuacaugccagguugguuucugugagugaauuccugaagcacaguuggucucuauauagguagaaagaaaauauuccugccgaaugcauaguuugaugucgccuucuuaacuguggagaaaagcauacuucuucaaagaauagaaugugaugguugauuggaaacuuuuggagcugcaguuuuuaguucuaccuccugaaauaagaaaaaaaauauauaaaugaguccccagaugaaggcguggugggguacuucacaacccuaauugacuccagacacaggccucgauuuguaagcaagcugugacaagaggaaguaaaacuaaauuaagaguaggaaggggagaaagauauggaggagaggugaugaaguuuuuggaagcuucuaaaugagugucuguaagugaugggaaggcugcagccauguaucaguuaugucagaaggggaaaccuggaaacaucucaguccaaaaacagacccucucucuuguuuaaggaucugucuugaugcccauugcuugguacggucuagagaguucaggugcuugcuucuggaccauuucacugacuagcagcguagcaucaucuguugggaagcagaggacaagguaucuuggaggacagccuuuucugcuuacacuuugacauugugacauuguuguagaucauguaaaugaauguccagaugucagcuguccucagugaccacagcuguccucagugacccacaucuguuguuuucucaauuauuuuccccuuuccuggucaucccuguuggcuuagugaccugagcccaggggacaggcaggcucuuugucccacuucuguuauagcauagagcacaugguuugguguuuaucuagaagcaaaagaaguuaaugagcugcagcuuuucccccucauguccauuucacuguggcuauaugaguucaggcccuggaccuacagcuugagcuugugggaagcaucaggccuuucaugucucuguagccaguccacugugcagagaauguaaucaucaucuuucuuuuaacucaaaccccuccauuauugccuauuucccacaggacaagcucucauuuacuuagcuggcaucuagaaggcuuuauaaaacuaccuauguccuuccagggugaguuccaugcuucucugaugguccuaucagcuucaaccaagcuuccuguucauaaucccaucugccuuccugucuuccuucuugacugcugcucuuucuccugucuggaccacuccucuccuuugcuuucucaaauuugacuuaccuguaagacuagucauacucuagccuacacugaaguggagcccauuguugucugcuuuguuuauuaagugagggacucuuucuggccuguaacauccuuuuuauuauugcuauauguaauuuguugaucacacaaaaguuaacuuucaagaugaaacuggacaaguacuguuguaugaauucugcauggcaguuguuacucgggguaauggagaugcaaggagaagucaggacucugccuucauguuucucuuuccuuucagaggauguaaacgucgaaugguccuuauaccuccuuguacagccacagccuagcagagucuggucuauaguauugucucauuacaugauuaugauuauugaugaaucaaaggcucucccuggauauuuguuuauuguuugaccaacagggauaagcuccccucuucaaagccaugcaagccccuuuucauuuugccuuuccauccucagcaguucuuccugcagcauggccccaucgccugccuuggguucagacugaauuuuaaaccaguuuucuguccuccuccucucugggagacugucgagcagcucaguccuguccucacuagaagcucuccagccuaccagacugccuccaggaggagcuucucagauuaaguuagcccaaagccucuccuggucuucauaaaaccauuuuguuguugauaaagaagcaagcauuuauguuuguuuuuaacuuccucuuccaacucuucauaaaacuuaguucuuuucauaauaccgcuaaaggguaacucuacagggggcugauagacacugucaggaauggaaggcauucuuuugaaaucucuucuaguaugcuauuagcugccugccucuaaucuugucagguguaauaaccugggaucuacucucaccacucaauguuuguuguuauccccucaccucccacuucaguguagguuagaauauggcuggccuuacagguaagucaaauuugagaaagcugaggagagggaguggucuaagcaggagaaagagcagcagccaagcagggggacaggaaggcagguagauuaugauguucuuuaauauguaccuugauucuuuucucacaaacucgcuuacauuaucaggaguccuaugguuacauauuacaaagaucucaacacaaaucaaauuggcuuaggugaucaaaagauuuuaugaauugauacuaccagcuggcuggguacaguugaccuaacaaugucaguacauggugaguuuccuuuguucccucuugucagccuuucaguguugauacuucuccauaacaguuuuguuuguuucuguacuccuuuuucaggucacaugagccuuuuguuuguuuuguguuuuuuugagacggggucuuuuuauguaguccuaguuguucuggaacucacuauguagaccagucuagcuuuaaauucacagagaucugccuccuagcacuaggauuaaaggcauacuccaugccuggcaccaugggucuuuuuuauucuaccauaaaaacacaaacguuagcuuugguacccucuuaaagacccccccccccauaagcccuugcuuugugguagccaaacaagagccacucuguccuuguagcacccacacagaugcuaggggcucagcuaguugaaucaaaagccugucuuaaaguacaggccucccuaggaaauggauaaucugugcaugugggccauuuagcucccagaucuucaccuguagucugucacugcagaggagauggggggaacuccucagaaggagccgugugugcauaaugguggcaaaaaagcugugcuacauucaaaggugugccuccucacuccauggcagauacauuguuaguuccucuaaacugagaguuagcucugagaacuaggucuuccauuucucacuccugcacucuuguguuugagcauccacucugucuagcaggcuaacacuaagcaguaucauuucugcucuugagcauagucuagugaagggacagacagggcaugaaggucuauaaggaaagccuguugugguaagugcugucacacaguggcaggcagcagaggggaagggaaguacucacacagaggagcugccuucucagcuggaccuuacagaguacaaagggauuacccuaacugugaaaggaacagcuuucuccugaaggcucaugggaacuaucaaccauuucuggcaggggacugacacaggcagauauauaguugagagcucauucuguugccuuuugugggucagguuacugcaagguugaugaucuggucagccaccacaguaacaaauuuagguaaaccucuuuuuucaagacaggguuucucuguauagcccugacuguccuggaacucacuuuguagaccaggauggccucgaacucagaaauccgccugcuucugccucccaagugcugggauuaaaggugugcaccaccacaccuggcuagguaaaucucuuaaaggccugaauuaagucaauaauuuuagggacagaagauugagucaggacauguaugacaggaaguaagcuccguuggauagaagaggugacauuaaagaugccauugagguuugguugcaguuggaagugacucagugggugcuauuacauuuugugcuauuaucugagguacauggccaacaaucaggugacacauuggucagguagcugccaagacaaauguguacuucaagauugguuucuaugcuggggacaaagacccaggugacaugaauaaaaauggugacuagacuuuggagagugaagaagaaagggcuugggguaaauuguagggaaagacauuugaaaggucaucagagcauaggauacccacagcauuggcucuggaguaggaaggcaugccacacgcuccaaauaacacacaaguuaguuccugaugaauguggugucaccuaagguggcuuacagcaugaggauaauggcagggacccuggaguccucuguuccuggagagugauuuguggccaaguuacuuauuagcccugcuuuccuccuugguguaggugaagaaaguaguuuuuaauugagggaauuaaaaugaguaaagguuuugaaagugcucagccuagacaacagaugugugggccacucugcauauguaacuccugucucugcauuggacuaccaaucuaaguauggaaauagcuuauuuggauguaaauguauuuguuguucugaaaacuggguuuccugugcaacuaugcaucugguaccuugaagucuucucagaucaugcauugguguuuuuguuuuuguuuuuccugcuuguuaucaguuugaccauggauguagaugugaucaucuuuuguuucuucuacauuuuauguauauuuuuauuguuccuaaugcuucauaguauacaguuuccugucuuuccuuccuguccuccuuucucucccacccuuuucaauuucuuuccuuagcaucuuuccuaaaacuggcaugcuccauuaguugcccacauugggccaugugugguguauuacuucagucaggcuacuuuccucauccauuuguagacauuggcaauaguuuugagucuucuccaucagggagaauccagagucugaacuugccaucuuuucuuccucuuccguuucacaagucgaugucuuaaaccaugucuggaucugugugcccauaauaaccuaagcagcaugaaacuggaauccaguuuaaaggagaauaucgcaccaaguccauuaaguuuuggucuuuuuuugauccuagauucaaauagaaugguauucagagugugaauauguugcugaaucccuaauacucauugagccuggcaucguguguguucauuuuucaguaacugggugggucacuuuuuuuuauuuauuaugaacacaaacacugaugcuaacagcugacaugugaaaggaaagaaggcgcuggugaugaaaaccauuuaaugauuagugaggaaacaaauauuguuuaaugaaaauaaaaaccaugucgaaagggccuaaugcugacuuuuggaaauauaagcauguugcggucuuuuguguacccucuguccuguacaguagauauuguuuaaaauugcuugggaacuggagcuugcaauugugagccuggaauguccugcagauaauuaaguuguggucaggcuuuggaaaaauaaaaaguucucgaacuaugauuuuauaaacaugcuacaauaacauuucuuuauauuuaacaguuucuuauagaaaguugauacucucaugaggcauugauuaaagguaaaacaucaagaaagaaaaaauauuaaauuaaaacuucacuuaggauguugacaguuggcuuguaauauuaaacagauguguauguuccuggggauagucuucuuucugaacugaauugcuaaguuguacuuuuuuuaaugacaacuacaaauuuuugaucaguuaauaauuuuaaauacccguucuacaaucuucaguaucuaacuucaucuguaguuugagccucucaaugauauaaugacuggugagaccuuugagccucuucuaaagccuuucauuuucuccaccccacccccaauccugaagcuuagcccggcucuucugauuucaugaugcagucuuggagauugauuccuugaaauaauuuuaggaucauuggguggaauucuacccuggcagauuuaugucuguaguuuccucccauguaagcuuugcuuuggcauuugagcacacaaacugaccuacauugugguauuguguuuguguggccaauuguaaaggcuucauaauaugucuguagagccagccaugcagaucagcccguaccccacacuguggggccagagaaaugccagugaggggaccuagaggaaggggaccuaaaggagaccuggccaggaguauaagaguugcagugaccuggcuuaggagggcuuugcccuuguacucucuaaggccagagucuaguaaggacagugggcuuggaaggaaaaaauguggguuacaugggugggggagucuccuucaauggcaugaggugaaaauauacuuggugacaucacagucuucagaucuuuuuguaugacuagaaaaacucuguauuauuguguuuaggcuaaugcaaaaauuuaaauguauacauuuuuguuguguaguuuuuaauaugcaagcaucuuaaguuuucugaaaggugucugguuacacuggacagaacuuuggggccuuggauacacuuauuuaucuuggaaccauauauuguuuguauagucuucuuuggggaucagaguuuuguuguuuuucucuauagauugcauuuggacagcucugauuuggagccuuaaguauaugggagacauuuucaguaaacaaaggcuugcuagauuaucuaaaaaaaaaaaucuguuuuauaauacaaaaguguauuuugcuccaagaauaauggauucuccuuaauagcuugcuucuucagugugacuguucuuuguuuauaugaguguguauauguaugugauguauguguugucuguauguguguauccauguauaaaaauacauauguauauaaguaugcauaaggauauguaugaagaaugaauuuugguguuuguucuuuucacaauucaaucugccaauucuccucaaaguaagacucgcugguuagcugcacccuuuuggaaagauguggaacuuugagcuauguacaaaaauaaauucaguauaauucguugcucuagaaugagccacccuguauuaacuuaagacucugaaaggcaauaaaagauaucauuagggaguuguauguauugguuuuuucccuagucuuuauacugcugcauuccaauucucuuccaauguuuugcuauuaaggacuaaugcaaauauuuuggauaguucucucuaaccagaauucauaauuauuaacagauuuaaguagaaaauucuguuucacuuugcuauucuuacugcaucacaagauaacucuguaaaugauauucacuuauagauauuuuggcuagcucacagauccuaauucuaguauuacgcuugacugagcacaagcugcugugaucagcuaagggaauuguauuaggcaggcuuuauuuucugucuauaguuugcagugucuuccauuccacagagaagcacagcuuuaagaguuggauuuucuguuuucaaauuuaauaagggcaggggaaagcaaggaguuucuuggagcaggugaugacacugugagauucacacacugccaucccucaaacaccucauuugguccucacuuuucuuccuauaguauuugcacuuagcugcuguucagauagugaagucgguauguuaaggaaagggggauacaauguuccuuccucaggauaugaguucuugggucucuucaccucucaguuacaacuugagaagguguuuauuggucccuaguggucugaaauggaaaugcgucucuagaauuuuuccuuagaacccuccaggaguuugauuggaaagaacgauguuaauaauaguagccagguuaucuuauuuaagaaugcucuuugggacccagcauuguuacuuuuccugcucgggcuuaggugcgauucaucugagggcaugggugcuagcuuugcaccuguacuuucagccacuuaggacucggggguggggagggacggccugaauaugcaugugugcuaagaagauagaagagcucugucugggacuugcuuuugucaucuuuuugucagguuuaucuuacuuaauuuucaugaaaaugauguguuuguuacuguggucacacuaugauuaagcuuuggcugauguaggauauuuuauugucccuguccuggaaaauuauagcaguuuuuaugaggagugguuuguggguucacacagcccacucggagugccacuuacuauaauucucuucuaaaagaaccauaaaacucauguaaauuguuuagaaagggaaaggucuuuucugagaaagacaagacaucuuuccaagcuucauggcuuagcguuuaucuggggcaggagaguuagcacucagcugaggccagagaggcugugagcugcagcugcuuaguucuaaacuaggcguugauggaguguaaagauccgcauucugugacuuuggaugaaguuaagaaaagggggaaagcagaaguuagaaaggaauuaaaaacauuuauuuuacaaguccucagcacucguguaaggaagcugugugcucauaaucuguauuaagacaugauuuuugguagccagucuugugaagcuuguauugaaauucacauguagacugaccuaaagaagcucucuucccuuugcaguuucuccaugccaguuggcuugcuauguucaguuuaugugcagcacaugaagaaaacauaaaacggcacaaucacaaggccaaaguucugucaugguuuuguacaaaugccuuauucugauccuaucuugguuuaagcaugagccuuacagagagcaagggcggaaauugggaaugauuuucuacagcacuuacaugcuacucugcuucuagucauucaauacaggucaaucuuaagcugagcaaaucgguauaagaaaaucuguacacaugugaagugggaaaucgggguaguuguucauuuuccgugaagauauaacuuauggaagauuuaauuuuagagacacuuccuggguccuauaacuuaaaguaggcuuaauuuuagagcuacuucuugggucugugcaagaucauuauacuugcagugacuucuuuuagaggcaggaaugagccaucuguagugacagaaacaguugcuucugcaaaaugugccucaguucaaaucagugcuguuaaaacacaccauuaucuuugugccuuagaaacugucugauuuugugacaagaagaggugauauugaucauguuugugugucuuaccaggaguguuggugaaacugccaacugugacugugaaaaccuguuuuaggccuacacacaugugauuucaagaagaacagcaacuuaggauuuauucuguggccauaaaauccucuuugcuguaaaacccgaacacucacagcagcuucugaaaauggaaccuugagacuauucuguauccuguacuuucuguuuucacuuuucuggaguuaggacauuucuacucuaucaguauggcaacaaaagugaguuuagggaauagaaaaugaagcuuuaauuggaauggagauugaaaaaaaauguuccuaaugucaugaugugggugggaaauccacgaggaaugcacagacuggcuacaaggcagcccuccaucucaagcuguuuuccccagggucgucugacaggguuggggccugagaagugucugccuguguauucagcacaccaagcaaaggcaauggcguuucagccagggcugggaguccgugcacagggaucuggagccuaugcaucagggagcgggcucuggggauuuauguggugcuguguggugacuucaugcuuguccugcuggauaaagagugcuguguuuauaguagggagggccucuuuuuuuuagauuaggaaguaguuuugcuuguuuuguuuuagcacagacaaaauuccuggucauuugcaauucuuaaaaagccauaugcaaggguuuagucaagaauaugcuuugcuuuauaaguuacccggcuggaagauaaccauaucaauguugcuaacgacuuguguccagaagaauguuugcuuuuucuguuuuucacuugagcccuuuaggaaguauuuuucauggacuucaagugauacaaacucauucaucaaacaguaacauuuauaugugaaaaucuucaucauaaggcaguuucugcuagaagagaggcagggucuuugaauuuccccccaaaacugcaacuucagaaaauauguaagagauguagcaauuaaccuacaugcagguuucuaauacuagaaaaugggcagcuaguuacauucaaagacaggaucugaugggcccaaauugcuuaaaacagcacaguuacugaagaucuucccuagggagcuugagaaaccauuuaacagaugaaaguacauucugaaaagucugaccuuacaggcaaucauaaaaugaaucaaaacagugcuuuuucccccugaaauguacagagcccaucugugucuaauccaguaauuauagacuguguucaauuaccuuuucaaacuuggagcagacuggagacuaggcagugaacaaacauaggguuuugucuagaccucaauugaccacagucuaaaacgugaauuuauaucuaauuuuauuuuuuguuugguuugauaguucuuagaggauucauuuuugcuacuugguauuucagccucuugaucucagacaccgccuucucucaucacaaaagcuuuuguaucugcuguggcuuaagcuguaacaagagguuuaguuuugugaguagucacuguugcuugcaaaucaauaauuugugcuagagaaaaggcuacacugggcugggggaggggguuucgccagugaguagcauuuuuuaaaauagcccuuuaaauguguugcugcugacuguaacucuuuguuguaugguuaggaaaaauaaauuauuuuccuuaaauguaaaaaacucuuauaauuuucaguugcuauguucauuuaccauuuuaaaaaauacuuggagauggccaaaagaaaucugucuuucccuauucucucagugguacagguucagugcacauucauuuuuauugugucugcugacuuuguuauaagauguauuuucaacccuuaaauaagucaguuuaugcuuugaugaaucagauuguuauauuuuguccaaaaaccuugucaguucaaguuuuuuuuguuuuuuguuuuccaaaugcaaaacagaagauuaccauaacuuugcagugggauagccuuuuuguuguugauggaguuuaguaccacuuaucucaugacagccggguugcaaacacauguuuuggugaaguaucauugccuaccagccaagaauuuuucagaaacuuuaggaccauuuuuaguaugugauuuuuuuagguagcuguguucuuuagauugcucuccccuuuggaaggcuuaagacugacacaagggauggacuaauuauacuuggucauauagaugcuuuucugggagucaccugaagaaaugauacaacaggucauguauaccuucucugcagaguagggugagcucuaugcuaagaacauauggcccugagcuuccucugucuccuucauggaccccauucugugacacuguuggcacaguguacuguaggcuucccuguaggagcuggagagacacuuuggaucuucugccaccuaucccucuuugcuuagagagcgguuucucugcccaucuguuuacuggggcagcuccuuccuagcuccugcucacugcccaaugugggaacuccuguaguuguguggguuucauauuagcugauuaaccccacucacauauaagugccuucagaucaaggcuggguggguguauguucucccauuguaucccagccucaacacaaugccuggcuugugcaggcagucugcucuuguugucugaguaaggaaaaaauggaucucccaucgaaucuuuaguauugaaaggucaaagggaaggauccuuaaagugaauagaaauuauaucugagugauacuuaaguacacacucuuucuauguagcucuguuuuacacucuuaauuuuuaacugauagucauaaagugaguuuugucuguggaaucucaguuucuccuugaagcuucccugccuguugcuuugcugacuuucugauggcugauagcagguuuuaugcaacugcuuaccucaccugcagugagaaaauugagaaaccauucucugguuugcacaucugcaggucuucaugauuccuauggaaacuuuacagggauaaucaccuaauagaauugaguacuuacuacuugaaagaugcugcuaaauguggugcauuuugaagugugagacgaguggugaugucuccuuuaugacuagcucacagcuaucccccacccucgguucacaguguccugacacuucuacucucagguugaaagggaaugaaagcauguucauauauaggcagugauguuuaguuuaaacaguucacgguucuccagauagaucucagaccacuccuuuucuccaugcuuuucuguuugguaucaauuuaaaauauagagugugauuuuuuuuuuggaccaacuuuggaguuuagagacguacagugugugccacauuuaaauaauccauuuaaauauugaaaauacuacuuuuugugaucugcauacuggugagaguggccccuaaaaccaacuaauacaccuuuagacccaaagguagagaggaccauaaucauuagauggauggggagaggcaggaaggugggucugcagaugacaaggaagguuggacucuucagcugguggcuuccugcuuugagcuugacucuccucugacuagaggaagaagagcuguuucugugauaagggguucuauugaaaauuagagacucagccugccuggggcaaagcugagaguagccugcccuuggucuaauccacagaacauaguucccagguuuguuggucagaguuuuggauuuccugucucucagcuacagccuuuacagagucuuaagcuuuuuuuuuuuaaacuuugcuucucuuagcauucugaauugggugcucucauguucauuugauauguauauuaucauauucuugaauuuuauucuugaaccaaauuggaaaguuucaaggcaaauauuugguuuucuguuagcccacaaauugggccaugguuguucaaugauggcuuuuguuaacugaggcaguaucacauguuaaguguauuuuguuaggaggucacagagcacaccaaaugucagccuuuugucaugucugacugugagcaauauucaccaaguuuuaucuucagguaccuaaugugucaucuagaaauguagagucuuguugagaaguccugaaacuguagcuguaauaugcccugcuggccccaugucccagagguuuuccaguggucuugagugcgccuuacgggacucuaccuguaagcuuagcucaaauguggaagcuguucugaguguugugagcucuuggagugcaggcugcuugcuguaugugguaaguguuggucaguagcaaugaggagauguaugugguggguacucgagucuccuugcugucaaagcacccucugccaaccgcagggcuacccuccuuuuggaagcucacucuaccuuugaccuuagccaggagccugcugcagaucugcucuguucccaagugacuugugugccuaucaggucacagacccaaggguaggaaccagacuugaaucagguuguuuagaagccuccuuaggaucuuguuuucuaauuggaauugggaaagacuguuuuuuuuguguguguguguguguguaagucugcgucuuacacacagagcucaggugcuagaggaugagucucacugcagcccugcggugagagacugacagcugaaaugcagagaaaacauggauugggagucggcaguucuggagauuuugguauuuggcugcaguugcuucagaggcccaggcgaaucggcaucuuuccugugguuggaucauguaagccagugaugcuaacuggagaaaggcugcuuccacagagcuuuugccagugucuggagaugucucugcuugccuuaagggcugauacuggaucuuguagguagcagucagggaugcuguuaaauauauucugcuauguaaauuucucccauaaacacaaccuccucccaacuccaggcaaauuauaaugaaaccccaaauuuuagcagaaaugagguugauaaaccugauuauuaacccacucuucauuugugacauucaugguguauacuaauaucuuccuccgcuuuucagaagcuaauuacaauuaaugucuguucagggaacuuagcuuaaccuagggauauacauaaacuuguaaguugcuuagugagugguacacacucuagucucagauuucugaucuucuaacguuuagcuacugcuuuggaaagguggauuccuauucucucugggucaaacuugcaggcugucuuaaaaucaaaagcauuggaguggugccuguucauaacuugacacuaacacugcuucagaguuaugccacucaccccagauuuucucugagagugauagucaaccuacauaggaaggagacacccaacauuuaaagaacaauugucauuuuaaaaaaccaaauauuguacuacaugaaacaacaacaaaaauaacccucagggucugcuaagucugggcuggcagacagugggccuccaugagagcacacagcgcuugugauucgccuggcagcuccccuucagacauggaguggguuucccuaguagacuugguaaacugaaagcuuguacaugauuggaggagaacuggggcaggagcaaggggcugcuauuccucacuuagaugaagagauacccccaaauaaccacaucuuauagaaaaagcuugagguuuuuuuuuuuuuuuuuuuagauuuuuuuuuccuaacaguuuuuauuuuuaaaccaaaaaucucugauuuuuuuucucccuucuguaauucccucguuuuucugaguaaucuagacuuaaacuaugggauuuugugaggaugcgugaggaguccucuccuccuuggcacaguugauauuuaguacucaucccuuauuggaacagugaacagugauuuccuccaacucuggagaucuaaauauugucucuagcccagaaacucucaaguuuguaauuuuuucucagacuccucugauuagaggcaucuguagcuaucuauauauguggaugucuggaaaacaguaggucugcaugaugucugucacacacacuaggcacaugucugucucaaggagcaugcacugguuguccuucugcuuggaaugcuuucccgaggugucuacacagagacagcauguagccacaugcucugcuucaaaccugcccucauucucagagguccucaugaccaugguguuuuacguguaacucggcucuuccuccaggcucccucagucccccugccuugccuggcacgugcucccucugugccuguccucaugcagaacuuuauugaccaguuucuucauugcugucauucuguuuccccaagaauuggguaaaugugacuguaaaguauguaacucuuugaaaccauucuacuuagucugacuaaaggagugugcuuuugggaguuacucagggaugaaccuauggguguuuccuuccugccuuaucacagaacagucucuuguucuauggagcucuauaguuacccgucaccuauggagugggccacgucugcuuuuuggcaauuuugaauugagcugccauaaauauuuauguguagguguuagugucagcauaaaguuuucauuuuucuaggguaauagguaaauacuuagagugggcuuguuaguucacaugguauuuguuaacuuucuaggaaacugccuauaaacaaacaucuaaagcaacaucauuuauggugacaaaauauccaugguccauuagcacugacugcuuugauucaauuuugguuuuuagacugugaugggaguucucuuuccguuuuuccuucccauucccucucguauugcucugguuaaacuaggcuuagaggacuuugggaagauacaaagauacacaguuacaauacauacauacauacauacauacauacauacauuauguagcaguagaagggaaugaagaauugauaccugcuacacccuggcuguaccuugaaaacauggcaaguccuagaugucagucacuaaggaccacacagcaugagaauccaucuauauggacugccuagaagggaaauacauagggaaucagaaguuagaaagauguguggagaucaugaacauggggcuuugaauaaauuguguaaaauaaaucucgauuuuguaaaaguugacuugcuuuucaauaugacugucucauucuguauuuccaucagcagugaauuuaaauuauguuugugaaacaucacguuggcacuugcuauuauugucaguucuuuuuuuuuuuaauuguuagagccgugaguagccucuuauuagaaauggauagauccaauggguagaaguuccaaacugaaaaggauugaacugaacaucaccaccaaucaacuugaucuaguugaaguuuacagaauaguuuaacucaauggcuugucuccaauggguaaagucaauucucuggcuuucaagauauuuucaagaguucgggauauucuuauguuugacuugaguuacuuugugaugauugucaguucuuuuuaucuguuugucugucugucugucuagcucuguguuuaggauuaagcauaucaggcuccccaugacucugugucaguggucuguugggaaguaggugccgucuuugguaauagcacuuccacaguugccagugaugcugacaccuuucacguaccucuuugccaucuuuguaagcagucugucccagucuuuugcucacuuuuaaaucaaacuguuuuccuuggcuugaaugaaagucuuucauauauucugaauauaggcaccuugucauauauaugauaugacauacuuucauagucucagaaugugcuugccuucuuggcucuuaaagauacuuguugaucaccuucaggguucaucuguugacugaaugccuaaguggggugccugguacagaaagggagaagcucgguguuuagugacuggauggaugggcuccuccuuuuaccauguagcaguagauuuguuuuguuccugacaggcaguaugcuggacaauuagaaaaagcgauuagguuauuuucugauugcaauauuccuuucuucuuacuaccucagaaggauuagcaaucuggagauuacagaacuugugugacgcuggcugacuuggauucuuccucuucugucuccuaauuuccuguucucccucuuaacccaccuucccuaaccaacugucuuugcuaggccagcuucaucuuaacuucauguuuuagcucaagaaucagauuuguucugcauuuguucugaaucuugaguaugcacgaagaggcagcugugguccuaaccucuugagcuucgcaucagugcuacaaacucuguccucuuccccaaaccaaguugaugccuccauuuuauguucuuuuaccugugguuuugcuucagaggauuucauuuauuuguaaauaucuuuagugauuuuucucuuugccucacuguaagccagugacuuuauuuuguucauauauuucccaaaagaauuuugaaacaacuagguaaccucucucauuugcaaaggauauaauuuccaacaugcuuuaaaacuuauauauauauauauauauauauauauauauauauauguguguguguguguguguguguguauauauauauauauauauauaguuuguuuuguuuuuguuuuuguuuuuuguuuuuugagacaggguuucucuguguagccuugacuguccuggaacucacucuguagaccaggcuggccucgaacucagaaauucgccugccucugccucccaagugcugagaaacccugucucaaaacaaaaacaaaaacuuaauauauuauaaugcaaguuacucaccugucuuuaacgaugcacuuggucgccucugccuuguaucaaguccagcuuugauagccuuuaccaguuccaggggccacagccuugcuuuugccugaugaacucaaacuucugccucauaucccauuuguguuugugccugguuuuguauugaccaugcugucaggagguucugucaagcaaagaugaacaugagaguugaaaugaaagucugacaguccauuuauuuggucaguguugggaucaaaacuagcgccccgucgaugcaugcuggugaaugugagauuuaaaguguuccagaggugaccagcagucuuucagugcucucuguuguuuccuuugugguuuuaauuggcauauggauuaggaaaacgugcagguuucacuggaggggccugucaaggucugggaugggccccuuugucuuucuaagugucuaugcacaagcuauuggcaugucaguguucaggaccuguucauucuuaguuuccaugacuuguagacaggaaaagaagacaguggaacuucauggaauuaggaacccaaacugucauuaaaaaaagaaaaaaaucugucagauaacaacucauuuuccauucauuuuguuggggggggugucccuaaauugugcaagugugguuggucagucauuagggccauuucuuccucagcuuuaaccugaugcugggugucucuuagaugauaccaauuugauccaguguugucugaaacugguaugaucugcccuugucuccaugggagaccagccaguguccagccuguggggauggagcccagugguguguugggaagaggguagaggaaaugugggaacaacuguggauccugugucaaaaacauccagcagccaccgucuccucccagggaugcccagccucucccaugggaaaugcagccaaaagccgugccaggcgaagcuggggacaguugguuuugcuuugcuauguuuuuauaccaguuucuacaacugguauaaaggcauggaguaagaccuuaguuuaaaaaaaaauuguugauacugaauauagggaaauuuuugcuguaaaauugaauuucaaaguuacaauauuuuuaguuuucuuugaaaauauuuaaaagagacaguacuuuuauuccugaauagucuuuauguucugaauuaauuuuguggaauagagggacagaaaagaacucccugaauugugccagucugguuggucagucauuugggccauuccuuccucagcuuuaaccugcugcugggugucucuuagaugggagaaaaauacuccuuacagcgguucuuuuauugaugcgguggcuuccgcccacuaacugucuuaguguugcuucagauagccuuuauugcuuuuaaguaacaaaacucuuuguaaaugcucuguucugaccacauuuaggcaucuuugaugcuaaaacaucaguuuauacuaauaugguauccacacaauuaguaauguuggcauuucuucucucaccugugguguuuuagaggcaccugauagauaaaucguuuguggguauuucauaccaugagggcucucgggguguacagauuaaguauaugguacuaugguaagaaaucugacugcagauggcagcuuccccuucugcaaauguguggacucuggugcugaguaaucuccugcaugucucuguuuugcugcagaaaaucuaucacagauuuuugauugccuuuuaaaacuaugcuucucaaggaaacuuaucuuuacuuuggcaucugguuuucugugaagucauaauuuuggaucagaauuuccagcuguggcauccaguuuuauggaguccgaacugagaauuaaaaacuacgcuauguguuucaauaugugaaaugaauguuaucucugugugaaacaguguacgcuguguuuaaggauuuuaguuugcaguauuaugcuaagagaagcagcuugcacagcagugaacagcucagaggaaugggcuggguuugcccuuccuccagugucccaugagauaauaugaugugccccucaccuaaagggggacaagcguaagucugccagcagcuaaggugacugccucccuucccagaugaggaaacugagaucuucacguugcugucacucugcgugagugagacaaugcucacugauuggaggugaaaagaguuaggguuaaucuuguuaggggaaaucacauggccugcuguuugacaaugcagggguccuuugcagagaaagagccccccucccauggcaguguugcucagagguugccugugccuaggacuagcagggcuaggaggcuagugaaacaggagacagguuggcaaaacuuugcaguauucaaaauguuuucauucucuacucucuaaaucuguucuucaauccuuauccaaaugaauuacaaaaaucaaugguuuggaauacaagaaugcuuucguguagcaaauuggugcuuguuauaggaagauuugucuugcugaauuagaccccugguuguccagcuauggagacaugacuccaucgugaucaguguagcagauggauguuauguugcuauuagaaguuuuugugccaagugaaauaaguaggcuauagcauaugauuucauuuguguggaggauguagauauacaaagaacaguauauaguguauuugguauauaguguauuucagagugcuggcagugugacuugauucugcuuucuaacucugcauaguucauaaacugucuaucauaagcagaaaauaaggccacaagauuuuaaugcaacaaaauagacaauuauuuuuauaauauaaaguuauaaaguuauagagucucacugaaaguaggcucguagauacagcaaacaugaagaugguacuugacuaaacucucacacagcugcccugucucuacgccaugcuguggaccccacugguaaggggauagcacccauccaaaacagaggcagugaggugaggcccacaaggaacagucugucagagaagucauuguauuugacccagaacaaaagagcacauacauuagaaaagcuauucuccuguacugaaagaacauugcuuuguucuuugagagugccuuccuacuaguuagcuccacugacuggaaggugauauucugccacuuguaaugcuuugguuggugacuggaaauuuucacaaaucugcuucccagaacauucuauuauauggguaacuugacccaauuccucuucuuaccugguucugguuuaauaauuaaauugaguuagccacuaaguaacgaaugguuguguagaggccaguagugaauagcugggagucugcaaacaucccuuucaucaggccaggcagaguacuguguucucggagugcagcacuggccaagcagcugugcaaaugaagcuguuuuucugaaagguaagccuuccccgagcguacuaugcuuuucuuuacucuaagaauucuuugaaggaaaaaaaaccuaaaaauauuuugaagcccucaauuccacuuuauaauuuugaauuaauaacuucuuacuacuguaauuucauacguuuuauacuacccccaggaaaaaaaguauuuacuuacuucacauuucuuauauugauuucaguuggucucauuuugcauuacaauuauggcuuuccauuccaugaaguauggcuuagaguuguguuucaaauuugaaauggcucaugcauuaauaaagcuacuguuuuuaauuugaaagaaauguucucuuaaggaaaguuguuaggcccugggaugcaguuuuaaaauguuugucuugugauagucuuaagucauuauuaccccaaguggcaucuuuagccccucacuugccuguuaggccaacuacauugauuuuuuuuuuccagucuccaaggggacacagaacaagagagacagugcuguguagaugagccuucucuauaaggccuugggacaaaggugauauguuacagaguaaaggaacuuucaaguggauccagugcccuagcagucgccucgagguuuccacaaucccccccucugcaucugauggaaaaccuagacgguuccuuaaaacucaagcugcuucuacuugccuaauuuggggcuugugaauguaugcccauguggauauaaacugguuuuaugguacuuguuaaacaucaugacuuccuguauuugcugauaauuuuguucugacagugaauugauuuuuuuuuuggggggggggaguuguuuuguuuuuccugacaaacagaacuguuuuuuuuuuuuuuaaacuuacaaaaucuuguauuuugaaucggagcaauaguguagacaguccaaacucaugcuuuauuaucuacuuaaugaauauucaugaaaccagucuucacuggugauugaagguacaauggagacauuaccaauauuggccuaaugacacaguacucuuuuugcaagaaguaaaacauccaauauggaaaauuuugcuucuuuuuguugggagugcaccccauggguggugguggggaacaauaacaaacacuuucaaauuuaggaaagacauaaauuaguuacaaauuucugguuacaguauguaccaagaauucuccuuuauacaaaagaauuagucucuuuauuucuuuauuaguauuugugagauucaucugagcuuguguguguguguguguguguguguguguguguguguguaagcacauuuauggguaguaauuagugauguucucuuugacagagcuggcgacuuucauauguaaacacuugcgaguacauccaucuggcccaaagccugucaucuuauguuuuuaugcuuagaugauaaaguugguauuaguaaaaaauagcaguacauaccucaucccaggcacccuugaugcaucucaagacaaggcaaaggugauggaggcccugugagcacacuugaauuuuauuuguuugggcuggugcagcaugauaggcaguaccagcaaaguagggcaaaggcugugcagccacaucagcucgauuugaauccaguucugggacuuaguagcugagugcaucaaauugcacugugcuuucuuaagccucgguuuccugugugugaacagggauaaugaaucuccuugugugcaauaacaauaucuaaggucacuaaucaggaucaagaugaaacugcacccaguuuacaauguucuaugagugugagggauauauuugcuauuaaucauagaauauuaaagucguuguuaugccuaucuucuaggcuuggucagucaaugccaauuaaguugaaugauuauuuuuuuucuccuaguucuccccacccccagaggcauguuauaaauacauuagcaacuggaauauguuuuucccucuugguggguuuacaguguuccuaggaauuuagcaugagcuccgagaaggaaacuggguccaaaugggcagaguggagguguucauuaucucugcaugccuagcucugagucaggccauguccucucuaaugccaauccaguaccuacauuccaaaccuuuguccccagaaacugcucuaauugagaugcugacucuguggaauuugauucugugaaaaacauaaaggagccugugaucuugugccggguacacugggggaguccuaccuaguacagguuauuuggcagucugaagaguucugcuuccucaauggcugcaaaaucacucuuaauccagcuacuugagacauuuaugcuuuucugcaucuuaaguucuuacgacuuuggccucuuuacaugacacuguagcaaaauaugacuguuaguaauuucuguuagaccugcacccaggcucuagugcaguguucguuagcaagggcagaguuggggauaaccuguaucuuucuacccacagguaaguaggcaaccuucugagucagcuugagaaggguaugcaaaagccauugguuuaaaacguguuaaccuaaguauccuagaccucaccucuccuuuucuaacaggaaggucugagcaagccacugggacuggaggaguguggacauuguccuggaaggggagugacagaugagacuggagagucucuuaggcaggggcacaaguaaggaucagagccugaggcuagcaaaugagccaggaagaugauggaggaacuguagaacugagugagcaacuggcugucgcuguucaggaggagacagugaucagcuaugaggccuaaaccugagcaggcagcaauaacuucacagccucacaagcugacaugggaacucuagaggcaagguugcccuggaugcaagauagagaugaagaugugagaguccagagagauggggaugaaggaugaggauggagggucccagcaagaugucuggauggggcaggcaggagaccccggguaguugggugagggcugauuuugcauguguaccuuuucccucucuugccucauuugcuacucauguugcugcuuaagucagagcauuuuuauguucauggggcaacucucuggcucguaguguuuuccaguuucaguggaagguaauagacuguucuaccuuucucuaaggaauguagagaaaaggugaaggggaaaacaauccugauuuugcaauuguauauaguuaaaaacuuuagaggaagguuccuuguguaagaaaugcgauauggccccaagagccuuguucugugcuaucuaaucaucaguugcucuuguucauggucccagcacacugcaugcacagugcguguagugcaaacccuggcuggagacggagcaccacagggcucugcuguccaccuugaagucucaugugcacuuugacuuguacuucuuugugagagucaugugacacucuuagagagaaaauaauauccuugcauuauucccaaguuucacuauacuuaccuugugccaggcacuuuucuaguuccuuugcaucucacccucugaaguacaugcugauauugcuccauuauacaaaugaggaaacugaggcaaaaguaggcuaaguauuuuggaauagccacguacuuuaugaguauaagcaccaucuuagaggcaguaucuggccccaaacuauuccucagccuuguucuugugccaccugugguucucagcucuggugaagccauuacccaggagcuugugggcaccagccaucuuccuucuccugcuucaaggucagugccuccuuauuuacuaguccacuaguauggcuucuuccucugaucuuauggcacaugugaggcuccuaauggcuuuuugcaauucaggaccuaguggcuuuagcccuguaagauaggcacuguggacacaggaacaugccuccuaccuacacacccagcauggugugugcuuguuggcaucucugaaggauuccauguguugcuguuaguuugcauuuuugaugcuuccagaggucugaaguaguauggaggguuaauugguugggucucuguuugaauaccagcucuagucucucugagccagcaguaggcacuguggauaauguucacugaaaagguuaugugcuccaugguggacaggcaugagggcuggguccuucaccuguaaacaggcaucguacucauuagaauggcugugaagaaccaccugaagaugcuguaauuuucagucaaaugaaaaagcugugggcucuuuggagcugggcuagaccuuaggaaucagggaguguaaucccugaguucauggcucuuuguugccucugccugugagcuuuagaauugagcaaguugauuuaagcucagcagugauaugucuagauguauuccguaaaguauuuacucuguaccauaugcaaauaggaaguuaacuacuuucuuaacuagcaccagccuauagucccagaacuugaagcugaggcaggaggcuuguuugagacuagcauagaccugucucaaaaaccaaaaacaagcaaaagaccauccuugcuccugcacugauagcugcuuuugccuacaugguguuggucacccagggcauauucucuguguugugauccucagaagaaccuccccugagccacguauaaaguuuuacugcuuuguaacaguggccacuauguuugauaggggcuuaggagaggcuagggaggaagcauauagacccuacugucugcaugagaggaagaaauaaaaacacauuagggucaaagccaaggaagcucuccuauucuuguuucccauggaaaugggggcauuggcucuuugcugccucgcugccugugaagguuaggaguggugggcaaguugaacagcaccagcucugcugccacgacacugacacugggcuguacugaacuuauacugggaaacuauaaugugcauuaggcuuagagaugauuucuagauuguuaaagugcuauuuuuaucaacauucaauaguagauuuuuacauuacuaccauuuguaacuauuacaauuuguaugaaaagugaaaucucauuggcacacagugagcauuguuuaucuggagagcaucugcuguggaaggcucagacugcaguggagaugggaggaagcagcccuuccgagaaccucacugcugucuccccauuccaguuaaaaagauccuuucucuuuuuacuaccacagaggauuaacguuuaucacagcagcggugagcauggugugguguuggcugaaucccagggggacugccugcucuuaguauuuagaaugccucaguauauucugucucuuguuauacagaucaacucauuacagacacauaguggacuuuucuccccuugcaggauucgaggagcgggaagcaaaugcccucugccugcagugaggcugcuuacaaaagcaguucacaggcuuaagcaaagaaacaucuuucugacuuccucaauuuucaugauggaaaagcucaaggauugguagccugcagguucugguguuuacacucuacuguguggccacuucacauauauuuaauaucuaauuuaugacacgaucagcaauaucuuuguuuccaaauggcaaguuuaaaaguaguaaugagaaucagaauguggcugacuuucaaaauuaugcauuauacagagaaaaacuugaaacuacaaauuuuaaaucucauaaaagcuaaucaaauuuaguaguauacauacucccucugcaucugaguuucauaagcccuaggagcgcugacagugcccgaggagucuguuucccacccucaagcagacauuccuucacccacucgggaagagacuuccagaggagccuagagauugacccagacauacauccccagcuucccagucaauaaccugcuugucuuacucucaggugaccgaagaguccacagcaugucucauuguccugugugugaaauagaaauggcagagugaaagcugacugguaacacguggaugggccuuguguuaagaaaaagugaaugguguuuucccaagagaaacaaagugaccuacuccaggagggauagauacccuucccccacaccccaucccauuagugcugaguuagcuugaguuacuucuucugucucuguuucuuuuccugcugccuauucucaaggguuuuuuggauguuacguguuucacuuucucuucugcagccauggucccguccuggucccuggcagagccuuccaacacaguuugacucauggugcacacaaguucaagaguuaaugaaauguguuugauuaauuuauuacagagcgcugccucaaguuaaaacaguuugcucuguggaaaauucuuucuguucaaaagaagguccuuauuucuaagagcagagcucugauuuuaauuaaauaaagagcauuuucugcaauuuuuuucuaaaagcuuaagacuaauuucuaugguuacuagggauauaaaucucuagauugcuuuaaaacaaagauuuguguucaggagagaguugacagcucccuuuaagagaagcuauuacuuaauuuuacuuuccuaaguuuaaacacauaaaaauauuuguaaugauaccccaaaggcaucauaaaaauguaaaauaauuguacucuaaaauaucuaaaauuacaggaaauagaccucauuuuaaaaaaugaacuagaauucauggcuagggagcuagggugugacacacuucaaaaucagagucucuuguuagaaggcuuuuuaaaaaauauuaaaaauauuuuguuaauuguacagacuuuaaaauauguccguucaguuagggaauaauucuuuuuaguuuuguuacuuuuaauuuguuguacuguguggaugccucagucuucugugagagaagucaucuguguguagaauuauguaggagcccugggcuugugucugacuccgaauuagccuauucuaaguauuguucacaaagagcccaugcuacagggcaccaacgcuguugccgccuuacucuuccaaggcguccuuucucucucagugcauagugggagcugguaaauguuucagcuuagaguguguuauauuuuaauaagcacacuaugaaauguuugguagaaagacugcaaaagcauuuuccacuuuuuaauaaauaaggcuaauccuucccuccuucccaugugauauuguggguuuucuuuugcuguuuuuguuuaccaaaauguuagcugggccauauauaauaaaacacucccaguucaugaagacagcaacauaugacuuguacagugcuuaugcuaaagaccggauauucuaugcaggacacucgugggccgggagugcucugcauuaguucccauuuauauuuucacagcaaaaugggggagagaaacgccguacccucuuuuuuuuuuuuuuuuuuaaagagacaagaaagugcaguuggcuguggguauugaaaugcugugagcugcguauuugaaccaauguaaacauugaucuuugcaaauguacaggaaucagcuuuuaucuuucaagcaaagcauuucccauaauuuuuguggguuuuuauuuaaguugggaaaacuuuggaaguuugugugaaaguauaaauaaauuuaggaaagucaugauuagaguuugauaguaaacacucagcagcaaauugggaaagucuauuaaagucagauguagcuuuuaauaauguuugcuuaaaaacuuacucuaaauaagagagaaacagugacuuauguggguuuggaacaaaggcuuggccaugauucagaauaaaagcugaauuggaauuuucuacaugagguuucugugacacaaucauuaagagccuuagugauuguuacaggaucuccacaaugcccuuucuuaguaagugcagaagucgcuuguauauccauauguguguguguuccaauuuaaaggcaaaacaauuuccaauaaaauuuaacauuuuuuuccuugaaauaaaccuauguggagauucacaauucugcaaugagagaagaaaguaacuuuguuuugcuuaguuauugaaauauacuaaaauacagauauauagauauagauaaaaauaaaauuuaaaacuucaaaucuguuucaaauuccagauuuguugugaguuugaccuggaaggcaguccaugcuucagccccucuguucucucgggcuagggaagcugcugcagcccccgaggcuaauuccaaaagagcggaggcugcagcucgccagcuguuacccggggcuuggaauagugauggggcuagcaucugacugagccggcugaaggcuccuaaaaaccguuugacucuucuuucuccaaaacaggccuccgugguccuuaaagugggugugcuuauuguuggggcacugugcuacauuuugauaaguaucauugcugacaaauugagacaugauuuuaaaguaaaauucuuuguuaugauaagaacagaaauguuuauauuuguauuuuuaaacauuuuagucaucugaaaaaaaaauugcucaagaaaguccacacuugucuuuacucaguugacugugagaccucucgcacaugaguuuuaaauaugaacucuaaguagagacuugaaaauacuuugugucccagugaaaucauuuuugaaaguaugggauuugagucucuuaguuaaggucuagugucuaucuuuauuuuccuaacuguucuauuccacccuagaaugcuaugucaggagccaaguagucuauccuguuugaauguuuaaguaaacucauuuuuaucacgcaagucuucacuuuguaacauuuagcaguugucaguuugcugcaguuacuuaaguucuagaaaccuggguuuguuuguuuguuuguuuuuuaacauuuccacuuuuuuaaagaacauguauuagaacauuuuguaacuuaucccuugaaacagaacuuucugcagugugugugagagagagaccauaaugagggaaaggaaucucuauuuuuugaggacagagaaugauuaggcgaggcccuggauuuccuuggaaugccggcuucggugcuguuggcagaggccagcauacucggccuuucauucccauucacucagcugaaugaggaccguggagccaggcuguggaucuuguuaccaaacccucucuccaaagagaaagagugcuugcucgguccuuugcuugcauuuugcuaaagaaguaggcuagugcagagcagagcucuucuguuaucagagcagguuuucuguugagugugaaugauugacaucuaucaggcagcagagacagugcaugccuggcucccucuguaccgcucacaguugcuuuugcuggucccuugcugaugugaagcagaaacugaacaagguaacaguuuugauggugagauuagagguagccaggcagacugucuccugccuuuuagagacccucauaagcucaggccacccccuccccuuguuuagauauuauuugcucuuuugaguuucggauuacaggagcaauugaucugcaugaccuaucuugagaacuuuaacuuugcaguggaaacuuaaaccaaauguguauccucaagagacaaaucaucuuaggaccaggcugcugucacuuugauguacugugcugcuugcaggggacccaugcgguagagagcgccaccuagugaaugcaacuuguaguugcuacugugggugaugaaaggcuagaaaauuggucuaaugcuuguucuuggaucacaaagaaaugaguuuuuauguuguuccuagcaaguaauguggccaggauucuaagaggaugagauggagaguauuugacucuuaucugugguuuucccacuuggauuuuaauuuauguuuauuauugcugucuuuacacauaguuccuccccuacuguugugaucaauguuggggggggggugucuguguguguguguguguguguguguguguguuguguagcagucuuuagucuucagggacuucauggaccagauaaacccauucuguugccgcagauuccauucgucccaaggaugaggaugaggaugaagaugagcuacugaucacaaguuggcucugaggucaugugccucugguauauacaaauauguuuacaguauccaugaaaaacccauuuauacauuguaacugccaauuaacucuuuaaugcuuuuuuuuaaaauggcaaguucuugauaaaauagcucucucuuugguuuguugaaugauuguagacauuuguugggauggaaaguaugccaggccuucagaauccaaagugaacaagacacuguucugagcuuuguaauccuuguccauagaagggaguggacaccauguaggaugcgcuguaauggauaucagaugcuacucugcuaaguauuuucugcuauggauggggaaaaaaauccuuuagcaaauguuuuugaagaagccaguaaguaaaaccaauggcucauuuuaugaacgccuuggugcagggcaguaguagaaggcagcauaacagcgucuuucugcuuugucuauugggcucaaguuuauuucacagaguccaaguuuuggaagugcauggcaaagaauucaaaacaacaggauguucacucugggguugaccauggauuuuggauccuggcuuucucauucauuagcugugugacuuugacaggucuccucauuaguguaaaugugaucagcagugcagggccucuuucacaagagcagggcauaugaugacugugcauggaggucacugugagcaaugggccucgggaaaaguguggagggagucugaaggggauaugguaggaagagagaggccuugagggccgaggaaagauucucaggagauuguacugggcaggaccgacugguugguagguguagcccauagaaacuugccuggcaaaagccuguugcuacuugcuguggaagaccuugaacuaugaaccagggggugggugaauccccaccccucucauugguuugguuucucagggccucaucaggaugaguauuucaucucaccagcugcaacacugugcauggcugcccuuaacaugacucccaaggcuacuaaccagggccucugguccauacccgaaggagccagucucugccuuuaguuagaaaggcuaagcugcuccgagguucaugucauuguaguuguguguucuggucaucuuauacucuguucaguagaauuacaagaggccaccauaauuuucacugaacuccugcauuuagcccaaaugacagaccaaaccaaaauggagucauucaugcuaaauguggcugaaucauuuuuuuggggggugcaggagauccuaguuuauuagugugacaaggagacuccaaaagcagugccaagaaguuggcucaguguuggcugggcccgaccuacagcucaggcuucuguugcugcccugcgaaagcccagugucuugcugaaggagaguagaggccagcucuucaugaauggcaggccaagccaguguaaucuggggcaugcacauguguuuugugcaugcaugcuagaacaguugccuuuucccuuuuccaguccugggcacugaagccauggucuuguacuugugaggcaggugcuuuaccacggaacuaaauugcugccuggaucucuggagugccaggaucacaggugugugaggccuugcugagccccuaaguucuuugcuuauuucuuuuuguuaaaauauguuacaacauugauacuuuuuaauuauaguuguuuucaauggcaaaguggucagagaacuacaaaugacaagaggccagaaaaaaagcaugaccauaaugaagacaggguuuaucaguagcacucuugagaaagucaucuuagcugauauaaagccagccugacucagugacucagguguggguguuccaaaguggcaucaguagaagcacuaagcccagagaugagaggcagaagguccugucaacacaagguuuccagucuauucuggaugguauagugacuugugaggcuccugauguauauauuuaagguaacaaauguggccagauccacauguguuauuucagguaaauaauucaugagaauucugagaauguguagccuagagaaagggaacacaauaccuaauauuuuucuuuuccagcccugagcauugaaugggggaaccuaacauaugcuagauaucuaccgcuuagcugugcuucagcucguugaacuugauucagagggaaaauaguguuuuacuguuugaaguggaauaacuucccaagaggaaguggacucccuaugugcuguucuucacaauuaugugucucccagagcuuucuaggucugagaauccaggcaggaggcagucaguuucuucuuuauucuuugguacuuugcagcuucugcuaagcaaauaggaagguguagcagaguagcagugucugagcuuuggagacccagaguacacuacccaucaccagagagaugcggugcagugugcuuggaaagggcucuguucaguuagcaacaggaagaaguugggcccugaaagagugugagugugugcugcuucagacuggugcuguugaugcuguccgggcugcucagccucugcuguacaucaaucagugaguccuuuugguuugcauucacacuaagaacacagcauguuuguuuucugggggcuauuuguuuuguuugggggcuaggagcuuacuaauaggaaggaagccauaccuuucaaguuguuaagucagcugcuaguucccugagcucuaggucacugugcccucccacagaacacacuacucaucuuuguucaguguucagccagcccuacugucugccauucaagacuaugggaaguuacauuacaagggugagacuagaaaaaguaaugucugguguacaugguuccuguguguuucguagaagaugcauugaauucugggagccauucuguaguagaacaagcugguucucaguuggaguccagaacagacccagacuggcagcacuuuacauacacagccgaugaggaucagauucagucagcuggccucaggacgauuuucgaagacacagagagaggagaaucauggugccacagguagagccucuguggacccaguaacugaguggucagugaugggaaagacaaggguaugaucaggagccugcuaagagccaggcacugaggugcaggaaggggccagcuucuauagcagauacuuagcaaggugaguaggcagaacucacagguaugguuuaacuggugggcauaauggaggccugugauuuucuggcuugggacuugagagagaggaagugagagagaauaucaagucuuuagggugaugggacaacugugagugagcuagaguagaguagagugguugcucuaguguccuuccaggacauacuuccuuugaugcaccagugaaguguccagaagacaacuggaacguagagagagugggccuggguggauauuuuauaggcuugugaauaaaguugugauuggaaugagucuacccaaaauggaaaguguccagccaagggcugaacucuggaagcagguuauacagcuuagugcaagcagagggcaguccucaaugguagccaugcugcgaaagcucaggagacggccugggggaaggagaggugcugugaggauuguaaaggaaccacccagaagccucuagugcagugguucucaaccuucuuaauuuuugugacuucagugggguccaugcacuccagaugcgugcuagucugugauuucucaggcauuuguggucauuuccuuuucuguuaagacugaaguuaguaguucccagguuaagccugggaaccaauccuugugaaaacucacucugguuuaucagaagcuggcaagcucucauaccacagcaccagcccuucuggucaugcuguacccuaacugacagggcaagcuguguucacugacugaaugaaaaauaaauaaugcuuuuguguuaagagaacuuuuuacaguaugccaggggauccuacuggagucucuuuaaucuugaacaaugcuugcuucuuucagaggcaaauuaugcagaucgguacuuaguguucugaacuuuaucaagucuuuguugguaguauugugugugccugcagaacacaguuccuaccaucuugagcaggggagaaggcuacaagucagaccacugcugugaucagaaaaagacacugucuacugcuuugaacugcccagcaucaauagagcagccauucugacgagucucacaauuuggcacagggcuuuacuuuuaguuuaucuugcuuuggauaauuugcaaaguacacacagaggagcagauagccaagcuguugaguagaugacacauaaacaaagcuggagcugccgccacacugucagauggcagccacguuccucuaaacaccuuuugugcccaauaccauauuguaaaaacuuuccaaauucauccagaguacacauguagguguaaaacaauguccuuuaaauuucagccagugcauaaaaauuaacuugaaggaauccuuugauuccaacuaaaagaaagaaccagaaaaguuuaaaagcccguggggggaaauggcagucuuggaugaacugguauugcuucugcuuuaagguucaugcugccaucuaguggacaggggaaaggugugcagcuaacucacugagaauuuucauacucacuauacuucuugaauaggaaaaaacaacaacaccaaaaaacaaacaaacaaacaaaaaaccaaaaacaagucagugugaaggacuaaauugaagagguaggagugguggccacaccuuuaauccuucauuuuuggaggaaagacaagcauguuccugugggugaggccauccugguccacagugcaugucauaggccaaucagaagaaucgcuuuaccaaaucuugcaugaggugugauagaccaugccugugcagcucauacuuuuccccaucagacuuaauagugagauuugacaacgcagcuugcacaggaaagaggcagaccaugaggaagcagcugugguaacgagaaaccgugcccaguacggacucagggcugagcuugagcuugagaucuguauacucaguaugugaccagagauguguuaguuuucuucuacaaaggucguguucccaacuggcuaugggaacaguggugaucagugcaaauggcagggcccuuggaacaagaaagaaaauguguuugagagugguuggacaaaccacucaggguuggacaaacuccaucagugcuuguuaaacaagugagcagucuaaccauacuugaguugaucuuugugcuuuucaagugcccuagagcaccuuucugacuugcauuugucguacuagucaggacugugugggaagcugaacuaaccuuuccacacaucuccagacagauggacauguugucagugagagucuuuagugcuuccugggcagaggaaugugaggaccacugugcaggccuccagggcagcucgugaugaaucugaaaagagaaguguguauaaaagcuaagucagcauuuaccagcaugccacaugggaggugugcagagcaaagugaaaauccuccugaguuggccuuuacagaaaaccauacagagaagugaaagcucagcaaaucugucaguaggagcacaaaggcaagagucgaggucuaagugagcaguaaucacagaccacaggcaggccacugcuggcuagucaaucucuuccucucaggacacucgucccaaaggacugaaucacuaacacacacacacagcaaaauuucuggguuuucagaagcaaaguuuugaguuuacagcuucagaaacuccuugaagcuaugcucuguuguguggaaaauaguguccucgcucaguguccgucugucuauaugaaauguuuggugucuuuucaauuguagauuucucacauugggaagcugagagauuuucuccuggagcacaggaaggaguauauuaaugccuacagguaagcaggcucuuaugcccauggcauugguggcggcauugcuuucuguuggacaguccgcuccuuuuuuuguccucauuuuuuuuuacuaacucagacuuauaaugggaaaggucaguguccuuguuugcuuucuguggcugugauaacaccaugaccaaaaacaacuugugaaggaaaggcuuuauuucaucuuacacguccauaucaaggucugugaucaagggaagucaggacaacccuaagcaggauccuggagguaggaaaugaugcauaggcuacagagaaacacagcuuacuggcuuguuucuguccauccugcucucuuacacacccugggcuaccuaccagaggagacaccacaucagucauuaaugaagaaaaugcccuacagacuuuccuacagacagucugaugguggcaucuucucaguuaaaguucucuuuccaagugacuccaacuucugucacauugauaaacacucacuagcacuucaacuaggcacugggaggauaucugcagagugaagcagaacaccauggcgggcggguuuguaccaacacacuagucacauggcacuagccaacucuucuagucugugucuagucuagucucuggguuuucugcuuuggagcguucuugagaaccuauuuccagcccuuguucuugugucugucccugggucaugcucgcucuuucuuucuuucuuucuuucuuucuuucuuucuuucuuucuuucuuucuuucuuucuuucuucccuuucuccccuuucuccccuuucuuucccuuccuuccuuccuuccuuccuuccuuccuuccuuccuuccuuccucucucucucucucucucucucucucucucucucucucuuucuuucuuccaguucucuucuccuuuugacacuuagagacagaaacaaauguccuuggcuuggccuuuguuucuuauggcccaucucaugagugcuuuacucagccccucacacacuuaugguugcauuccuccugguggugaaguuucuagucaguaccauuugcuuacaucaccaucugaguagauccacugugaagauccacugcgcugcacugguacuggcucaccuucuccuuucaaaucaagccuccuagaucccuuuuaccguggugcuccagccuugccagccuuccuggaagacuccaggcucauccuugcugcugggcauggccagaugauaugcuucuauuuccacacaucccccuuuuagcuucgcuccucaacuuuuuauaccauauaguauaugggggcagagaagaguccagacaugcugaggcuuuaaacugugucuucccauauccuauuaguguuuauuucuccaucaugaaucuuuauaaccugaaucacaauauguaauaaucaauuaauagguuuuugucacauuguaaauuuugugagguuagagaccauaucaaccucucauuuauauuucuucuuuuucagauuuauuuauuuuauauauaugaguacacuguaacuguacauauuguuguaagccuucauaugguuauugggaauugaauuuaggaccucagcucacuccagcuggccuagcucacuucggcccaaagauuuauuauuauaaauaaguacacuguugcugucuuaagaaacaccagaagagggugucagauugcauuaugggugguugugagccaccaugugguugcugggauuugaacucaggaccuuuggaagagcagucagugcucuuauccacuuagccaaccuucauuuauguuucuaaauguuucagcuauguauugcacucaucauuucucagauaauacacaaguuuuccccucaugucccugaggcccuugacuaacuaccugggguuuuggcaacaucuuaagagauuuuguugcaacaauaggaagaauucuacuagcgccuggcggaugugggacaaaggcauaccaagcacccuucaguacacaacauagccuucuauaaccacagggcagcuggcaccaacccugaaaaggcugccucauccugacuuguugauuguccacacauaugaggaucugugagcaccugcccagggucuucugagauucuagaugcuuagagcacaucagggaguaagguagaaaucugucucuuucucaauaaagccugcaagcuagaggguuggcaaagacuuucuggugauaaaccaaggcagagcaagccauggggugggugugcuggggauauuacccauuuuuauguagugugguuagggcaggccccuugaggcauccuccuaguagacuccucugaagccuaaaaucccuggcaagaucauguccguccugccuguccucauuguccuuccuauccaucagcugcagagaacuugacagucccacuugugcccuguaccaccccccucuucccccauccccauccuguccccaaugcuucugaaaugcagcuacacacaagacucccagugguuuuaaugauuucacugucuccuuccuuuccacuuacauacuuaccugcuuccucccuaagccacaguuugaugucacugccaaacaucagaguccgcuuacucuggaaugagggcuaacaccucagacuuugugggccaugugugcuuucugucacauguauuauuuguguguuuugcuuauuaccuuugaaacacagaaaacauccuuagcuuccagaucacccgaaacuggaccugagggcuggcuccggcuguagcuugcugaccacuggcgcaugcccgucguccucaccauucacugugcuacaauccuccaagaagagcucuauugccucucucuucucucaggcuccauugccucucucuucucucaggcuuacucugacuugcucaucaucaaauccaguggcuucucucaaaccauguguaaauggaguaacacagagcacaccuuuccaguaaacaaaacacucauuuauucucauuucuuuuuuuauauucuauuaugcugaauuaucauaauuuuguuaucuauuugcauaagaaauagauguuuccaggagcugcugugacugagcacuucugaaguccuuauaaacauaaauguccauaaauagcuaggagagagaugucuaaguacuucacauggcagauguguguuuaaccuuaaaacaaacucccaagcccagggccuaacagcucagugggcaaaaguucugacuauggauuggaauauucaaaaucaccuaugaagcaguuuugcaaggugguucacacagccugccauaacagaguugccaguggucuacagccacaccaauaucugguauggacagucuuucauuacaaccauuauuaguaugaaauagcaucucaucuagcuuuaaauuagcuccuaaaaugucuuacacccuccaguucuucacagugggguuguccccagggcacuggauccuccaucauagagguuauggcauacuguuugcaugcuugugugugcuuacuagaaucaccuuagauggcggaugacauccagcauggggucagugcucaaaaaauacuuccugcuguagcauauaggaggacagagccaguguacugucagugaggacacagucgucuugcucuaaguuccgguacagucuguggaacugcccguuagaaugcacugcaaacgcauaggacuaacuguauuuucacuuccucugacuauuccaaaauuugcuucuuuauccuuaacuugcaccaaagaacuuugcaugguuuuuuuuuuuuuuuggucucuuuugucuuauuugugucuacuuugcauuugaaaaguaccacaaauauuauguuaaucugauuuucaucccugggacaaauacccaagaaagcaacuuaaccauagagauaauuuguuuuguuucuugauucaagguuucagaucagggucaguuugguuuauuacuauaggccugguaagguggaaagucaugauuugggccaaaguugcacaccucucagcagccaagaacugagagaaaugggauagcuaaccccuucaaaggcauaucuacugacaugcuccuccagacaggugccacuugccaguauagcuccucgaagcugcucguggacugacucaugacucaguaguagucagcugggcaccaggccuccaauagagacccuugagggccgcuucauagucaguucucuccccacgcucagcccucauuuguccaugugugaggcacacucugcuccuaaguacuaauguguauuuugucuccuuuaguccuugaauucccucuccccauuuuuacugagugccugccaugcaaggccaaagacagacauuaugcuccuugucacacaggcaggcagguaaauaggaggggcacuauaaaaaaaaaauggaguucagggauuuggaagacccuggucuuaugaaauguccuuugagaggugacauuugagcugagguguaaaggaggaaaggaguuaccuagugaccaaaagaagcuaaggaauugguuugcaugggccuguaccagcuggccccugggaauagugucuguccugcugugaaagaguagcugugcugagaggagccuccacucauacugaccccacagcugaagaggcacugugccaucuggaaagugaagaaagcuuuuggccagaacguucaaaauggcuucuggccuggagugucaucaucagcacacaggcgcaccguggugcagacauuuggaccugcccuggccacaguaugcuucacuguggaacucacuaaaucaucagaauuuggccaugacaucaccaggagccucuuucucaggcuggggcucugucucugaaacaagugucugcacuucaguacucuacuuaaaaaacaguccucuaugcaaaauggcaauaguuugcauacauuccucaacaaagaaacucacgucccaggugauauaagcagucccuaacacuguccccaaauuuaacaagcaauuuuaugcuuuuaaacgucuuucguuuugguguuuagaaauacccugagauuucauccugaugcaaagcacuguuugcaagucugcuguuaacuggcugugaucacuagguggcaguguaaauuuuauuucugaaggugugccccugucugaaucagguacuaauucaauagguugcucucacaacugaggcugcagucacaauuuuauagaccuuucaugaaagucuguuguccugccauugucacucacacaggcaugaugaucauuccugaggcccuccaggcuuccuagaugugcauggagcacugugauuguguugucagcugacuggacucugaaucaccuaggacauaagccucuggguagcuguggggaacuaucuggauuagguuaacugcuguggggacaugaagcuuagcuguaggcagggaccgggaacugagagccagcuuucacugcucucugcuuucugauuguggaugccaguguggucaucugcgucaggcuuuugcugccuucccuucccuuucauaauggaaccuugaacugagacuuuacucuugcguugcuuuugucacagcaacaggaaagaacugaagacaggcucccccauaaagcauccuaguacaagaagggcagggauguuuauaugcccagaguaagcugacuuuccagaaaaaaacuaaaacuauaaagagcauuguccugaggcuuggguguguugaauguaacugcaaauucgagaaaguguuggcuguuaaugcaagauuuugaaugaguaaaaagaagggaaagggaggagagguccaguuccaagcugguuuuguuaaaaagacaaugaaauccugagguuucauucacaucaaagcauaaaaaggcuucuugcuaauauuccuauugccuuggaaagugucuggccagcuagaugaugagugcuauggaaggugucuggcucaagccacccuuagcaacuguuaagagucuacaaaagccaucuuaucucgaaacuucagugucucacuccaggcuggguucugcccacugccuguuucuaaaaaggcuguuagcuaaggucaguuucagguguuuaaaugguuggagaugagauaaaagaaaauaacguuugccacauuugaagugaugugaaauuccaauuuuagugcugcugggagaauaguuccauuauaggggaguuagaaguugaucauggcagagggaggggcauagcaaguuuccaggguucccagaauuacacagcugacuggcaacucaguucagccaaccacaauggacagagcucaagacuauaggugagcugguuugugauauuaugguccuaagcuagacucagucagguuagugccacggaucauaguguucccagcuagcacaaccuggucccuuugcuaggagagaguggaauagagggauccucugaugucugugggcagccagucuagggaugagggugagaugggauugggacucgguacaugcccaguuccuuuggcuaaaguacccacucaucagggaaauuccuguuccucucucgggauggaggagggguaagccaggguucacucuggggaagcuaauacacagagaaaugccaggacaggggaauaggugucaccauacugugcuguccaugaagucccucaucagcucccaccaaguucuccuucccugagguuguagaccauugccagccuuucagcuuuacagccccccucccagugcaacgugcuagccuuggcccgcuucuaggaacauuuuauaagcaguguaaucacagaauugaaagaguauggguugaaauacugccuucagaccaugaggcuuuguuagguugacauaauuaggaagcuauaauuuuuuccagaauguagagcucagacuuuauugacccauuuaauuuuuuuaauaauggcauuuuacuagagcagaacagcaugcagccuaggcagccucuggcuggaucuuagaaugaccuuaauuaaaauaauuucucuacucuguaccuuuuucauaauacccuggcaacaaaacaaugccacuugggaaaacaacuuuguugguuucuucuguuguuacuaaaagaauaauaccacugucaguuuccaguauccaaggucaagagggucugcauaauguaucugagaacuccccuccucccugaguaaucaguauucucagauuagccuuuagaccuucacucuuacugagcugggcuccuuaacugggaauauggagcuagaggauucaguuaagucgguguuucugggaccaguguuguacagguccacccugguggcugguugcauauuccuucagaagccagcaccuuucuaacuugggaacgggaacgugugacccuuucacuucacuacucccagaagagccauucagacugcagaagaagggccauguaacagagcuugcucucucaucuccuggaaauaaggagucauuuauucagacaccugggaaagaacauuccagaaggagaaccaggacuuguaaguccauaugcagcauguaugggaagugaaggagcagaaggcugacgagccugagucaagggcugggguaguugagcccagagaguuccucaagaacagccuuguuuauccuaacagccuuuguucuuagaagccuuuggaaggcuuggcaggauccagaucugggagagcauccauguggcugguaugccagggcagaggagaagaggaugggcagaaacagcagacccuggagucagccucagcugcagacugggugggagauggugguggauagauucuggguaauguucugaagguaauaccuacaggauauguagacagaucugcauaaacuaagagaggcaaugggagcuagggaugaugucaggguuuggagucggagcagcaggaaggaauggaaucacuaccagccagccuggggaaagcugcuggagagaagucagggcuuccguuuuagacccaagcgcaauacaaguaagaugggagugggucauuagaugucucuguccaaguucagugacugucuccuuucacugacuuguagcacuugagagacuacccaucauuccuuaaaucuccucauguucuucagaaucuuaacugcauagugaagagccuuugcccuggucaguccuucagagcaccgugaugaugccaaggacccugucuugacagcauugcuucuuuucugcugacguugcuucccuaaaaucccagggcuuccuguguuccuuuuguguucugugucuucuugagcacacaggcccagaucucaggguuuaaauuuuaccuacuguaauagcuguucuguuccaggcaguucugcaucccugguucuuccuuuucaaacuuccugccaucaccuaaaccuugccauucuucucccuccuuuaugucugccucauuaaagcaggggccuuucuauguagcccgggcuagccuugagcucucaguccuccuaccuccccggucuuggguuccagagggugcucugccauacccagcagcuccuuucugcaauuuaagaucuacaaaauuuuaucaacccucugcccuuuauaagugcuagaaacagagaggugagagaggcugggcaugcagcuagcucagugguaaacacuugcuugucgugcaugacgcccugccuggguucagucccagcauuaacuguggggagaggugguaacaaacaaucaaacaaaugauacagacaaaugaauguggagaugaauaaggcaggcuucuuagcucaaggucaguagccccaggcccgaguuucuaccaccguuccaugugacaugccaccucaucuccccuuuaugacacuuagccuuuccauuggcugcagagucccugaucagcucugguagucacuaagggcagcauuccuacuguccugugcuccagccaguuugaagucuucaccuuucucuucuccuuccacuguuaccugcuuccauuguuauucuugcugccuucagccaugccuuccucucaagaaucaguuuguagauuccuccguccccauccacaauacacacgcaugcacacacauguacacaccuuagucuaaacucucuagccucacuggccauggugacacacaccuauaaccccagcacuugagaggucaaccaggagguucagaauuccaaggcugucuucagcuaccuagugagauugaagcaaaguugacauacaugagagagaccugauuccaaaaauuaaaaaacaaaaaaguguucuagagauuaaugaagucugagacuccagagcaggcagccuugcucagaccccaucucugcuaaugacuggcuaugugaccuuggcaaguuagagagccacucugugccucaguugcuucauuuguaaaaugggaauaaaauagcaccuaccuggaagccgccuagauuagaacaguggacagugucagugcguggaaaguauugcuaaccauuacauuagccugugcugagugauagaacacaucuauaugcacaggccugucauugucuccugcuugggaguuuauuggaagcuggaucuauauucagcuccuguguguagucugggcguuaacaauuuaauuucauaguguauauucaccaugcauauuauaugcccaguauaugcucuaaaacugcugugaaucuaacauuccuagcaaaaccaagguuauagucuuuaacuuuccacauccuucagcacaugacacaguaaagcauuugcugguuuuugcuucuucuucacccucaguuuguggcugcuucuauauaaaacuauagucaagacaagguaagugauguuuugacccugaacuagcuauuucuuaaugaaccaggcaaccaagucagaaggagaaacauauuccuuuaaauuucugagccaguaaauaacuguuuuuuucacuuucucccuuucuccugaaguaaauugaccaguuuaaacuuauaccucauguagucuccucuaacugaaucuacuauuuagauguagugacaucccauaacacaauuauuucuuuacauagucaaggaacuaauacuugauguuuauauaugcagaucccaugagaauaguuuggaauuauuuacaaaauguuuaaucuuuucagaauaguagugauguuguuacuguaacgugaguuguggccuugauaacuuaagccugcucuguuucagauguacacuguguaucucaugcucuuaaaacacaguggagcaacaggguggggaacccucuuguaagcacuccagcucccuacauguaaggcccuaacuuuggccuggcagcauuggcucaguagcaucaucuccuucccuccagccugggccuucuauccugggugagaugucuguuuguacaucauaccugcgucccagauguuuccauugccuccauacccagacagucuguauugccugucaaaaccucucacaucugucaccuucaaccuccccccccaccuuccccuggacauugucuguaccugaccuuucuaauucucuuagacaauggcaguggucuccccgcugugauuagaauaccuaagguuaggauucuuaagucuugaggcaugcugcuguggagaaaccaugaaaagcacaaauggcucugcuuauaauccuucaggggucauccugcugguagagccagcacugggaguggaggguggagugucuguguuugaguuuuaaguaagugccuacuguaacacuaucuuaggagcaaugguggaccaugugccaggcacaucaguguggagacacagugagugcaugccaugugcugcccucccuagggugccugguugacauaggaccaaccuugcuguuccuuuccuuauuucacucgcaugugcccagguguggaguagauguuauguguucauucauaccaucacccacagggugggggauuguaucuggccucugucuccauccucugucaggacaugccuuauauucugccuguccucaucccacacaagcugaccaugcuucacuuugagcccuauuguccacuucugcuucuuugcugaucucuccuauagcugaaugccuuuuguggagaucagaaacaagccuugcucgguuuugaaccccagccuaguacuuaucguaagagggaaugagugacuugugaggguuacagaaaggaaucaggaacacauaaagcccugagcauuggccuggcauauguacaggguuagucaggcacucgacucugcuacaugcuuuuacacaggcacacacuccuuacuuccauaaagcuucagaggagaaaaacggacuuuuuguuguuauuugggggaacaauaagugcaguggagaaaagcaaagcagggucagaagcagaagcagcacagcagaggggaggaucagaaguggucccagcucuguuccaaagcagagaaauggggcagcuuuggagugaagugcaggcacaauagucuccugaccagcacagcaugaaaagguaauguugacugaguaccauggaggccauuguuucuggagugaagucagagucacuuaccauaacagaguggaaacccugugacgugggucacaaguggaaaugggaugguuaggacuuugucuucuguccucauggcuagaugacuagguaagugaagauggggugguuugucucugcauuacccaagugccccugcaggcugcagcaugugagccugcaguucagcuguaacguacagaguguugaacuaggcugaggggugucacugccacugauuacgcuacacucccucccgcucucuugcaggggagccaggugcucuguacuguacuacauagugcuguguuacugaaaagggaugcccuucccagccugggcacugcaggagguuuaacuuaacaucggggacauagaguuuguuucugcaggcuuuuuauugugaaguuugaaaacugcuuuccuguguuaaaaacaaacaaacaaacaaacaaaaaacagcgcacacaaguuucucauguuucaagaucauguagggugaguggcuugcccugcaauggagugauguacuccucagucagagccucuguuccuagcaaagcugugcacugcuccugcuucuguggaagugaugucgaagacuguaccucauggccuucugcuccacucuccaaaccauucucacaccuguuggucuggccacuccucuccaagccuuagcauuaaugucacuuguucagggaaaccuuucuucuugacaguuacccaggcugcaguauguucucacugacaccacucucaugcuuucuuccucuuuuuuagccacaccaugucugacuaugggaggaugacagacacagagcgagaccagauagaccaggaugcucagauauucauaaggaccuguucagaagcaauccaucaacucagaacagaaggugaagugcucuaaaagaugccaacagaucccaugacugugccaaccaguucaacaacucauugugcagccacguagcauuccuucuuucuuuccgaaugacauuuaagacuuaaaauuuuauaauccuucugagauaaggugaucaaagcccaaaaaagaucaucacucaaguuuuaaaaaauggaaggcaggaaugggaaggacuuuucuaaauagaauccauaaccuaccaaagcccaaggucagagggaccagauugugucuaugaagacaugcauguauggcuauguucugaguggcaggauggaugcauguggcuaaggguggaacgguauucccugagaucuaccuguccuguuaaagucagcuuccauacaagacaucacgguuaagagaaggcuccgcagcuauuacuuaaaagcuaugcacuggagcucugccacaugcuagcucugugaccucgggcaaaucauuucaucucccugggcucaacuuuuacaacaaaacaguacagaugauaauuaggcauaucucuuaagguucacucaaauucuuacagugugcuuagaacugugccugacacuaggaaccugguauuauucccaccccaccccccuucauuggguuucauccuuguugaggagcuagauggguuuccagucuuaugucuuccuugauucauaagcauauacauuaauacuacagaggucaaaguugacaggugcuguugggcccauggcagagacuucugcuggagaaacuucugaaagaacacuaucagccaccagggaagucugcuugucagaaaaauaugcaacauacaaaauucaguuuucuguguccagcauugcaaagccccuagaucauuaugugaguagucccagguuauaguccucugguaaaaacauaaccuguaccccauacucuuaaggacauuaguuaggcauuuaugugacuuuagacuacauacugccucugaaccccaguggucaccugagguagcucugugauguccuaucaucaugcccgcacccggggcacccagccccuccaccaacagcgguaucuuacuauaggagcugccacagccuucugggugguagcgcguccuuguagcucaucaaugggaaagguucucagagagcagcauaguauggauagugccacucagugucuacggggagaaagcagccacuguaagcugaaaagcaacucaggcggaaggcgucuggguuucuagcacgugugauuuaagcaugucacuugaaggugagccugggcauuggaugcuguuaauacagccaggucagcauuccggaaggcgcuggaucagcucugcucccccggggcuguaauaagcuauaaauuauuugacugcaguuucuauggguuuaaucucucaccuggugaacccaauaaaucuuacucuuaaaaauguagucucacuugacaugaggcuguuuuauagcugugcuuuugaacaugcuuucacugaagcgcucuggggaagcugacuguucugucggguccuugagcacagaccugagugcuguccuuuucucuuacagcccacaaggagauacauucccagcaagugaaggaacacaggacugccguuuuggauuucguugacgauuacuuaaaaaguauuucauuuucuucuaaaggucaaaugugguauuucauaagagaugcaauuuagaauggagcuuugcuagcugaagaccauagugucucauuaguuuuaaugauaccuuugccuacgaagccauuuuaaauggucucuguucuucuuuuuuuuuuuuuuuuuuuuuuuuucugcuucgacaggaguguguaagcuuuacucugaacaaagagccauccgagugaagcgcgugguggacaagaaaagacugugaguauugcugccuuugcucuuccucagcaauggcaaccagagcucguaaagcuccagcccuauuggcugcucugugccguucucacccgugcugccauacacugaggagcacgagugagcugagcauacacugucuacuagguggugcuagucaacucuguuagcccacagcagcccaugagcagguccucucuuucauuuucugaggaugcugagguucagcggguuagcaagccccauagucucauggcagcugaaccgguauugagccuucaccaauuccucuuucuuuuuuuguugggaguaguaaggagacaaucugguucuauaguccacacuggcuuuaaacugccauugaacccauuguuucugugcuuccacauucagagugcagggguuacaggugugugccaucuacccagcuucccacccuguuccuuaauaucccuaugaagugggacacuuggcgcuguuugaccuuggucucugcccccauaacuccaucuuugaaaguuuuuccaaaaaaaggguuuucacagugaccagugcuccccuguaugacaguaugacagaauguauucaggauucuguguguauugaacccaccccucccucuacuccaaaacccuuuuuggcaugguuggcggccaguuugccaaggcaggacccaggggagcaggccugacucuggugauguaugucugucaucugucaguaugguaaggugaccagucacuggcugucacaguccccagggaggagaggcaugucugccgagcuguugcagguagagacaaaaggaggcugaggcucauucggccuuagucuugcuuuuaaggagaaguuuccucugaaguccacacugaugucagucagaugagaaauguacagcauuacccuaagcagaagaccuugggggagcagcccucugcucuuuagcuuuuugaggcagucucuguacuucucagguaggcccugaacucaggucauaccaccucagccucccagauguggguacuggcauuucucaccacucugacuucuuucuuguucuuuucucaucuuuagacacaagacaucugcuuaaaacauacauguaguuguaauuuuaugcccccuugugcccaggucucauaaaggugaaauauggcagauugaaggcuauaguguuucuaucauagcuuuuguuucugaaucagcccccagcuccucugcucugcaagccuugugcgacuuuguucuaaaggggcuuugcuuuuccuuccugugaacacaauucugucauccuucuagccccaacucaaaugucaccuguccccuguaguguuccagcugcugccaggaguauugugccucccuucuuaguaggcucccauuuuguuguuuacagucagguacaacacacacacauacacacacacacacacacacacacacacacacacacacacacacggcagcggggcucagccaccguuguguuucagcucauggcaccaucccaguccuuugaggaggccaaugagcagaguguucgccauugucacgaggugguucucacuacuguucuguuuggguugcuaaugacugucguuaagaaguugauuaaggagucuagcugcucauauucuguagucucauuuguauggugaaggaaaacauaccugucgagguacagcuugauugcccacuguaaugucuuaagagugcagaugauauuaugugguagcuuuuguucucacagaguagagaucuuucuaucauaccaaagggcucuuauuucacauugcugaaaguacuuugcucauuaagccagaaguauucccagcagaccacucugcacuucucuacagugacuauauugucuguaagugauagcacuguuauuagagguaccuguuuucaucuacccugauggcauuugucauucugagcugacaaugguaccuguuccauguugccucuagcuagagagggauaacuacccuugauaaucccaccuccccacuuuuuuuccugcaagaauauaaauuuuuuggagguggagaccacucuuuuuugucaaugcauugaucagagccugcuacaaaguccauucucagccauugguaccugagugaaggagacauccaaaggggcauggcugcucacuccuggcucauugauuuuacagaguaaaagcuaugugcaacaauauuggauguagcauuggcacaaguggcuccgucauccauccccagugaguuuuaaauccaccucuuuuccucuugaucuccuuaaaucucugguauuuugggugauugaagcugaaauggccaucucaugcuuugguggcaugcacucucaugaaacaucugagcuaucagaaccauguucucuccagaaaaacagcuuguguaucaugagaaucaggacuaggcugagacccuugucugcuggugcagaggugccuuucauauguccagugaaugucaggugcuguuugugcuuuccagcugaccuggcucugagguuugcaggguccaggccauuuagucaaacccuucacuuuucugggacaguguuuguaugagcagaaacuuuuaggggcauucucugucucaagggagaucuaagaauggaagcuauuuguugaagguuguagcuucuucaaauacugagcccauuacaaaacaaggucaagagugaauaacuccguagacccugcuuaaauucauaacucuagcaugaagcuaugguauuaacaugucucaccaccacaguugcugaagaugacuuucuaagguauucagaagacguguugguggcccaaguacagcuuacuuggacaguguagucuauuguuggacuggagggaugcucuuuuuccagauuucuguuuacaugggcugugugcccugaugaugccuucguacagggagcagcaggcccuuccucaguccagaccaacacacaccaaaaagcacugccaugaucugcagccacacaggccccucacauccucuguauguguugccugcugucaguacagaggaggaagaucaggcuaccuuucuuaccuuuuauagaagauagcaggucucaugugaugcaccucuucauguacugaccucagauuuaaagagugucauguaugacuccacccucucuccucagcaggauugucagccuguugccagccccugccuuagauccugcacauaguaagaguucuggggaugcugccaguguuuggaaugcugguggugaccgaaagggagaugaggaaaggcagagacgcuaugugauacgaggaccacaguggugauuuugccucaucuacugucuacgauggggaccguguuuguugccaaggagaaguuguggacuggccuaugggccaagucuagacuuuaaacuauuuuuguauggccuuucaacuaagcaugguuuauuguauuuuaagagcucuguaaaccaaacaagaaggaugugaguuagagccuaaaauauucaccaucugucuuuucacugugcuaacccuggcuuagaccaaccccccuaaugugaagggccacauuuuuguagucuuugcaguccaccagggacugauguauagucuccuguucaugacacagucacagcugugucccagguggccugucacaguagucaaaugacacgaagcuacucuauaccauguucagugagacaaaggcacugucggaguucugugcaugcuugcuccguguuuuguacuuagcccuguggcagaccagcaguaagcaucgugaaaacuggcacuaaucuguggaccacacuuuaggaacacuuacuuaauaaagaaauucccuaguaugugguagauacccaauaaauaccugucaggugaguguggaggugcguuagguagaguggacugacucuacccuccccgucacacagaggucucugucacucaggugccacuuuggacuagggcacugggauguuuguagcgaguucucugcccucuguguugguuuguaaaagacagcagcccuucugggugauuuuuauguuugcuuucauacuuuuuuuuuuuuuuuuuuugcuucaaaaccaauaaaaucuaucuguuucuuuuuuguucuuuuacaauuucaaauauaauuccaagacuuuucaaagccagggaccuguguugaucacagcuagauaauauauggccuuuaguuugaaaaguacacugaagugaaucaggggaauaaacggaucucuguggugacuuuuuuuuaaaauugcucccccucccagguugccauuagcuagcuaguuuguaauuucccugaggauuucaguagacauucuggguauaauuagaaucuguuuuuaucaccuucaaaaaguguucaauuuugucucugucugcuucucugcagcccuuuauuuauuuuacauugaaaacuggcacugcuagacuccagggugaugggcauuaaaugaaacguucagucaagagacagugcagcccauccccuuccugaaccaagcaguugugaaaccaggagauguguagggguaaaggugagugucugugguggugaggagcccugcugcccaggguaggguaucagggagggcaugcagucagagagacagugagaggccugcaaagaugaguauauccucuccaggaggaggagugcuacuagaacugagcugauacagaaaguguagaaagccagcuuucucauuguauugaaaagagaaaaggccaggaugcuuagaccuuguaauagggguuagaauaguuacaguucccacaguucagucuggaagucaguguggugugugucugugugaccaugcacaauguggguuuucuagaucuguccacugggaaggccuguuagcaauaauaccauaguagcaacacauacaugcacaagcacgugcgcgcgcacacacacacacacacacacacacacguguugguuucaaaguaccacuucuaguuugagggaccaggcuuucuggagaaauagccuauucuuaggcuggauuaaggaaacugaaaugagccaaggacauuucuguacuguaucaggaaacaagggaaggauugcagaauggcaggcugugucugaagagaacagcagcugcucugaagggguuucuacuggccucauugaagacagcuggagugaaagccagaggagggaagcaggcuguagccuagugaguggugauagcugcuacuguuguuuaaucuuugcaacaaagucugagugguaggagugaggcucuuaggacccagguugcucacugucccaaaagcugaaggaagaaaagccagaaugggcccuggguuggggauuggggugaaaaacaucgaaaguagcuuuaucgauaaggaaccagguggagcuggguccuaggcacuuccuauugggugaucucauuucaucuuuauaaguaccuuaaagacagaguuuuccccauuuucuagaugcugagaaugaaauauauccacagucacugcacacagcaaguaaggugcagucuagaaucaaacccaugguuguauccacaccucauuaucgaaugucuuuuucaugguggcuacucagcucgugacuucaggacccagacucuuaaaguaggauuugugguauguguuucagauugccauguccagcgauccauggagucagcgucugcuuagcaauuaguaaaacuaauuugacacaaaauguuaagcaguauuucauuuuauaauuauacuaauacacguaauguuuaaaaggucucuuuugaguugguuuuacaguacugagaucaaacccagggccauaggcacucagugagcacugugcccugagcccuucuuccugcccuuagucguuuuuauguggcccuuccucuuucuaaacaugucuuacaaacuuaacugugcucagugguugugguuugcccucugcugcugaggacguugcccugugugcacacaccauugcuuucccuacugcguuggucuauguggguugucccgaguguuuucuguagagaaaggcugcugugacugcuggcaguuccauguggacauagcuuucccuuucucucugggaagcaccucaaaguggguuugcuucguuacagugaagacacucuuggauucagugagaaauggugccaagcuuucgguggcagcagcuuugacaucccacccagcucugccagguugugguucauucucaucucccaggauuugguguggaucaaacauacuuuaacucugccugugggcaugcaggaccaccucacuguggcuuugcuuugcguuaaucaccuguucaugugugcuuagaggugauuucuauauuuucuucagaauauucaagucuuucccacacuuuguuuuucagucauuugcuguuugcuaauuuguguaggaguuccuucugugcccugacacagguccuuuguaagguuucugcugcugacaauugucuccuuccuugugcauugucuagucaggcucuggagugcauuaauaagcaucuguucuauauaaauauccacucguucugucaauguugguuaaagagacuuucuucauggaauugacaaaacauggacucuggagcugggacccugaugucuuguuucagccuagcuaccaugugaccucaguuaccuucuuuauagaaaaggucauugaauacuaguaccuuuuagaaagagguuuaaagcugaguaaguuugucuacauuuacccucaauaagaugcuuaaagaagaacguaguacauccuaggugcucggcaaacacuaagugguguguaagccagguccaggcagugggcauugacuuuaugcuuuuacucacaggccacuuggccuauagguggagacuaucagagaucuuuucagcaccugccuauaauuuguauauuuucauauaaguuuggguaaagcuguuaugaugucuguuguuuuauuuuggugauugagugauuuuuuuugaggagggcugcacacuguaacccagguugacauauaacuccuaccuacaauccuccugcauccguuugcugaguguuuggacuauagucaugcggugcuuugcuuggcucuagagcaccuuauuuuauaaucaauuuucuccucuguuagcguuuuacucauauuuauaaaguauucauucaacauguguuuauugaacuguguuaguuagauucccaucucucuaacaaaauucccaugacagucaacuuaaaaggaggacagucgugguggugccugccauuaaucuagcacucagauggcaggaacaggcaggucucuugaguucaaggcuacccuagucccauagcaaguucuaggcuagccaggauuacccuggcuccagaaaauaaacuaaaauaaaaaauagaagucagaaggggaaggucuguuggggucaaaguuucagaaguuucugcuuauacuuugcuuggcccuggugauacaguacauuacaaacgaagccuguuuuccucauggcaacacaguuggagaacaaagagaagggaaggaccaagguccccauggccauuucaagggccuuucuuacacuagcccuaccacaaagguucacucauugaagccauacacucaguaaaugcauggucccuuuaggggccucuuugcagaucucagcuagcacugcaugcagacacuaaucuggcugagcagcacacaacucacacagacagaccuacuccaaagaggaacaagugcaugcagaggaacaggggagugcuuguuguguaugcuggggccuggacagauggcuuggggguaaagugcuugcugugcaaguguaaggacagaguucaguuaccuaacucucauguauggccugggcaugcugguacucacucaccuguaaucucagcacugggguucacuggccagccaggaaacagugaacgcaaauaauaaauggaagucagguauggcggcacacaccuuuaaucccaggacucagggagcaggggcaagcagaucaacaaagugaguccaagacagccagagcaacauaaugaaaacaaacuaacaacaauaaaaauaaggcagggaauucuaagggaaauuuccuaacauuaaucucuggccucuagacaugaacauaugggugacuaaaccugugugcaacacacacgcacagaggaacggggcauggcagcaagaugguugaguagauaaaagcacuuucugcaucagccuaagaguuugauccucagaauccauguuuuauaaaaggaaaagaaaaagaagauucuguagcacacauguguggucucaguucuccuacagugagaugggaggugugguucagugcuccuacugugagaugggagguguggucucagugcuccugcagugagaugggugguauggucucagugcuccugcugugagaugggagguguggucucagugcuccugcugugagaugggagggggagacaggaaaccaccuggaaguucccagagaaaugagagggaccuaccucagcaaaguagaaagagaagacauauagacaaagguugucuucugagcuccguaccugcacugcaugccugcaggcacacaugugcaccuacuagugauaaaaaagaaguaauacuuaaguucacauuuuuaaaacuugaagaaagcuugugaagaucucuuaaguagcagacaugacuguguacccuauggugggaaaggagaccacauugugggcagagguguauaggaagaggugagaaggaagcuuaacacagagcuuccuggcucaacuggcuguuaaagacuuguacuuucauaguuaaacuauuucaagauacugcacguguucacguacgugcagcacguguguaugugagugucuuuggcaguauuuuugaauuaguauagaaguacugcuuacuguacacccacuuccugguauguuguccuuuuccagggcaaccucgguguaugcagauacuaagcacugggcuguggcucgaaugcagaaggccauguacugucaacaugguaccuucccacgaagcugggauguguccgugugacucuuagaacccaguagaggggccagagcaaaagugcacaagucacacgugacccucucuguugucagaaagggauccuguuugggaaguaaaauaaauaacuuccaagucuugucuuuagaucuaagcuggaaccugagccacauaccaagaggaaagacuccacaucugagaaagccccucagaacgcuucccaggacucugaaggaaagccugcugcugaggagcugccagguaugacucaggauaaaagucuugcguugcgcgucuuccuucugaccuguccgcaggaauacgaagcagagaggcagcagcgguuccugacccgggguggugagcauagacgccuaaagcagaagcagcugagaggcagcagugcucagucugagggccacacauucacguggacucugaagaagggcugcuguccuguguuccugcuggguggagaccgaggaggcgccauugagccuuccugcuaaagacagguguaagccuccacaauggaagucugcacugguggcaggcagcuacacuaccccagcauggagcgugcuuucucaggggucuccacagccaggcagcuccugggauaagaugcaaggauggauuuguauugcuugucaucacagacagugauguuccugacaauccaugccaaagaaaugccuagucugcaucaaaucagaaugucacggacugcuucauuauguguacaguccaugcaccucuggcuagggaugcacugcaucccugcauacgguguagcaagcaagcagguuucguguggcaccgcucacugccuagcagcucacugaagcugugaggccugccugaauguuuucucugcugugucugaccacuggagggucauagccucuuuucuuuagaagacccagaaaggcucagagcccaggcuacuuuuccagggugaaagcucuuaaauacucucugguccaagacucacugguguguggccuggcucucaagcccaccucucucucaugauucccugcauuucauacguguuccacaugcacgcaucauggcucaccacccuggaggaugccagaggcccccugugcagugggaacagcacuuuuggagccuuucauuguuccacacauccugacugagugacaggccugacuugcauuggaucuuugggggugugugcuuuugugaguauuuuaauaggcgaggaagcuaagagucagagaaguuauauaacagcucaaaguccagcacugaagaagcacagcagccuuccaugugggugguucuguuugcacagccucagccuauuccuggcucagagcugcugaggugcaguaugcaggggcucuguuuacuucugugccugcccagggcuuucccacagucccaugggcacagcuccccagaggacaagaugggcauccuaacuccauuuacugaagcuggaugcagcagccacagucagucuuucaccuacucaggcuggugacagcaggaaaagccagugcugccugagggccuagagacagugcaucucauggaaagauacccaauuauacugcugaccucaaaccuacacugcauguggugccaggccuuggaacuucauaguuaguggaaauggcucuucuuugggcucauagggaaacaagugagggagguccauaugccagcgcccuuccacuguggugccugugaaggugaggagaguggugguguuccuaugcucagccuuggacuccacaugaucagaaaguugucuucugacugguugagcugugagcaguugugagcagcguacaggaaacagagcacauguggacaagagccccugggcccuacgcucauggugcucacugagcaucacuguggcuguuaaacaugggagcacggagaucagcacuagucauggggcuugcauucaaaggagaccaagagaaugcaaagacagcccacagaaucugaugaugcacuuccauccacauggguggacacacaggcuuuucaacugaaagcuaaaaacacacccagcuggaaauggcaaaggaucugaauggugguuucuuuauuaauugaaaaaaauucuaauacaguauauucugaucaugucuccccuccucugacuccucuaagcuccugcucaccuacccaacaccacauccuuccucucugugugucuuuagaaaacaaacaaacaaacaaacaaacaaaccaaaguugauuguuaaaaguuaagaaaacacacacaaucaaaugcaaaaucccuaaaaccagaggggauggcaguuucuuaagaacaucugugugacaaauaagcauccuaaagggccuagcaucaccagugaccaggggccucagaggggccagugugggaaaggccacaugcacggcgcuggggaggcgcuggggaggcauccucaugaaguuugcagcugaauucaaguuugccuuuggagcucagcaugguaggacuccacugggcauuccaaagcuggagugggccaugguauggaugauauccaaaaagcucugacacugccaagagguggcauggaagcugacaggcuggacaguaaucucuugccacaacccagacacaagaccccugccacuggggaccgccuccaacccccauggagugacgaguguucccgucacauuuuggacucugcagccauuugggugugugggaugggagcuugguaaaacuuacagccuugaggcugaagagcugguggaaggcauugcugccugaggugagugcagcuccauguacacucugacagcaaggugggggaagcgaguccacauaccuaaauguguugggccuuuggggccugccugcuggguguucagguggaaacaggguauugauggggugagcagggagacuuaggacuaggagcucgggggaucuugggaaauaggcaguguggugcccuagccugggugcaccucugaaggaaguggagaggaggggagaagcaggccagacaggccagggaaagaccugcacccagcuuucaugugcugucuguuuccuggcuaugcucuuuuuuguaccucaggcuugauccugacagggaaaauccuccccuacagccagcucuccuucacauggcugugucugcccuuuccagcgugccaguagaaaguguuucuuccuguguguggacaucugcuaaguaugcugcgagugacaguuuucaagcccagccuguggggaugugucuuuuacuuagccuuucaguauuuauuuccuuuugaaaccugaguugucacucacaugagcauguucugguaccaaaaaagaugguauggaucuaggcaagggaugaucuacugucugucauacucccucugccacuuggcacuugucauuuagucagcaaguucacacuucugcuccugguuggccuaccuccuccagcauuaaggccuuuuccuuaaaccuucugccuggcaaggcugcauucuucaugucuguggucaauuguuuucccaucuugguuucuggguauucagauguguuucucuagugagucaugguugcugccccugaggagcucgauguugccggggaagauaggguuuuagcuccuacacgaaaguagcguccugggaaaaacaaaaguggggacagaguucagcagaguguccugggaccucaggaagagguagcccugagcaacguagacagcaacuaagaaagaagcuuagacagccauaggcagaagagauagaacaagaacacugaagggcagagugauggaggccucguggguguagucacugagcccuugagugauggaggcccucguggguguagucacugagcccuugagugauggaggcccucguggauguagucacugagcccuugagugauggaggcccucguggauguagucacugagcccuugagugauggaggcccucguggguguagucacugagcccuugagugauggaggcccacguggauguagucacugagcccuugagugauggaggcccucguggguguagucacugagcccuugagugauggaggcccucguggguguagucacugagcccuuaggguuagugaguagcacaagauauaagaaauaagguugcagaggcuggcugcagcaagacuacagaaggccugggaugcagguagggcaucaggaucugacugguuggcucaguaugcugugagcacuguguuuuaggcgaguccugaggcccagaucagaagggcuucaggugacacacagucgaaccaccuggagagcacagaacuucuccaugcugauguagcuaauucaugcuuggaucugcuauggugggcuuuauguuucugauuuuguguuuguauucaaaggagaagggaagagaagucugaaaugaggaccauacugaagccaaguaggggucugacgucauaggggugugagugugauggguucacaccuagagaguuacucagaacagugccacucugccugagcaugcucugagaucucgauguuuucucuugucuguagcuccggcucaccugcacugagguauagaucacuguugauaaagauguguuucuaauaguagccaugacuuugaugcagaaugggccuagucuaccuccucuccacucugcugugcugaugugcuuucccggccaaaaccccuugaacucugaccaccccacagggcuaagcuuaauaggaaauugauugaggcuaaggaaaagaaaaggauguagcauuugccuuugagacccuggcaaaacagugauggagcccagggacacuacuacacacagaaaccuagaauccccuuugggaucaggcuuguaauaguccccacugagcagccuuuaccuucccccagacagcccuccuuccauguaccucccccuagacagcccuccuuccauguagacuaugcccaucauccugggcagaaguucuuucaaggcaccugugcuauugaagaggcauugugugcuugucuugucaugaacagauuuucuagauuaaaauguucauguuuuagucuauagcuauccuagaaaaagacuuaguaguacauggaugggucauggagcugcugcugcugcacacuagcuaacucuccaguauggaccacacugcagaauucuacuccuuuugaugucuucauaugccugcuucuucagcugccuguucugacuaaauaguggcuuccuauuuuuguccacuuuacuguuuccuuucuuaacagaaaagccuuuggcugaaucacagcccgaacugggaaccuggggcgauggcaagggugaagaugagcugucuccagaagagauacagaugguaauccuaacugcuucccuuuaacugccuguccuaagacuuugaauaagugggagguugugcaaauguccuuuuccuaauuugauacugagcuuuaaaaguauaaacacauuuuagauacacuuacccacuuaauauccuacuuccuguuaggcuuuucaugaugucaauucacgguagcauaauuucaacagaaguuagcuuggauggucuugcuaagcgucuucaccagcaggaugcuaggcauccauuuuaaaugugucucuuauguuugcaaagauggugcauauacucaguugagucucuggagucauagaaauagaaagaaacauggugauggcugaaggaugacaggaacaaccaucaggacaaugaugaccuccuggugaccugucccuugugcuaagugcuauuauuugucuuuucugagugguuuccggggacaaaguuuuggugauagcuucccaaacggcagccuccuggcugugcagcauugacgaugagcauuuuaggcucgucucccuggaugaucuucaguccugcaguauuugucaucuccuccuguccuuggcaaagagccagcaagccccugcugauaagaguggagcuggguucccagccucuggagacuggaggaucugcggugaacagaagcccuccugucuaguaagaaugggcucuggccuuggccuagccuucucccuuucagaaagcuguuugugccgcuggcuauuucccuggaaagggcucuucucgccacuccuaucugacuccuaucaugucuccagugugaccucuuguauucuguacccucuacuaugcuaggaccaugugagcagaaucgcugcucaccaucauugcccuagccucaggucagugauugcggauggcugcuaaauaggucagugacugaugaguguaguguaaaugcuugagguucuugucaaugguauggaaggccuguucacaugccugcuuccucagaguuagcugugcagcccaggugacaugcucagagucucuuacucaacuuccuuuuucaccuugcuugaaacaaauggcugaaacagaaagcaauuagcauaaacaggugaaaacauuugggaagcuuaaggagcugcuaccucaaggccaaggaaagggcucuggacucagcccacaucugccuucaucuggaaccucuguguacucuuacugcucucaagggcaauaaggaugccaccuagggcugaugauggagagcuaucccuugaaggacagaugugagaggaccagagacuucagagguuucuaacugggacagucaggaaaagggcaagcauggaucugggaauuggggcacagggagcaggaguugauaauuccauuuuagacaucuuggaagugcugugaacaugauggaagauauagacugccauagggcauccucuagaaacacuguagacagggaggagacagggccaugaguguuaccuggaaaugcuacauuagaggcagaaaauaacaaaugaguuucaauacagcuggauuguauucucucugacaacuaauaaugacaggagugugcuaaaaucaugcuauuugucaccacuggcacuguggaagguaggccuaaggaagcagacagcaaggugucugccaucccauggcauaguccuucugagauggcagagaaccagagcugggggaccaggcagucagcugugaguccuccucucacuacuuguccauguaagucgggaagcaaacgagccucgguggacaucaagcucaucagaguggaugcccugcagagcuauggagagucaugauugagagagagccacucaacacagccugccacacagcugaagacaaguaucaggaugaguuccucucccaagucuguggugucaucuuucauguccugcugucccaaccagaccauucaccaaaaggcugguggugaagccugcaguguuggugccauauaaccagugucugcagugcuuccuaguuuuuguucuguugcugcaggugggugggacagaaggaugucucaaacuuuuuauaacagucuacuuaauguucaccuaaugacguucuuguuggggaguaauugcugagagucauauuguaaagucugacuagcccaauucaaaggcccaauccuaaaaaugauaggcaggaauacuauauuauugguuuuaugaugaaaguaguuuagcaaauugugguuauaauucauaaugaguuuuggaacuuucccuuaggaugaaauuaagcccuauacuggcgauuuaguucauucuuuuaaacaaagaagcuguuucuagguggugcagaauggcuacgggauguuguuugcaugugcaaucgcuguccagguguaagucaugguacagguggaugggaccuuaagucggcagagguuuuuggcaggcuccgugaagcccaguuguuuccuaaugucagacgucaagauugcuguccuuuagaacccacauuacucuuaugugccccauucauuuacucaagcagagucaccuuuauuuauugauguguucauugagguaacuuugaagacacuacuauggccuuucuuaagccuguauacagugagucuguagcagguguccccagagguagcucauggcacccaggcagccagcuggcacgcuuucauccugaggcccagcacaauucauauaucaagaacuuagguguugggagagucugaguccucacuuuucuucucuggacaacuugaaauaggaacacuucauccugccuuauuuuuuacugaaaggccuugacaauagugucuuucuuuguaaaacuuagcaaagagggguaaauugaaaacaggauuucuauagaaagauauuacuaauggacuugugucuuuuaaacuagaagcccuuuuuagacuagaagcccuucacagagggaaagucuaguugaccacuaagaggcagauaguaaagggagcuauugcuuagcauacugugcuugcaccauggcugccuugaguacuuccacuuggguuauguuacuuagccucauccaggagggaguauugcagccuccacuauguggugagccauagacaccuaccuguucagggacaccugaaucucaaguuguaucucugggcauguagacauccugcugugguguugaugacagagaccaaggcuuugguucagcccugugccuggccuggccaagucccuacuuaugugaggaggcaacauggcugcacagucagacugacccuagaagggacugccuguacauauuccagagccugacagagugagacagcaacgggcuacagcugcuccauugaaucugaggugaaagggaccuccaugcaucuccccccuuaccuuaacaaccugucuggaguuugucucccagagaguacucaaguagacaacauacgugucuuaacgaccucacugccuaaguccuacucuucccauuuuggugacaaaggcagaaggacagaaggguuggauuacucaccaaagacauacagauucaaaggugaaggggaugggauuccaacugcaacuucauaccucagggucaaggaagggcaagguucacagcugucuacaaagaaacugauagccaucaaaagguugccgacagccgggcgugguggcacacaccuuuaaucccagcacucaggaggcagaggcaggcggauuucugaguucgaggacagccagggcuauacagagaaacccugucucgaaaaaccaaaaagaaaaaagaaaaagguugccgaccagcuaggaccaccuaaccauuuucaugagcucucauaccuggcuuccauaccaugagguauguggccaacauggcaaccccugcuacccaaacuucggggcagguuugccagugaauguccaucagaaaacacaggcauuuacauuacaguucuuaacaguagcaacauuugcuaugaaguagcaccccuuaccacaugggaugguguguggcaucagucccuugaaaggcuggguauuucugagaugacauacagaacuccagggucagggaagccugugccuuugccugacugcuggagccacugugauacuuucugaagugucaguugcuagggcuuagaaaggccccgcagccccggaucucaugccugggcuggaggaagccagagggcuuuguuugcaggcagcauccaguaguaagucaccuagacugauaguuaaucguuuguaaggacaguuucaaagcaucgaaagacaagauuuaaaagggcagguccauauuuuaucauuaggggaaaaagaaagaaaggaaaugcuucgcuggaaaacaaacuugagcauaccugagggaguuggugcauguaaaucagcaccuacaacugaaguaauuacacaugcgcaaggaauacuggccuccuaagucacugcugagcagacaguuaacagcugaagccuucagacucaaagugaagguuuuauucucuuaccuggucucugugaugccuaauggaaagagccauuagcaauacugucuccacagucugcaaggcagcugcuaugacucaaguggugcuaggaaccacccauccuccuccucccauuuucugaucugaugagucuaggguagaaugaagccucuguucugauggccggguagcaggguuugugcagggcuuaaggacuaaagauggcucugccucucaagagaagcuggucccugaacaaguuaagaaauaucacagugaagcugcaugcagggaagacccagagaaagugccuccaucugcucuagggccaggccuuaacauggcaccugugcuggaguccccagccaggcagaagagaugggggaauguggcauacaccuguguccuguggaaguggcugaggcugccgucagaggugaacauuggcuggaucacagaugauaauauguaccugaggccucuucugcugggccagguagcuccaacagggaagcagugcacuguugucauaggcagugggguacugagcccaacacgaggagccauguauuaccugaguucuuuucagagcauucugcucaggaucuagacuguacuccacagaaggaaaacuaggacaagccaguaugaagcagguguggagcuuacucuaaaagggcaguggggcuaccucuaggcagugggcagcccuggugcugucacacaaggcccugggaggucaaaggucugucccugucacaggccaaggagccugccagccucugccccucagucuuccccacaccaaguucucugucuaaaaugcugcaccuggagauaggcggcagccguggaaucaaagcggagugugucugaagccgcagaggcagcuuccucugcucagcaguuagucugagugucagcugcuccugaguucagacccaggaggacucugaagucagcguagcacaguuggucuuuggacuggcaagcauuuuccucccagaguacaguauuuuucagacaaucugcuggcaauacccugugcuggccgacgggacugggcagggauccuuagaagguggguggaaggucaaagguuccuuguugccccuuucuugagucccaucugauaucauucugagugugugugcuucuuugcaguuugaacaagaaaaucagcgacucauuggugaaaugaacagcuuguuugacgaagugagguauguauguagcuaguagcuugaugacaguuuucccagauacugggggcucuuuccaauugcuuuggcauccaggcacccacguguaacagggcagggccggcugagccugugggaggagccuggcugcuacaguaagcuugugggugcugcagcaugcagaaagcacacacuaaagacagucugucccaaacgcagaaccauagcacuagcacggggcugcuuggguggaguggcuguaaaugcagugggggccuugugaaggaguccugcuuccaggugaccaggcucacacccacuugccagugaacugcaagcgcccguguuccacaggagcguggcagugcuguggaagcaacagcugagucuuugcaggaccccauuccauucagaguguggcccuucccggccugggacuuacucaggguagggguacucccugggacagccccaggguuauuuugucccagagguggcucucucgggccucuucugcccauccacuugcuguucuucuccaugcccugguacugcuccuuccaugucuccugucugcccuucccauauuuucuagagggaaucccucgccacucacaccuuucuccugccccugacccagcugugcuggaguagggaaggucagucugagccagcuuccacucucagccccucagccccagccugccccaugguggaaaggcucagccaguguuucagguugggcaagcacaugauugcuaaaccagacguggugaucacagacuguacugcagcauugucuugccauagggagcuggcuugagagagaaauaauacuuuuuuuuaaagaugggcuuucaaaguaaccaugccuuugcuucuccagcauguaucacaagguaacuaggcuaugcagaggaccuaccaugccugcccagcuccuccuccugucuggcauggcugcccuuccucuuuugcuaucacuuuaauguuuccuucagaaaaguguaccauucaucuuagauuaccaggagcuaacagcuaacaugucaccuguccauucuuuuuuugaaggcaaaucgaagggaaagucguugaaauuuccagacuccaagagauauucaccgaaaagguuuugcaacagguaaaaggauccagagcccagcaguuuugagucuugacuuaggacugacagagagcuuggagcccucuuccagaagccucugagugaugccgacuagacagcaccauguucuguuagcuagucacaucacucagagcacccugaccuagcuuccaucagcccgcagcaacccucuggggcacagcugaggagcagaguggccccugugagcuagagcauccagugguacuaggaaggugcaaucccuccacaccaucccccacccccaucuguagaaagggaugagaccacagggcugcuguuguguucacaggugagcacagaagcacucugcacggugcagaauggagagcugcuuuucaacccacugugcuccagaaauuagggacagccucucagccagccccugcugcuccuggagcacagcugagagggggaagauugcuccccggugagcuuaggacuaaaacauaccuuccucuucucuccgggacguuggcucacucacagcugccugaaccucacagcagaguugagucagcauggaugagguagaagcuaacaacauuugggaguacacggucauaagaauaagauucacagguaucuuuuuuaaaagaaaaaaaaaaagauuuauuuauuuuauuuauauggguacacuguagcugacuucagaaacaacagaagagggcaccagaucccauuacagaugguugugagccaccaugugguugcugggaauugaacucagaaccucuggaagaaaagucagugcucuuaacugccaagccauuucuccagcccucuucauaaguaucuuaaagaucuacccaagccacgugugugaaggccaugaacccuggagacagacuuugugcagacccuuggccuaauggccaugucagcugcaugacagaggaagccaucaaagcaagugagcuggcaccgcagcucacuuuggggagagucacuuugucuaaagcauaaagcuuucagggugaccagguugcacuguggauacuccacccugugcacuguggccaguacuucuccucagccccauuaucugaaguacagcuagugcuccaggccucucucucagagccagcaaguaguaccacugaccuaucuggcccauggcaggccuuucggugggacucugaccaagccagguagugcccugcuguaguaacaccacauaugccaccaugaauauguucucuacaugguaauccagugacauacccuggcuagccauacagcaaagggaaucacagucuuuuaggcuccaaggucuagaggcugcacccacacagccugggaaucgucaccagagaggugggcaucacccaacacaaagagagggaaauuuauggcucagagauaucuacuagcuuacagagggucacauacugucugaguggcaggacuaggauaaggcucuugucagguuguacagcucacacuaucuccuaucucuccugugucacucaccaagugacaaggacaaauaugaacugcugauacuggccucuccucuagcauuguuuauucuuuauaaggucuagaagccagcuucaugauguuacaggcuuugaaacacauuagccauacaagcagcgugguuuuuuuaaauuuauuuuuuauuagauauuuucuuuauauacauuucaaaugcuauccugaaaguucccuauacccucccuccauccugcuccccuacccacccacuccugcuucuuggcccuggcauuccccuguaccggggcauauaaaguucaagcagcauguuuuaacacauugcuaaauggguaagaguuagaacaagacuugaauugcuggccacaaaugcccuguguagaugcugagaacuuggaaguagcgggugcuggucuccauucaugagacaaugcuauuggagacccuaccauaccagccaugugguacuguuuuuagucuuccugucggggguggagagagggggacaugcucuaaugugcccacauuuagggagcccguccugguauaaugcuauagaauggaaggcaggcuucagucauucaguucccaguggagacaucacuggagugcacauggcacaugggccagggcauguggguagugacacacugcagagaucaucagagcaggagcugaggaguuugccauaaacagccugcagcacugacauaagccugauucucaaggccucacaguucaaggggcccauuguuauuagacgcguucucacgaccggccaggaagaacaccacagaccagaaucuucugcggcaaagcuuuauuucuuacaucuucaggagcaagaguguaagaagcaagagagcaagaagcaagagagagagaaaacgaaaccccgucccucuuaaggagaauucuccuucgccuaggacgugucacucccugauuggcugcagcccaucggccgaguugacgucacggggaaggcagagcacauggagugaagaaccacccucggcacaugcgcagauuauuuguuuaccacuuagaacacagcugucagcgccaucuuguaacggcgaaugugggcgcggcucccaacaucucccccuuuccuuuuaauaagagcaaauaggccacccauauuaaugagaguggagauagaggucaaauccccaguguguagguaaaggagccauguacaggauuagcucuuaggcucacaggcuuuuacccagagcaacccugaccugcucccgugucguuuugccugggggaagggaacuaggacacugaaccuucaugaaagaugacaugucucccuagaauaggcucauauaugccgcagagccuuuccauugcagugcuuagccgugcaacucucucgggcugcugaagcacacucacucuaucccgugcaaugagucuagccucgugagauguaagagcugaguggccagcgaccuauugccuaggcauagauaaccauauaucagggggagcuccauguucuaguccugcaagcgccugggcaauaaccaccuugucucuccuaguuugggccuuaagcuuacagaccaaucaaagaagcaacacuaauccacagcaaaguguaucuccaaauaauauuaaucccacccauuuuuuaaagaaagaaaaugcugaggagauccaauuggguaauccuuuggucagggacagguccaagcgcguggaguugaccugaagucucaauucccgaaggaucuguucaaauucagccauccaauucuguaacauauacugaaaaagacuuuuugacaaauuagcugcccuaguaaauuuaacauacugaauggaaauaacacacaaucccggaaacuuuuguucacaacccugcugaguuauuugucauaauacaucuaguuguaucuggacaagaucuaugaguugauuaaccagcaugagaccucucuguaucuugacauuagcugaggccuguuuaucuaugacuguagucacugaggcugacaaaguguuaauggugucagucgucuggaccuguccagacagagccaaggcugucugaauuaaggccaaacccaguucccaguuagugguaaaaaagcaagagaauacuugagcauuauacaucaccgucauugggaguggaaauaucgacauuaucccccaacgcugcucucucauuggacaaaauaaggcccaaaugcugcauaauaucccuuccccagagguuaaccgggagugggagcacauaagguaugaauuucccuugcugcccuucagaggauucccacgucaaggcaauggagcuuauagugggacaugauugauaaccuaggcccuguaaugaaugagaugacucuguggugggccaugcuuugggccaccaauguguagaaauuauacuuuuaucugcuccgguaucaaggaugccuucaaacucuuuuccguugaucuuaaggcggagcuuaggucuaucauuuaaagauacaaccaaauaggcagaaucauuuccugaggagcccauuuucuuuaucucagguccugcagauuucucccugguauuaucagggaggagcagcagcugagcuauccuaucuccuuuacuaauagaaaaaacgcccuuagggcuugagcacaggaccuguauuucaggggaauguugacaauccauaacuccaggguggacuacuaagcccugcaaggugagugaaccccggccgagaauaaggcccaugguucccgggggcaaggaugguauaggcuccacuggcaccggcugaauacucauuugaggcauuaauaggaagucggaggcggcacgcagguccacccuugugggucuuccugggucgccucucugacugcuuccuggguccugacaaaccgguucccauaucuuugagggcccugggaccgagggcccgaugacccguuuuuuggcacauaagcugauugacuaucaggugggggaagaauucugcccuuuauaucccucacagagcgacacuggucagcucuaugauaacccuugccacacuuagagcaaagagugagagucccucccuguuuaucuggagcucugcaaucuuucuuaaaaugcccaggcuuuccgcaauuaaaacauguccucugaucauuucugcucauggagcgguucugagauuggaggauggcggccgcuaagccugcauuggugagaggucccccaagcucucgacagacccugagccagucuuguaagccuuuguucuuucuuggggcuauggccgcucggcacuccuuuguggcuugcucauagauuagcuguucuaucagaggcgcagcuugcucugacucuccaaaaauacgcucugcugccucugucauucuggccacaaaaucugagaaggauuccugaggucccuggauuaucuuuguuaacugaccagugguuucaccugcucgagagagcgccuuccaggcccuaauagccguggaagaaaucugggcauaagcuccccaaugguaguuugucugaucagcagaauaagcucccugacccguuaacaagucaaaaguccaaucucucugcucuggagucaaagcagcugcguuugcucgggccugcgcuugugcagcuucgugccaaagcgcucuccauuccauauauuugcccauacuagggagagcggcuuuuacaaccguuugccagucagcaggaguuagugccaugccggcgagccugucuaacugcaccaagguaaaauuagcauugguuccguauuuacgaaccgacuuggcaauuucuuuaauuuguaaguauucuaccggagcguggacacgcccacccucggcuccuucaaagaccggaaaugccuguuguauuuuccuuuguuccucucugggaaugaaugagucugcgcacugccucucugcgcagggcugacgcacuaugcagggcggggacuccgcauagggcggaccuugaagccgacugcccugaggccaaucagcaaacuggccuucgccagccgcuuuuggcuuccuuaacugauuagcuagcacuuuaccuggcugguacccuuuuuucucauaaugagcugcuucuuccucccagucuguuucuucagaggagaauucuucaucugcuucagagcuacuaagagcuggcuccccgagcccauccagcgaugagcacaggcuccuuuuccuagagaccuccgcuaauugaucuuucuucuuuucccuuuuuccucuuuuucuucuaaucucucuccagguauuccuaccuaaccuuaacuuuuccucggguucaagacccuuggaaaggccuguauacuuauuuuguguaccauauuuucucuuugcuccuacucucucuccccgcuuuacuucugauagcuuguccugaauuucaucuagaauccgcccugccuuaaccacuugauaacaugugaaaaggaacaaaagggcuucuaacacuagaaaaaauucaaggccaaacauauuccacuuuacuucugauagacugucuugaauuuccuuagaaaguucaagaucagacuuaccucguaaagcuguacucacugguacucucguuccccagcugaaaaguucugaauucauacaguugaauccuucuuaacagucugcuuuacgggaaccuuuauuaccgcgacccgcaguucugguucuggaaugagggaucuuccuugcgccagucccgaguuuuuucucgucccggaauucggcaccaauuguuauuagacgcguucucacgaccggccaggaagaacaccacagaccagaaucuucugcggcaaagcuuuauuucuuacaucuucaggagcaagaguguaagaagcaagagagcaagaagcaagagagagagaaaacgaaaccccgucccucuuaaggagaauucuccuucgccuaggacgugucacucccugauuggcugcagcccaucggccgaguugacgucacggggaaggcagagcacauggagugaagaaccacccucggcacaugcgcagauuauuuguuuaccacuuagaacacagcugucagcgccaucuuguaacggcgaaugugggcgcggcucccaacagcccaugguggacuccagagggauaccauccucauaaccuacuauacuucccauagggcagcucucuucuuucucaggggggcuuuuugcuuaggccucuggggcagucacugcaguggcagcugaugucccuagguagaaggcugaguccuggagccuuugauucccuuugcuguauggcuagccaggguaugucacuggauuaccauguagagaacauauucaugguggcauaugugguguuacuacagcagggcacuaccuggcuuggucagagucccacugaaaggccugccaugggccagauaggucagugguacuacuugcuggcucugagagagaggccuggagcacuagcuguacuucagauaauggggcugaggagaaguacuggccacagugcacaggguggaguguccacacugcagccuggucacccugaaagcuuuaugcuucagacaaguacuuguagaagaaugucuucuugguggagaaaagaaugcuugucuucccugauauucuucucuuccacaggaaacugagaucgacagcauucaccaguuagucgugggggcaacugaaaauauuaaggaaggcaacgaagacauccgagagguggguaccuugugcuuucuagucugauguggcccagcacugcaucccagcagccugaaucccauuagugagguuguccaagaauacuguguaguguuuaggguccaccuugcagcuguagccauggguuuacugucagggccagccucagagcauguguucauaacaccugcggauucucaagagaaaguagcuuccaucccugcaaggacagugggugggagagcacccagguagggucaggauaaucugaaaccacggaugaguccacagagaggaggagcccagaaacuaacugugaagggcaccuagccuuaugagccagcugucucuaaaucccagaccuccuaguuuuuccugugucaccacagaccggcaucacuggaacacccaagcccugguucaaaugggauuggucccuggggaauugaguccugggagguuaggcuuugcccaacagaagagguuaaggacagagcaagcaaaauggcucaguggauaaaagugcuuguugccaggcaagacuaucugauuuuaauuucugaaguccacaggguagaagcagagaauuaauucuacauuuuccucugacccuaucccacauacacgguggcauguauucccaccuacccaccauugagauaaauguaauuuuaaaaaugucuugggaggcagaggcaggcagauuucugaguuugaggcuagccuggucuacagagugaguuccaggacagccaaggcuacacagagaaacucugucucgaaaaaccaaaaaaaaaaaaaaaaaaaaagaaagaaaagaaaaagaaauauaagggcuuugcucucugucaguguccaugcacaguggcuuuugugccuaucuaaugagagcaugggauucauagaggugugcucagggcaccuagggcuucuaaacccaguccaggcuggugcuaacgccugugcuccuccugccaggccaucaaaaacaaugcagguuuccgaguguggauccucuucuuccucgugauguguuccuuuuccuugcucuuccucgacugguaugacagcuagcccaccagggcugagccugcgccugcgccugugccuuggacgcaccacgugccagcaugugucucaucggcuguggagcuguguaagguccaagggcugggaaaacaccgcccccaagccaaccuuuggaaccucucaggaccuggaaauacauggauugcaagugcccuucaggguggaaaauaaaaggccaucaggagcagcaccuucaggacaggccacaagcaugguggggacugagcagagcaaggaaauggcaggccuccuaucuccauuacaggcuuggggcccaucuccugcccuucccacgcccguagcuucaggggagaacaugccuaauguugcuaaagucaucaguucuuauuuccuuguggcaucuaaugugugcugauacauggccauuuugucauagacaauaauucacaucugccuugucgagcuaauaaaugcaauuacagccacuuauugcagucagugagucuccacugagccccucuggccaccaccuggcuggacaggcaggcucuggggcccuccacuaagccucucuccugaccuggcucccugucuuguuaacaucaaagcuagggccuagaggcacacgaagccucauuuccugccacugagucccagauauuuguguuccaagaaggguguggaccucagaagagugggccuucugcucuugcuccugcauacucgccccucuagaagaggccacaggguugccuguugagaacuagaaguguauagcacauggccuacaucuguguacagauguauccuggguuacacaauuccugcggaagcacaugaguacagacaguccagugugcggcuuaaguacccacgagcucuuuauuuguagaguaaaaaugagaaauuacauugggagaguucacaguggguaaagggcuacguuagaaaacacagagggccugccuacugcacgcacacggcccaugagucggaucccucuacagacaaguuuuggcacauguguauugcucuuugcgcauuccucgcagcuuuccaaugcacuucaagcucgugacuguguggccccucccccugugcugagcucaugcccuuuguuuuagaacaccucaacaauacaugauguugucucaguagcacaccucaggaagcagcaguggagcugaugguggccaccaugcuuguucacaaaggucucagacuauuugccauuuauuucugaccuacuaaaggacgccgagacuucugacaugcccaccagaaacaacacauucugagaacauggaagaaaacaaucaggaauagcuuuuucuauuuaauugucuuacacauuuaguuuaccuacuggugauuuuguaaacauauacuuuaaugucaagauucagauugaaacauaaacauacuuuucuuacaaagauuguggacuuagauauucuauuugcaaggugccacaucagccccccccaccagccguccugccccuucccacagcacaggagucacaucuguucacagaagaaaagcuaaaguagcccuggcuuacccaaaauuacauuucacuuugcccacuggcuaauaaaacaaaacaaaacaaaacaaaaaacccaaacugcaccugcauucagggcuguacgugcaaauauauucauaacaggaaagaaaagaaccagugggcuuucuuccuaccuagcacauuaccagcagacagcccacccacagagaaacaggcucggcgacccccuagcccagagccagcucuuccccaccccauccuugugcucugcucaggggacauaccaaagagaaccucccagaauugccuggcagggcugcgucguggugcccacguccccuucucugcgccgcucaacagugcauguugacagucagcacugccaccagcaaaagcacgggaucacucuagauauggcuauggaguaaggucugcagauagcaaaggggcagaaaagaaaacaggaaaccagcagcugugcuguucugacggccagaccccuggcauagccaguguagauuaccuuuugacaguauccagugaaucccagggaaggagcuaaaugaagacuccucagcguggacaguggcauccagcucucuaagcaaugcugagaugcucuuguucuuacgccugugggugguccgcagcaaguuuaauuugcaaagcagcauuagcaaacagaagcaauugcaccguaaaugaguaaucucuaaauuaucgguaauuauauuuaaugaaaugucccucaaaguccccuuguugccuucaagugacacaucguaaggaaccugcccugcucgcuaagcugacuucucugcagcuucggucuccuguuccgacagcuucucuucugacagaacugacauccauggcgacacggagcgggugaugcucugcuuggccacguuguagugguuuaugacaguguaaaauuucucccg

SEQ ID NO: 2434 - RNA, 9464 nt, Mus musculus
cuuccauagauaguaauaauacagggacccacugcuccugagaccagagauccguauuuuaaaguucaagugcuucuuggugauuuagugcgguuucuucgcccacuaaaaccgccaagguaauacaguuuuauuccgagcguccggagauuccgcccuuggaccuggcgccggaagugcugcgugcggucacuuccgucgcacuggcgggcgccaagauggacgcuccgugggcucgggagcagcuacggcggcguuaccuguuuccuuccgaaguagagcuggacugcgaggacgaggccaagccgggugaggcuccccagacucuggggcccagaguggggccgcgagucgguguccaggguccugacaggucuuucaaccaucccauccuccccugagccguauuuccgcauuccguggagagucgacuuaaugccggcuuggaaacccccuuuaaaacuaaaaccaaaaccgaccacuucagcuuugccccaauguaauacgguacggauguauguacuuagcugccugucagcagaaagcuagcaaaaaucaguuuggauuagauguaucucugccuggacaucagauagacuuuucuguaucccugugggccguuuucagaagguaucucagaacaauauuuaugacaugucaccauuuggguacgaacuacacuccauuauguguuuuugccuguagaugcacagaauaaaaagcaauuucauaggaacgaaucaugcuagcuuccuauaggcuagagaacgguaaggaugagauacacuuuauuuuagagcuguuugaccuggauauuguaagaacuuuauuuguuagcuuuucaaaauaaacacuggcaguuugugugcauuuugagaauaucuucaagaauuuguguuaguaguaaccucucuacagacugauagucuagagaccucacuuggaaaccaguaguccucauacagagauggcaugucggaaucccuucauuuuguuugcagggagagcagugacucgccugucaacugugcagucuaugcugucuuccggggcuacagcucugguguguuacuccauguuggagcuaccccaaaagcugaugucuguuuaaaauauuuugguauaaauuuuauuguauuuggcguuuuccuuuuauuaguguaugcgcacucauuaauugguacacgugcuuuuggaggccagagauugcgcaucuugcucuuuuggucuccacauuuuuuuugagacuagaugucccuuggccccuggauccaccugucucuguggaugcuggggaugaacucagguucucauguuugugcagcaaccauguuaccugcugaacccucucauuccccugcuuuugacauuuuacuuaguuaacauaauuaauuacuucccuagaggaaaugugaaauaaagugugugcuauaccauacuucuggauggcauugcuguagcuagaagauuaugaaaugcgauuccaagauucauuuuucagcaauaaccaguaauauugagcauauuuucuagugaguaccuauuaacuauuucagcaaauguaaaucuaccauuuuuguuauuuguuugguagguucuuggcauagaacucaagacuucaugcauacucaagauauauucuaccacugggugacgccucugccccuauauauacacguauccugaugcucugacagaaggagcucccaccuuagugggagggauucugguuacuggaaaguucuaggagaugacuucaucugguguaaaaaacugggcgaguucauaacucaaaaucuccccuauuuuauagaaacacccacagcuguugagaaaaaggagcgaccucuuccaagacuuaacauucauucuggauucuggauuuuggcauccaucguugugaccuauuauguugacuucuuuaaaaccuuuaaagaaaauuuucacaccaauagguaagaaaauguuguuucuccaggcauagugacacaaugaucuuaauuccagaacuugggaaacagaggcagguggaucucuugaguuuaaagcuacacauugaguuccaggacagccuauauuagugagaugaaaaaaagaaagaacaaaaaaaaaaaaaaaaaaaaacccaaacaaaaaaaaacaaacccaguugcuucauguuuugcguguuauaguuugucaguugaauucacuaaacaguuaagagaucgugagaugauuuauuugguaaagugcuugcuauuauauuauaagcauguugaucaguguuugauccccagaaccuacauuagaaaacagacaaaugaacagagaaaaaaaaaggaaacaaggcaguuuggugcuucuaaucccagcucugaguaggugggggcgggguccccgggcuuauugacugguuagucugcaugagucggugagcuccaggucugugagagacccugucuuaaaaacaagguggagagugaucaagaaagacacccagcgcugaccucuagccuacacacccacacccacacccacccacacacacacacacacacacacacacgcaggguugaccucugaccuacaugccccccuauauguacaauauacacuuauauacacauauacacuuauaccuauauacacauauacauauauacaugugcaugcacacuauugaccucuaucagacaugauguugaagcagcuacugaugauacagaaaacagcaagacacccuuuagucaaagggugcagguuuucacacauagccuaguaaguuuugggggaacaguguaugugagaucuuaucaucuuccuaucuuaugugguccucucgugaccccucccauuacccuucuauauacaguguuagcuauuugaugcguugaauguguccguaagcugauucuaguagucauuuuacuauguugcauacaguagauuacaucauuguaccuuguaugugugcaauuuaaaacuguuaccugugccccuagaagacuagagaggaaaggccugagaagcagagguggagugggaacuguggcugagaaagguguguuucagaguagcuagggcagaguaguuaggaagggggugguuagagggugugacucagaguuagcugccuugaaggucacgggaggagucgggagcuuaggucugaguccuagugucaaauggcccuuccuauccaggggcagauccuguucucucucaucccaggaggugaccauggaacagaaauuaugcaucgugugugaauaauguggagcuaucagguaucagaaaagggggagauguaggcgaugucugagcuggcauaugaggacuguguuucaugccaagaacagugacuagacauaacaguagagccauaaaagaugcaggcaggaguuuggucuugcugaaucaugggaaaugcagucuucaaagucuugagguggaaggguguaagacgugaaguaguuccuuuaaauccugaggaagaggcugcuccaucuuucacaaggaagcaucuuuguuuaaaauaccaccucccgccccaccacuucuucgucuguuugugcuuugguaggucaugugacuugucuaagugaguuuuagauggcgaacuggaacccagcaccguucucucgggcgggugucugcucccugaaggaggcucacucugcucacuuugcaggcuucuguuuccacacucacacaggccacacugacaaaguggaaguucguggucuagaaccaaggaauaagucugugugggacugaguaucuuuuuuguuugauuguuucgagacaggguuucucuguguagaccuggcuguccuggaacucacucuguagaccaggcuggccucgaacucagaaaucugccugccucugcugggauuaaaggcgugugccaccacugcccggcgggacugaguaucaacaaaagcucugaucccacuccccacagccauguucuucccucagcuccaucagugacaaagcugacacucaguuuucaucagccugcaaacuuccucucucagcggguuuagaaucugcugggagagagccgaggaccucaaguggcaccccagcagcugcuuuuuuuuuuuuuaugaacuagaacuugggucgagcccaggaugggucugacaugguggcaggggcacuucuaauuucaggagguuauuuucugcuguggcagacagacucauuaccaggugucauggugccugcuuggcaggugaugggcaggaugccgggagggccugggacuguuguguggugaggccgugcugggaaggccgacuuuucagggcuuuaguguguguccuuuccuuagcuuuccuaggacuuuaaugugagagaaguagcauuaggaauggucccccacaaaugauguaugggaucaaccacagaaagaaguggggggcuugggaccacaugcccuccaguggcagagacagcauagacacugggccagggcuguggcgaugggagaaaguugaaagcacaggccuggccuuaacaugguguguucuuagaggcaaaaaggcauggcccccuaccaagccaaggcuacugaaaucucugcuucucccagcacggucggucgacacugacuuucuuccucuuugucuccacaguugguuucucuuuggcggagccuuguuauuugucagccugucaauugcauuuuacugcauagucuaucuggaaugguaccgugggauugaagaauaugaugucaaauacccaacacuggugcccaucacaacugcaacuuucauugcggcagggauuuggugaguggauguugaaugugaaugaaaagcaauuacaaucacuuuguguuugugaugaacgugacccagaaccuaaaucaagcagcauggugccccagggggaaggggaucccaggcacucuguucuuugggggucuccuuucagcaucuuucucucuuaaucugccucaguuauucacagagaaggugacaucugcacgagcccuguguucuguuuuguuuauuaagugucuuucagugugcaccgagugaacucaucacggggcgagugcugccgcccucggcuggggaggccuggugaucgaucccugcugacccuucccuuugcuucacgcugccuuccugcugccugcaaacacugccccgucucuguugccauuuuugugcaucccauaaacacgguucuguucaucuguguuuugaacacaagacuguagagaaguugguuguacgaucaccagucuuuaagauuuaacuguaugcaugcaguguaugcuguucuuguguaguuuucccccagcgguuauucauugccaguugucaauccacugcgucacugaguccuaguguaccuguugcgcggccacccagucaggcuguuuauaguuggugcuguuuggaagggugccauugagacccccucccccccacucuguugggcuuacauguguauacauauacccagaaaggugugcuucauuccauaguaucaggcucuuccaaagugguugagcugucucaccagccacuguuccccaaagugaaugucaucuguguuaagcaugugcagucccuuucucucuguugcucccuaaacaacagaguaguagugccuuaggcagcaguucacaguguguggcacuguaaggacccuagggauaugacauaaggacguggggaaaggugcaggcgaucugcaggugcagggcucccuggaaggcccugagcauuucgagacuugguguugcugcaagauuuuagagcuaaugauccuuagguaggaagggacagcugucaugccuucccagugugucuaguggcacaguguagcuuguaguucuuccacagugggagcagcugugccuuuuaaagguuacgugucuuucacagugugcgcaugcuaagacugcucaacccguucguucccuguugccagcgugaacccaccuuuguaaauucacauaugcucagagaagaagagaggcuauuuuaaagagagagagagagaaaaaaagguaguacuugcucacugaagaaaaacuuguaaauaucagaaaauguagagaaaguuaagcuuccucucugaggguuuucuuuuuucuuuuuucuuuuaauuucuuuugguuuuuugagacaggguuucucuguauagcccuggcuggccucaaacucagaaauccaucugccucugccucccgagugcugggauuaaaggugugcgccaccacgccuggcugaggguuucuuaauguaaacuggguucugcuuuuugggaaagucuuaaagcuuuauguauauucugcuuaaaugcucuuucuuugacccaguuucgccugcagcuggacacuugccacugugaggucaguauucuguggcgaggguagaccaaggaugcuguuuuacuuugccuucuauagcaggaacaucccaagaaacaucaaauuaauuuuaggccuguggcuugugauuauuugacaucuauuuauccaggauuacauauuaaaacccauagcugucuagauagcuuauuuaauuuuuuuaugguuucccugguagcuucugcuucuaucaguucaaucauuaaaacucacuugauuuuaggaaguguuugauuugauuuggugacaagaagacuguuuuuugcaaugaagaguuuauagcaucauguauagcauugcuuuuucaugcuauuuuaagaguccuuucgucuuuuucccaugauaaugccugagaugauaaagcaggcugcagccauuugaguuugugguccaucccacaugcuaacguccagagacccaugucaccccaggucauggugcagcuucugucagcacaggcagaaaucuccuucccaucagucauggugccggggcuaacgacccgcauagguggauguccucaagccgagcuccaacuccagacucuggagugggguguuugugucaucccacuugcugcugucagcuguuugguuuugguuucuuucagcuucaaccuggcucuguggaauguguggucauuuuucacucccuugcugcuguucacccaguuuaugggggucgugauguucaucucacuccucggauaagcucugguaagaugcuuguuucuaacagugagccguggaaaggucuugcagucacuuccugagggcacucuugacaggacugccugggaaucacuuccugcuguguuugugcugacgugugucaccacugaacacagcugcaaggccugaggcuaucuucccaauguggaguuuuaagugcucauuuuucagagacagcaucaugccuuucaaagaacucauaaagacagcaugugugucuuaauguagagaagugcacgugaggccacuuuauacugugggcaugacuguuggcugaaugguucuuagaaguaguaugggaaauaauggugaucuuacccuacuugggacagauucugccauuuucuauaaauauuggaugaaugguacccuagcccuuuuaaaaaauucuuucccaggggaugaagagauggcucacuggugaagaucacuggcuccucuugcggaggaccugcauuccauuccuagcaucugcauugcagcucaccuagguccaggagaucuaacaccucggccuccacagaugaugucaggcacauaugugcuauacauacauauacacaggcaaaacacucguguauaaaauaaaaauaaaucuucaaaaauucugcccuuuuuauacuauuuagagaauuuaugugucccuguggaccagcuccugucugguugggaguacugauagacaucuauuaaauaaguguauagagugugaagaaugcucaugcugugauugggggaaaaaaagacaauauagucccuccccuugugccacguacaucugacuuggagaaaaucaacuugacagggccauuugcaaacagggcaaguaagacucggggaugugugaguggggcuuaggaccagggugcuccagcugauggagugugugcacccuuagugugaccagaaagaagagguacacaugagccugcuguugcuagucacaggcaaguugcuggccaucaccacgcugucacaaacaauugucuucuaauauugcacuguccagagacugaugagacccauggggccccuuguuccugugcaugccucacuuuaagagguuuagucccgccggguaugguggcgcaugccuuuaaucccagcacucgggaggcagaggcaggcggauuucugaguuugaggccagccuggucuacaaaguuaguuccaggacagccagggcuacacagagaaacccugucucgaaaaaccaaaaaaaaaaaaaaaaaaaaaaaaaaaaaaaaagagguuuagucccuguaucacccuauucccacagcuuuggcugacccugauucccaacuuucuccccccucccccuucccuguggcuggcgaucuuggguucugacuguuuggcuguuucuagguguuugggugccuuggacuuccaugagccugguguguggcuggcggugagagcagcauggugcugggagccaagcauguccucuuuuccuuuugaaauacauaucugugugcaugaguguuugcuuguauauaugcuuguuuguauauguauauauagauauagauaugcaucacagaggucagaagaagccauagcaucccuuagaacuagguuaaagagguugugagcuuucaugugagugcagggaauugaaucccagcccccugcaagaacagccagugcccuucaccacuacaccaucucuccaggcacaccacuuuguuuuuaaugggaauccaugagccuaagguguuucacuuggcacauaaaugcuguuuucuuccagacuucagaacaugaccauuuaaagugaacaaagcguccagcuugucggcugacgugaaggagaagcucagugugcacugcugucuccgcagugaguuguuccauggagaaacugugacucucuagaucugcugucgaaaucagaauaaaugaucuuucucucugcuguucaaaacaagugauugcuucucagcaguuuguguuagaacuagcgaguguuaaccugucagcuuuuagagacaguaguagcucaucacaggagcacagugccaacaguuuuacagauucuggccuguucuacuugaaggcuagcugcccuuguauaggugacuggacacaagcaugacagaaucguguugucaccguuaguagucacuggauagcucguauuugucauaguuuuuuaagaagaggaccaaacggaaguaucuuaugguuucuuguuacucuggguuuuaucauuauauaaguuauuggguuuuuaacauuuuucaacuuauguucuuuuaauaauguuuaaguauauauaauuuuuuucuguaacaucaauaaaauauuuuuauaauuuucuugugcauuugguuaaugca

SEQ ID NO: 2435 - RNA, 1493 nt, Mus musculus
aucgggaacuuuccagaacgcucggugggugguggaggagcagccuguggcugagcugcgcugugcuccgcuccuuucagcucucuggugccggcccgcucaccggcuguaaauauggugaaagaaaccacuuacuacgauguuuuggggguaaaacccaaugccacccaggaagaauugaaaaaggcauauagaaaauuggccuugaaguaccacccugauaagaauccaaaugaaggagaaaaguuuaaacagauuucucaagcuuaugaaguucuugcugauuccaaaaaaagggaacuauaugauaaaggaggggagcaggcgauuaaagagggcggagcagguggugguuuuggcucacccauggauaucuuugauauguucuuuggaggaggaggaagaaugcaaagagaaaggagagguaaaaauguuguucaucagcucucagugaccuuagaagacuuauauaauggugcaacaagaaaacuggcucggcaaaagaaugugauuugugacaaaugugaaggccgaggugguaagaaaggagcaguagagugcugucccagcugccgggggacagguaugcagauaaggauucaucagauuggaccaggaaugguucagcaaauucagucagugugcauggagugccagggucauggagaacgcaucaguccaaaagacagauguaaaagcugcaauggaagaaaaauaguucgagagaagaaaauuuuagaaguucauauugauaaaggcaugaaagauggucagaagauaacauuccacggugaaggagaccaagaaccaggacuggagccaggagauauuaucauuguguuagaucagaaggaccaugcuguuuuuacaaugcgaggagaagaccuuuucauguguauggacauacagcugguugaagcauugugcggcuuccaaaagccaauaucuacucuugacaaccgaaccauagucaucaccucucauccaggucagauugucaagcauggggauauaaaaugugugcuaaaugaagguaugccaauauaucgucggccauaugaaaagggacgucuaaucauugaguuuaagguaaacuuuccugaaaauggcuuucucucuccugauaaacucucuuugcuggaaaaacuccuuccugaaaggaaggaaguagaagagacugaugaaauugaucagguagaacugguggacuuugauccaaaucaggaaagacggcgccauuauaauggagaagcguaugaggaugaugaacaucaccccagagguggcguuuagugucagaccucuuaaugggccagucacucuuugacauucuguaugcaguagugaauguggaaaggacuguaaucauaauaagcucacuacuuggcuauuguuuuuguuuuaauauucaacuauaguaguguuuuuaaaauaaaguuaaaugaagaauaaacacaaauauaaaagcucaaaaaaaaaaaaagaaaauuaau

SEQ ID NO: 2436 - RNA, 1667 nt, Mus musculus
cacaaccaaguucaaggaguuagaaaggggaacuucugaguuuggaggccaggaucgucacuauuacacuuuuuccccuggcaacagaguauaggcucuuuccaccucaaagucuuggagcagagcuuuaaaagguaggugggauuccaaauggcagagacaugaaggagaagaaagugggaaaugaccaagccgugugcucugccaugcauuugcuguuaauauuugcagugcaguauucccgucaacacagagccaguaucuuuugcaauacuaaagaaaagaaaaaaagaaagaaagaagaacuagaaagaaaagaaaagcaugcucagagugcccugugagacucacaaacguucugcugaaggaaaagcuauccaaggcagaauuugucgaaauuaaaauuaacaacaaaaggaaaaacuuugagaucuauuccuagcugagauauugaacagucaacaacacuuaaauuugacuuugauuuuuuuaaaagaauguauguuguuuugaauagauauacuuaaccaacuuuugcaagcuucagaggaagcuaaaauuacguuaaucgcuuccucauuuugaauagacuccauucuguggaauuccaaaaguaucugucaccaaauuuaccuguguuacaugaacgcuguauauuuuacacaguaaagaaccccaaauaccagaaaauaccugcaaacauuugaguggccaacuaagcacucucuaaaauggguuuaauuucuaguuacucaugggcaucuggaacacacccuaagcaggucauugguuuugguuuggguuuucauccaagauauguaaauuuuccagugaaacucuucuuaauugguugauguguuuugagcaccauggugcaucuccuagggagcaaagauaguuuguuucuuugaccuuauaccagggauugaaaaggcacauguacagggaacugaaauuggcaucuuaggggaucccacuaagcuccaaguacuucacuggccuuuuauauccccacaucuccgugauccaaaugucagcacuuggaaaagcagguagaggacucauuuguuccagcaguaugguccuuccaaggccaacaacuaaccacuugguucacuggcuggagggagagaggaacgguggggacaaagccacauguauggacaaauggauaugaagaacauguuuccaguguuccacaauacacaaaugaaaagaugaagagagaagaggagcagaggcugugaguguggagggaaaagagugagagggggaggggaaggugaggaaugaggaguuucaugugaauaccuuacacaauggcagugcuccaagcugaucguggugacagcugcucaaaucuuugaucauaccaagaacuguuaauuguaauuuuaagugggugaacucuaucaugucugaguuauagcucaaugaagggauucuuagaaauaaaaauguaaaauccuacuauagacuaacaaaucagugaaauaauuuuguuaguuuuaaccucuauaugguaaaacacuugcucaaguucucuccaaauggaauuuguugauucagaagaaacacucccuguguuguccccauuugaaauaaucccaauaauuaauuccaaauuaucaauaagauuaaaccagcaugggguuuaaucuuccucc

SEQ ID NO: 2437 - RNA, 910 nt, Mus musculus
agucucucuucuuuuccggcuggaaccauggaggcuguuccagagaagaaaaagaagguugccacugugccaggaacccuuaagaaaaagguuccugcugggccaaaaacucucaagaaaaagguuccagcugugccagaaacccuuaagaaaaagugaaagaauuucgcagaguugaaggugaagcgccugaggaagaaguuugcccugaagacacuucgaaaggcaaggaggaagcucaucuaugagaaggcaaaacacuaucacaaggaguacaggcagauguaccgcacugagaucagauggccaggauggcaagggaagcugggagcuucuaugugcccgaagaaccaaaacuggccuuugucaucagaauccgagguaucaauggaguaagcccaaagguucggaagguucugcagcuccuucgucuucgacagaucuucaauggcaccuuugcuaagcucaacaaggcuucaaucaacaugcugcggauuguggaaccauacauugcauggggguaccccaaccugaagucaguaaacgaguucaucuacaagcgaggcuacggcaaaaucaacaagaagccaauugccuugacagauaauuccuugauugcucggucucuugguaaguuuggcaucaucugcauggaggaucuaaugcaugagaucuauacaguugggaaacgcuucaaggaagcaacuaacuuccuguggcccuucaaauuauguuccccacgagguggaaugaagaaaaagacaacucauguuguagaagguggagauacuggcaugagagaagaccagauaaacaggcuuauuagacggaugaacuaaggugucacccauuguauuuuuguaaucuggucaguuaauaaacagucacagcuuggcaaaaaaaaaaaaug

SEQ ID NO: 2438 - RNA, 56886 nt, Mus musculus
caguuccuuuucacuuccgggguugcucuagauccgcugguuccguaacaacaucccguuggcuucccucaggcggcgggaccuguguagccgccuuccucggagcgccugcccgccugggcucgcgggcuccccgguccgggacgccauggccaccaacccgcagccgcagccaccgccgcccgcgccuccgccgccgccaccgcaaccacagccgccgccuccgccgccuggcccuggggcuggcccgggagcgagcgggccgggaagcgcgggggcuggugcuggggacccgcagcucguugccaugaucguaaaccaccucaagagccaggggcucuucgaccaguuccgcagggacugccuggccgauguggacaccaaggugcggggcuagagcggcgggcggcgcggggaguggggucccgugugcuccgaggggcgacuuccccgagccggacccucgggacugucuugcauacagggcuccuuuugcagcugcuucguuuguugauuuguuuguuugcuuguuuguuuguuuguuagacuugcggcggugugccaugcacucugcaagucuuggaauguucauucauuccccugcccuuguguuccuuucuccggcuagaaacacuagccuggaaugccuauuaugugccaggcaaugcuuggccuuagcuaguauaccacugugguaagcaagacccaagucguuccuagggagacugguuuagaagcacuaaggcaaacgggacucgguuuagaguucauucuuuuguuuuucgagacaagguuucucuguguagcccuggcuguccuggaacucuguagaccaggcuggccuugaauucaaauccgccugccucugccucccaagugcugggauuaaaggcgugugccaccacuaccuacuuacuuuuuucaccuaaauugguuuuuuuuuucuaccaaaaguuucuucggcuuguaaaugcaacaaauguagcguuugcagauaucguaaaacgguaaggcaacgauuuacaauguauuuugcuggauguugaggggcgggugaacuugcaaagguagagaggcaaaguugggcagagaaaaaaaguggguugggagaugggacugucguuugaucuuuugcaauggcugccuggcuuaguaguuuacuaagaugagaagaggcagacagacagacagacagacagagagaaagagagguauagcgcauggagccagccauuccguuggaaaucuguggagaggaaaugacagcaacuugaagugaaagaaggaaaggggaggggguguguguuagguuauauguuaggagacagaggacagagaggcaagggucagcagaaagguucccuaaccaagcagaaggggagggcugcaggcacccagcaccgacguggaagcgagcuuuagcagggaaacugucaucuuggcagcaagccaagguugcaggacuaagucagugaaguuggugaaaagcuaugaaagugugucuggaagcaggcgaagggagagguguugguuccucuugugggguauuuguugcuuucauuugguuuuguuuggggguuuguguaucuguuuacuuuugcuucaguguggguuggucuguuggauuggaguugugaugauguaagguuuuuuucagacuggcagaucugaaugaagaaccuuuaaaagaggggugcuugcagcaucugcauauccuugagcuuugaggucaccagcacacagcucugucaucuccucuguaauaaguccuccgaacaaccugaggauaucuucuccaaggacucugguccugggcccguucccguagccuuuccaaaauguuguagguuuuauucacagggacuucaauuaauugaauguguauagguaguauaaucuucccuugcuuagggacuaucacggccauauuauaaaguccuugcuguugccuuuugaaaaguauuuuaauaggaaaauauuaggcauggucagguaaauguuuccccauauaaagcuaguuguuugcaagcaacagguggguauuacacuuugauguucuuagaaaucuguguguuuguuuugucacuguguauauuguguauaauaaauuuaauguuuuaauauuuugaugacaggugcaguuuuuacaauucaaccuguuauuuaucucaucuccauuaaauauuaccauugucugugguaucccugcccaaacuucuaaaaguagauuauuaaaauguuccuugggugaaagaagaaaaauugguauggcaguguaaggaaagcuaggccuuucucgucaaaagugcuguuuucaauaguugacaguaguugacuggagguacuuucaugugguucaaccuugugcuauguauagagagggaccacagaauguucuucuguagauaaaaagcuuacgcuagauaagaguggaacagagaagacacucucuucccagagagcagcacagcggggcauaguugcugaaucuccucgauaaucauuccuucucucuuccccuccguaccacuguuucuacccccccccccccaucuuccucacccuuagauaacagauguguugguuuuaacuuaaaauauuuauaauuaaaucacauuucuauuuuuccuaauauguaaaaugcaaaagaauacuacuuaggaauguagcauuuauaacaacacaaugaguaggccaaaauagagguacuauucccuacucauauaaaggacugucacuuuaauggaacucuugagucucaucugccacuuguaggaaguaugguauucuucacaacugaacaugaaagacuggccugcuuuccaccugaaagucuucccugugguauauaggcuaugaacagucgguggauugugucaggcacauacauguguaacaguagcaggugcugucuuagacagucuuccauuccguguguccacaccagggugagagguaccagugucuacuuccacuccuggagccaacaaacauaacucuccugguaggccuccagugguccugaagcaagaguguuucuauggcagauugacuaucauucuugaaagagcuguagccuuggacagcuccaacaucuagcuacuccacuaaggcugcucuuucuagacaacuagucaucaggugucugacucaagcuguguggcuugaaagccauccuggccccuuuuuauugacuauccacaggagaaugaagagggacaauugagaggcccagcauuguguccuagacaagaaucugauggaccaagaaaauucagccucaauuuugaugacuggugaagguaguuuuggauacuuucacaauuaugaauggcuucuggucaguuaguucauggaucaaauaguauucauuguucaaaucuuacauaccagacauuuuagaagcuggaaauacaacgguaaacuagaguucugcugcuucacaguucauccuagcagaggaaaaagaaaguaaguaguguauaaucagcucugauuauacaaaagaauaaagcaagaagaacaugagcaggccuacuguuuuguucuggauaagguuucaauuaagauaauauuugagcuauccuugaaggaauugaaaaaaauggaugccuuccaacccuagagcagaggacgugccaaagaccugaggcaggacugcugagagaggacagugggccccuccacacauauucuaaugcauugugaauucauuguuuaggguuuuucuuguaguaagaaguuagugaguuuugaggaaaaguuaaugaucugacuuguauuuuagaagagauaauaauucuugaucuacuuuggacuuaaaauguuuuguaacccugauuuuuagaagauuuaauguacucucuuggaagauggaguuuggcgugggcaagcaggaaugucaggaugugagaagccuuggggcauggguggaaaagauaguaggaaaugggucugaauguccucugaugugucugcuaggaccugcagacuuugcugaccagaagaacuuguugacuuugaauuuaagucaggagcuugcuauauagugcaagcuggccuugaacucacuauguaggcagaguagacugugacauugcuguccuuccuccuugcaaaugcugauuacagacauggaccaucaugcccugcuagugggaaaaaaaguguaaacaagaaacauuuugggggggggggugaaauuugaauuuauuuugaggggacuaaaaagcuaaauguauuuaagucuaauaaaugcuuauuaaaagaagaaauacauguuauaaauguuagaaagaaauuuucacguugauuuaggguaagugaagagggccaugaauaaauaauugggugauuuuccugggaaagagaaagaagcaaaacuugaaaauuagaagugauagaagagcaucucauaaucuccaauucuagggagguaguuaccuaguuaccaaaggacaguguguaaucacugagcugccaagcaguguggacacgaguguguagacauacagugcccugcgagaacugcugagugguuguauguauagaagacgacaggaguggaaaggaugcaagcucacuuugggcgccagaaugaccuccugauuagaaugagagcucuaagaugagaauuuugucaggcggacagcuagagagaaugguuaggugagaauugguuacugggauagcaccuuugacaggagggagggaggagugguaccgggugaugcugcucuguuuuccauaaaauccuuccacucacuuauauugaagggaaaaaagauaagcaaagauaucccuggaugaguagaugaggggacugauguagguaaggacccuuuuuuuguuuuguuuauuguauuuugguauugagacaugguuucucuguguugcccugacuguccuggaacccagagaucuaucugccucugccuccugagugcugaggauuaaugguacauaaaccacugcaacccagucaaauaguccaacuucuuguuuguuuuguuuuguuuuguuuuguuuuucaagacagagcguaccucuagcuguccugugaaucauucuguagagcaggcuagccuugaacucagaucccaaguguugggacuaaaggugugugcccucaccaccauuucuuaaauagaaaagacuggaucuccuuuucaucuuccucugcuuuuuucuuuuucucuuuucuuuuuuuuuggggggggggcugguuggggggcaguguggagaacuggggagguaggcuuucuaagccuuagacagugugguuacuuguagggugugcccugagcugugugcaguauuccugcucgcuuuccucaguuauaaucuaacaugcuuuagacggugccgaauccccguugagggaagagagguuaagacugcuugagaacuacuuuaccccagauacaguacaugguucaguggucuguuccugaguaauuucucuuaagucuguaacuuccaccucaucucuuaccaccgcagaccuucauuauuuuaguuauugcauacuuuuccaggugaguuuugugucuacuuacacucagcuguugaaccacuguguucauaugugaaaugaauucccauucucaaaccuccuugugcaagcaccaagucccagucuguuucgagcuucauuucuguuguuggacucucuucucuaacuacauuagaauacagcauaugaguuuucauaguacuuguagcauuguuagcauuauauuuuuuuucuaguccaaugauuccuuccuuuuguuguuggcucuguccacaaaggucauucucauuccuggugacaucaugcaacuuugaaacuaauuuucccuguaggucauaugucacauucuuucucaggacuucuuuccucccucucuuuguuuccaggccucuaacauuaacauuuguguuuugcuucuaguuugucuacaaaaaggguugucuucuuuauuuuaacucuauuuacaaacaacuugucuuagauaaaacaggaaguauuuguaaauuauaacuacgaagcuuuccaucaacuauaacaaaccuuaggacuauuaaauauguuaaaauuauugaacugauuuucauuauuguaugaauuaaagguuucuagcauuuguggguuuuguuuuucuuucuagccugccuaucagaaucucaggcagagaguugacaacuucguugcaaaccacuuggcaacucauacauggaguccccaccucaacaagaaccaacugagaaacaauauccgacagcaaguucugaaguaagucugaguuaggggcacaggcuagauuuaaaaugcuguuguuuacuuugucugaaagcaaccagaaauacauucuccucaagucagcaguuuuggaaguuuaaugugacuuaguccaguauauuuuggaguaugaccucaucauuucauauuuccuuuauaaauuuuuacucagcuuuuccuguagacuuagagagguauuuaaguauuugggaaaagaaauagcaugacuuaaaaaaaaaaacacaucagaaagaucucuauguaaauauuaauggauguaaaugcuauaauguccuauccaauuacauuaaugacuauuuucuugucuaacaauuagaacguacaugacacagcucugaaauuuaaaacaaucccuugguuguacauguugucuucuaauauauaguauguagcuaaaugaaaguauuuugauuuguucagucauuuuugcaucagcauaagacacaaagaauaaaagcugaaauauuuagaaagucuggauuauuuaccuuaaaaagauugugaacuugguuuacagucuucugcuuguuuuuggauauaaauauuugcuaagacaaaaaagucuuucuaucccaguuauuuaaagaguaccuauucuuccugcuuugacaaauauuuauacuuaacauuuguaaaguguggcuuuaaacaggugagcaguuuaacucaagccuauguaguaugauaguuccaagccauaggaagccccagaaauaaaaaugcucuagaaaguucauuuaacccccaaguaaugcuagaaacccagagccaggaagcuuaaacugugucucccuguacuuaagaaaaggaaacagcacuagguuucuugacuguguuuuaaaagcuguuugagaaccuaugaaagagucuaggugagaucaaaagaugccauuggaaggcugcuuaacgguaccucuugguaaaaagucaaagcuguuuccugaaaagaagagacuagaaggagucuuuugaguggcaggccaagaaggcuccuuauuuccacagaguagaacaucaggcaaaggagcacagggauagcuaccagccuucuacagaugauugcuuugcuucaucaccauccuguuuagaagcucuugcauccuucucaggagaaggguaucuuucucuuuacagugaugauccaguccacgggauccagcaaaucuugcacuauuuuauuauccaguguugacagucucaagaagaacaguuuucuggaguuuuauuuagacuuuaguauacagaaucucuaagacaaggacugucauuuuauuuuaggugagggaaaugugaaaagucaaucacuuacaacccuaguacaauaaaagacaucuugaccacaguuccugccugguaaaagguaaggaagccaaacauugcggcagcagugagugaaggaacccuguggugagacuagagacugggaagggaacagcuguauucugguaacucaccagccacucuucugagacuucuauacauuguccccuuauuaccuuuuggguauggaggccaaagaaaaucuccuucagaggaauccagggauucaacucaggucauugggcuuguacuacaagagcuuuuaaccacuaagacaucuugcuuauccuauuugcaaagcuuuauguuagaaauaguagcauuuugaaguuuuccuuagagaaggauuuuguugcaguugauuuuuuguuuguuuguuuuuuucuuuguuuguuuuugagacagggcaucucuuuuuuguuguuuuguuuuuguuuuauugagacagggugucucucuacauagcucuggaaguccuaaaagucauucuguagcccaggcuagaaacucacagauccaccugccuuugccuuaugaggagauguacacugcuauguccagcuuagagaaggauucuuuaguuguaugcaaacuagaacugcguggauggacuagcccuauaaauaauuguaaucucaagcagguuuucacacacacuugagaaaguacucagcugacuuaagccauugcaguugccauuucuauagaacaaaugccuacuaccagcaacuuaaagugggggaacuuagcuuauuuucuuauucaggagaaaggaaauuuuuauucugugcauguauucaugcugcaaaaucuggaaauacuggauagcuuucaguaaugacuugggcaggauuuuaaaagagaaagaaguggauuaguuuuacuuaucuauuuaguuuuuuccuccaguauuggggguggaauccagcucgucauacaugcaaaaauaagcacucuaucgcugagguacuuucuuaaaaacaguagggucucaguauguagccauggcucucauauucuauauguagccuagauuggccuuggacuagaaugauggaauuacaggcaucuaccaccuugccuggauucagcccauuuugguuuguuucuauuuugagaaaaaggcucaauuugugcaagauggccuugaacucuuacccugaaauuuucccauugcucaggccagucauaaacuuguguuuauccugccucagccuccuaagugguugguauuacagacaggcacuaaccaggccugcagguaaguaacucuaacagcgaauguaucuguugucagauagacuuuaccuaugggggcugagacuucucucugaguugcaguuagggaauaccccaaggcagggagucuacagaacaguagaucaguagacccuauuuuuacauaagaucuuccuccaugagaaggaagacuacauuuaagaguacucuuguuuacaggacaagaagccaaaaauauacgcaaacagagaaggcaaccgaagcaauauuuugggguucaguagguuuucuucuuuaauuuuaugucuuuguacuuaugccuuacugcaaaacuuuuuagugauucuuucugcuacauucgcaacucaucuuuaaaggggacaaaaagagcuuuaagauacagcaguguuuucaggauuugcauucuguucuuuaauuuuauaacuugaaaaagcagguaaccuacuuuguugcaugucagcucauuuuucuuuaugucccacauaaauagaauuauguuaucacauggcuucaaagugccuugggaauugaaaauccaguccacccucacuucagacagguacacucaaaaacagcauuugacaguauaaaggucaacaccuccuacccauucucuccagaaagaugggggucucccaacacuguccugugcacuuugauuccuccuggugcaaucuacgaagaaaugugaucuuaagucuguauugcucagaugccauuuuacacaagugcuacuuaaaacauguucuugucacuccucugucuguccucuuagacuuauagcccccuuccucccucccucuuuuauacacagcaagacucagcuccaugacuucucuuuguggaguguucccaccuuauugugaacacagccaauaauucuuuacucuucucuuuccccacaauacauuguguauguuaaugucuagccucuuguauuguaauuguaucuguaucuuuaaccaacacagggcccaggcucaggucuggucuauagugccugguggccagcauggugcauuuuauguagaagacauucauaaccuaccucuuuaaaugacuaaaucauccuauuuuauagcaggaaaguaauaaaaagaaagccagacaucuugaguuuuguuuuuauuuuucuuguuucuuguuuaucaauuugaugaaaauauauguuguguauauuguucaccuuaacuagaaacucuaagacuuagaaaaaguuuauauuuucuauuuuuuaagaagaaaacauuucagagucaagagauuuacuaggccuggaacucaucucucauggaauccucuuauguuccagggauggagguugagagaggcacgaccucccuuauucucuguaguacugcagcuacuccagaggccuuuuuguguuuuagucuuucuaccagcaaugcauugggggacaguuuacaaaugucuuuguaguauagcauacuuaaaaccauuacuguauuaacuuucccaaauagagucuugaagacauauauaauagacacuauuuucuucaaaauaauuugugcaaauaauaaaguuauuucuuuaccuuccugugaauugcuuguauuucagaucaggaaugcuggagucugguauugaccgaauuauuucucagguuguggauccaaagaucaaccacacauucaggccucagguagaaaaagcugugcacgaguuccuggccacauugaaucacaaagaggaagcugcuggcagcacagcuccugaugaugagaagccagaaucuucugucauuacccaaggugcuuugcuuucccaggcucuucuuguucugacugccuggauagagauguuugguuuuuaauacauugcuccuuuugacuacuuuagugaaauuauaugugcuuucaauauugcucaaguucccuaacuagcaugacauuucuauuuugaaguuaauuucaaaaaacauuauaauaauggugagugugugugugugugugugcacacucgcuauaagagagaaugucacugaaauaguaaaggcauucuucucacaacuggaauggucucacauguguuggcaucuuuccuauaagacacuauguacuuaggagauagaaauuuuugaguauguguacuaguuuuguaccugaaaagccuacaggaacaugcauuucugcucagcuuauaacaguaguguguacugucagugaaguagagggaucuacuuuuucauacauuuauuucuuuuuuuauuuauuuauuuauuagguauuuucuucauuuacauuuccaaugcuaucccaaaagucccccaugcccucacccccccaacuccccuacccacccacucccacuucuuggcccuggcguuccccuguacugaggcauauaaaguuugcacgaccaaugggccucucuuuccaaugauggccgacuaggccaucuucugauacauaugcagcuagagucaagagcuccgggguacugguuaguucauauuguugauccaccuauaggguugcagaccccuuuagcuccuuagguacuuucucuagcuccucuauuggggccccugugauccauccuauagcugacugugaccaauuuauucuuaucuucuccuugaaggugcuccugcuccugggcccagugcuaauguagccagugaugccaugucaaucuuggaaaccauaacuucucuuaaccaagaagcuaacgcugccagagcuucaacagaaaugucaaaugccaaggucagugagagaacauccagaaaacucucaucucagccaagcacugacguuagcacagacaaggagagaggcucagaagaugcgacugagagagaaaaggcuaccucugauucuggaggagaugggcuagaagcugcucucaagucagaagaacccagugaucucccuuguccaguggaagaaacuaaaaaucauaugaaagagaauaauagcuuacuguuacuaaguaaggaugcucagcaggaaagcacugacccaaaaauuaaaucaauggacaaaggagaaaagaaacccgaugguaaugagaaaggagagagaaagaaagagaagaaggaaaagacugaaaaaaaaauugaucacucuaaaaggaaugaagauacacagaaagugaaagaugagagacaagcaaaggacaaagaaguggagagcacaaagcuuccuucugaaaagagcaacagcagagccagggcugcugaggggacaaaagaagguacaugcacaaggccgcauggcuucaagagggauuguuccuuacaggaagaggacagugucacguuuggcuuuugauuguaaugauuuauuuugguguuuucaugucaaaacuugaaaacuuguaaagcaauaaaaguacuacgcugugcacgguggcacccagcaguaaucucagggcuggacaugcaugccuaguguacaguucaggcuagccugagcccaaucauucugccucaguuggccuucuuaacuauacugaugugucuguugacaaaagaaaguuuacagaaaagcuauaaacuucauaauuuguauuaucauuuuuuucacacuguuccaagcaacuuaaauuguauaugcuaaucuucaaaauacuagguaguaauaauaauaaucgguuacuuaaaaucuacauuuguauauagccuuacauuauaaaucaauaguuuuuauaguucaaguaacuauuuuaccuuuguauuuuacuuauauagcugcuuuucugauaguuaaauuuccuguuuaaagcaggaaauuuuuaauauugagggcuuaggcuuuaaauaccuucuugugaucaguuguuuauuuugcuucauuguuuuuccuuaaagauuguucuuuguuagauucugauguggauggucucacugauaucacagucagcucuguccacaccagugaccuuucguccuuugaagaagacacagaggaggaaguugucgugucugagagcauggaagaaggagagauuacaucagaggguaagggugauacauuuuucucaaugucucugugacagugcugguaagcguuauuugccuucuguucuaauggcuacuuccugacuaugguauagcuagagucugcuaccuugugauuguaagauuggcugcugguugagcugcaggguugucugucuaguuauccuuguacauguuaccagcccucaacaagccuacuuuuccaugaucaaccccaucauuugauguuauugcaaaguugagaggagaugguguacauagagcugcuuuuguuugugugugaauggugcuuggugaauacaagcuggaaggcuguccucacuucuaccaccaguuacaaauuugagggucauaaagagcacccuuggaaaaacugauuuccuaaaaggcauaacagagugcaccaaaagcagguauauuauacuagucagguauguuggcuugugcuuagaaucacagcaauuagaaggcuaaggcaaaagaauaacuguuaaaacugggucuauauagggaguucuaggcuauccugcuaguguagugcucugccucaaauaacuacaaauacuggucuacucaauauaguugaucaagcuaaggaacacggucaaaucagagaaaggacagugugcucagggucaaguuuagaaacuuuuccaaacgugagcccucuguauguccucucuggaacuguaggcaacuugacauccauuucuauaaucaggauagacuaugagaacccagagaaguucacuagaacuuuggucugaaauucuuauuugggcuaaaggauauagucauagugacccuugugccucuagcccuaagaggucuugcugcaggacugaaucccauuccuccaucuuaacaauaguagacuuugauuugaccauaaaagaaccaggaaagcagaaacacaucagucaaguacaguaucaugagagcccagagaugaccucucagaagcuuagggcaaaugccagaucucucugagcaaagcugaaaucguuguuauacaguuugcuugucagcugacccuuccuaaguucuuacuggguuccagagucugugcuaaugucuuucuguuucuuaacuucugcagcucuggaaaggaggcacaacaaagggaacaaagucuugaaguauauccaguccaaagucacauggccacugagcaccagggcagaauucaaagcugagucugcauguagccaguacaugcugcucuuugcucugacauaucuugccagugggcaacaucuuuuacauuuucugcuagcuuuguauaggaugucuaggaagaaacucagcgggggaguagagccuuuuaacuccacagauacuuuucuuagccuuuccuaucuuuacauuuuauggguauguccaggagaagaaaguuauucagaauaggagcagcaguguacacuagcuaugauggugguccuuacuguccagcccgugugggaagacgagucccuacccugugaucccugugcuuuuucuaugcuuuggggucugcuaggcugcuuucuuuguugggguuagauuuucuguguacaugcucuaaauauaagaaguucacuaagaacaauaaguaauaagaaaugaaaacauuccuuuuuuuccgccuuuauacugugucuaguggaaagauugccuuccuaauguagagguguuaguguaaggugugugugauugauuccuaaacacauaacuaggcauuaagaucucaggugugaucuggguguggugguguacacuuuuaaucccaacacaaugggaggcagaagcaaguggauaucuguaaauuggagaccaguccacauugugaguucuaggacagccagagaaaaauagugagacucucaaaaaacuaaaaacauaaggaagauuucaagugugcuuuaaaguauaguuucaagugaauuucuucaacuuaacagugauaaaaacauucauaucaaguccaagaacuauuugucaaaauacauuguuuaaaauaacugaugggaggaacaguaaguuaagaugguuccagcagcuucaacuaagugggcuccugaauuaauaagccagaggguaaacgguaaaaggagacuuaagcuuagacuggcagagaccaccuaccguccuccgaguggaugcuucccaucagaucacaagcagguaaaggccuagcggaagcacagccaguguguacuuggcuuccauguagagccuacagauccacccugcucuaggggcagaguggagccuuugccucuuuaguucugagccuguccugcuucugcccugcucugugcaacucuccucuacacuucuuuugucuuuuaauaacacaaaugucuaacuuggucugccucuaugugugaggugaacuguaguuuuuuaaaugucaguuucuuuucucauacagacaaccccuuuggaccuuuaaauacauuugaaguauauuaguaucuuuugcugcauauaugacauguugaugcuuguugacagaagcacuuuuuauauuugcuucuuuccagaugaagagaaaaacaagcagaauaaagcaaaaguucaaccuggugauucuagugauggaaaagccagaggcguacggcaugcuuauguucacaaaccguaucuuuacucaaaguacuacagugauucugaugacgaacucacaguggagcaacggcggcaauccauuguaaguccaguugaucacuugcagauuuagagugcuucuaaaccuuccuaaugcugcaacccuuuaaacacugcucaugcuauagugacccccucaccauaaaauuauuuucuugguacuucauaacuguaauuuugcuacuguuaugaauuauaauaucuuauaugcaaccucugugaaaguauuggucaacccucaaagaagucacaagccacaacugugauuuagccaacuacaacagauugacaaaauuugaaugguagccugugcaagguacuguuaugcacacagcagacauggucuugcccucagggagcuugccauggaacugcauagaauagacacaaagggguaucauuguuacuaacgaaagugaaaaaauguaacugucugcuucauauuguaaaagugcuuguaucccugugacucauuucaugcagagauacaguauguaaggaguauaaggaaauugagggaaauguaguccaccaauuuucuagguuugaaaaugcuuccaauugucaaguaccauucaauuauugagugcuuuuuaaauaaaauucauuaguuuuuaaauggcuuacaauauaaggaacauaaaaauauaaaauguuucuuaugucacaauuagggaguuuauagaaauaacuauugaagagaacacuauaaaaugugauugcuaguuagcuuuccuuccaggcuuagcucuuagagaggauauuggauaggacuuaugcaccuguuggguuuuuuaauuggauuuuugaaaguuuggcuuugagcccugaccagaaaggggugguuagaauaacaaaaugauugugaauucucucuaauugagauucugccaacagaaagucccaaggccacgguuuaggcccaggaguacaaccaccaagucagauuagcuguagaauuaccugccacuugaagcucugaagacauacccacugugcuugguacuuaugugucuauagccuuuuccucccaucacguuuucucagaucacacuuuuuccuucaaaccaauagcauucuaaaacaauaaugacaauuuuccuaucugugccucuaucaucuguaccuaggcacacacaguuaaugucuguuccucuuuuuuuuuuuagauuuauguguauguuuugcuuguguguauauguaugccuagugccugcagagguuagaagguguuagauuccccuggaaguggaguuaaugaugguuguuagcugggaacagccugggacaucugugagaacagcacgugcucuuagccacugagucaucuuuguaaccugauauaugugugcuucugcauauucuguuaauguguaaaaacaucagaagaacaaacuaaaacuuugucgguagggacaacuuugaguacaagagguuuacaacccaaggucucacucaagugugcugagccagaucaauaccucggagagguacucucagcuguuuucucacauaaguucuuucagagugucuuggcuucuaccugauaaucuacagguaauuuuaugguuuuaggcuaaagaaaaagaagagagacuuuuaagaagacgaaucaauagagagaaacuugaagaaaaacgaaagcagaaagcagaaaagacaaaaucuucuaaagugaagagccaagguauagcggacauuacuuuuauuugagaguaucauauccacaccaccauuuucuaguuagucucauauugcuuguggcauaugcacauaaaaaggugcuauauaugcacauaaaaaaguuccuaaguguggaagaauuuauccugcucuacugguggaauagauuucagauagaaguagcugagcauuucuggugaugguagugcagcuagccuauaccucacaucaucuuugcuuuuucccuuuacucuuguuauuuucucugaugcaggggauugaaaucaagaccacaaacuuagcucugcccugacugugcuacagcccucaugcuggcaugcaucuggcacaguaaauacaacaaaauugaugucuguuuuuccuagcagaaacugagacucauucggagcuauuuuguguuuuauacugcguauaaaacuguaaugaaaaguaaauacagcacuguuacagaacugucuucggaacuaaagcuucuuuauuuacuuucuaggcaaaaguacuguggaccuagaagacucaucagccaagacuuuggaacccaaagccccaagaauuaaagaaguccuuaaagaacggaaaguucuagagaagaaaguagccuuaagcaaaagaagaagaaaagauucaaggugcauuuuuaccuacuauguucugauugucauauuagugguacauuuucagaagaacagcuuugaaagugggcauaggcugucugaaaaaguaacuggacaugguggggggagggggagaggcauggggucucugugaaucugaggccaucaugaucuacacagagaauucuggcacagccagggcuauagacagagacucuaucucccccccacacuuuuuacuuuuuauuuuauuuauuuuuuuaaaaggguccuuuucacuuaaucuuugcaguuugauggguugugaauuucuguguuaacaaucaucuuuugcacagacaucucuguugaggucugggaacuauuuguauauuucgguagguguacaaauagcccuggaacccuugagcucacucugauccuucugccucagccuuuccaguacuggaauuauugugugccaucauaccuggcuuuuuuagagagaggaauuuauagggcaguuugauuuaauaucuguucagcaaaauaaagguaguauguucacccuagguuucaugaggucucuaaucaugcauuuuaaaugucauuaguauuuaauauuaguauggcuaauauguauauuagucaaauuuaccguaacaggcuuguguuucuucuuguggaucaggccuuaauuccaaccagaacaugauaaauuauauucuuaauacucaugcacuauugcaccuaugagcauaucuuaccaugcugaugguuauuggagcucuuggauccacagcucuguaggacuguugaugacucccuccauccccagggaccuguuuaauaccuucuggcucuuugaaauuuacccagcaggaaagaaucuuucaaaauaguaccagcuugauuucuccaugcccugugaccaaggucuguggcguuuucagcaauaggauuuuacuaucaaguuacgcuugcaaccgagaucacugguaauagguaguauuauuuugggaaucuuugagaccccuucccaaccaauaacuugaggagaaguaucucacaccuagcacucggucuuuacuuggcaacguaggcuucuaggggaagcauuauccucugcguguccagggauagaacucaggucaccuaucuuggcaggaagcagauuuaccuaaugggccauccugcuaaccuugacauucuuaauagaaaagcaggaacugaugcacccguggggaugauuuguacuuaaacaggacagaaauaaagaaaacaacaaccugucagaaaaaaaagaaaaaaauuagucagagagaaccucacauugacuuagauguuacuaugugcuuaugaaggccuugccuuggaauuuguucuuuuuaucaucuuucauuguauugauagcuauagcauuuuaaaguacauuuuuaguaauuuugugaaaaucugacggaagcuuuagauuguaucccagaaaguguacauacaguaacauuuguccuuguucagaguucaguuucugggcuccuggaaguacguguagaaguauuuugucugggccugugggaacuacuuaguaacagagguugcaucugcucaccaggcuucucagcaccuauuugacaucaccccaugauuuccucuucacagaaagcugggguuuuggguuuuuguuuuuguuuuguuuuuuucuagcaauguauuuucauugcuucaauuauuuauugaagaauuacaaaggcaaagacacucuugaaaguagcuauguuguaaugugaaccguagucuacaguuuuacuguuccauuaaauuacaauuauuuccuugaacuuguuuguuuuuauuuuguguguauguguauuugucuacaugcauuucuguguaucacauaugugcaggagccugcggaggccaggagacaggguuggguacccuugaacuggaguuagcaacaguugugagcuguccuguggggguugggaccugaacccaggucuuguagaagagcaccagaugcuuuuagugguugagccucucucgagcccaucaugacaauucuguacauuagccauaaacuuaaagagacgugaguuacacaacucggagagagggaucaguucucagguuucuguacccuguucagauagcucugagucaaaaaggccuuccugcgucuucaaaugauggugagacauucaagcgucugcacggugggcacaguauucgcaggcagcacguuaggaacugucuuuguagcauguuuuccuuuaguucccggaauguucacgccacacuugaacugugcucucuggugacgaaacauaagguuacauugaaguguaaccagccuucacacaugaagugaauaggacagaaaagaguuucaacucucuugugagguucuuagauucagauuggaaguucauauuugauuugcuccccucucaggaauguugaugaaaauuccaaaaagaaaccucaggcugaggaagaguccaaagaagcccucaaaacaacugagguauguuguugcgguaaaucuccaacccaaauaagccugggcaaugaaaacacaacacaguuaauaugaauacaugcugugcgccuggacugggcagaucuaccgcuacacuaccaucuuccccauagaagagaccccuuagaacuugcacuuuccuucuccuccuccuccuccuccucuguuguccucucuccuuuuucucccaaaaccuucagcuccaccucccccucuuucucugcccaaucaccagcucgagccuuuauuuuauacauuaaggugggaagagguuuacaggaaaucaccugcgugcugacuuauuccuuguuuggagaagggaauuaacaucaaauauaauuagccccagggcugucugcaacacuugucuuagugaaacccuugucaaagcccuuuuguuaguugugggucauucaguauucuuuugcagcaaaacaguauaauaugaucuuuacgguauuaugucuuaaaaaccauuccacucaacauuuuuagccucuuccuauucggccugaauuaccuguuguaauggguugaugcauauuuaguuuuguguagagaguacguucucuucccuuacccucuucacccuguuucuuauauacagcaauaacacaauugucaguaagaagacgaaagagaaaacuaaaauugcccagaguagguccccuauuuuaucucuuugguuuccacauguauagaguuuuuuggaaggggaaguauucuaacaaaaaaacaaauuuuuuuaagacuuugcucacuuuguguuaccucuuaaugugcauaauuauguaacaauugauuaaucuacugaauggauacauucucaauuacuuuaagcacuggcuuguaugugacacuuaagguuguauccaaaaugugcacauuuuaaauugugaaaaucuaugcagugaauguauuucucccuguauuggguuauuuucuugggucagauuuagcuuuaacugaauuuaagucuuuauuuguauauauauauacauauauauuuucauaaucguauguucugagauagagacacuaauagcuuaguaguuguuaauaaccaguaaguuucuuuauucagaaacuagagucauauuuagacauaguccugauauguuacuguauauauuuaaauauuuaacuuuccuuugugauuuuuuuuuuuuuuuuggaacuuaucucaggaagucuugcacauguuaauguacuaaaugccaaaacugggguggagaggaaaguucagguacuuugcaucuucccagaacauaugaauauacauguauguuuaugcuuaugucacauguauaugcuuacaguguuacucaguuacuguauacauuuggaauuuuauaaauuuugcacaaauagucuaaauccauaugacuucuguaagugauuuguguuucuaaauuuuaaaauaaaauuagucuuuacuuaucugccagcauguauauuuuuaaacugaaaagaacacuguaccccaauuagcuuacauuuacuaaggacucggguauuagugagcuauagucauuuauaguauugaagacuuccuaaaggcaagaaccaguuagaugaaauaacugcucuguauaacugggaagaaugugaaaugcagagugugaucaccuagguacuuacacugcacuucuuggugccugguacuuacucugggcuaccucauccauggagcagaagugccucagauguucuagagcucacauaguagcuauacccaaauguuaaguuuguaucuaaaauguguuuucuaaguauccuuuguuuuccaacaguacugugaaaaagaaaaggccucuuccaaggaccucaggcacacucauggaaaaggugaaccaaguagaccugccaggaggcugucagagucucugcauucagcagaugaaaacaagacugaaucaaaaguagaaagagaauauaagcgacggacauccacuccuguuauauuggaaggagcucaggaagaaacagauaccagagauggaaaaaaacaaccagaacgcucagaaacuaauguggaagaaacccagaagcagaaaagcacccuuaaaaaugaaaaguaucaaaagaaagaugauccugaaacacaugggaaaggccuaccuaaaaaagaggcaaagucugccaaggagaggccugagaaagagaaagcucaaucagaagacaagccaucgucaaaacacaaacacaaaggugacagugugcauaaaaugagcgacgagacugaacuucacucuucugagaagggcgaaacagaggaaaguguucggaagcaaggucaacaaacgaaacuuucuucagaugauagaacugaacguaaaaguaaacacaagagugaaaggagacugucaguauuggguagagaugggaagccaguuucugaauacacuauaaaaacagaugagcaugcacguaaagauaacaaaaaggagaagcaccugucgucugaaaaauccaaggcugagcacaaaucaagaaggucaagugacucuaaacuucagaaagaugcucuaagcuccaagcagcacaguguaaccucgcagaaaagaagcgagagcuguucugaagauaagugugagacagacuccacuaacgccgauagcagcuucaaaccagaagagcuuccucauaaggagaggcgacgaacgaagagcuuguuagaagauaagguugugucaaaaucuaaaucaaaaggucaaagcaaacaaaccaaggcugcugaaacagaagcacaggaaggugucacaagacaggugacaacuccaaagccugauaaagagaaaaacacagaagacaaugacacagaaaggcagcgcaaguucaaacuugaagacagaacuucugaagaaacugucacugacccugcauuagagaauacuguaucuucagcacauagugcgcagaaggacucugggcacagagcuaaguuagcaucaauuaaagagaaacauaagacagauaaagacucaaccuccucuaaacuugagaggaaggucucagacgggcacagaagcagaagcuuaaagcauaguaauaaagacaugaaaaagaaagaagaaaauaagccagaugacaagaaugguaaagaaguugacagcagucaugaaaagggcagagggaauggcccagucacagaaaaaaaacuaaguagaaggcugugugaaaaccgaagaggaagcacgucacaggaaauggccaaggaagauaaguuaguagcaaacaugucaggcacuaccaguaguuccucucugcagagaccaaaaaaaagcacagaaaccacaucgaucccugaacaagagccaauggaaauugauucugaggcugcuguugaaaaugugucugaacuuucuaaaacugaggacaucaguaguaacaguucucagcaagacacugacuuugaaaauguuacaaaacauaaagccacugcuggaguuuuaaaggaugaguucagaacuuccaugguagauucaaaaccagcagcagcugugacauguaaaucagggcguggacuagcaguaacgagcauuucugaaaggcaugcugaccauaaaagcaccuugaccaagaaaguacauagccaagguaacccaucaaaagcagcuccuagggaaagagagccaauucagcgaggagcccaggaaguaaguguagacucugaagugagucggaaagcacucucuagggccccaucagaaaacgagaaggggcagaagaauuugaaaggcauguccaaaacuaccgaggaauguggcacucacagaaaugcuucucuugaauacucuacagacucagaccucuugucauccucaggcucugugacuguuguuccucagaaagaaucucacaauucuaauacaauuccuguaauugacagagaagccauaucagaaggcggcagagccaguaccucccuugcaaaucauucugaugucccuaaccaauauucgacuguuaagaagucagaaguacauaaaacaaauggcagcaaagaagguaaugauggcuucacaguggauaugccaacaaaagcaaauggcgguagcaaaaggcaucuuucugaagauagccaggccacauugcuguacaguaaagaaagcaaaauaagcauaccucuugcugacaagucaaugagugugacuggggacaauaagaacauuaacaaacaaaggagccugaugggcacagccaagagagagagugaucugaaaguaaauccugauauaaagcaagacagugcugcaggcgagcaugucguagaccugaguacaagaaaggaggcugagacagucagacguaagcauaauaaagaaauaccaacugauguugaaaggaagacugaaaacagugaaguagacaccagugcuaggcgcgauucugcuccugugccacagcaaaggcacgggaaaauggagaggggggcagcuggaucugguagacgagacaaagcuuuuauugcuacuaguacugaagggacggacaaaggcaucauguuaaacacagucaagacuggagaugccaccaccacuucaucagaagugggagagaaggggacagccuuaccuugcaccaguauugaggcggacgaaggcuucaugaugggugcuugcccuaaaaaacauccccuccagguuggggcagaagccagugaaugcacuguuuuugcugcagcugaagaggguaaggguguugucacagaaggauuugcugaaagugagauuuugcuuacaagcuccaaggaaggagaaaguggagaaugugcuguggcugagucagaagacagaguagcaggucccuuggcugcucauacaguucaagcugaagccaaugugaacaguauuacaacagaggaaaaagacgaugcaguaaccagugcaggcucugaggaaaagugugguggaucugcauguacaguugaggggacggcuacuuuuauuggugaaguugaaagugauggagcuguuacaagugcuggaacggaaauaagagcaggaucucugagcagugaagauguugaugggucccaagaaaauaggauacaaguugguccuaaaaaagaaacagaaggcacugugacauguacugaaaccaaaggaagaaaugauaacuucauuugcuugguaacuagaguagaaacccaagagcaacguguaguuacaggugcagaugugguccaaguaaaugcugcuaaaccccaagaggcaaaugccaaucaaggagaugguucuggaacugauggugcagaaggugagagugcagucaccagcacaggcauuacugaagaagauggggaagcaucagcaaauugcacaggcucagaagacaacagggaaggcugugccauaaguucugaaacagaagaaagugcagagagugccauggacagcacagaagccaaggacauuacuaaugcaccuuugguggcugcuggucccugugaugaugaaggcauugugaccagcacaggugcaaaagaagaggaugaugaggacgaggguguugugacuagcacuggaagaggaaaugaaccuggacaugcuuccgcuugcacagggauagaagaaagugaaggaaugaugguuugugagaguggagaggggggugcucagauuggcccuacgauagaccaugugaaugcugaggcuggggcagcaacugugaauacaaaugacaguaauguugauaguaugaguggugcagagaaggaaaucaaggacaccaacaucugcuccagugccaaagggauuguggaaagcagcguaaccagugccuuggcaggaaacagugacaggccaccaguucuaugugguagugaggguccuauggcuagugcaucuucucaccacagugauagucagcuuaccaggaaagaaacaguagaagauacaacuauuuccacugguuuggugaagggcagugaugauguucuugugucuggugaaguuccagaaugugaaguuggccacaugucacccaggaaaaaugaagagugcgauggccuuauggcuucuacggccaguugugauguuuccaacaaggacagcuuagcagguaguaaaagucagggcaauggcuugaugauuucuacuaguacaaaugcuugcaccccucagauaagugcagucauagaugugagaggagggcauuugagcacucugagcacugaagaaauuagggacggcgucagaguacacagggaaggauucgaggcuccuaugcccagugcaguuucaggugagaauagccagcucacugcuagcagaagugaagaaaaggaugagugugcuaugauuuccacaagcauaggggaagaauucgaacuuccuauuucuagcgcuguuacagucacaugugcugaaaggcagcaaccaguugcagcaguugaggaaagcacuacagguccagccuugguaagcaccgaggacuuugagguaccuaugcccagugcucccacugaagcugaaagcccucuugccuccaccagcaaagaagagaaggaugaaugugcucucauuucgaccagcauagcugaagagugugaagcuucugucuuugguguaaguagaaaugcaccaucuguuacagaugggaaugcagucaucucaacaaguucaguggaagacugugaaggcucuguguccagugcugucccucaggaguccgucugucccucagucauaccaguagaggaaacaggugacacugccaugauuuccacaagcacuucugaaggacgcgaagcugucaugguugguacuaucccuacagaugaugaccaggccaccacugugagaggggaagauuugagugaugcugccauuauuuccaccagcacagcagaguguguguugacgugcacuagccuaagcaggcaugaagagaaucagcaagccacgcacaacccagaaggaaaugguggacauuuagcuacaaagcaaaguaagugugaauuacccaugcccagccucguggcugagcguaauuguaagugcccugggccauucaggaugggcaaaggaguagguccuuuaauggcaguaggcaccaggggggagcaugacaggcugccagucugugagcccucagugggacaaggccagccaggcacugcuuugugcuuaggagaggaagaaagucauggcauggacugcccuggucaagaccucaaugcaaaagaaagaaauacauugcugagcucuguucagagggagagcaaaagugcagaggcagaggcagcaggggacaguagcacagccaggagaacagugagaaaggacucagagaggaaugccaacucacugucugagacaaacugucugagagaaccagaacagaagccugcugaggacaccucuggcaguacucacugucugacagcaguaaauccuggugcugaagcugauggcaugcugcccaucacacaugcugcauuggaguauccugaccaccaggaaccugagagcaacuugaaaacuaccaccaaauguauuacaggccaagagucacaaaugccuucuucccacacaggaguccuuucagcugucugccauguagcuccaugugcuucagaacaggaggggggcuugccuacaaaaagugaccacaguggcacguggacuagugaagggucgccugagaaaaugggacauguugcuggugcaaggcagucauuccacagggaaggaaaccuugaugucacucuuccuccugaggauaaugggugugguguaggugagaguccauuuagaauugucuauucuaacagaggugacuuuauaacacauccugugucuuaaacauuaaaacuagaccauuacucaugggucaguauagaagagucaggaggcuaaggggaggcaucuaaacauguugauuuucaugacuggcaaguuucugagcuucguccaucuuaagaucuguuuguccauacuuuaauugguugguuggguauugaauccuggaccugucacauacucuacagcugagccauauacauuuccagcuccuauuuuuauuaacugaguuggcaauucaaguaagaugcaauaauuucccguuuagaauauuuggaaggaggguaugcgccuucaaauguacuauucuuguggaaaucaggaaucucuuucgaagguauaguucagugauuauacuauccaguuucaggugcuguauacaguuucugcuaugcuaggcucuagaggugcagauaaucaaagugggaaagacagcuaugaauucuuccacagugacucaaguaugacaagugcuuaggaugaguagagagcaacauauucuacaaacucaguuucugaguuaaaauugaaggagccauagacuuugauuuaucuccauuuuagcuuuauaaacuaugguauccuuaacauuuaaagaggaagcaacuuuacuuacacuaagccuaacuucagaaagcugcagcuaguagauuaagcccuguuuguuaagcagcauaaacaaaugcccuaagguaucuucuccaaggaagagcauaccaguugguugucuagcaccaaauagcucagaaaauacacauaaguaauguuguacacacugagcagguuauauguuuagaagugugugugugugugugugugugagugagagagagagaacgcacauguauauguauguacauacauaugcacauaacagcaauuaaugaaaaaagaggacaugaauuuaaaagagcaaggaggggucuauggcaguuuggagggaggaaggggaaaaugauacaaucucaagaauaaaaggggcuggagagcuggcucagcuuuaaagcacugacugcucuuuuagaggacccagguucaauucccaguacccacaggcaggucacaacuaacuccaguuccagaaggaucugacacccuugcagagauguauaugcaggcggaacaauguacauaaauauaaauaaauguuuuuuaaaucaaaaacuuaggaauaaacguauucuaaggguugaaacaaauaauuuaccuuucccauuacauuuagccuagaaugaauugaauacucccaauaguuggugugaaucaguuacauuacauucuuuuauuaaucuguccccuggaagagcaaauagaagccuuuuaacaaggaaaaccuugcaggcucuuggagaaaugaagucucuugcuuuuuuuuaucagcuucuguguguggcaggugagggaaauaagccacaguuacaaagaaugugauaaaauugcucccugagaagauuucauugucucugcgucggccugacagguuuuaauucuguguucaguuucacugugucaggaagcaaagugagucuaccauacaucaccuucuuggucgggucgguaguuauaaaucucaaagguucagaauguugcuuagauaguuuuagagacaaauuuaguggagcugacuauagaacaauacuaggaaguaagcacaaauaauauauuuuaucucccuuucugggcagcuuaccuuuuuaugcaaacauuccccagagaugagcaaauggcccuuuucccccacggugggcuucuuuucccagucccuuucccccacgguggacuucuuuucccagucccuuucccccacgguggacuucuuuugcuaacagugaaauaaaucagccagcauagguggcucugacuaccagauaacaugccauucguuuuuagugugagauguauuuuugcauucaguuuuuaaaauuauguuaauucuuugaguuuuauuaggcaaugaagagucaccaccaaaggguauaggaggauuggaacugucgacuggcuuaacaacugagguaagacccgacacauggugguguugucuaagcuaagaacugcaguaaucuuaguaaaaaguacuguugucaauuccaucuccucgaggcagacauguagccaccuucagucucucugucacccauguuuaauuuucagucagcaaaacaugaggcgaguucccauagcuaccaccaaugccucagugacuuuagugguuucccguuagaccuugacuucuguugcugcccuuccuaugggcauguuuauguugccauguccagugucuuuaaaaaugguaauugggucuugucauagcucugcuuaacuuuuccaugguuucauguuuugaauaaaauuguuguuaauuuugauagaucuguaccauauacaauuuagacucuuguuuccuguuuguagacugauuccucaguacugccaacagugugaugagcuggcagugaauggagguuaccaacaaugcagagggagcuuaccccaaaagagcauuggacaggcagcaaggagaguuugcaaaaggacauuggugcagaauuauaaaauagaguugaagcucauuggaagagaaagaagagaaaaccuaggcaaagagagaaaggauggaauauacugugguacuucaggcucccugcuguaacacuucauucuggugaaggaguaggcuuaaucaggaguagggaggaccacauggauugugcuaagcuagaauuuuaacccuuugccguaaaagaagcauugaugagugaaaugugagauuggacugauuuucccuguuuuguuuuuaaauguugacaugcuaauuuuucaguucauggaaguagauuauucaauuuauucuggaugcugagggaggagacaucaaauauaucaguugccagcuaggcucaccucgcuuauuuuuguggugcuuuggauuuucauagauaucugugaguucagaggaagauacaagucauggaguuguagcggcacccgagaacccguguguuggaaggcggagaggggcagguaggcugcuucuagcagucauucacacugucuguuguucacacugucugucucugcauugguuuuuuuaauuucauugaaguuuaaaguugguugaugguuucgaguaaaacacuggcagacaaugaauuugccucuuaccuuuuaaaauaguucagagaaaauuccuuuuucuauuuuuuuuuuuuuuuuuuuuugguuaaagauuuguuucaaauuuuguguauuuggugggugggugugcacaugaguguuggcaggugaccugggaagccgaaacugucaggucuccugcaacugaaguuagaggcaguuguaagucacuugaccugcgcccugggagcugaacuuugaucuucugcaagagcagcacaccugcauagcugcugacuucucccucgagcccuguauucuuccauuuuaacauaccccuuucacguccgcuuuuauauaggauuauuguuuaaaucuggcaucuccaaauaaucacagaaaaaggagaacugucugggcgcaagggcuucauucccugcauguuucucccugcccuugcugcccucccagggcugcugcagccuguuugcaaaaaccaaucaugugcccuaagccaaagcacgcuggcuguugcccuaguaacaguauaaaaccacucuuagcuugcaucuccucuuucaagcuacagcauucucuauugucagccauaaaacuuuuaagagaaagucucagaguuagaaaagguuagggcagcagcuuucaaauguuuucaucucaagacucuggacaguuaugggacuccaugaccaaaauauugccaguuugaauguagaauguccccagaggcuuauaaacuuggacauuuagucucuagaugguagugcuguuuggaaagguuauagagucgccuuacugaaagcagcgccuuacugaaggaaaagguuuagauagccuaccuguuccucauucuuacucugcuuccugagcauugaaacaacgugaccagccacuuuguguucugccaacaugccuucccugccacaguggacugugcaccucuggaauuguaagccagaguaaacguucuuccuucucugucagcaugcuucaucacaaaaaugagaaaguaacuaaaacucacauuaagacgacuaagauguuaucugcccuaugaguuugugauuguguuagggaguuuucaauuggcccugcaucugcuaugcucacaguuaacuaaaagggguaccuaacgccagcgguggcugaaaguguaauucaguucagcaguaaguauggcacuugccuagcaugugggaagcccuugguuuuaaucaccaauaccaccaccaacaaaaaaaucuccagacaaaauucacuauaagucuacuguguacuuuauucuuauacuaugauuuuuaaaaagaaaggaaggaaagaaaaggaugaaaaaggcaucugaguagguggaagcagaaaggaggagcugcccugggcuccaccagucugagaaucauuagcguaaggcaauaaggaugagaacaauuguagcaauagaaaaugguuuucuucucagcccuauacuaagaagaaaagaacugcucugucagggugcagcugaguggccgauuaugccuuaucauauagaaggcucuaaguuccaucuucagcaccacaaugggggaaguuacuagaaacuucucacuuuugagguuugaacuuucuccucucucccuuccuuccugcccacccccccccccgccccuucuccaguguuaaauaucuuacaagucaaguggcacagccagugucauuuggauggcaaacaacauaaaacccuacaaauacuaccuuaaaggaaauguauagcucccagagcugagaugaggcagggaauaucugaugcaggcacagccaguaaaacuugaaucucagcucuuacacucauccuccuauagaucugcuuucucaagcagagccuugaggaaaacgcuuuuguacuaguucagaccagaauccuaaggaauguguuaagccgagugcuguuucugguauugaauaguguugcagagucuggguuccuacagaagaugcuaggauggcagcaaugauaccuacuguagcuagcucuuuaaaucauuucuucaacaaaacauuaggcuagcuucuaugagaaccaacuuacgugccaugaguaaggcauguaaaaguggaucauuuagauucaagaaacacuacauauaauccacaacacgacugcuaucuggaaaguugggggaaagggcauaacugaggaccguucuggacaaagccaucugaaauggccauaggagccacacagaaauucacaguccucaaggcuacaccaagaugccgagucauuuaugcggaaguuaaguaauccaaaauaugaauuuauugguuaaauggguauggguuuuuaaauacuguauaauguucacugucaagaaggagauguuugugcacucucagucuuugguucccauaucuacuuuuagacuguuuuacuguguuuagguacaauucaauaagagaucuauuuacauagaaggaggcuguuuaaaagaaaaauguauauucugucauuguugagaagaaacaguaggcuuuguacuucaacuuccaaagaauauaaacagaccauugcuguuggaggagaaaggaccuaaccuuucaucuguuggcauuauuuuuaaaugagccaguguuaacugcaguauaacagauaacauuuaagaccuuccaccuuuuccuuagcuacagaauauugaaaugguuaaaucacugcagugacuuaaugggcuacagacauuauuguaaaaauccaagcuguuuuucugguaauacacagaacacagguuguaaaaacugauuggucagaauuuuaugauucacaaaaauaguggucacuugagauugucuuguucaacucuucugcucuggaaagcuuuaaaugugcugcucuacauuucaaacaauguuguuuccuucugucucauguuuuugaacagcugaacuacagauggaagcuuuauugaugagggaaucacuaaauguaaguagcuauaauaguuugggccuugaugauguuuuguguuuuuucauuuaaggaugaguagagaagagauaaccagucuaugaggacuuguguguacaggaggccauguggaagcaugcucuccacucaaguugagcagcuuucacuugaucuuuucuacaguugccuacaucccugauaaagaacucugagcuuucugggguuuauuauaauaggauugcaaauucaauuggaauaucuuaaauuuucuugucacgguacacaaaauaauuugagaguuaaacuucacauuagaaggcuugucugaauagacugaacugugauugcaauaaacacuuuccccaggugugauucuuauaauuucuuuauauccuugaaaauuuuguuuuguguugccccaguguaucuauagggaaccuaacaccggggggugaacauuuuuauaaaaugcucacaaaucuccauuagccauucuucccuguguccuagaagaaaugggaaggcgcucuuauugccaggcacuguggcgucagaguccuuagcacaauuuauugaaccacccaguucuguuccuagacgcucacagacuaugcugaaaagaaagagaagccccuguaguggggcucuaauuuacccucuaaguugaaaccuccaggaccagaccaugugugccaccccucacuccaaguccccaguagagugcaaccgccaauagucaugagggauguaaaauguuguaaggcauaagacuuuguauaguuuaaaguaugauugccgaguagguaauuuuauaacagacauacuuacgaguuuuguuguuggagauuuucuaacuuuuuggaacagucuugcuauauaaccuuugcuucauauguagaccagcuggccucagccuuacagcaguccuucugccucagccuccccagugcuaggguugccgaugugugcuacagcaagcucaagagguuuuauagcuaaagaggugaacuuguaagaguucuuugagugaaagagaauucugaaacaugaauuuuuucuuauuuugcuuuugccaaaaucauuuuaaagacaaggagaauaaacauugaagcaugauaacuuaguaaguuagaauauuuuucacaaagcaggcccucuguauccuugagcuuuuggguaagcugaagagaacaugcccccuaguccugacagcauuguuguaaacagccagguauacacauaacuuuuuaaccugccuuuaaguuuaugugagacuaucgagaaacaacuuguuuauuguauauuuagguugaaaaaucagagucaagaaucaaugaagaaauucacuuugaaucucaaaacaaagaagguaaguuaaugaguuccacugucauaacuuuaauguucacuauaauuacuauuucuugagagucuucuauguacuauguaugcucuguuccuuuucacagauguucuuaaguaguuuauauaauccaaucaagugaacauuaagcauugcauuuguaguuuugggaauaacugagagagauugaguaauuuggcuauacagcuaauugguauuugaccuuaacuaacuacaacaacuuugccagcagccucacuguggguucaguccaguguuggcacaaacugcaaucucaugugauuuguaugguagagauagucacaggcucaguaugauaauaggucagcauaucacaucaugagucagcccuugauauacaucaccucugaaggucacuagcuccaaaaagagaauucuguucucaaccagcauguggaguuuuguugguuucugcuaauuuuguugauaacucauauuugacauaguauuuuagacaauagcaaaacacugacauugauugauagacacguguaugcccaucaccucauuuagcauaccuuaaaauguaguauauuugucuuacucaauuguuaaaauguuacaaauguagugaguccccauaauagggcuaccuuguuacaaucucuuucucuuucaucccauccaaagggaacuacuauucugcauuaauuagguaugguuuuaguuucauaaagauauguagcauauguugcuuuguuuaggugaauguuaaccacguuuuacaaaccauuuccacaguauuugccuauuuugcaauauguucugagguucuguucucuuuauuuuauguaagucuaguuacuucauuauaacaacaguuaguauuacauuguuugauauggcacaguuauuuuguuuguuuauuucuguuauguguuaauauugcaaccuuuuugcagcuuuuuccaauuguagaguacuauuuugcaugucccuauuccucaaaaacaugagcaguguuugugaguucagauuugcuugguuacaagcacgucaucaguauacugaaugcuagcuuaucuucagacggcauaguugucacuucacacuugcauugugccugaccucauuaggcugugaugcuugcugaucugauggcugugguacaguaugucauaggguuucuuuggacaccugacacuguuugccugcaaagcugaaguaugaaggccuugaacucugcuguguaaacuugaguuuuguagcacugaucuuaauucacacaacagugacagacaguggaauuucccuaucauccuauuauccaccaaaaguuaucugaacuguuguucacagugccgaguauauagcugcuauucaaagggaugacuagacagcuuccccuaacauccagauguuuuauuucagagauuuaauauguuuuuuuaaauaugguuuuaguuguuguauuuaccauuucagaaauaugcugugguagaaaaggcagcacggaagcucugagcgguugcaguguugaagcggauccugaagagguguguucccuaguucacuuaagcgcgcauguguuauauguaggguuuucccguaacaugaagaaaggugguaggaagguuuucuuucuuuuugugguuuuggauuuugauugguuaucugaaaguuucauuuauaauuugguuguuugcccuccucccaguucuccauaguccuguacccauucaacucuguaguugcuguuguuuuuuaagcucuucaagaccaauugugcugcucaaauacuauuucuuuauauaaguuagguggauguuagagucgcucucauuuuugccugcuuacuguugugacacuuagcuacuaugucccugcuauauggucaaagugcagccuucuuuaaaugacuggcuccagguccugcuaccuauaucaugcucauucuuaauuccagguugaagaggaagaaaagcaaauaucucaaagaaacagaaagccggauuacuccuccucagaagaagaacuagguauuccuaugggcuucuguuugagaugucagaaaaguuacaguccuuauacuuaguaacgugggacaagaaaauaauuaaugaagauaguaacuguuuauuacuucauaauguuugaggcgaauuggagacaccaacaggaucuuuucagacuuggguccagaaaugaaacuauuuccugcagaaaacccaacuuguggacaucucacaaaucucuguaauggggaccuaugaccaggccagauggcacuguaugcugcgauucucuuaugggcagauaaugggcagagauaaugaggcucuuuagcugaggcgcauguaauaaugccucugcugcauccuguugauaacauggccuagaacagccaugugauagaacuuucuacgaggguggaaaugguucguuguuacuggcuccuggcuacuagaggcuguugagcauuuggauauggucaguguggaugaaaggcuggauuguuuuaauuaauauuuuuucaguacauuagguaguaugggccauaguaaugaauuuauaaauacauaaugacacugcaccaugaaguuuucugucuuaaugcugagccugauaccaugaauccagaauuucagcuuuucaagagacugagcaggaggacugggccuagcugggcugcagaguaauacugaaacacauguugcuaguggcugccaugucagacauuuccuaacacaagcagaaauguauuaaauacaagugaaugaacauauagaaagaauacauauuuucuccuuuauaauuagaugcaugugguuauuuugugguaguaaauugauuucauauuuuauauugagauacaauucaugguacuuuuuaaucuucauaauaucuagugaauagaguguaaagcucugagagguuuacuucauuuccucaagcaaaccugcucccacagcccaggucucaggcucaaggcugugccucuuggauggaacuuauucaaguagccaaagcugccucgucucugggacucugaacacucagcccuucccuagacucaggguacccugugagcuucuuuauuguuguuuugguuugguuuucguuuugaggcaaggucugaagauauagcugagaguuccugaacucucagugcuccugcacccauuccugaguucugggauaaacuauccuagguucucagaguuaagugaucaugcccugauaacauuuggaaguuuugguguuuuguuuuguuuuguuuuguuuuguuuuguuuuguuuuguuuuguuuuguuuuguuuuaugcucccuuuccagaaagccagcaagucccauuacauucuaaaaauauuuagaauaacuauuggcuuuaguguaucauagacaaaaaaaaaaagucuacuguccuaaaauagaacuguauuucaguuucaguuacuuuuuguucuuucgugauucuguccacacugauuuacagaugauagcccagauguccuggauuccagaauagaaacagcacagagacaguauucugagacugagccacaugacacaaagguauuuuucuacugauugguuuuaaguuuggaaccuaguugcaucauugcgaauacuuguaauuuuuauucugcuacauuaugcuucugacaauaaucagcuuguuauaaaagauguaauaugaaaguuagauauaaugcuugcuuacuauuuugcucaauggccuuauuucucaagauuuucagauguuuucuucuggcuugcaguuuaccauagaaguccgugauaaguggggaugcacauuaacuguugaugagcugccucugauuacuuucugcccaagucuggcagccccagauuggcuugucgcuacuugccuucccucugcuccccuuccuucuagucccagaugugcacacuuccugccauggacuucuugaguguucucugagccauuucugagacuggcuacuuuuuaucuucucugucuucucuuguccauguuacuuuccucuaugcaaauauaaaaucugcuaaagcaguccuccuuguguccacaagggcugggaacuaaauuuaaaaagggauuuuuaacagccaaagaaggaaaaguagcgcaguaccaugaauuucaguugaguugugcccaggaaagaauaggcuuuuaacucauuccucauugcccuguucacagcuaggaucauaagcuaguaaguacucuaaaugaagagagaagcaauuggaagauacuuuauuuccccucaauuucauguaagcuuuaaaucauuuauuuaaaucuaauagcucagagaucgauacagcauuuggcuagaguacauagaacccugagcauccauagauaauauguucuguauuuucauuguuuuccugcacagaagcuauguucagaagcuauuuaauaucccauuuuacaguaauagugaucuguagacuaggucaggggugauuuuaccauuccuaagacaguucaugaaguaaggauguaucacuuuuagaagcaauaaagucauugucaaguugguaugacaaaacuaaaaaaagauaaaaauuggauuuagaaagaccucaggcacuggaaaaguggaaaucagagaauaaaaaugaguuccuacuugucaugaggagcuaguagaauucuugagggaccuagugcuugcucugaaacagucaucccuaacuggaaauacauucugucccagccaugaagacagccugagcaaacaccagccaacaaaggcaugcaccuguccucccacuauccagcacaugaaaaagccuagggcacaugaaaagaguguagguuagaagucacuuuauacaugauccuguauaauguauuaaugaggacaaaguaaauagcuugcucuucagacagcuguuaggcucucucaggugggcagaccuuccauauucuaaacccaugcccuccaagaccaaaaggauauuuaaaaagugacaacugcaucuuaauucuauuuuuauuuaaaauuauucuaaaauucucugugaauauuuaauauagaaacagucuuggugucugcagucauagagagcuacauugucugucaugagcuguaauucagugucuugguacugguuauauaagugcuuucaaggucccagggaaagcuggguguuccacaggugaagggacuucagcaucaugugauuagauuuuacagauaaucagcuaagugaacuugcaggcucuauuagccuaguguuaaaugcagugaccuuccacacugaauaccuuaggacuccuacaaagagagcauccauuguguaaucacacacaaaugaaaacugccugagcucacacugcuauugcuaggagacacacaaguugcugcuucuuauccucauuacuaggcaggaagaaucugccucaaaguagacccaaaaccacaaauguuuggaaagacagagaugugcuaugaugcagauguguuggcuuuguuugguacuuauuuaaguuccugaaaaaugggccagcaagauguggauacagucauagauagauagauagauagauagauagauagauagaaacaaacaaauaaaauuaagcuuauuuauuucccuaaauauuauuguuucuuuaugguagaaaacagucaacauugugucuuccauauuuuaauacaaucuauuacuaguaucuguaguuaugcuacuguguaguaaacaccagaacuggauuuccuauuacuuagcagucaccuaccuaucaaaagauauuuucaaaaaugcauuggaaauauguacaaauauauauauuuauguuuauaaaugugugcauauguauauauauauauauauucuccaaucucuuucguacucacccagaaacaauuuuguuuacccaucaaguucaauuuguacugcccguauauuauuggauaugagcccuugaccuacugggggugacaauuuaaggaaaacugacugucccucccucggcagcuaucaguugcuaacaguuccugaggagcuaggggugggacuuaauaccuacccucccucuugugcugggauuugaucuggccucagcuggcaguauaggguuugugucuacugucacgagcacugugagcuucuguaugcauuuaccugcucuguccaaagaacaguuuuauuguacucauucuccacuucuggcucucacaguauuucugcuccugugaugaugaucucugagccuuggggaugugggauagauagcccguuuagggcugagcaguuaacaguguuuuacuuucuguaccuuggccaguugugggucucuguguuacucuguaucuacuauaaauagaagcuacucuaaugaggguugagagaugcauuuauggguaugacauuaagucauuaggagucaauuuaauacugugucuauuuagcagaaauaguaugaaacauggaaaaacuagguuugcuccagucacaaguucuugguccagcaaauaguuccaaguaugaguuucauuuugcagagugggacuuuaaucagaaagugguuacaccugugggcaugucuugcuagccuaguuguuacucuagcuuucaggguucacuugacauuuugagcucaaaacguuuuucagcuacugaugaauaauuuaccugcuagaggauacuacuauaaauuaguucaacuaaauccccagauguccuuuugacauauucccccuuucucuuucccuauaccccucuccucugccacuccguaaagaaaugcaauuuagaguauuucuuccuuuggaguuucucuuaaauggacaaaguacauuuuguaggaagaaaauaaaacuaaaccuaaccuugguauuuuguaucuacaucugcuuuucugccuucaguuuuuguuaucuucuuuuaacaguuccaguaacugcaaugaugguuauauuuuuaaaaaaacauuuaucaaacuauucuaaaugucaaauaggauucuaagugucaaauaggaaauuguuauugagaggaacucacggaagugugaaugaaugcagagucaaauuugaaaaugaggggccuagcaaacacagaaguggaugcucacagucagcuaauggauggaucacagggcccccaauggaggagcuagagaaaguacccaaggagcuaaagggaucugcaacccuauagguggaacaacaguaugaacuaaccaguacccuguagcucuugacucuagcugcauauguaucaaaagauggccuagucggccaucacuggaaagagaggcccauuggacuuacaaacuguauaugccccaguacaggggaacaccagggccaaaaagugggaguggauggguaggggaguggggggagggggggaauaugggggacuuuugggauagcauuggaaauguaaaugaggaaaauaccuaauuaaaaaaaauuugaaaaugaaaccacuggucuuguucaacuucucuacaggaagagaacucuggagauguggaggaauucuccucaguuacuucaaagacaaacagcagcacuggccuggaagacagaggugagggagagcccucugggaugccagggcccaggccacacagugccacaccuugcaccaaguuucaccugcuggagcauccuccugcccauuuguucccuccauagagcacagagccuuacgcuuacauuuguaaaguuggccauuauuuuuaaguuucauccucuucucaaaguauauccuuaguuggguguauugguuuaauuaugguaauuaaaugaaguaugcauguguguaugugugucuggaauugagcugguccucugaaguaugaugaaugcuuaccuggucaccagcacagcacugagcucugccuuuuccucagaugaauuuagcagcagugaggguacaggagaaaagacugagccaaaugaagaugauggcagcaucaagucacaggaggugagaacugcuuuucauauuuauucgcucaaaauaacuuccagugugucaugugccucuuugugaguuuuucauaaguacuuuuuuggcuguuuuuaaugcagcaggacacuuuuaaacaguaugcuuuauuaaugucauucugauuaauuuuguuugcuugguaaauccuauuuaugucaucauuagauaggaucaauccaacauuuugccaggggcagugucagguuccuggccuugcagcuuaacgcugcagaaggaaaugggaacaucugcaggagggcccaaggagaccuagcucggugaggcacagucguggcuuccaggagguugcagcuuccccaugccagccaugucugcuuccagcccauucaaguugacaguuagcuucugcgucagagaaugauaguggccugagacagaccucuaaaucccaaagcauccauugcuaguuuaccaacucuuuaaugguuucuugugagaaauuuacuagauuuuuuuuuugguaggaaauagcauuugaccacagguagguuuaaaaaaaaaacccagacauaguucuugucuggaacaacacucacuaagcauuuguuacucgugugagacucuggauucauaggacuaucaguacucaguaagcaaggggacuaccuacauacaguaagaagaaauacaacucuaaaauugcaccuaagcugggcuucauuccuauuaaguuagcacugaauugauucaagggagggugaauuauucuuuuauugauggggauuuuuuuucccucguuuuccuguuaggaugaucauccaauaauuauuaaaaggagaagaggaagaccccgcaaauacccugcagaaacagccuuuaaaucaaguagguguuagauacaucuucaaguuauauacaagagcuuucuaaauugaucuucuaaguaaauuuuuacuuuauuuuuuuagaagaagauuccaaaacagagacugacauuaccacaguaaguaauuauaaaagauaggaaaagaacuauucaaauauuugcucuuggccugugaacagcucguguuguaaacuacuuuguauuauuuacauacuucaaaagacuuucuuaaaauguggcuacccauucagauaaugccucgauuuaguaguauuuuccuauggacaguucugauagcuguucuugagcugaugccauccauauguaggagugcaguugucuaaaguuaaagagccuugguuaagauacagaaagaaauggacuguuuuaugugauuuagaguggaaacuugucaagggaagcuucugauggccuuugcugccuuaugauuuucucuugaauuguguuuguacucacuaugcacuaauuuuagugcaggggaaccaucauugcucuuuguguggguguggguauaguaugugcacgaguucaugugggagcacacaugugugaaugcaugugugugcauguacaugcacacaugaaggccagaggccuauaucagaugucuuccuuuuaacucuccaccuuaguuuuugagaugggucucucaguuaaccuauaacucaugauauaaauagguuggcugaccaguggaaucuacccaucucucccaccaacucuugguuacauaugugcauuucugcacugucuuagucaggguuuuuauuccugcacaaacaucaugaccaagaagcaaguuggggaggaaaggguuuauucggcuuacacuuccacauugcuguucaucaccaaaggaaaucaggacuagaacucaagcaggucagaaagcaggagcugaugcagaggccauggagggauguuccuuacuggcuugcuuccccuggcuugcucagccugcucuuuuauagaacccaagacuaccagcccagggauggcaccacccacaagggucccccgcccccuugaucacuaacugagaaaaugccccauagcaggauuucauggaggcauuucuccaacugaugcuccuuucucuaugguaacuccaggcugugucaaguugacacacaagaccagccaguacaugcacccagcuuuuuacauggauacuaggaucucaacugagacccucgugucugugaagcaggcacauuauuaacucagccauuucccaguacugcuacuuuaucuccuugacucuggaguacauaugcagugaaaucauuguaggaggauuucguuccauguacuucaauggcaaugagcaguggcuuagaaaacaucacuuuugauuuagauauuagcuuugccacguacucccagaccugugacucguggccagucaugcacuccucugcucccuugaguugugaaauaguacaguacuguagcaccagagugcuucucaugguccuaucaggcugcagacgcagagaaccacgugugaaacgucggacugaccucagggaaagccgacaacuuugaacauaauucaccacuguggcauucagucuccagagauguaccaaggugcucgggaagaguccuguguuagagacuggucagaaucgagagcauccacacuugcuagcucuguuucacuggccacaggagacagauccucauuacucugauuauguaauaaaggccuuaacauuuacugcuugucuuccuguaugauaaugacaaacuguucuuauuuuuugcucauuuaaacuuagguagaacaaucuucaccuaguggcaaacuaaaagucagccaagcagguauguuccaagcaucccucugccuguggucuaaggaggggcuguuguuucaguucauuugcaagaacuuuuaagagugauuuucuaaauaagauguuuuuccuucuuaagcagggaaccuagccuagcuguuaaggaagauuuuacaauuuuguuguuucucaaugaaauaaguugacuuuugguuuaaaaagaaaguuauauauacuuacuguuuuuucuguagucugcaguugagucugggacacugucauugcaggacaaggcaguagacaagaaaagagugaaggcuggagauaaauguagcacaguauugaagcugugguuugcuguauucugcugagauaauacagaacaaguagcucuugaagcacuguuacuaugaagguuguugcucauggcaacaaccuacagagcucagaggagugauaauuuguaagagaaaccugugcaucuuacagacugagaucguaaaagaauuauuucaaguauuuuuguccucauuccaaagagagaaaauuccaaaauguuaauaaugguugccccuggauaggaggcuaauagaaguauuacuuauuauuuagucugucuuuuccagauuuuuaacaguuuguacauuuuaaucucauagcuuaagauuuuuaaacgaaauaaaguacuaucaguggauuuaaaggauuggcaguaugcagaaaagaugacuaugacagcuguuuguaaauagauaacaaucaguuugagaaucauggagucuggccaucaagauacaucaaguacagaacccauggacaguguuugcacgccuaauuauacaagcuuuucauucugcuucagguuuuuuucuuggcucuuggcaaauuaagguuuuguuguuuugguuuggguuuggguuuuuuguuugcuuugggagggugggcuuuuauuuuuguuuguuaagggaggaagaaggcuucugcuuugguaugcuuuuuaaccugauuuuauuauaguauuuuaaaucuggacaauaagaaaucuuuauacauugaacacacuuuaaagauucugaucuaugugaucauauggugguuucgauuuuguguucuuuucugacucuggguaaugaugaccagcuuagggcagacuuugaucuuauugaauuaacuuuucauggucguuaguguagugacucuucagaacaaaagacagcacuguauuagcggaggacagccuugucaggcaucaaugggaggagagcuccuugguccuacgaaggcccaguguagggaaaucgagggcagggaguugggaguggguggguggguggguguaggaauacccucaucaaagcagggggugggggaauaggaugggagguuucuuggaaggggagggggaaacagguaaagggauaacacuugaaaauguaaaguuuuuuuuaaaaagguccauuuugguacucacucgaaacauugcuaaacucuucaauauaggcuauaguggaacuuucuggacccaccauugguuaaauaaugauacagagacuuaugaauuuuuauuauagcuuagacuuuuagcuggguagacucucagcuagcucaaucuaaauuuauccccaccacucuagccccagguccagccauguggccagcucuuugcugguguuuccaucagcccaccugcuggguaaucuuccugccucugauucuucucccagagacacucucucagccuggaaguccuguuucccuuuucugccuaucuguugucugucagaucuuuaugacaggugagggaggaagaguguuuacaaaaugcugaggcaggugauaagccauaagaacaucaguaccaaaaucuggccagaacucagcucucugcuguuacagcagucaacaauugaauauacagagauaaccuucacacagugcaccccacaauaggcaguucauuuguucucugccaggaggcugagauuguguggcaaaucauucucggucaggggguacaguggagcuugugauaauaugacuaauuauccagucucuuuucuucuaaaccucuaccugaccacucagacuuuuaaauuauugagagaaaaaaggaaaauccauauuuacaagaagcaugcauuuugggugagugguuagaugaauuucuauuccgucaccaccacacagguagauacaauucuagaaauugcucuguauccauccaucuucauuguggugauggagugccugagagaacaaguuugagaggggaugggauuacuuugguucauaauccaaagauuuaaaagagauuuaaaagaaacauuuccaaucaaaaaccugaaagccucagaauccaaaaccuuuccaauauugacaugauaaaguggaaaguuccauaacuguccugcacucaggguaccgaugcacuaaaaauauuguggaguaguaccuucuaggcaugcgaaugagguauauaugaaauagaagugcauuuuaugucugucuuuuuaauauguauaugugagaguggggcggguugcuguacuugucugcaugcaugucuguaccuaccuguggaaaccagaggacaagcucaggugcugucuucagguaugccgugugccuccuuccagacggggucucccaucagcuuccaaucacccauuggguagacaggcuggcccugagccauagcaucccccccucccccaccucaucaguguguucuaggguucugaacuuucagaggcccuugugcuuucaaggcaggcacuuucugacugagcuaccuucuauguuugcauguagucaccuaccuaagaucuuuuauuaugguguuuccuaaguaaugaauuauauaauaguguauuaacauugggaugaugacagguagcagacuagaucuacuguggaaauuuaauuucugguuugcuuuuuuuaaagaugaguccaauaaagaaauagccaaccuagaagaaaaaaguacaagcaauguaagugcuaguuuuguuuuguuuuuuuaucaaaguguaucuuccauaaauaaaguugauaaugcccagcuaaccacccuuucaacuuuaaugcugcuguuucuaggacgauagugaagaaaaaacagcaaguaugcgucugagaggaagaaagcccaaacgcucacugacuucaucagaugaugcugguaugagucugguacacucuuuucccgcccugucucucuuuagaaaacagcaggccaacuucaaaccaacagagggaaaaaaacaaaccaagaaacacauacaucuguacauuuuaauuacagucuuauuucagaaucacacuuuuuaaccaaucuuuuuuggaugaggaaaaauccagcugggugcagcuagaauaaauguugcauaaaugugugugaaauggcucuaaucccugccagaaauggcacaucccagaugcuuuucugagcacaugugaauuuuuugcaaaugcuggcugugaacugcauaaguaaacuaucccaaauguguuugagauuaagguaaacaguugugaacugcaaguacugaaacuaaaaggaaguggaaaaccacuucuucugcuuccaaguugcuaauauccuaaguucuauuccauggcuguccuuuggaagugucuuugggaauuguauaguccagguguuacccuucugucugaacagaauccucagagccagaaagaaagcgccagaaaucggugucugaaacaucagaggacaaaaaagaugaggagucugaugaggaagaagaggaggaagaggaggaggagcccuugggagccaccacaagaucagccaccagaucagaggcacagagguaaugggugcaaccagaagccuucagaggccuugggcagcuacucugucuggaagcagcucuugguggcaugggacucucucaaagacgcuuucuuuccauguuuucgccuugacugucucaacucagagagaauguuuuucugccucaguugcugggguuacuucagaguccuugacugacuuaagugcauggcugaugaaauuagucagcucucuccagacaguuucuaagcaucuacuaccucagacagugugugcugaggaccaugaaggaacccagaggcccccacacagacaucaccugugcugacccugaugaacauguucccuaaaguaugugcucucaaacccugauagaggugcaaaccuucugggggaaaacuggauauguggucaaaugggcuugaagaagucaugaucucugcuucuucuaagucaauguaugugaaaucaaaugaaguauuuuagguuugacaguguucuaaaggaaguaagcugguuguauauuuagccaccagaguccuccccagacccuccauguuguuggugcaccuguuaacaccagcagugccguucuccacuuaacacuuagagaugaugugugugaugcugcauggcucucccuaguauucaccaguauuuuccaucuucagugucauucauacacugugggucuuggcauaaucuucuguaauaucauucuccaaaauuaauauaaaagaacugaaauguuuauuuugaaagucuuaccauuaacaccuaucucaccauaauagaauaguaauguaguaucauguuuauaaaaagauuuaaaaucaacccauuucuaaacccuccaaacauagacauuauuagccucuggugacagaguuugauuucucaagagucggauuuaaaauacaaaagacaaaaucaaggagcuuccaugaguaaccuuaaaauggugugguguuugggcuuuugaagagagggguuggagaggaggaaugggcgauaggaauaaagugacugaaccaugagcccuagugagagaaagugagcacguccuaugggugcaccacuaggacccuauguaccucugcgacucuuaggcugaaaguccugggacuccuucaguguagugggacucaacuucagaaaguucauuagacuuucugucuuccagagaauaucuaaaaguuacuagcaggcuugccuuuuaaaauaauagccuaaguuuauuauauacauguauggcaucguuuaugauaaggaaaauacauuuuuaaaagaguaagucauuuauuauguagguuaauggucauuugaguuaccaguauugucaaauucuuuaggaauguuugauuuauucacagacucuuucuguuugguuuaaauuucucggcauugguuggucggucccagggcuuuaguaucuucaugguuucccaggugcucggggucagauguaugcuuugugauccucuuguauugcugaccuuggaugccugagccacaguaccuccucuguauuggucauauucuugugcauacugcaagggcagacgaaccucuucuucccuggccuucucuuccuggcacuguagaugccagccucccugugacuucuguguguuugaaguucuacucuugggaccucauaauaauucccgcaaguauuugagggcaguuuccaggccuugguguccugagcuuccuuagcaguguuugcucucuaaucuguauccucucuaagaaacaaaugguccacaccagguguggaccaaaaauccagaagggcuguucugcugaucuuacagauacugauacucaggaugcaccugaacgggaauugcuucaaauugaauugcauacauaccauacauugaauaaguccuuuucucccuuuucucuggaaagucagcuucucccuuaaucggauuucugucuuguguaacugacuacuuggagcauuuagugcugugaaucaugcccucagugaccuuagccucuugcucuguuugaugagcucuuugcuagccuugucagccagcguauuugcuauuuuucagagucaucuucuugauugugguaaaauaugcacaggaaaagcaaagacaguuuccuggagguagaauuuaguccuggcugacaccaauuuacuagcaaugaucaagagacccagccccuuugauccuaugagucuccauagcugucuugcccaggcaaaaucucuuccuuucuaguagccccccggacuagagaaucuagugcuaccauugcccagugucucuauaauguguuucagaaagaaucauagcaagccaucuacacgugcaacauccaaacuuggcaucccagaaacaauuucuccuagaaaucgccaaaaguuagcaaaagagaaguuaucuaccagcgaaaaaguuaguaaaucucccccauuaggaagguaagucccugccugcccuucaaguuguuuaacucccaaguaaugcuuuuccuauuuucuuaaagauaucuguuucaccagauagcugucuugggggaucauggguuuccagaaauaggaaggcuuaaaauaaaagugucuuuaguggcuuugccuuguggcccagccacacagacuuguccuugacucuugugagccuuauuagcuaacucucauguccaaagacgggagucaggcauguuucuucccaagugauugcaugucugagugcauaguucagucugcacaauguggugaaucaugucacaguuuagagauacuucugguuuaaacuauuguagaggugacaaaacaagaagcauuuucaaacagguaccugcgcuugcacuuccaccacagcugggcucaccucugcuucccaugguccuccuccuuugccucuucugugcuuaggcagugggugcucucugccugccucggugagacagguccuuccuuccuuuaagcccucuccuucagggccuccuaucugcugcagccuguucucaucuccuuccuacuguaucugcagucagcacuaaacaguuaggaauagcagguggcagugguguagguagccaauguuccucucucccugagcuguuaaguuccuuccuugaggugggacuugucuuccucuuuguguacgguaacauucauaaacaaaaggugaucccacgacuauacagacuguucaugcauacucuuacaguguuugauccuaacagcacacugugguauguaugugucuuaggaaggaaggaaauucucucauuucaucgccauuggaugagaugaaguagucaucuaugugagugucagacuaucaggacagcauggauacauguuucucagaauuaaaugugcagaggaauuacaugguggagguuccaauugugacuguuaagaguugggccugugacugcacuuccagcaggcuucuguguguaaggaaaggccuugacuuggucagccuggcaaguuuccacaagaggagagauggagccugacucaggauucugccuccugcuaacagcucacagcacaacacuggcuccuguugcacagcagcucugcagcgaguuagugguccguguggccaguggcuucccaugacacagcuugggaugaauuauuaacaggcaucucagccacucucagcucacucuuagguaaccuauaagaaccaugucaucugcaaccccauccaacucaguguuugcuucuaugucagaagaguaauaaccaugccuuuguagcaaaaaacguugcauugcucuuuauccugaagcuuuaguuugccaguucuuuaauuuaucaauaaaacauugucugcauguuuaccauaugacaagcagauauuagaaauauaaccagauaaugugucuaaucuuugcaacugcccagagaaaugucuguuaaugacagaaguggauguguuuagaauuuucaagcauuugauaguuuuauguuucacaauacaacuagugcucacauucaaacuacuguaacagacaaaacacucacuaguaaacuuaauagguauggugacaugguauuuucugucaucuucuguuaccauguugcuugaaaguauuggcuguaaucugcaaucugaaaaggcacagcagauaaguucuaguggcuagugcuguguuaaaagccuaaaguacuguguaguuccuaggaaggaagcugucugcucuucuggaaggcuuuucacgagagggcuuuugaacugaaguugggggugaaaauggucagauggaucauauaggaugacuagaaaaaaaagaaagaaagagagaauugagcguguggcgcaguugguagagugcuucccuagaaguccuggguugaagcccuggcacugcauaaacugaacaugauggugcaugcauguaagaucacuuaggaaguggaagaucagaaguucaaacuugucaugugcuacacagggaguucaaggcuugccuaggcuaacuacaugauccucaaaaaggacuaaaaagaaaaaaaucacuaguuaaaacguggacaaggaugacauuuuuuguuugaaaauagcagugcuuagacagcauugcagugcagagugcugaaaggagagagcugguuguguaaacacaugcacuguggucugauuguuuuguccuacagcagugguucucaaccuguggguugcaguuccuuugaaggucauguaugcugcauaucagcuguuuacauuaugauucaugacaaaagcaaaauuacagucaggaguugccacaacaugaggaacuguauuaaaggggcucagcacugggaagguugagaaccacugucugagaagcagaagagagccaacaagagcuauauaugucugaggauggugacacgguugaaucaguuacuaugcuucucuaaaccuuuuccuacugugcaagcuggcuucucuaauacuacucugaaacaugauuugacugugucagaugcuagguuacauuccugcuauguuugugcuaguuguuuucaguggggucuguguguguuucaguagaaaggacguguaggaaaggaugcuaacaagaccaaggucaguaccucaggguggcaggucuggcacagagugcaggccucugugugcuucccccagagcccugucugcucuauucaagguugcuggugaagaaccagacguucaagaacuucugguauuaaagaccguggggauuucccuccaggguacuggguuaaaaacucccaaguuguuugaagcaacugacuuuuaacucuccucauuaccuuggcuuuugcucaauacagaucaaaggcacagcucuccccuucugucaagcgcaagagagaagucagcccuccuggagcucgaacgagaggccagcagaaaguagacgaaaacccucugaaaaaggcaaagcgguaaugguggcucuagcuuucugacuaacaacccaguggaaagaaaauggacaagccuugccccauggccuuuuucuuuuuuuaaaacaagagaaggaucugcaugugcuguaaguuccuaggugcaagcuuguucauuuuauguuuuaaacagcuuuacaaaccauuguucauggacgguauuauguacauucacuucagauaaaggaagauaaguuuacuuuguaucagaacucagcaaaguaguuguauauuuuaacagcagaaauugggguuuccaaugugacacaucaagaauggaauccuuccagcccaucagacaccaggcugcccauggggaucuguguauaguauauaaacauguaaaaacaggcuguauuuuacucaauguaugaugcuaaucaaugaacacuuuauuuauuuuacagagaaaucuuaucugugaacuuuacuauauaucuguuuauuuuauuuuauuaauuuuuuuuaauaaaaagaggguuuuaaaugcuaugcagucauuaauagaagaguucuaggacuccgagugcccuguaacuauuagcauauggccuggcaggagacagaaauucacgcaugcauccgaguaaaguagguuagcuaaagaacggacucugcugcuuccguccaaggccgcgacuguuuugucuuucgauuacccuugccccuguggcucuaccugccagccccauuaacguaaguuaccuggcccagguaaagccacaucuuucacugcaggcagcaagcucuguggguucauuguuuucaucuguguucaccccaagccucagccaccaucuccauacugucuguucagugaagagaagugcuugaagauucacugcuccaggcuauucagcuucaggaugccauguuuuauacaguucuuucgggauagaaacugguuuuauauauagccagauucuuuuuuaaacaugauuuaacucccauaaugaacaaacugucugacuuaaguuuuucauaaaauaacauuuucuuaagauuggaucuguuucuugcaaugauaugaucaguugccaaaugauugaaauuuuaaaugcucuguucauacucuuguuuuauaauuaaaauuuacauucauuauguguagguuuuuuuauuguuugggguuaugauuuuuuugucuuuuuuucauugucuuuuuuuaaauuuugauuuuauuuuuuguuuuggcucuuguaagguggauauucuugucauuuugcauuguuucuuacugaaauuuuauauauaaauuauaaaauguuucccuaaaacuugagugacaagaauuuuuuuccccaugucuuaaaagccaaugcgguuagaaaugagacugaaucccaauaaucauuuuugcuagaauagcaguguuaaguugauu

SEQ ID NO: 2439 - RNA, 439 nt, Mus musculus
gauggcagccaccacaggcucgggaguaaaagucccucgaaaguuccgacuguuggaagagcuggaagaaggacagaaaggaggaggcgacggcacaguuagcuggggucuggaggacaacgaggacaugacacccuuacaagauggacaggcaugauaauugggucuccaugaacaaucuaugaaaaccgaauauacagccuuaagauagagugugggccuaaguacccagaggcacccccgucuguaagauucauaacaagagucaauaugagcaguuugaauggagugguggauccaagagccacagcagugcuggcaaaguggcagaacucccacagcaucaaagucauccugcaggaacugcggcuccugaugaugucagaagagaacaugaagcugccacagcugccagaaaaacaguguuacagcaguuagu

SEQ ID NO: 2440 - RNA, 1954 nt, Mus musculus
cacaaaaauuuuaaaagaaaaauuuaaaaauauaacauuaauuacuaaccuugggagaaacuuccacauagaagaagcuuaaaccaggagucacauggcuccauuuauaaacucuucugccucugauugguaguauaaccuugaggaaaauucuugauaucucugaacucaugugaacuaaaggacuagggucagucgagaaccagacaaccuaguuuggaauuaguacaaucuguuauuucuauacucuuccucuauuguguucaaaauaaggauaauugacaguccaauauucauggaauuuaugggauggggagaguuggguuuguuccacuuuguccuuaguugguuucuugauuaauucuuguauguguuuuuauaaccagagucuggguaaucuauaacauguagaaauuuacugaacauggcucaugaaguugggaagucaaagaucaaaauaacgggcaguuauuuugucaguuaaaagacuggucccugcuucgaagauaacaccuugacugggguauauaaguaaaggaaugcugcuccuccucuggcaagagugaaaacuuagcaagccuguucugacacacaauuuaagaagucaaaaacccauucaagaggcucaaguucucaggagauaaugcugaucuugaucagaugcugucugucaagucaagccuaccacaugacaaagcuguaauaggaaguaaguucccaacaugugaauggugagggacaugcauaggucaucccaguaggaaagaauacuuaaguggaagccauggcaagcaacuuuauucauuuccuuugaccucuauuuucccacaggcauaauggccauaauugcauucucugucucaaagaacaguacuuagcaugugcuucucagguaaaagcuuuacugcuguucuccagaggaacaaaggagucaucuucaaggaaugucacaagguaaaguaauccgauuuguguuuucuuagaacucacuauucuccuuaugugcacuagaacuaaaacuugaacugaugaaauugcaaguuauuuaagagggaaauuuuccuugaagcaugaucuauuuuucucugaaagaagaggguggagaaaagggauacaaucuaaauguuccuuucaggcugggaaaacauccuuuuccgggggugggggugagugaggaggguuguaguaauaguuuauuuuguuacacauuuuguuugcuuacagugacuauuuuaucucaguuuuccaagcuugaaugcugugugguucagguguaacuagcaguuaggaagauuuugguuaccauacucaguaaacccaggaagguauuccuauagaaucgcccacuuugacgucaaagaacaaauugaucuugggcacuaauuuugccuaaaacagcugccuggaaaggauguacuaucuuugacaaugacaauauucuucugcauagaaaccaaacacuuccuucuccuuagcauauguuguaaaccagcuuguuauauugaugcucaaagccuuugucauuuggccaugaguguuuucuuacuuuauuaucuaacauucuuucuuuggcucauaaggauuucaacaucucucuacugucuacacucacauuuuccauauguccaguuucuaagcaucaaacuccuuugaaaacaaguguuugugacacuguaaaacuaauccaaaacccaugacugaagagguuuuuggcccuaugggggacuuaauaguguugcuuagcuaaauugugacagcaucaagccaccuuuuacauaucuguguuacagauaauagacaauggcuacucugagccugaaucagagaagcuucuccuuguugucaauaaagugaauaaaaaguccauagcuucagaagaugcagagaaauaaaggguaguugaggguuuaucccugaaaaagaccauuauaucauccuucuuaaaucauugcua

SEQ ID NO: 2441 - RNA, 2217 nt, Mus musculus
ugacuugaccaaucauaucaccaauauucugcugucauugaauuuagcauuucccuuuuacaaacgagaaagcaugggcugauuuugaugcagugacuugacaaguuucacugccauucuugacuaugcaauaaaaugguugucacggugaaucucuuagugucuaagaaggacaccgacagggugcugaaguaagcuaguuauggacugauuugcaaagguaugaaggaugaggugagagcggggcagucacaagaccguguugaccucgaaagaaaggaucacuuuguggguguuguucucuaaaaugccauccaucuugggauaauguuuuuaaugaauuuuauggaguuccuagaauuauaaaagaaaccaauaguauuaaaauccaaggaagaaaacauauaaauaacaaguuuguaaugcagugauagacuaacacccaaccuaccaagaacuaaagguugguauaaugaccacuguaaacccacaguaaugaugagcauaaggcacaccuucaauggcuggaaugacugugccucugugaagugauaugacagggucuaccaggauaaucacaagcacuguccagucuaugugugcccaugugugaucgggcuuggucacugaaggaaucucaguuagaaugagacauuggugauuauaaacacauguuuuuaguuucucuauuaaaguucacagagcucuugaagucaaucuauccacauaugucacauuacuaaguccuuguccacugaaggaaagacucauaugaagaagucacuugagagaagcaaugacuuuuugauggaggaacacaacccaaguaaaggaagcaucacaggugggaagaggguaguagaacuucaggugcucauacaacauggcuucugcaaugguuuaaguaugcucaucaauauugcagugucuucuccaugaaggcuagguuaggauguugggagauuuguuucugccgaggcuucucuuccuaucuuauaagagucucuuuucucccuguguccuuacgcaauuuggccuuucaacgugccugcacuucuguuuuuccauccaggaaaugacccauucuaauuacuuucuuuuacuuuaauuauccacauaaagguccuguuuccaguaauagucacaugcuuaaguacugagguauagauuucagcauaagaaauuuuggggauaccaacuggcugacaacauaguagauucugguaagauauggguccccuagucucaccaaagauguucaaccuucauggguuuaguucccugaauucucaaugagccuucaucugcuucacaagccacacaacacacacuuauccagaaaucacugaucugaccuugggugaucccagugggagaaaauauugcaaaucuagagccaaaacccagacagaaaaauaucuuuccuuaaaacagcguuccuaugcccuuacaguccucuuuugcuucacucuugcuguauugauuacauuauuaaugacaucaaccaacugcuaaauguugugugcucuuuauuuuauugacacaguuucacuauguagcccaggcuguuuucaaauggccgagccuccuuccugagcuucuucagugcuggggucagaacugagaucaccguaauggcugaugugauggcuuugucauuggagagccuugaauacagugcucuugagguucgccugacuccuguuuauuaggauugagagggggccuuggaaguaaacacaugccacucuggaacuuaaguuucacaucuccaaaaaagcagcugccaaauauucaggguuuccacauuuuaguuguaaugauuauaauauauagauauaaauacauguguacaugaaaacauaaccaccauuuggugaauguguauuacucgccccaaaacugacaccgaaaggugcagugcagauccugaugacauccaucacacacagcaggaagcaucaacucgaugugacagggccugcaagagaggugagaacaagccaccaugaaaacacagagcgaacauucaugcaaaccagcaaugcucuguggggcuaaugcugucugugcuagaccucaaagaggauggcaagaaugagacaaggaauaacuucacagguucagggaacugcguauggcauacccacagugggaggaagaacaggcucuugcagggaaccaaagcagggcccugugcugggcagagaacgugug

SEQ ID NO: 2442 - RNA, 77027 nt, Mus musculus
cgagcaggugguuauucucccagaacagugacugaugagaaacaaccaggaguuaaaauacgaaauaaaauggaagcaccuugacugcagugucgucgagguaagucagcagccguuccucacggaaugcagaccugccgcaggcccgcagcuuucucuugccuugcugcuguggcgccuuugaagagugucaccuuuguccuuccuguacuacaaagacaccaugcagagcagugguucucaaccucccuaaugcugugacccuuuaaugcaguuccucgggcuguggugacccccaacgguaaaaucauuuucauugcuacuugcuaaguaucauuuugccacuguuauuaauugagauguagauauuuuuggagauagagguuugccaaaaggggucccacugguugagaaccgcugacuuagaugaugacauaucuccccuguaguacaaaaugugugcaucauugcuaagaaccuugcauuaggaaugauuaagaccagggcuugaagccuggcuccaucgcaugcuagauguguaaucuuuguuaaggcauuccgucucuccgugugugccuccguuucuagcuguggaaaaggaggaccagaagccguaggccuuguuccguagcucugauuaggaagguaugcgauugcacaaugcccuuccuggagcgaacagugcuucaaaacaccgaauucuucacagcauaccuggaaccuuccaggauaaauagugucuccacgcugcacguacaacaacauucuuggucacuggcucaucugguccucaguaguccagucucuuuguagacuggaagggcuacaagaacugcuguuuaugucagacccuuaacccuuaaugcagcaacaccaggaacagaaggauuucaauacguuauuugcuuaguucauugaccagcauaauuuuugaauuauguuucugcuuuuccucaacaaagacguaggaagaaacaaaaggcagcauagauguaaaaaugacacuuugguccauagcugaaggaucuguccuuaccuugucccuaggaauggggugccuggagagguuaaugaagagaucauagucugaggggagcacagagcagggguccuuguccagcacccccuugaaggccucccagauggcugugcaguuuuuguuccuguacaaaaaagugccggucagaacuggagacgcaguucggaggguaaggccgcuugugccauaggcaagaggaccugaguucaucacccaccaacccugcccauauggcugccggugccucuaaccccagcauuguauuagguggaaacaggaagaugacugggacuugcuggccacuagccuaacucuagcuuccagacuaagacagaaaaugauagaguaggcugucuuccucucugugggcacaggcacaacacacacacauacacacacacacacacacacacacacacacacacacacacacauucugugcacacaacaaaacagaguucuccaguuuaaggaaagcaguccccuaccccauccccaccuccagacuuaugacagaagcagacaaggccacagauaaaagugaugcuagaaagugacaauuucaaugucaauaaaccaggaaacuucugguuuucagaacucuccuucucccucucccuccccccucccucuccgucccccucucccucccccucccccuuccccuccccucccccuuccccccccucugucugugguggagguacugcacauguaucauguagucaacuguucuagcacugaaccacaccucuggcuuucgccuauucauuaagacacaagaguggagcuccuuguucagguucauuagagggcgagucucugggcccacugaggucaagucaggaggcaagacuugggaagauaggaguggaugccaaguguugggagcaguuuccucuacugagucagaguggcuucuggggccaguuuucacuccugagguccaggacgccuuucaaaaucacguucuauagcaauggucauguuguccuaccuuuggugacaaugaccaaccugacuucuuauguuauucucucauuuuauuuuauugagcugcaucccaauuaaaaacaacuggcaugagaaagagugguguaacaacacaaaaaagcagauccagagaaggaaauuauuucaauaggaaacacagugugcacaagguagggggaaccagaauccucuagaugggacaaggggagcuaauucccaaguggugcucaaaauacccaaacuggcaguuguugauaguaggcaaggcucuuucacucaaauucaccucuagacuggugucgcauuacagcuuucuccucaccucuacacccacaggggcagccuuagcaguuuccucccgggucuggaaauccccugcacaggggaucuugucccuaagaaucaccuacauacacaucaccugcauggagucccgcuagucccuccaccugacuuuccaaagcccucaccucaccccacccuucugccuuuucacugucuggcuuagcacuuaccccaggcucagcagcgugguguacucugcgcagcggcccaggaagaugcucuggaggugaggagugguacccuccccuguccaccgcgcucuugcccccagaagcacugucagcaaggacagccauagccacagccacagagacaacaggccucccuggacagccaucaagaagacuuugauuccucuagcccguggccucuuggacuccucccaguuccucuuccacugaggaggcgguuccccuuagcugagcuuuggcaggacucauccagaugccaagccagcccaccucccauccucuuuccucuuccauuacgacagaaauuaaacuuagggcauugccuggcaaaagacgccucguggagggaccccaaagggaaugggaauuugaagcgcgcgcgcgcacacacacacacacacacacacacacaccucuauagaaaucuguuaccaugugagcccuaagcaaacuuaaauucuguccugguucacacagucuuuccaggagagacaugugcuacccuuagugaaaauugauggcuuugagaaaagccgaaggcacaagggcacagacaagaaucacaugccauuccuaaguugacucuuagggaguuugucuggguggacucuggaugugacugacuggugccuguuuugucuuuccuuuucuuccuuugugagggacaucguccacaggcaucacuuacaccugccccauggauucuggagcacagggcuuguuuucuaguuuuccaagugcucacagauaacuuugucugagaauacaguacggucagagcuacacuccuuuguaauuuaggcaguuuagaugugagauuuggggacuugaauugauacuaaaauaaguucauaauuguaggggacgguagguuagguaaaggaauuuaucauguaggauggaugugaauuuuugaagaccaaaggauaacuccaaugaagccaaaauacccauuagagauguuuacacucauauucuggaguucugugaugauugccuugcaugguagugaaggcucuaugccccaguauaagggaauaucaggaccaggaaugggagugagaggguuagggagcagggggaggggagaggggagagggaauuuucagaggggaaaccaggaaaggggauaauauuugaaauguaaauaaaaaaaucuuucuuuaaaaaagaaauugccaaaaaaaguaaauaaacagcaaccccaaaaguccccaaaacccccaaaaaaccaaucacuauaauaugccaagauuguuacacaaagaucauuuucaaaaacaauuuccuaagugagauuuuuuuuuccugugaggaaaaugugaauuucuuuccugaauuccuaagccccgccaacuacuuucuuuugggaaaacccaacauacuguguugugcuagagcaggucaguaugaguaauuccaauaucugaaucaaauguuucaagagaucagcuacucagugggcuuccuugucaaagggaaacuuuucacugcgcuuucuauacuucugugacaaccuguggaauuucucuggacgggaaagcaacucagcagaugacacagaaacugcaaguguguugcuagccauuucuagcguaguguuagcucaccucuguguucucaguggaacuugcugcuccaucucuugugaucauuuguaacuuuccagcuuauuugauauugaccauauauaugcuuuucuaauucuuuaaaauuauauaaagacucagaugugagguuaaauuuaaaaagcaaaaauaucuuccauaaaaucuucuccacacacacauuuuacauaaacuuuaauaguguuguguggcuccccucauggguauuuuuuaucaugcuggauugcaaaaucuauccuggguuauaacugaauaauaagcaacauuucuaaugguucugcaauacuacagauuagaagagcuacuguguuauuccuaaguuucauuuucagcuucucugcugacucaucacuagaaauuguccacaccagaaucaaauaagcugggacaauuccuucaccaucuguguaagacacucaggacuccuuccuaucaaaagaaggacaaccacguugauaguuuuaugucuuuuuucuuucuuugaaaacauucaauugucucaccauuaacuacaucauucuaaguuucugagcaccccuuuauuuuggaagguuuuaagcuuuuauuugcaagaauauuauuacaaacgauacuuggaugucuuucauuuccaaagggcucugcacauuugauaaagccauauuuuaaguaaucuucauuauuaugcuuuaagcucacuuuuuccuuucugaaaugugacucaacugaaguugaagcuaccaaauuaggaacaguauucuccauuacugucagcauuaacacucacagauccaaaaguugaacuuaaacgugugucuuaaaaaaaaaagacucauuuuaaaaguauuucuuccauuuuaauugaaauaucauaguugcuacuaauaaaaagcagccuaaauaacaguuccaaaaaugcacuuagagucugcaacugauucuuuuagaaaucacagacuucacuuucauuuguaagucauaguugauguccucugucugucgagagagcgaagagaauugggacacaaauauguuccaccaggcucuggucuggcccggaauacccaaaguguuacagcucuuagaagagaaacaagaagguuugggcaggcucagggcagguagucgaguuucucggucucucaucagcuaccaccagccgcaccagcuccagaggcagggguggcuggggcagcuggggcagcagagacacgggucuggccaguuaggcagguccaaggucauugauaaauguuucgggugagagaacucuuccccaaguguuacagcucaguaaaaacagucacucucagauaguccuccaucaaauaacuugugugcuuuauuccuugugaucagagacuauauaaacauugauggguggggugggauuuaaggguagauguuuccuauuggcucagugugagauauagagugaugcucuauuugcaugggaaaggacgucaguguugccuaugugacugacugacugccugguucucucaguggggugucaugguuaggcagguacaaauauggauaggguguggcuggacuccugcugaucucaagucucugagauuccaggaaucugagcucacucagccuuaccaguucuucugucugguggcacauuuaacuugccccacaacuccuuuuugguaauauaaaggagaagugucauugaauuaacugucuccuguauuggaaaugguuuggcaucgaaacaaaaccugauuaguagugaucuuuuuaaugauacucaugugcaguuuuagaaaucggguaagucaaggugccagggcuccaauggcuagugugggaccaaggaggggaagaagucaagcuaccaagggauguaaguaccguaagguagggguguggguagcauagugugccugaggaucuccccuaagaucuuugagcauguguaugccuuguucuaccagcccggauucauugacauagaagaaacauuucucccccuagcaaaaugcgugucccucucuguucagcagucaguaaguccucgggguuuuuguuugauugucuguuuguuuguuuuuuguuuuuguuuuuugagacaggguuucucuguguagcccuggcuguccuggaacucacuuuguagacuaggcuggccucaaacucagaaacccaccugccucugccuccugagugcugggauuaaaggcaugcaccaccacgcccggcugagacucagguuuugaagagcaacucuugcuaaggacauuaucuggcauagaaaggacucaagggugucugcaguggaggccauugacuggccaaguuugucuuggaagucacugaacagaagguguguuuggacgagggcugcuccagugguuccugcuaugccuagugagacagagagccccaaucugaccagccgagggaugaagaucucucucuucuucugagcuccucccagcuguaaggcgaguucuucagguuuguaaagauaaaccuggggaacaaucaauacagggguguaggaaccuugaaaagggaggcuuaugcaggaaccuguagugccuccgcaccagaaaagagcacgaggggugaggggggauuuagcacauauugguuugguaauggacacaugcauguaggauggagucuugaggagaguccuaccaggcaaagggagaggguagaucaaaggaaggaaugucuugugauuuuccuguggguaaggauccagggaguucaugaaaagaaauguuaaugggaacagcugccaauccauucagaaaagagaagcacaggaaaagcauugggaggaguuagggugggugguuaggggacagaugucagcugccauacuggauguaucauugccaggaaaggguagcuuggagcuccuucugagauugauuuuccuguugaugaauauuaacauggaugaagacugauuuggggcagggacaagcuaucaagagacauguaggucagcuacaggauauuuggcauagccauuaggguagagcuuacccauggcucccaucuaccaacauucaucccagggauuacugauggaaagcugaaaaggaguuuuaagguuggcgagcauggugccaccacagccgguggauuccauucuacagcuccgacaucuguauccuccauauguggaggccuccuggaggcauucaccuguguuucaguaaggaaagcagaggaaagagcugggggugggggcguaguggagauggaaucggguuguagggggaagugggcaguccuggguuccuaugauuuuguuguguuuguugugggucuuccugguggacaaucuccaguagugaguacuaggaaggcuagagagaggcuugagcaguagcagaguuaguaugaagaaggacaaaaacagccauaagaauagaggagaggggggcuuguggagggcacauggccugggcagccgcuaccaggucauaauguccuuccaggagaucuuguuguuccuuuaagaggugggaucuccuccgccucuuccuccuccucugaccuugaucugucaguugagagucgggccaucuucuugguuggugaggauaggucuaggcugguccuguagaaaaacacuaacaaacccuuuuuguuuguaaggaggggguuuggucccuuccaaauuccaucuaagggauuucaccauuguuucuggguuauuucuggugugugccaauggagagagauaggaaggaggguguuuggagcucugguagauguuaaauauauuuaggguagucagggcugucauuaauuuacauuaggggauagguauuuggcuuuuguuuuagaaucugggcuuuuaggguuugacguggucuuuuuaauauuccuugucucugagggucaugggcaaucccuguauggugggcaauuuccuguugugaguagaaaguuuugaauugagauauuauccauauaaugauacauauugaguaccuugccuaaauaauguuucaauguaguggucacagccuccuggcagaggguugggcuguuagccauucccuaaggaaagagguuagaccagaguugguaauggggggacugugaaugcaaagcauuguuagcaaaacauucacaauucuuggguggguggguguggagagggauggaaaacauagauauaguuuuuuuauaucuauuaccaauggggggacaauggcaggaauggcugagacauggggcaucccccuuuggggaaaggcccagacuugcuugguuuuauuaauuccccuuaaaucauguuauuaguuuccauaacucugagcuuuuuuuuuuuuuuuuuuuaagagcaaacauagaaguauuccauggacuacaggaggggcagauguguuguaguagaagcuguucuuuuaccaguugugcgagggcuucaaguuucccuugacaaaggccacuguucaauccaaagaacuucauuggaaagccaaucaaggcagagaguauuaaaaucuaacaaugguucuuagggguugauuuggagggagagguuagggucuuuuggguauaguuuucuuuauaggcauuguuaugcauccuaacucuuuuaacaucucauuacucauguaaucccuuucugauugagugguaagcacugccucucccuagagcuacuacagguaauauuagcuccaucaggaucuucccacugaagaggacagcucaggaacuuuggaaaauuccaccagacccuuccccuccuggaagagaaaggucauagaacacauaggcaccccuccccucuggaagggggaggcuaauuacauucuucagaccacagggggaaccgaccauuggccaccuacaaaugagggaaguccagagcauguagacacauuccucagggcagauggacccuugaaagcuguauaaaaacuggcugaauggacugcccggggucaccgccucuuuuggguauaggaugaccccgacaaguugaaacaauaaauuccucuugcuuuugcaucaaucuccugcucugaauuguucacugggggugggggguggggcucaauaagccaaggcucaucagagucuuauaccaacuguagaccugauuggugagaggaguccccaacgccuagaugcuggggcccaggaauuaaucgucagucuuauaagaucuccuguugucuuaaaauugucuugccugcuccaguaucaaugagucauuuaaacagcuuuuuaucuaguuugaugguuauuuuugggugggagccuucugagaugcuggacaccucuaaggcuucuauggaagcaguuuucccucuuacugucagggcugaggaccacccccuuuuaacuuuaaagguuccaaugguuugccaucuuucucauauaagaagguaaaaucucuucuccaggggaaacuuucgcaacacagugggaggacugucuuaggggcauugauuccuuuaugggaagggacuuuucugagcauucauuuuuuucgguguccugucucuccacugcagaaucuccuaaagaagaucucuucugugcuuuauugcugcugcuaaagccugagcuacagauguaaccugaugugauguuccuagccauggguugccacaacccaucuaucauaguguucaucccagagaccuugacaggcuagccuggacucagaagucauacccucccagaugauguucuaagaaggagaucucuggcugugggguugggaauuuuucuuucuacgcuuauuuuaguucuaagauaaaaucaaauaggggcuugcccggcuuuugauggagaaagagcaaggagaaggcaggcucuucugagccugagggugggugagucugucccaugcuugaauugcauaaaggcagaucuguuaauaguaaccuauuagcuguguugucugcugugcucugguggaaaagucucccuggccaaagaguucaucaaaucucuauggaacgucauccccauucugauuuuaccugauuuguugcaggcauucaucuugaaauagggccucccauuguaaaaauaucggaccaggcagggagaaggagcaaauaucucuccaaucuuggggcauguuuaagguggcaauaaggcucuguagaagagauuuuguccaggcugcaugaauucaucuuucuuuacuuccugcccaaguucuuuuaagacugaggcuuggaauggauaccaguugagugguuuauuuagaaugggguuaauauuaacuggaaaugccugacauuugggggauucuggcuucuuaucagagucaugaguagagugguagguggaguuuguuuucugaauagaauagaauagaagauuacaaagcuguugugugguagagggucgcugguagggggcuuugaaguuauguggcuuuaugucuauguuuuugguaggucuuuggaguguguggcuuuguuggcucagggaggaaggagcagagguuaguucuguucauuuugcggggugggggugaagaguacagagaggggugggugaucuuguugguuuuucuaauggaauccuguagagagucagguaguugguugagguaaagaggggcaggugaggccaagguccaucuauggaacucuuccccaagucuuacagcucaguaaaagcagccacuaucagaugauccuuggacaaauaacuugugugcuuuauuccauguggucagagacuauauaaacauugagggguugggugggauuuagguauuuccuauuggcucaguuugaaauguuacugaugcuuuauuugauuggaggaaggacuccaguguuuccuaugugacugacugccauggcccucucagugugguguccugguuaauguguuccagagcagguacagaaauggauagggugugguuggauuccugcugaucucaagucucugagauucuuaggaucugagcucaugcaaccuuaccauuuuucugucugguggcaugguucacuugccccacacauggugauagaaaacuaaacuauauauauccuuacuuuuguucuccugaauaccaaaugacacucacaggcaaguuauuaaaaauaauuacuagucaauauauucaucaucucucauucuuuucuaguguauuaaaauugaccucaauaauccuuggcauaugaaaaauucaggcagaggacuuuugcaaaacauucugguacucuguguuuuauuuuguuucuaaaaguucaccauguggccaacaaucgacuuaaugacucaaagacauacugggguaaacacugauaagaagacauuuugugcugacugcuacuugagugucugauaaugaaagauuugcugaucuccuagacauuucagacuugcuuaggaacuucuuaaaguguuugaaauacauccuagauuuucacugcugaugcccuuugauggggaguauucaaugaucagguuggacuuggugauggauggauuuucacagaacuuucuuagaaugcaugcuuggccugggguuaagaccaacaacaugacagaaaaguaucacaauacauaauaauauuauuaccagccuuguucugaccgguacguucccuuugcauguaauaccugccuuuucuuccagauaaagucacacuacguugcucaggcuggacucaaacuggugaucccccaccucaaacuacugagugacuuggauucuccagguauacaccgccauaccuggccuuuucuugcuuuucauacaaacugaaauccuuuucaccauuuauaaccuaucucaaaugcuacaacauucaacaaauaaguaucuaaaguguuggacacuagagacacaaaacaaaacacaguggauaucguugucaguaaacaugugcagaguggucuguauuauuguggggucgacuuaaauccaaccuaacucaaacaccaugucaaugcagaugacaaaaauuuauuguaaucaaaacacuauugauagaucaggaccacagaauagacuugggagcugaagugugaccuugaagggacauuacacagcauauuuaaaggaugaaaccacaaagcaagggagagcagggugggcuguaacacuguccagucguauuuugauguaaaagguugaguaagagaguuuccauccauuaggauaggaagagguucuagggaacaugaacuuccaugucugacauugccagcaagauggggaaguuguccuugagaugucuagacucagacaacuaucuccuuauuuuuuuaaaaaaaauaucauuauuuuuuucuaauagaagauguuuaguuugggggaaggccccaacucuccuagggccuggguccuugaauguaucuuccccuaugauuaaauggagucugaaaacgaagugauaacauuuagaauaaguuucuuuugcguguucccaauaguaugaaguagagcuacaagaaaaaccuugaaaguaauauuauguggacaaaauagguauaaagaaaauauaaauuccuggccuaaaauucacaacaccacacaggauauguuaacuuaagaauuaaacauaaacauaugugggaaguaguuacuaugcaagaaagagagguucaugagcaaagugaugggaauagaucaaaugacuaaggacuucaauuguuuuuuagcauuuauuucuccaguuggguaaguauacauaguguuucuucugacuuguuuuuuguuuguuuguuuguuuuuuuguuuguaaaaugaucuuauuauguuuuaaaagcauucauuaagacuuagugacuuuaaagcccggcuccaucaccugucuucuccuucgucaucuauauuguccgaauacagggaaucuuacagauaguaacuuccaggugccagcuguaggaguauuagaauguaaacaucuucccaggagacccccaacugauggcucccggaccuccagggacccagcuaagacuccaaagcacuucagccucauuaaaggagcugaucugugcaucuguccucugggauacagaauauuaccucacucuucuuccaucagaacuuaauuuaucucugaguaaauccagaaggucaccuuuucggauccagcuccauuauaaccagccuuuccuccaccagacgcccagcugcagacaaacuuaacccaaaacccugcaguugaaccugcccgcgcaucaaccccaaacgccggcuagugcggagcugggagccgggagccggaucggccugagcgcaugcacgaaguccucggcggcuccaggcguucucgccgcguuaccgcggaagcaucuccucucgcgggagugauuugaagcccggcggaaaccgggcuugccagggcugagucugaggggacggucgcgagcugcagcuccgagcgcgugggccggggagaagcagcugcugaugaacaagggcucucaggcgggcugucgcagcagcagcagcagcgccagagccaccggcugaugguggauccacuccgcuuccaggaucagccgcgacccaggcgauaaauccuaauaaaucccagagugacgcacagccccugugcgaguaucucugagacuguugacguuuggauuccgguuuaccuugucuauuuacuuagaauacuauaguguuuuugauaaucacaguagucuuguguggccuuuuagguuaagacaaccauugauuaaaaaaaaaaaaaccuauaaauucauuaauuagauguacauauguaucuuucccuguaaugauuuuuaauaaaacacauuuugaaaucacuaacuaguaaguacaaaugaaugcaucucugucacaacccauaauuauuuucuguuuaauguagcugcagucuuucauuacaguucaagaaguagauaaagugacuaaaagcauguauuaaucuuggagaggauugccagcacuuccuucagguggcucaaagccaccaguaacuccaauacuaggggauccagcacccucuucuggccucuaggccuguacacacacacacacacacacacacacacacuuuuuauaaugaaaaaaaaguugggcacagaaguuugaaucucaauucaaacuuuauaugacauuuaccucucucucccucccucccucccucucucucucccucccucccucccucucucucucccucccucccucccucucucucucucucccucccucccucccucucccucccucccucccucccucucucucucucccucccucccuuccucccucccuuccuuccuuuuugagauuucccuuucuccuuuuucucucauaccaugcaucuacuucucauacaucagcuuucacucccucccuuccucccagucuccaccccuaacuuccccucucccacaucugcugcuucuuuguucagaagagagccugccaccacaugauaccaaccaaacgugccauaacaggacgcuguaagaguaggcauaaacccucacaucaaggcuuggcgaugcaacccaguaggaaaaagggguccccgagcaggccaaacugcucccacucccccacucccauugccaggagucuagcaaaaaccucaagcuuaacaaccucagcuuggaugcagugggccagguucaaacccagacagguucugugguuucagguucgguuucugugaaaucuaugagcucugcuuaguggauuccauggacccuauuuuccugguucuugaccccucuaguuccuacaguccuuccuccuccuccuccuccuccuccuccuccuccuccuccuccuccuccuccuccuccuccuccuccuccaucuucugcagagaacccugagcuccaccuauguuuggcucuagcucucuguaucugcucccuucaguggcuggaggaagccucuccgauggugacuggggcaggcacagaucuuauaccuucauguugacucuuacuccagcugugauaagccucaacaccauaaucgugugugagucauauaugucagucauggaccugguucaaggguauugacaucuaaucaucuucuugggacuuuguucuucucugccuucuuugucuacaaccacagccucagauccacgggggcaucagucacacggucgagaaucucaugguggagcguggggcuggcucggucauuuuuuuuuucuuggacugcuaauuucauaaucugagaggcucgcugcgcaggguuuuaaagacacuucuuuccaggagugcgugguggcgcacgccuuuaaucccagcacucaggaagcagaggcaggcggauuucugaguucgaggccagccuggucuacaaauugaguuccaggacagccagggcuacacagagaaacccugucucgagccaccccuccccccccaaaaaaaaagaauaaccucuaauguucuaaaguaagcuguguuccuaugguuggcaguauuuacauauuuugcaauaucucauagagaagacuucaaacauucccaccacaaagaaacaguaaauguuuacuguaagggaugccaguuaaccccaaucuauuaggcauuacacauuguauacacauguugaaguaguacaccguacuccacaaauucagacccauuaugugucaauuaaaaauuaaaguacucuuugauucucaaacccauuuguugauuugcaaauauuuauuuuacauggcucaaacuauauaaaaggaaauucacugagaagauucagccuccuuaguucacuuuugucaugguuacuuuuauugucuugacaaaacacugugaccaaggcaacuuguagaagagaguuuauuucugagcuugcuuacaguuucagaggauaaaucagcaaccagcauggcgaggggcauggcagcaggccagcauggcaaggggcauggcagcaggccauguuggagcauggagugguggagcaguagcugagaguuuacacuugacaagccccagucugagggggagaguuaacucagaacggcaugggcuuucaaaaccucaacacccagcuccagugacacaccuccuuccacaagguuauaugccccuaauccuuuccaaacaguuccaccaaguggggaccaaguauucaaagcugugagccuauaugagccauucucauugaaaccaccacaccauccaauacuauuccugaucaucuucuacagguaacuauuuuuaauuaaugccuuuuauuuuuccauucuuacuguagacacaagcuaaugagaauauauauucuuuuugcucauuuuguuguugagauggucucauggacaagaauucccuauaaaacugcuacauucacuccaguagugacaagcacgacaggcccugaaaaccugggcacugucccgaggcaaaaaguucacagaaacuuagucuccuggaaucauggcauccuguauaaagaaugcuccaauguccuugcuuuaguugguaaacggaucugugugcuuucccuuaauauugcuuuauugcaagugcuccuaaggauugauuuuuugacauauagcuaaauuagauucuaggcaguccuugauccaaccuugggcauggauagcugagucacugcccuacacagaaauuuaccauuaucuaggaagaaggaaguuugugaucuaagaaggaaccagaguagauacuuagaacuauagauagcugagauacagccauacacaaguauuuacuauggccuagggggaagguagacuauacaauagacuagaauaggaaccauggcaagggcacccaagaagcccuugacccuggcuucuaagauuaaguggaccuuagguggagcuguuuuugaucccaguuguuaacauugaauuuuaucccagcugguuccugccaguccuuccguguuugcauuccucuguuuuguguaagaaucuuuguaccuugccggugugucacccaacuucccuauucuguauacaaaguuugaugcucgauuugacaaauuacauucagauucuacacaaucucaugugucgcuucugugugucauucgccaacuccuuguccaccugcaaccagagacccguuccacguagauaggagacccagaaaggggauagucugcggcauaaaaaccaagaaugaucuugaacucuugauccuccugucaagcccuggaauuauaggcaugaaccacugcucuuggcugagaauguagucauuauuguuaauuaugauaacaauaauuacuauuauuuuaacauucaguucuuuuugguguuuugauugcauguaugucuguguaccauaugugaacagugcucauggaggccagagaaggcauuagacccccugggacuggaguuaaagaugauuguaagccaccauauggcugcugaaaaucaaaccaggguccccuggaagagcagccagugcucuuaauuguugagccaucucuucagcucuagaaguacauucuuaucucacucaauucuuccuucagaauuucuguaguauucaacaccguuuagaaauguacuguaucauggcuauuccuccauucuaguauuuaauuaaguguacacauuuuccccugucacauauucuauuuugucaauauaaucaaagcccuauguaugggcacuuguguuguuucuagucuguaaauauuggaaagaauacuuuguugaaugucuuaugucuuaaauuugcaaguauggcuguccaacucuuagaauuacugaucaaaagagagauguuuuguaaaugaaauaauauugacaccuacccuucacagggaagagguaucaaugagaacaaaguauacugacaucaaaaugccauaaugaaacuuguuucuuuguacacugauaaucagcuggagagauagcucaacaguuuagagcacuugcugcucuuucagaggagugaaguuuucuuggguggcucacaaucauccaucagcucauagucaccuauaacucuaggggaccugacacucucuucugaccuccaaggcaccagcacauguacacauagucacacauagucacacacuuauaaagaacuuuguaaaaacuagguaaaaguuucucuucugcagacucaucagcaaagaauggaaaauauuguuggcucuugauuuguuuuaguuuggaggcuauucuuauucucucccugaaagguuugacaauguaauucaaugacaaaauuugaguguuugccauauguaaaauaacaauuuuaauguaaaggauacaauguuaggaacacugucugaguuaugguuucuauuguuuugaugauacaccaugaccacaguaacacuuauaauggaaaguucuuaauuggggcuggcuaacaguucagagguuuaguccagugccaucacagcaagaagcacgguggcaugaaggcagacauagugcuggagaagaagcggagaguucuacaucuggaugagcaggcagcaggacaagagaaucacacuggaccugguuugagcuucugaaaccucaaagucuacccacaaugacacacauccucuaacaaggccacaccuacuucaacaaggcuacaccuucuaauagugccacucccuaggagcucaugggggccauuuucauucaaaucaccacaaacaccaaauggaaaaaacauguggaaccucgauacaaggcucucaugcucucuuuaugugcuucaauaccaaaugaucugugucuucaaacuggaaaguccuuggaugugguugcuugaaagucuuuaccugaccuuuuacuuaguaucuaugguucaacugucccuaggcccucuccugcucuuagaguuggaaggauggguugacuaauccaacuccauauauguaguugauuguacuacaggcuagccuaggauguggagcuaccuaauauuccucucuccaauccaauucucaugcaucaccucccuaguauaaauucagaugugauugaaggagugaauuacaaaaggauucaugucuggaaaugacaaguauuuaaauggcucucugcacuaggaacuggggacaaaaaucaaguccccccccccuuuuuuuuguacuauugugcuauuuaaaaggauaauaaaaugaaagcaucuaacaucugacuuaaguaauagaggcguggugggggucauaucuguaaucccagcacuugagaggcugugguaggagaacuuccaugaguuagccagggguaccauguguguaguuaagaaccagaaugcuaaguuggcuuuuuaagucuuccuuucugacuguauuccuucuaacgagaagcagccacuacaaguuuuguguuaucuauuauaucgcuuuccuguuaguuaaugccuuuuaguuagccuuuuggauacuaaaaaugucaugucaacuaacaguguuuauacauagcauaucuaauucaaauuugcgugucaugcuuaaacaacauaauguccuuccccagcugaucuuucuacauaugucuaucaaaguauuguguaacuuguucucgaagacuggauuaugaaaucuuacagcuugcaaguacugcuuguaaauguucugcaaugguaaaaaaaaaugaaugauguuagauugaggcuggagaucaccaggagaaggguuccccagcagacgccauggccugaguuugauuuucagcauacaguuuaaaaagaggaggaagugagucagcuagguaguuuguuaacucugcauaacuuuuaauuagcugagcuaucaagguauguaugcaucuacaaagauguaaaggaaugcaugaacugcuuucugccacacaguggcuauuccauggaaauaugauucauuaauaacagugguggaauaacuaagaaauuagauaggacuccugaagauuacuuuucaauuucuuuaucaaauaaacauauucccccuuuucucuucagugcuacaaauuaugugugaacuugcagacauuaggcaaaugcucuaacagugagcuacaacucccaguuccuauauagccuuauuaauuuuuaguauuuuaaccuuuauuucaagaauaccaugugacacacuugaggaacucagagguuaaguuuaucuuuaaccuaaaucuuuauuauauuuuacuuccuuucaagaacauauuuugaaguuaaaauuugcuguuuaaaguaaacuuuaaaaaauaacauuccuauuucuuuuuugagaauuccauauguuuuggucauauucuuuucccucccccaacuccucccugauacuacccuaccucccuaccuacucaaauucauguucuuucucauuccaaaaaggaaaggaaaggaaaggaaaggaaagggggaggggaggggaggaggggagagggggaggggagaggagaaggggaagagggggaggggaggagggggagagggggaggggaagagggggagggggaaggagaggggaaaggggggaagggagggggagggagaggggagaggggaggggaggagaggggagggggagggaggagaggagagggggagggaguagggggagagggaggggagagaaggggaaaaacaaacagaccuuggaguccaguuaguguuagcuguuacuccagagcaugagccugcuuuggaaagugguugauguacacagugucacucuauugaagaacaguggcuuuccccucucccaacugcuauggauugcaaagagcuucuugacuaggggcggcacuuucugccuccuuuccccccuccauacuaggacuuuggcuggucugagcuugugguuuuguguauacagugacaacauuuuucuuuuucaauuaaaaaaauaaugugugggggcacaagugugcugcagcaaauguguacgugcaugggugaaggucaagggugcaugcacagaagacaggcuucgagauuugagacuuuauuuccacucuguggaauuaucauuuuauacuauauucccuugauaguggaucugucacugaaccucaagcuaagcuggcagccagcagaccccaucaguuuuccugucucaggccagcacagcucaggggucauaaguaaacauagcucccugcuuuuuccuggagcuagggguuuaaggugagggucuuaagacuugggcagcaagcauucuuauccacugaguuauaucuccgaggcuaauauucaacuuuuaaaaacagaaauaauauguaugaaaaugucaucacgaaacguuaaagacuaauuuucaaaguuaaaaccuguuuaaaacuuaauaaauaaugcaaacaaaacagaacaaaaacaaaacagugguuaagcccaacugcuggaucucauaugcaaagugcccuuugaucaaucgcuucugaucuucccccaucccagucucucuacuucuaguucaguguuuuuagaaucuacauguaaauaugaucaugcauuauuuguauaucuguguuugucuuauaguaauuucuuuuaaaaugaagcuuacuuauuaacaacagauuaaaacacuaccacuuguuuaaagucauaaucuacuaagaagugggugaauuucacccauuacuacuuuauuccccacaaacuguaguuuuaucaaaguuagugcaauauaaauaacagcagcaaccaucaguacgauaacacucguaguuuaaaaacugaaacacucaaccuaacuaaaaggauuucuauuauaggagcaaguuagaagaaaguaagaacaacgaaugccauugcugggaaauuguggcaauucuggacaugaagccaugaggaacaugaaucaacuuccucuugcuucaccucagaggguguggugguauguggccuuggacagaucacuuacuuuugacccagauucuuccagaggguucuagagcauaaauguuggucgacuaguguuuuuuccccucuaauuugcuuaaacugcaggauuuugugcaguuuuugcucguguccuuuucucucauaagcauuagcucagcucagauagugcaacuucuuauuacuuguuuaaaaagaaaacauucgggggggggggguacaugcagaacucugguaggcagggaaguggguggaugagagccaaauuauacacugugaacauuaacuauggguggucgaggauucaaauaauuuuagauguauuugggaaaguuguagaugaccucaggaagcccuauggaaauguuagccaagguaacuauccugagucagauuguuucucagaagaaauuaucugagucugcaauaaagcuauuucuagagagaaggggaaagugauuauggggugguauucgcuacuuguacaucacuguuaccaaaaaucuaacagagcaucuuccauucauggcuucacagggcuuucuguggcaggcgugaguguuggagcucuucauggcguguuggaucagaaagcagagacuauggccagaaccagggauguuuucaauccucaaaagcccaguucuaguggccuucuucugccacagggacccuaccucccaaagacuccucaucaauccaaaucaauauggcaagcuggaggacuagcauucaaaacacaagcccaaugggaaacacuucagauucaaacuguaacauuguaucucugccugaagaaggcuucugggcuucucaaacugcaaaauggucuuagcaaaaccucaagauuuagcaucguuuuaaccaaugacauuguucaaggucugauaucuaaaauaucuucuaaaacguauaccaaucucuuagcuguguacuccuguaaaauauaaaacguuauaaacuuccaauauucauacauacauacacacacacacacacacacacacagagagagagagagagagagagagagagagagagagagagaaagagagagagagagaauauuaaaacucagaagggaaaacaacaaauguagcucuccauuauccaagcucuggccacaugucucugacaugugcuucaucugauggugacuuuggcuggcuccucucagugccuucagcuucccucuggagacaucuuuugcucccagggucuccacuucuuggccuuuccauugcacuuuagauuucauuuucacagcuuuguaaauaaccugcucagggcuucccauuuuacacugccuggccgcugggauuuggugcaagcagccuugaccccguagcuuuuauguuaugcaggccugcaaaaucagcauggguaaugcugaguucugcucccaucuggaacccuggcugcagaauucuauggguaccuacauaucugaccugggaaaugacuuccuuggacagccuuuccuuauagagugcuucuguggcuuucuuuucaggcaguuuuucauauguuuguauguucacaucuuggaauuguuaaugugcagugccugguccaugaggcgcuuucccucuugucccagugcaaucugcacagguuacuuuucaauggcucucaucucuuuuacauuauagauguuuugucugcagauguuaaaacacuuguccuccuuccuccgcacagaaggacacauuuuaaaaucugucuccucagccguuuguucuaagucucacagaaaugcugucucccaacaacaaacaacaaccguuacauagacuguuauuuuaucuugaaauuuccuacaccaacaauauucugcauuugaauuugcauuuuuauucaaaucuuuagggcacuggcagaauguagccagauucuuuucuacaguguaucaugacuauacuguuguucagaucccuguaaguccuuguucccaucugugccuaacaagcagacucugucgaccauacuucuguugguauuccagucuucugcauuccuaccagaaugacucgucgaacaaagcucacaucauuguagaacuucucucaccuaguuaaguucuaccaaauuccucccacagauuaauuccaaaaguuuaagaaccacauagucagguuuugucacagaaaugagcccaccgcucugguaucuuuuugucugauuaaauuugcacuguugugaccggaauaaguaacagagacaaguuaagguaagagaaguuuauuuuugucuuuguuuucagguggauuucagcgcaguaggauggggaaggaaugacugacaggaguaauucuguccauggguagguaugugguagaacucgucacaugacuaaaaccaaggaaagcucuaucuuucagaggccugcucccaaugguccaucucugcuagcuaagccccaccuuauuaguggcucugcaguucccucaaauagcacaaccaaucaacauaacgcauagacuauggaggauucaaaccauaagugguaugaauaucucaaaguuaccuuaaaauuucagaacacugagaguguucccaauaacugaagaacuacagggcucucagugacaacaacugcaaaccauuucacugaacauguggaccaaggcauuccuccacugggacuuuuaacaauauguucacaaaggaguaagccauucuuuucuaccuggguaccugaacccacaauggcugcacaaaaauguaggacucagaagaaugggaaaaacaauuggcuuaccuuucaagcaggucgucaccauagccauaguggugaaacgucaaugacugucugucuguccaugacugucaaaaauuaucugugaggucaaaaugcuuguugguaagaugggggucuguagaggcucuguggauuacagacuuugguaagucauguaaccuccuuuuuauucuuuuuaucugcaaauccaagaugauaguagcaucaacacuucauauccuuauccuaugaauggaaaugauuuuauguucccaaaguccuuagaaaacugcuuugcaaucaugcuuaauugcuaacauuauuucuuuuaggacaaaugcauaaacaacaaguuagugagccccucucuucuuauaaaauggacaucaugguguaggccugauuccagcacuucagagauagaggaagaaaguucugggguucaaggucauccuccgcuacagagaaguuugaggccagccugggcuagaugcugucucccaagccaaccaaacuaaauaaacauacacacacacacacacacacacacacacacacacacacaucaccuccaaaauaagcagaagucaacgagaggaugguaccauagucuacacugagauggaucaugagagcccuggaggucaagcccuaccuagacaaccuagcagaucccaccuaaaucuauaaaagugaaugagaugggaaaccagaagaccuggcaaacuuagaggacagaagaacagugaaucacacugugcuuguugaauaguaagugagcaaauuuuguuuuuaaagcacuuaaaaaaaaucauguaccaggcacuggucaguuagcaacauacuuuuuguggacugacaauaauagaaaguuucuuuuuuguuuguuuguuuucuuuuuuuguuuucucaagacaggguuucucugugcagcauuggcuguccuggaacuuacucuguagaccaggcuggccuugaacucagaaaucugccugccucugccucccaaguguugggauuaauggcaugcgccaccacugcccagugugaaaguuucuuauucuaggaugcaaaaggguucugauuuauuguaaugguaaugccacaaugaacgggccagaauuugaacacagacaauuggauuucaaugcuaauauguugagguguuacuaaaauccuuacauacucacuggcucuuaauacuagagucuaauaagagaguuguuuaauaauaaagcuguuucauauagcuuuacauuuguaaucaccacgguaccuauuguaagggcuaaucuuuaaugccaacuugaauuaagaagcaucuaggauacugguaaagcacacaucuagccuguuguuaugaugcauaauuuguugcuaacugaccagugccuggcacuuaauguugcuaaaugcuuuaaaaacaaaauuuucucacuuguuauucaagaaacaaugugacucacuauguguuggugagggauuuucugaggaggauugacugaagagguaaaaguuacccugaauguggguagcaccauccuguaggcugggccuuuagauggcaaaagggaaaaaggaaguucacccacccagguauucucugcauccuaguugcuaugugagccacacccucucuucugugauggacuggucucugaaacaacgaagcaaaacaaauccuuccuuccuuaauuuauuccucucaggauuugucacagugacuaccauaccuaguguuugcugggugucugcuaugccagacauucuaaucacuguuuuccugaaggauguagaagcuaacauucauagaaguuuguaacuaugcccacaguugcauaugcagcagagauuugaguacaggcuucuuuaucaccaaugcauuuuucuauuucuauacgcaucuuucauauuuagcauauuauauauuuaacccuccuuaccugcaggcuccacauucauggauucacucaaucaugaaauggaaguguuuaugucucucuguguaugugugucugugccugucccuacucuugugagggagagcuucuuucugagaugaacagugcagacuuuuuuuccuccuuacuucccaaaguguggugauuugaguaaaaaugucuccuguaguuucagguacauggacacuugguccccaguugguggugcaguuuugggaauaguacugccuugcugcaugaaguacaucacuagggguggccuuugagaguuuacauagcccccgagccacuucuaguucagucuuuuugcuucacacuugugaaugaaaccagcucucugcuuccuguuccuuuugccaugccugcuacugacaguuauaucuuccugucgugauggucucaucccucuggaacuguaagucagaauaaacucuuucuuccacaaguuuguuccauaagucauggugcuuucaacauuaaagaaauauugaauguuaaaggaauauuacaucuauaacucaaaaguuaagggacguguguggaaguauauauucaaauaugguaucauuuuguguaagagcuugaguuucugggggauuuugguguucuugaguggggugggagggagcuguucuggaaucaaucacuguacuuauuugugugguauccugaugccacaggcuuuacaacccccuuauuagggguaaaaaccuuuuacuacggaagcaucaccagugacuggaaugauguuuuucgaauguuaguuacaaaggaacauucuagaauccugagacuaacuacaacugcauugacucagauuuccaugggaaagacucaggcacuacaucccuuuaugagucuugagguccugaugcagguucuccaagaccauacuuugagggcacugugaaagaugcuaugucaauacucuuggcauucaaguuucugggugaaguuuuacuacagugguauuguugguacuguagauuuuaucgccuucuagaucuuauccacuaucauuaccuuagcugagggcaagcacguagguaagaacuuugaacagcauguacucugccuccugcuauguggaacaugauuaucuccuauggucucuuuccacugauggcuguguagcucaacaagucuacaaggucagauuuguuuuuagugagacguaaacauguaauaauggugcuacaaggaagcauugacuaaauccuacuucuugucucaauuuggguucccucaucuguuaauagaaccccuuuucaauguuuuaagguaacauugugcuaguauacggccaaucuuucaauagcuaugcuaucaucauuguauaauagaguccucccuuugcagaggaauaaaaaaaguguuaugcuauggcuaaaggaaggacuaucuuaucuuagaugagggaaaacaugagcaaaacauauaauauggaaaauuaaauauaauaauaauaauaaagaauugacuugaaucuauuuugucauauauauuagaauagaaacacauagcccuggaauuucaucuaagucauuuuaaucaggggucauuaguauagacucuguaaguuuuggaggagaaaauugccuuguuuuuguuuguuuuucauguucuuugugucuuugugcugagaucugcucaucagauguuagaucauuaguuuagacuugcugguuuuguuauuuuaaauccagguugccuuuucucuuucugguggauuaauuugcaguguucaagagagacuggauuguagcauaauugugaugauauuucauccucuuagauugggguucuaggcaucugguucuaccuuuaaucugccccaugaguugagugcugccugcagcaacugccacuaucuaguauuuaauccacucugauaacagaguagcaguagacgucaaaacugucucuuguuaggugcugguuaauuuugggagugaggcgaccauaaugauaccgugaauagucauauguuaggauaaaugcaacggaagagaagagguuagcaaucaccuugagagcagugaugagcauucauuuauaugggaagcagaugauagagauauacauaggaagaguacguggaugugagguguuuugguuaauaguagacuauaaagagggaaggucagccucugggcuuugagagaugucacaguaagaggaaugaguaugggaaagagaaagggcaaaaaagaagggaaaaggaaaaagaggaagggaaaauaggagagggagggagacacacacacacacacacacacacacacacacgagagagagagagagagagagagagagagagagagagagagagagagagagagagagaguuggagacagagaaagggguugggagcucaccagcacaaagauaugugaaacagccagggacagugcugucuuguuucagugccuccugcucuaucuagauaagaaguuaagcuguaggggagcggggagagcuggagacagugggaucacuggcagggaagaauagcuguggugguagagguggagcgauggcuucacaguuaagaacacuugccgcucuuccagggaacucaggcuugauucucaucacccagaugguagcuucacaaccaaccgcaugcccucuccuaaccuccauggacucuacacauauaugugguacacauacaugugugaggacaagacacucacauauaaaguaaaaagaauauaguuggccgugguggcgcaugccuuuaaucccagcacuugggaggcagaggcagguggauuucugaguucaaggccagccugaucuacagagugaguuccaggacagccagggcuacacagagaaacccugucucaaagaaaaaaaaagaaucuguaaaaauaaauaaauaaauaaauaaauaaauacuuuaaaaaauauagguauagaagggaaggggagcuggguggaaacaagacaaugagauuacuggccugacuuagaguuccucuccuuggcugauccacaacuuugcuagcuuagcccagguccuggcugugcgccuacugcaucugaacagucccguuuucucugugggcucccagcuccacacacuaauguuuucuugacuguucuccggcacguugauagaugaagcuaucaacugcccaggcucagcuucuguguucucacagaggcagcaguggcuaggggcugcauggugccccaucaauguucauacuuuguguuuaccucccacagcuuucucuuucccuguuggagugcugauggugguggccuuggaaguagucacugggaagcucuucugugaaaucuccaagagccugcuuuuguggagucucuagucaguccuuuagccaauguagccuggaggaaaacgccccugugacaguggagcaagucagguccugcuguagauaaaauuugugaccagagagaggaaaggguuguuugagauguugagcaagucaauuccagguuagaagaggcagcuaauggauugauaaaacauuccugcuccccacccccuuuucucuaaucuguaaucagguacuccaucggaugcaguuucuauuccaucauccuacccagaagccuuuauuuuuuuugucuaugaauauuuaccuggaugaguguuccuguagcauuuguuuauuuaaugcucauagaugccaguagagagcaccggauccccuggaacuagaguuucagaguauugugagcucccauaugggugcugggaaccaaaccuggauucuuugcaaaggcguugagugcacuuaaccccugaaccaucucuucugcuccagaaaggguuuuucuguuuuguuucuuacauaacauggaguaggugagaugaacagcucagcacauaaugccugacuacaugagcucugccuagagacucacuuguuggaaggagagugccaauucauacaaguugacuccugacacaagcugucuucacgaccucuuugguacuguuaaccuugaaugugggaggaggaagacccaauccaggacugucugcuuaaauccagcuuuauuuuagaagugcacccggaacugacccuguugggauuugagcgaucagccccugacuggcuuuuugaggucucuuuuauggggugcagggaagcuaaggucaauagaaaacagcuguaaggguguuuauggggcaagaugcugcugcaaacaauacaaugaaaggugagaauaaaagcaaggauauccaucaugugcaaagagucauacacuauggggcaggugggcacagguauagaucaagguaucuuggaaggaaggcaaagaacaaucauacaccguggggucacaaguucacugcagaguacaauagguuuagcaaacagaaacuuauucuuuuuuuuuuuuuuuuucucaaugacauuuccaaugcuaucccaaaagucccccauacccucccccccacuucccuacccacccauucucaguuuuuuggcccugguguucuccuguacuggggcauauaaaguuuguguguccgaugggccucucuuuccagugauggccgacuaggccaucuuuugauacauauguagcuagagucaagagcuccgggguacugguuaguucauaauguuguugcaccuacaggguugcagaucucuuuagcuccuuggcuacuuucucuagcuccuccauugggggcccugugauccauccaauagcugacugugagcauccacuuauguguuugcuaggccccugccuagucucacaagagacagcuauaucuggguccuuucagcaaaaucuugcuaguguaugcaguggugucaguguuuggaagcugauuaugggguggaucccuagauaaggcagucucuagaugguccauccuuuugucucagcuccaaacuuugucucuguaacuccuuccauggguguuuuguucccaauucuaagaaggggcacaguguccacacuuuggucuucauucuucuagagcagaaacuuauucuuaacuagcaauagaaaccuauucuuguagggcacggggacuuaacaacaauguggcucuuuaacaacagugcggugacucgauucugguuucacaguacgagugcacaguauguauucuuugucaggaugcccccacacuacacgaguaagcauaauaaauaaaacaaagauaccuuuaaaauaagucaaggccuaagagcagagugcacgcuuagcacauacaagucacugagucuuauacccagcccuuaaaagaaagaaaucaaucauaaguauaacaguuuuguuaucaucuugcauacaaagaaaaugaucagaguaacccaaacgaguccccucgguagagacauuauggacagugaaugaagaaaucgugauuacccugauaacacaaaguaauaauugauuguagguaauauaaucauugacugacuuaucugcuuguugaugauugauuuuccaaaacaggguuaguacuuaccugacaaaguuauuuuuccaugugcuagagauuagugagguuuuuuuuuuuuucuuucuuuuuuuucccaaugcccccuuaucacugagcagcaucccagaccaaggcuggaguugaaaaaaauaugucccuagagugggacuaucauaggcaauggcugaaguaagauuagaguucaggccaguauuucauuuacucauggcuguuucagaagaacagugauuagucuauccagggaaauccuugucuuuuugaccaugaaguuuacaguuguaccuguacuuuuugucuacuuuauuggguucuuauaucuaccacccuucuccacuccaauuccucucauccccccaauacuagguaggagagaaagaagauuaggggggaaagaaagagguugccgaacucuuagacuacuuccuguugauuagaguaauggauugacuuggggcaagucuaguuuucuuugccaggauaucuccaaccagcaaccagcaacaacuagcaacccguagccaucaauccagcaaacaguaaccaccaccaccagcagcaguaauaagggaagcggcagaaggagcagcagagggagcagccccuuaccccaucugacauuuuuauacccucugaaagaguccccagcauaucccgccccucgccagagcacuagacaaaucauagucagcugcugugaacaaucugaagcagccucauaucccacgccugggagugaaacaaaaguacauucaccuaacauuucuguguuuuuaaaggaaacaaaauccucacgacacuuuguaaauuuucauaaaguuauuuuauauaauaugaauuuuuuuguacucugaaguccccugccucuguguccccaucccccucccccucagucagagcuagagaggaaggaaacagacuaguauuucuguaaacauuuacccgccuuuuggaugggauuaggcaauuacucacuggauuucgucauuacaaugacuaaauccaacaauuuacagaagcuuauugcucuuuuguucuagcugcgugugcuguuucuuacuacaagguaaaauaggcgcgaugagcuggcuaugaaaccagccaccuucucgcaggccaacacaccuugaguacacagucaggaacacagccugaaugggaaguccaagcugguguugaguuagcaacauuaauugagaaaaagagaggggggugggcugugaacaucaccaaaguacauuguaugcauguauaaaauucucaaagaauuaauaaacuauucguguuaaaacaauaggagaggugaaaaggucaggguguuacucaauaguggaaugcccgucuggcaugaacaaggggaauggggugugugugucagacucuagcaguuaaaacaauccaaccaaccaccaccaacaaaaagccuaagagagaugacacucagauauguuuagggaauggaaggcucuugucuggaguguuugcaaagagacacaggccuuucaacacuucuucacaucucuauauuuuaaacaaaacaaaccuucaacaaaaggaaaucuaauaaguaggcaugguuaugcuugcuuguaauccuagugcuuaggaaacugaggcaggaggauugcuacaagucucagguuagcaagggguauacagucagacugucccaagaaaaaguaaaaagggaggugggggcggggggggggggagguguccuaggaaaugaaggagcauccacauuuggacacuugagaauuuauuguaugcuuuccuccucucuggaaacuagagcgagucauucuucuacuuacucugucucuauuacuuccuauuuucuuuacuuguuugcuauuucacuaggacagagagucccaacaacagucaacuuugguuccaucccagagcuuaauagcacauauuacuaggcauucaauaugcugauauaaacuaaugacaggaauuacauuuugagcagcagagugaaugcguaagacaugaauuuagaccauaauguuuuccacucacuagcucuaugauacuggaagccaaugccugucuuuguacaucaccuucuuuccauuuagugggaaaaauauaacaguugacauaaaauuacauaugacccucuggaaaacaucauaaaugcccgaggcaugcauugauguauuucaaguaugguuucuucccgucaauuuuuuucuuuccuauuuucuuuccccugcucugauuuuccucaucuuuaaaguguuuaauuuguuauuugugcacguuugugugaauguacguuccaugccauacuguagaggagguccaaggacagcuuucaggaggcaaguuucuccucccaccacguggacgcagcagucaaacucugcucaucggguuuggugguaaagcuccuuuaccugcugagcuaccucacuggcuccuccuccucuuuuuauuccuagcaaacuuauccucccaccccuacucuaucccuugucucggguauccuauuucaugccuuugaauauguccgacuaauucucauguacugaguaucagcgaacuaccucuagguaaccgaaucucacaccuucaaaacagggcacauuauguaguuucugucuuccaaugugaugcucuucguagccuucauauaagaagggaacuaugugcuacagauaugcuuccucagucagcucucuguugcuguaaccauggugguaauggguggcaaaacuacuuagcucauggcaggaacuugaaagaaggaacuaaaguucuuguauccccuuuaagaugacaucugccaaaugacuggaugaacccuuacuauugucuacuucuuaaagguucuacaacuucuccaaagcacuaugaauuggggaccacaccuuuaaugugugggcuuugaagcauacuuagguaaaucaguuuaacuugaaauucuguaaguggacaccaagacuaaugcuguguauaaaagcagacuccaauuaggaaaauguccaaggugagacaugucccugaaauagaaacuuaaggguucuuuggaaacuugguuggaugauguuuugcuggggcaaacacacguaggaacauuuagcugaagcagacacagguaaaaggaugucugcuaaagcaagcacaugaaagcacaugugaugaaggaucuuugcuaacaauacgguuauauugguccaccuuacauuguguaguugagcugcauuugucaggauucuauauagagaaaugcaccaaaaaaucuucuggugguaugcugcaguuuuuggcugcuuccaaggucuugauuggcagagugaugucagcugagacagacauacaugcugagguaagaccuguggagaaaugauguauggaggaaguauaaauaggacucgauggacagugccaggggugagcuugacuugcuuaauagagcuagcuguacaacccucgugguucucacgucucugcugaucuucgcuucccugagagaggcagagccgagauccuuaggauccuagggauccuucuggucccuccugauuacuugugcugaggcugaggccuugcugucucugcuagguagugcuaccacugaugauucgugguugcuauccugacucuauggaacuggacugcugguguauccaugaaguguuugggagugauugagcugccugccucugcugaccugugaacugaacugccgauuuccagacgacacagacggcaguugcuccgaagaaccaggucacuaccccaucucuuuuauuucccacuaccucugguggguggugggcuaaaagggagguuaaagcauuuaagaaccauuauuaaaaauagguuuugaaaaaaauuaaaguuacauguccuuggacuucugacaguuaguuauuuggaccuuaaagggagcugguaccuauuucagguaguuagggagaacucaccaagauagugugccuuaugugugucuuguagggcuuggucugaaaaacugagagugcuuucccagugaaaaauggagagacuuaggugucaggaaggcaagacacuuggccccagucucugaugucugagacaggaugggucucagagauuagcauaacucaggcauugccuacagauuuuguugcccuucuugucgaugugaccaaauaucuaacaagaaacaacuuaagggaacaaggguuuggcuuucuguuugagaguagagucaguucaucauggugggacaggcaaauggcuggagcacucaaagcugcuccacagacccguaggaagagacagcacaggaagugagggcaagguauuagcccaaggucccauaggucuacuuuguucauuaaaacaaaggaagugaaugcuugaggaaucuccugucucugucucugucucucucugugugugugugugugcgcguacaaguggcauugaggucuauuuacauauaaaaaugaggaaaaaccccaagcacauuuggucuugcauuucaacuuaugagcuaucuuuuaucuuuucuuucuccagugccaaaauucuuucuaaaaucaacuuaccucauuguaacagaugcugaauggccacuaaaaaguuauuacuuauguguaugaguguuucgucuucacguaugucuuuuuaucacauucaugucugaugcccaugaaggucaaggaauugaacccaggucuuuuggagauguagccaguguuccuaacugcugaaggcucucacuagcccugauuagcuuuuuuuuuuuucccuuucauaacggcaaugaucaacucuaguacuguacugagcucaugauucuguuuuauaauggcaaccuuguugucaguacuucuuuucaaagucaacccucugguggggacaguacuaggucauauacucaaguaaaguuauaugccuuagaauuggcugauucugacuaggaauucuuccucaagucuucacaaauacuguugggaaauucugggaaaugccuucugucaguguauuuucaguuuuccagagaacaauuugacaccuuccuccgcuucauguuuacuuccuauaagauuaagagugagggggaaaaagucaccaauccaagaaugaggcuuuucauggcagugauauuacccagccccuuuguggggauaaguggauagguggucuguuagaguuucuguugucauaccuaaaggggucacagagagaugacuaaccugcuagacuggacuuuaguagcaauucaaaucuguugugauuguaggaacuuagagcaacaguauaacauuaguuagucuugucucuuaggcugaaguucaacgugaauuagucauaucuauagccagaugauugacugaucuuuacuuggcccauggggauaaugucaacagcuuccuugagagggaaaaugacucauaggccuuauuuuuuaaaaucgcuuauuucuuucauuuuaguccuugaaauaaauccugugaaauagccaaauuccaaaguagcuguauuuuuucuuaguggacuauaauccuuccaauccagguuauagugaaacucaguuuguaggugacuauuuuuguuguuauacaccuacuaaaugaggcauauauaauaugauguauuuauaguuaauaugagaaaaaucacaaggaugcugggugcaucccucauucuuucuuuauucugguauucuugauccagcuacugaggaaaaucucuucauauagcucuauguaacugguacacugaagucggagucuauauuccaagauggcuagagugaaagauuaggauauaacaaaugagggguuagcaaaugucuuuugagaauuguuaaaaauauggaggcaaagcccugcuuaaacagcggagaaaagaaggggaaaagagggaaacagagaagggaacagaggaaagaagaauaaugggguggagagggagggagaaaucugucaagacuuaucaguucuguaagcuauuuuuguuguuguuguuuucuuuuucuuuuucuucagucaccucuuuguuccaacuaauacaguacacaggaacaaacuuaucgucagaucuagauacauuuggccagaauuuuauguacugauuugugaaauccugggcaaugucuuaauuuccuuugucauagcuguuuucucuaacauuguuuacagggaguauucgugaugagguauuccuauuagcacuucaaaaauacacguacuccguuuuccuuaaaaucuuaugaaguagguuauuuauuccccucaucucauuuuacauaagagaauacugcggucagaacacagaagucaggucgcucuccaagguuaguacaacuagaguuuggugaaaccaugaaccuaagcuucaucuccagagucuguuuuccagcucaauuugcauguuaauaucaaaagguaaccagaacuagcugcacuaauagaaguaucuuuuuauucauuuucugagagucugguuccuuuuaaccauugacaugaauuugggguaggaaauacaaaggugaauaauguagcauaucuucugcuuacuguucaaaguuuaugguuguugagaaaacgacacacccuucccagguucucagccuugcccguguuucucccauuuuuccacgaauucuaaagccacggggugagagccggcucugauacuugggaaaagucuacuggagggcuuagaugaggacaggugacgugcacuggccuuucucuaggcagugaccucauuuauggcccuuucuuccugucugagccuccucggcuuaaaauggcgggauuugugcuaaggcucucucccuacuagacagccaugauggcuccccgccccccccaccccccccaaacccccgcaggcucaucuggccgcucugggacugucguuccugaucugagguguugguccucccucugguguuuccaguuccccagggccaccaucccacucugcuccgugccaggaggggugaggaggggcugccagguccccagcucucagccgcaggggagaggccaugcuaggcccagagccagcaucccaggccuagcaaaacccgaacgaggcagcaaaggcggcugagggcucggcgcgcgcacagcccgcccguccagagcacgcaggcucgaucuggucacgcaggucccugccucaaggccaggcacccggagaagcgcccuugaagacccucgcccugggacagugcgauuuuuuaagagauguaacgcaagggaccagggacgaccaugcccaccggaggagagagcucugggcgccucagcgcgcgcgccggucacgugggccgcggcaccgcauggcggcggcccgcgcgcccccgcgucacggccccgcggaaccgcccgggcgcgcgcgccgacggggcgggcgcaugcgcaggggggcgcgccgccucugccccgcggcgagggugucuauggagaggcggcggccgcggcugcugaggcggacgcugaggcaguggcgauggcgcccuuccccgaugaaguggacgucuucaccgccccgcacuggcggaugaagcagcugguggggcgcuacugcgacaagguaaaggagcgcggggcggagggcggccgcggaggagcggccggguuccgggaggccuggccugcgugccucccgcaacccccgcguuggcgccgcgcgagcccgucgcccgcgccccggcacccgcgcggcucccgaaccuucccaccggggucccgggagcccgcgcuggccgcggccugggacgagcgcucgcgggacugaccugugccggggugaggggcgcucccggccguccggcucggccgcccgcggggugcccgcuccccguccgcaggccgcuucugcgguuacucgcagccacagcaccgcucgcccggucccuucgggcucuuuuagucgcucugcaaacacugcauccucucucuggaccucuugacuugcuuccuggcuccacaggcagcgucuugcagccccuggagcaggcuuauuuuaccugccugcuuugcacugguuugguuccguacacaagcccgguacacggacugggaagaccugcacuccucuuuccugguuacucuuuuuuuccuuccaguuuuuauuuuuccuggauacuuuauuccuuguagaauuuguuccucuguuggacuuuuuacuggaagcaaaugagaggggccccuaggaaaaguugccuugcaguggaacucacuuuggacuuuuaauggguguagccgaaguugaagaagcacucuugugaagaugaguugggaaccuuuuucuaaugaugcugaaaacucugaauugucacuuuauguucggaagaucauauaugaguaaauucugggcagucauauguuuugcaaaaaaggugaaccaaauaaauagcuguuaaguaauuauuaacuuaaacguaaaaauaaauugaauuaucagagauuacguggaauuagcaccacuauuaacagcaaacaagaguugucuuucaaucuggagaggugcuaggaaggaggccaaugucuucccugguaggccacgggaagaccagcaauuugaaguguaggaucuuagcaucuuggcugcacaguccucucccuccauuuugggaaaagaaaaacaaacaaaccaauaaacucaaacccaguuaguccuaagccaguggaccuuuaaacaccaagaccauaggcucauggcucacacuacuugguugcccaagcuugcuguuaaaauccugauggcugaacccuaacucaaauuggaaucucugagcauagaacccagaugucaaguacaguuuagagcucucagugagaguggggcccagcaauggugaguaccaccuucccaggggaggcuuaaggacuggcuaagccuugagcagaagaguauguauacucgcgguaguucucauuuagugguuguguuguuuguaaucucccugccuuuugauuuuuuuuuucauugcacuacccuuuaauuucaggaauuucucaaaaaagcaaaagggaaaugaagugaagacuaauggcuaguuuuggggagagguaguccagagacucccugguaauaugggcgaaauuuugucaauguguacaucuuccuuggugcuuucuauaucucuucucuuuuuccuucuauuuuguuuuguuuuuccugugucuggaucuuguucuauagagccagcuaaccuugaauucccagagaucugccugccucugccugggauuaaagguaugagcuaccauaccaggcuugucuaucugugugucugucuuucuuuuucuuuuucuuuuuucuuuugguuuuucaagauacgguuuuucuguguagcucuggcuguccuggaacucacucuguagaccgggcuggccuugaacgcagaaauccgccugcuucugccucauaaguccugggauuaaaggcuaauauuucuuaagauguuuaacauugucaaaggauuaugaccuucccaaauaaucaaaauuuguaauguaguacccagucucuuuuuuaaaauaaugaggaaguuggucauuauacuuugguugguuugguucugauacuguuuuugagguagaaucucccguaauacaggauggccuugagaacucacuguauuucagaggcuguccuugaacuccugaucuuccuucuagauucgagaacuacaggcauuugucaucaccccgggcacaguaauuuugugucuccuuuuugagaauguuugaauaaauuuugaaacugcaguugacuuuaaaaaaaaaaaaaaaaaaaacaagucaaauaagauuauucucaguaguuaaauauucccuauugcauaaacuaauuuaauaaagcauuuuuaauuugguauagcuuuggucaaaauugccacugauuuaucaccaacacuguacagaaaaucacuaauucugaauuaguugaauauaguuaaugagauuaucacauauauucaucaagagugcuaaaauuccaguuuucuuaacuaugaucaaaguaauuuaguugagaaaaaagaacuacacaggcauuuucaucauuucucgggguuaacauggccaguagaagguaaucuggaugucuuugcaagugaagagugggaaaaugcacguuugugauggcagaguaguagccuugaaggauuaagagugguuuugacugguuuguucucucaaggcuuguccuuucauuuagcuguguaggucaaggauaucaaucugaauguccagaaacuauaaagauuucaauuuuauucccauuauugaacuuauauauuuauaaaaugauuucuuuaggagcaucaaaucaguuguucuauuauuugagcaaugcauuauucuuuagugguuacagauuauguuaacaauugcuguauaauaguuuaauguguugccuguagauuuucucauauaaaaaggucaaccagacaaaauccaacaagcagggagaagggaaaguggguucagagucugaaucuacugauguaguaguaauuuacaagugauagguuucucuaaugacuugucacuggguauaucaaccacccuccccaugcccaggaguaguuggccaacagaaaacagacuccauaguuuuuuguuuuguguacauguuuuguuuuguuuugguguuuuugucucauugauuuuguuaguuuguuuucagaaaaagguguuacgggaagguucuuuaucucugccgugcagaccacaggccuuuggcgcaaagcaaguaaaaguauuguuugcuucugucuuaugcuggggauucaugggccuggauugguuaggggagagcuuauuaagauagugauagagacucagaacuacccaaaucagguuuaagacucucagcuuaauuuucuucaucagaagcugagauagcuuuugauuuguuuuguaacaagagucuuguuucauaagucacugacccugcagauuggauuauguguaguaaaaauuggaggcaaaugguagguaauccuugcuccauuuucuucacaauuucuaguauucccuuuaauccucaacacuuauuuccauuaguucuuuucugucugcccuguaguaguuucuauuggcauugugaggccugauugcuauuccucaggagaucacaguuucauaucaguuucauaugcacuaucaucugugcuaauacagaaauccaaaaagugcagugggagcaaacagaagaagguacacagcaagcacugggaguaguugcugaguugacuucugagaacaguuacgugguuccuauagagauccccaccacacacacacacuauauauauauauauauauauauauauauuuguuuguuuuuuugagacaggguuucucuguauagcccuggcuguccuggaacucacuuuauagaccaggcuggccuugaacucagaaaucugccugccucugccucccaagugcugggauuaaaggugugugccaccaccaccucacaauuuauauauauaccugaguuacaaaaaaguuggggagaggcuugagagauggguuagcaacuaagagcagaaguugcucuuccagaggaccuaugcucuauucccaguaccaacaugcuaauucacaauacucuaacuccaguucuagggaaucuaauguucccuucuaucuuccauuagcaucagauaugcauguggugcauauaaauccaugcagacaaaacaccaaccacccuuaccuaaaaaaauuaguggugaaagcaguuagagggagccuaaguuuuucaagcaaggcugaaaguaaacacaaaauugaauagguuacucucugaaacuugaauguagcuuuauggucagguucuucccccuguacccccauuuuucuacauuaccuguauuggcauuugggaagacuuaguggacauaauacugaaucuugagcugagagggaggaaaagggaguuuaauggauucuuacuucguacuaacauuauuucuauaauccuuacaagagcuuuguaagacaaguguuaucccucauuuaaaagugaggaaauagucuuagugguuaaauaacuuaccagcucacucggcaauuagagccugaauuuuaauccgagaauuuuuuucucccuccgaaacccauguuuuuuaaccuugccucacuuguugcuuauuacuaacucuuuuugaaaaacaguuuauuuguaggucaauuuuuccaucuguaaauuuagccagagccuguguaucucugauuuacugaaaguaugaucuugauaauuggacagaaauggggugguaauguuuggauuccugcugugcauuucuguuccuauuuuuuaacauacuggcuuuauguugcaguuauuuuuggcaaucaguuuuaaggccagccuuucuaucuuaggcuguacaguaucuugagacagaaagacaguaaugcauuuucgugugaaaaccaccauuuaauuguuucacugauguugauugugugugucuuguuauauguagguucuuuguugaaugugguggcccccagaguaucuaauugugcaggcuacuagugagcucucauucuaccacagagcauuguuuuccacaguauaucuuaugacccacuaguaggucaucaaucaacuuugugcaucagaaauggcauuagaaaaggaaaguggaaauguaaauacaucccagaguacagagggagauaguuucuccugaauuaucuuugaaguauuuguucucugucuggauuucacuacauuguuucauuauauuuuguauagagagagacuaccaagguccuuuguaguaaacaauauuuggaaaacacuuggccuggagcagcauuuugcagcugaagcacuguugacauuuugggcuacauaauuuguuguggggguuguccucugaauuguaaaguguuuagccauguucuuggcucauauccacccuaugucaguggcacuucucuauuggugacaaacuaaacuguccccagaccuccccuuuuauauccugggggacaauguuucuuacagugagaucuuuguugucaaaccauuauucugaccaguuacugucuuggguccaaaaagauagcuuucugugugggauagacauuuuaucuaugacauaaauuagcuacagaagcuaacucuccauuauugcauaguuaugugaagaguuauguugugugugagcuagcauuuuuuaguuuauguuuguuuuuauuuugugguauugaagauugaacucggguacucguucaugcuuaguucucuaauacugaguuucgucauggauaugcuuuuauccuuuaaauccacuaacuucuguuacuagauuagaauuacuuuuauguggacaaaaauugaugugggucguagcuugagaaccugcuuucucuuuucucuucuuuucuuuguuuuuggccuuauucacuauuuuaucagagcaacaaguagaaagaauuuaauacaaaacuauuuucuuuaccuauucuauuagcauuuuuuuucuccagaaagcacuuuucaaaucugauuauuucccccccagcuuuaagguauaguugauaaaguuauauauauucaagauguacagugguaugguaugccacuuacaauaugcauuuacaguguuuaauaauugcccaaauccaauugauuaaccuacuauuaacauaguuauaauuuguguauggguagguagaagaaaaacacauguuagagcuacuuuguuaguaacugucaaauacagaguaguuagcuguaacaacuuucuuaacucaccaguauauuguauucucugggcaguaaaaguuuaugacagugcuuuuauguccuaugucuacuacguuccuuuuuccauccugggguugaacaaaccuaucaccuagugcuugcuaggggggcuuuuuauugcucaugauaucccuagccucuaauaggaagacuuuuuaaagcccucccucacgccucccuccaauuuaagcaaaaauuacccaugauacuauuuguaucuaauauccuccagugaagcuuguuuuaaucugguaugguguauuugaacauuuuuaaaaucugaagaaugucaucaacucuguuauauugcuuuuaguguggaaaggagcaaagcauuauuguuuauauuguuucauaguugcacgcaaaagaauauuuugugacaugugaaaauuaaacuucaaacguuguugucuuugaauacaaaguuuuauagaaauaaaguaacggucauuugguuacauaucacaugugauuuccuuggggcuauagcagcagaguuaaguaguuggcauacguuuauacccugggaaaaugaaaauauuuacuguuugacucuacagaaauguugccaaccccaguucuagaugacuggcuaauguagguuaacuauucauuaucuucucuucuguaaagugucaauuccaugaagacagaaauucuuacuuuguucccccguguauucccacacaccaggaacuaucuggcuuaucauaacugcucacugacuauggaauagaacaaaaaguaucugcauuuauaaaaaugaauauuuaauuuuuagaaaauguuaggcauuuuguuccuaguuaucaucaagcagaaaaaaagacauugagagacaaaaguuaccuagcuaaauaaaugguagagcuggaucucuuagggaauuugauucuauagaucucugugauccuguugcugauccaugcugccguugaaggaagauauuuaguucuguucuggguagauaggcuuuucuucaguuugaguguuuugccaucacaccacaguucuugccgugaaaggccaguaaaacagcuuauggugcccucuuuaggaaaggaagccucagagauuugguguuagcagcauuuaacauuuguuguuaauuuaucuaccuguuguauuuaaccuaauuguuuccccauuuaaaaugaauuuuguaauuagaacugaacgauagaaguuagauuuaguauagauaauggaagguuugaauauuacuuugaguuuauuuauuuauuuauuuauuuaggcagaaucuuucuacguagcccugguuagcuuucuauuuagagcagguuggccuugaacucacagagauccaccugccucuaccuucaaaauucugggauuaaaguuaucucaaugugcuuggcuuacuuuaaaauuugaaacauuucuuugauguguguguuuuaaauaauugaauuuaauuuucuauuaagugugaaagcuuggaguuacauuagaaugaucauuuuccuuccauugaaugcuccaauuaaaaaaugauggcacacuuuauauuaugucaguuuucuuaaaaauauaccucuucaguuggugugguggcucaugccuuuauucccagcucuugaggugcaaugggucuuuguugauuugagaccagucugguuaaccaggacuauauaauaagacccugucuccaaaaacaguguuuuccaacguuuaaacuguagaagcaguaaguuucuucucauguaugugccuuuaguguaucuuuuuuucuuuaugacacccagagaguaauggaauuucaggcuugcagggaacugggucugauagguuuuauuuaaauaaaguauguuauucuccccccacccccuguuuucuguauuaccaaguacucgagaaugcagccuucagcuuccuggucuaggguacuuuuaaaucuuacaacuauaaguuguuauuguaugauuuucuuuuauuuguaguuuaauguaaucauaaaggaaauaucuuguuaugagcaaaaauuuagguguacauuugaauuguaucuuguuacaucauuucauguuuacaucuauuaacuauaucuuuuaaaauuuuuauucagcuuucuaaaaccaacuuuuccaacaacaaugacuuccgugcucuucuccagucuuuauaugcuacuuucaaggaguuuaaaaugcaugaacaaauugaaaaugaauacauuaucgguuuacuucagcagcgcagucagaccauauauaauguacacucugacaauaagcucuccgagaugcugagucucuuugaaaaggggcugaagaaugucaagguaagucgcagaaauugauauguacugauucucuaauuuuuauuagccacaguaauaagugauguuauuuauggaaagauacuucauuuauuugagacggcuacgaaggcuguucaugaggauugguuacagugaaggcuuauagcaaguugaacguaagagagaacaucaggaccaggaggguucuuguugaaucagcucuaccggauuuuugcugaagauaggucagggaauuaaucccggguacucuggacgcagaagaaggggaaucuuugugaguucaaagucagccuggucuacguacugaguuccaggccagccaggguuauauagggagaccuguuuucaaacagaauaaaacuaucaaaauagaauuggaaguggaaaauguaauucagugguagaauucuugccuaguaugaguaaggccuuaacuucggucuguagcaguggaaaaaaaaauggaauggcagcuauaguguucacgguauuuuauuuuucccuauuguaggaaauugacugguuaaagaagacaauuucaguuauauggcacgaaugguggcaacuuacuugaaauuccaguagucaggaggaucacuaguuaguucaaguccagcccaggguacaaaguaagauuuuaucucaaaaccaaaacauaagaaaauaauaaaaaagaaaaugaaauggauuuaugaguauaguuuagaguagugaugcauguauauuaauuauauuugucuuagacaguauuugaaaauuaaucuuaguuuaacccuuucaguucagaguagcacaggagcaagucauagcucccaucaggccaccauauacccuuuacuuagacacuuugcuuuagaaaagugauucaguaagaggggagguuaauuucaaaggacaaaaaacacucaaauugaagaccauuauuaaauucuaccaguaguuucuggaaggaaaaacacuacauagauauccagaggagaugugguugauuaguacagggaagaauacuggguaguaagaaaaaggagauuuccuuuuguauugaauacuccuuuguaagcuccauguuuuguaucauacucauguauuauguagucaguaauuucugaaccaaaguagugauuguugaaaauauaggggaagggacaugcuugacaauuauguaugaccuaagaccaguggaauacuaggauuauacagagugguagaggaaaagagagagagaagugagagagaguuguacuggacuuuuguauguggaagggggccaggcauuaagacuuauucugaucuacuuaguaauacaagugugcauuacuaauaggaggagaggcauugguggguuugaagagcagaaagagugagguagugugaaaagcagauuugauaauuacuagcauauauguggaauuggaagccguacguauggauggguuuaagggauaugucaaagucucagcagaguucaacagugaacugaauauuggaaaguaauugaauaaauuaucuaaaagaaaaaucagguccugacagagauaaauuaguacuugucuuaguuacuuuuuauugcuguaauaaagcaccaugaccaagaaaacuuagaaggguuuauuuagagcuuaugccuccuuccguguguguguguguguguguguguguguguguguuaaccggcagguauagugauuggagcugagagcaaaguacucaaaucuuaaaccacacacaggaaacaggaaguagacugagcuugaaaugaacaagaaaugaugaggauuuuuaaucucuugaagucugucccaagugacauacuucuuugaguggggccacaucuccuaagucuccccggcagugcugcuaagcagguccaaaccucagauaccagagccuuuggggacauucuccuucaggucaccacaguaucauaguuuuaaguauuucacuauuuugaaugcucccuauauuuuuacauuggaaaagauggagaaauuagagagagguuugauuuuaauucauaugugaaagaaauguuuggcucuugagagguguccagaauuagaaugauuaaagugugaauuucuugccuuuagaaauguugauauuaauauuuauggccuguuaggauaacauaaaauguauuaugaaaacuuuauaguauauuuguaauauauuuuaaaauaucuuuucucuauuuuaguaaaauuuaaaaaccagaauuggaguuaguagggagcucagagcuuguuucagggcugugugugggagguggugugccaaggcugacuguagaguguagacacguuagcaagugcucuagcucugagcugcacccuggcuccaaggacaucuuuaugcuaaaagaaaacuaaauggacuuccugugaucaagcaguauauaaugaagcaaaccuuuauacaacauuacagugaagcaaaacuuacauauauuugaggcagaauccuacuauguagcccuggcuggucuggaacuugcuauguaggcuaggcugaccucaaauuuagagaaccauuuguuccugccuccugaguucuggcauuaaagauaagugucucuacuuccugcuaaauguguauuacucuuuguuucuagaaugaguacgaacaguuaaauuaugcaaaacagcugaaagagagauuggaggcuuuuacaagagauuuucuuccucacaugaaagaggaagaagagguaaguagaguuuuucuuuguugugauuuauauucguaauuuaacagaagauacuauuuugaguugaguuccucaaaagaaggaggaaaugugcuguugauagaaucagcuguuucuucuugggcacaggaaugaaauccaguggaauuauaaaaagcauagcuuuaauucuucuuuuacugaaugaaugauuuuauuuacuuaagaauaaguauauauauauuuuuaaauauuuauuauauauaugugaguacacugucgcugucuucagacacaccggaagagggcaucggaucccauuacagaugguugugagccaccaugugguugcugggaauugaacucaggaccucuggaagagcagucagugcucucaacugcugagccaucucuccagccccauaaguauauuuuuaugugugauggcacuaugauacauuuucauaauugucacuaauuuuucagaacuuuuagaagauucuguaaaucuuuaaauauuuucuuuuugccagguuuaaagaguucuuaguguuuuuucauuaguggacuugaguaauuaaauaguggcuaaguuuaucacuguugugccucacauacaugcauuagcauaucacuaacacacugcaaaacaauuuguuuucuuugaguaauaaaggaugauuaaguauccaguguaagauaaagagaaacuauccuaugaggacugacuacaucugccuuuuuucucuucuaaagaucuauuuucauuuuacauguaugaguguguuuuucugcauguuuguaugugcacuuugugccaauggacaauaucuguuuuccuggagugaaguuccagaugcuugugagucaccauaugggcacuaaagccaaacucaggcccuucacaguagcagcaaguagccuuaacugccuagccaucuuuccagcucuacuuugaaaaacaaagccaaaacauucauugugcaauugggaauugucuccuuccacuauggguucugagaauucaacucaggucaucuuucuugggagcaaauauuuuuacccaccaagccaccuuguuggccuaugaauccucuuuuuuuaguuguaaaucauuuauuguagugauuugcaauuauguuuucauuuuauaaugccuugauaauaaaaugaaguguaggcuacccucaaaacucuacuugggauaggcagcauugccuugguguucuucuuugguaguugauauuauucuuuacauuguaguauguagccugugcugaaaccaagguaacaaacagucuuuuuucuuuuugaaaaaaaaauuuuuuuucuaauauaauauauccuggcuaugguuuccccucucucuacuccuccuggcuucucucuaccucuccuucuaccuggaucaaauuccuuuucugcuucucauuagaaaacaaacaggcuucuguggaauaguaaaauuauaauaagguaaaacagaaaagcuagugcucagaauugaacaaaacaaacagacgaaaaagaacccaagagaaggcacaagaaucagagagcuuccaacugcacacccagggaucccauagaaacaccaaacuggaagccauauccaugcaccuggaagcgacaacaaagccuugguuguucauuuaaagauuauaauccuauaaauuggagguuagggcuguuuugcagaagaaaucucugaaaaguuuuucaggacccacugaacuaaaauaauguuuagaauaagcagguuggauaggucauaucgacugagcugcgauuguuaggguucugggauuguuagaguuggugucauacucaugcaaaggcccuguucuguuagaauucaguuacucaguaccaaccaaaacaacucuuacagaagaaauacguuuaaucuggggcuugccuucaacuuucaggggcuaacucugugaguauggcagggaacauggcaucagggagcaggaaggcauggugcuggagaaguaacuaagagcuguauccugaucuguaggcaggcaaguggacagaaaagcaaccccccgcccccaauccccugcacuccccaauggccugguauaggcuuuugacaccucaaagcucaccgacggugacacacuugacacacuuccuccaacaagaccauaccuucuaauccucaaauagugccacucccugaugacuaagcauucgaauauaugagccuauggggucuuucucaaaccaccacaggcagguacugggcuaaaugucuaauaauaacuaaaugauuggcuguuuaacaagcuugguacaggaaaaccuuccuauucuuuaaaaauuuauagaggcuugcaaaaucagagaaauuacaaauguuuugauaauuuagugguaauaacuacaauuuuuaucucuuugaaauguauguucauagaacuugguuugaaccauuaguaaaggguuuuggguaaaauaaauugaaauucuuuccccgugaauacuuuugaauuuagguuuuucagcccauguuaauggaauauuuuaccuacgaggagcuuaaagauaucaaaaagaaagugauugcacagcacugcucacagaaggacacggcagagcuccucagagggcucagucuguggaaccaagcugaggagcgacagaaaguucucaaguacucuguggaugagaaggcagauacagguaagacucaccugcucccgauagagcaguuuauuagucagugcuguugacauuuuguuacagagucuguuugagaaaaaauuuaggucaggaucauacugugguuaguuuaaaccauucucacauaaagcuauaauugaagacaguaguuuuuauuuaguagaauuuaguguuugcaauauucuucgaucuaggguuggguuacauguagugugguguuucuugagugaauuuguagguauaaaauuaguacuauuuugaccagugaacauucaggacugcuauguucagaguaauaguauaguaucagccaguuuucugagcuccuucgauuauagugacagguuuaaaaguuuuuguguaucuguguaccguuugcauucaguacuugcauaccccagaagagggugucagauccucugguccuggaguuacaguugauuauaugcuaccauguggauccugaauagaacuugggucuucaaggagaacaacuagugcucuuaaccucugggccaucucuccagccucacaguagcauguucuauuuuuguguauuuuuucacuuuucaaaaucaguuaauuuauaaacauuguccuugaauuagguuuaacauagaauguuugggcuuuaaaauggcacgaaaguaauuuguauauuucaguuuugaauuuugacccuuuuucuguuggccuagcuuacgugcugaauagaaaauaaaaagcuuucuaaauguccaaaugcuaggcagcagcagugagccacgguuccuagacaacugugcccauuccagggaucaaccaguucauguuguccauggagaacucaacagccaucgugguugcuagguugggugcacuuuuguuccugcacauaaggaacugaggaugaauuuguugugaguuaaggaaaagaacauuuauaauuuuauuuuuacccucugauguuuaucauucaguuuaucuccaguaauguucaggguagugagugugagagagaaacaaagcaaaacuuuagucauuuugagaaugcauacaagaagugcagauaaaauagaugcuuauuucuucuaguagacuuugauuauuuuuauucauuucaauuguuuugcuuuuuaaaacauuaaaaaaccgguuguacagaccuuuaauucccagcacuuuggaagcacagaggcaggcagaucuccaaguuugaggccagcuuagucuacauagcaaauuccaggcccgccagggcuacauagacagacaaacaaaagaauacaaaugguuggcauccuuccucuaguagcauuucugcuucucaauuagcaauggcaauguuaguccuguaaaauacuguacaauuuuuugaaauugguauuuuuccaauauaaaaguagucagauucauguuugaacaaaagcaaguugaagcugugauuaaacccauaaaguucaugagcuuuacucuuggaauccagcuugugcccuggagaccaugccaaagccuguuaagucuuguuuaauuguagcuauaagauggaguuuaaaagcgucacacauuuaauuuucucucuccuucaaagcaaauuauagcuacuuuauguguaaauauuuggcacuuuaaaaguggcaguuuaaaguaguuugaucauauguuucuauauugaagauucuuugugaagacaaaccauauacauaagauagugaaauuuuucuucucauccuccucauugucccuccaucuccccccuuccuccuuuuccuccuccuuuuuuuuuuuuuuuuuuuuccuuuuugagacuugguuucuuuguguaguccuggcuguccuugaacucacagagauuugccugccucugccuacugagugcugguauuaaaggugccaccgcugcccugcaaaucucaaauccuuaaauaguacuuaacaccccauguucguuuuucuuucagaagcaugcuagcauuaugaaaucauaggaaguugaaucuuucuacaauacauaauaacagaagauuucuuacuaguuuacgagggaaauuuguuuacagaguaggcacauagcuuaaguagauuaagacauuuguaaauuaaagaccuuuuaugaaaugucaaaaucagagggaacacaaggaaggaacuaacaagagccuuagugcaugaaucgaaaaugugagcaugugugucauuuaauaaugcguuguagagcucauaaucuggcugaguauacgcuugcugauuuaaagcaguguaaccuguuugguuccuuuuucaaaugaugcugcuuaugcuacaaagugaguauuguucugucuaugaugccucuguaagaggaagucaguucuguguucauuauugucgcucccacugaugaaguaugaucugggcugugauaguuuaacucacggguucuuaacaaguucaacauccccauguucccucuaauagguguuauuuccuuuucacauguugcaagcaggaaggaaucgacuucaggcacuggcuuuuacucgugauuguaauuucuuaaugcauuuauuugcucauguagccuaacuguuaaagguuuucuuuuuuauuucagaagcggaagugucagaacacuccacagguauaacccaucuuccuccugagguaaugcuguccauuuucaguuaccuuaauccucaagaauugugucgguguagucaagucaguacuaaguggucucagcuggcaaaaacaggaucuuuguggaaacaucuuuacccuguucauugggcaagagguagguaaaugggacuuugaguuuguuuaaaaaguauuccagucugccuuuuuagacaaauagugacagccauuacuauguaaugccagggaaaggaaggaaacuuugaggguuugaccaaaacauagauuuuuuauaguugauuugguuuuaguauacaguuuagaagagcaagucaauggugaaguauuugugaguaaauuauuaauggcugcuacuaccuuuagaauaauggggaaaauacgucagagagauuguaaaaacuacugguaaaauguugauaauuguugaagauaaaaaaaauggguacacagaaauucauuguacuguaucuuuauacauaugucaguuguaggaauuuuucauagcaaaaguuuaagaugaauauaagugauuuuuuuuaaaaaagaacuguuaaauaauuauauuuuuugaguauuuuaaacauagaaucaguucuguaaaauauaaaggugagauauauacaguuuccuuuuggucauggcuuaaaguaaccgacucugguuuugucuuugacauaacuuuuuacaaugaugguuaauguauugcucuuuaaaucacauuaguuacauugcaccaaguuacuuucacauaugaagguuuagagaaacuucccaugaguauauuauacaaucauggcauauuuacagcuauuguauauacauugcuucgucacugaauuaaaacagucuuuuaaauaucaucgucaaaauuuucccuuauagggaauuuugcaauggaaauauguauuucuuaagaaaaauuugacugauuuaaauuaugagucuuauuuaaaaacaguuuauuugguaagauguauagcucuuuguuuuguuuuuuuuugaaagacagcuucuuucuaucuuauuguguaucccuggcuggccuggaucucacccagguccaccuucuucuuccucugccagaacugugcuuugaauauucuacugccucaccugaccucuuaauuuuuguccuccugcaucaaacuccuuagugcugaaauuagaggcaccugaugagggaguuguuagauauuuaguguuuuagaaguaaucagaguuaguuuuguauggauuuauuuuucauauuacuuguaggaugguaaacuugaguaaaacaucagauaaggcacaugaaugaaucagguuuuucuuguucagcuguuuuuaagaauuaagacaaagucaaauaaugguuuaaauauuaucaaaggugauaaugcuuauuucaugaagccacugcaugguaaauaugcaacuucacguuuuucuguuuuuaacacauuuagaccuugguuaaaaauuccuuuuguuuaugauaauuguuuuugccauuuguauauuugcggagacauccuugccucucuugguucugguuacuguggcaacaucuagugcaauggaucucagcuuacggggcugggaccccucugggguugcauaucagauauccuacauauaagauauuuguauuacaauucauaacagcaaaauuacaguucugagauagcaacaaaaggucaccacaacaugaagaacuaacuauauuaaaugacuguaguaucaggaaaguugagaaccaucgauguaguggguagaggccuaugaugcuacuaaguaccuuguaauccauugaucagcaacuuacccagccucagauggcaauggugucuagguugggaaaucuuaaggaagauauaacuuuaagaauguaauaaauugauuguuauuuucuauaucuucaugaacauauauguacugugauuguaggagcuuacauuuaugaucuugcuuuaccucagcgugucccaucuucucuuccuaccuacuguacauugcugacuaaucacuauagagaagcuagcuguucucagaauggggcuauuucuggacccaaagugaagucacagcagggaaaaaagauuagguuauuucuaguaauuuaaaaaauuguaccuauaaauacugauaauuacuucuuaaaaaucacauuaugcuuagaaaccucauuauacuaugcuuuuuauaaccuguauaaagaguaacacagauacauggcagguauacagcagacuguaagcuucucaaguucuuuuuuaguuuuaaagaaagauuacuuugggaaauacuguugguuaguaauuagaacuauuaauuaaacucauauagucauaguuauuuuuuauguuuuaaauugaauccuuugccuauauauguguagguuuuuuuuuuuuaauuacagguauuuccaaaaauagcuauugccugaaguucaaaugugaauaggagauuauaaugaucuaucuaauuugacuuuguuccucucguccauucaugguauaggugacugguauagugguccugccacugaacuugauacugagccugaugaggaaugggugagaaauaggaaagaugaaagucgugcuuuccaggagugggaugaagaugccgauauagaugaaucugguauuucacgcuuggaauaaaaauuauuacaugguguuuaaauaauaggcauucugcuuaauaauuauuaggccuuaaaguucauguaucuuaugauuucuaaagacuuuaaaagccuacuucucugaagaacuugaaggaacaauaaauuuagaauuucuuguuagaaauauuuuuaaaagagaauguuuucuuuuuuaauauuaaaauaacaaaaucagaaacugauggcuauuuuuguguggaaaugaacuauuuucauuaaagucuuuaguuuacaauaugugauuaggaguauuucgguuaaucaguucaucagcauuuauugaaucaucuggguugagaauugggaggcaggaugaugguauguguguaaagucaugucacuugccucaagguuguuacacaguuaagagguaauguguaugagagacuuuggguggguguagcuuaggguagaacuuuguauaacauguauaaaguccuggguuuagucuccaacacuacaaaaaaaaucauaugugaaaauuaauuguguugcacagcuuugguccacccccauuaaguauuauaugagggguggucugagaguggguacaaauucaucccuacuguuaaauaauagaaguaagggagaauuuagaauauauaauaucuuuguuccagguacauaaucagaauugcuguaauagagauucacagugauguuugggagcauagaggaggaagacagauuagauuguaucuuuauauauuuauuacuuuagauaaauuuuaaaagaucauaaaauagugaaaauguauagaugagaaauuuucagaaguuucuguuuauaaaacuaagauaagcuggucugguggaagauguguauguauagagaagaacuacagugauuauuacuccaggagugaaagugguucacauuguugugaauuggagaggacccauuuggguauaguuuuaggaguuuggaaauuuguuuaauaaggcagauauuagucuaguuagcuucaaucguaugcuucucuguggaggcaguagaauguguaacuguaggguuuuuuuuguaaacgaagcauaccuagacagggagggccacagggaaaagaaugaauuaagaauaaaaguauaguggaauaagaaauguuuucugaagugauuuuuaugauacacauauuguccaaguaaaggaagaacuugagguauuuaugaaauacacaaagucaauaaaauaguuaguaauuacucuuuucacauagcuuucuuuuaaucacuauauuuaauuuuauuuuaaacaaaucuuuacuauauuaagcuacuuuauugugcaguacauuaagguuaggaguuuagguaaguauaguaaagguagaauccugaaaaguaauacaaauuuuaggcuuacuuacaguguguuugcuuuuuauuaaauugggauuguaggaaaauuucuuuucuuuaauuuucgggcuugaauucaggucuuuacucauccuguaaaaacagucugcuggcaagcuaagccuguuuaguuuuuuguuuguuguuagagaaguauuacuugcuauagacauccaagcucuauaaaaguuaccaagugcaggaagccaugcuuauguuuaaacuucuuaugagcugaggugucuuugcuugaagauucguacugauuagguuaauggcguuguuucauaucuagcucuguguguccuuuuuaauuagguagaauaacuuauguuacuuuaaaaaaaagccaaaacauuauagaucauuuauuccuucucuugaaugaauuuuacaguucuuugacuauucagaacuuuuucuuguugcuggaaagugaauuguuuacaaaagugaggguaguauagaguauuucauauuuaauauuuugaugcauccuauugguggcauacuuaaaauugguauaucuaguucuuagauguuugaauucauuuuacagaagagucugcagaggaaucgguugcuaucagcauugcacaaauggaaaaacguguacuccauggcuuaauucauaauguucugccauauguugguaccucuguaaaaacuuuaguguuagcguacagcucugcagucuccagcaaaaugguauguacaaaugaacacuagcucgaguauuaaggaaaauagcagugagacaacuuuaguuuacuuauuaauguuuaagagggaaaaaauagugucuucccauggauaggaguacacuguucgcauucauauaauuucauuucuuaggguauucuauguagcauagaaaucuugccuguguuauagauaagggaacuaaaacuaggcagcuaagcguuuacuuggcuuuauagauguuacguggugagucuuaauucuauagaguugauuauaacauguaaggcauaggaagaugcacaagugagauaauuaguuuuauaaaauuaugacuuccuacauauaaucuccuugaguauuccuuuaaaagggugauuuuucugggucuaauuucuaagaaacuuuaagaagauuacuagaaauaugggcccagggauuggagagguaaaaguucauuugguaaagugccuuuugugcaagugugagacccuggauccccagaauguagauauauguauaauggcauguauuuguaaccauagugcugggaccaggagaaaugggugcagagacaggcagauaccuggugcuuacugugcaguuacacuagcagaaccuaugguuuagaguucagcgagagauuguggcucaaaauuagauggagggagacacacuggcuuaacuucaggccuccacacacaccucaccaaaacagaauuugagcacagaguguaacuauuuuagugcauuguuggagugauuuuuuuuuuuucuuucaguaugcauguagacuuaggaaaaaaccacgguguuauauuuaucauuguugcuuuucuaacugaaguucccacagguccucacaguggauuuccuuuccuucuuagguuaggcagauuuuagagcuuuguccuaaccuggaacaucuggaucuuacccagaccgacauuucugauucugcauuugacagguuaauuauuuuaaauaucuaaauauaguaaauaaaauaaaacaaagccagcaaaagauugucuauuuucuuguuuacauaauugcuguuuacuaauccuacccuguauuguuacuaaaccccugccauguauggugguaacuugauagaaccuucccaaguuuucccuuguucacauguggcagccgauccagaacaucauacuugccauuuguaugucuuaucuagcuugcuaggcuugcucuguaacuguugucucggucaguauuacuguucucaagguuuuauuccagauuuuaagugccuuuucacagagcuccuuuaacguaauucauuguuuuuugguucaguaccagucuguucaagccagacaaaugauucuuccuuggagauugcuagguuucuuguuauuuuagcucuccuuucuucacaguucugauagauccuauuucaaagggagagacagggucuuuaccuguuucuagaguuuguuucuucuguaucuucauuauauuuagcaauucuuucaugugugugcugccuccccuuuaacugcuuacuuaguguacaggaaacuaaaucucuccuauucauuuuuuucugcuuucuuuuuuccuucuuuaauuacucgucuuaguauuuuuuucuuauccuuagcacuuaacauauucccugaugauugaaauuccagaaauguuaaaguaucgauuuuguacuuacaguaaugcucuuacccaucuaucuguauguauaguuuaaugcuuuucaggaauuuaauagucuucuucccucuuguaguuggucuuggcucgguugcugccagagucuucggcaucuugaucugucuggaugugaaaaaaucacagacauggcucuagagaagauuucuagagcucuuggaguucugacaucucaucagaguggcuuucugaaaagugcaggcaaggcugcuucaacuccauggacaaguaaagacauuaccaugccauccaccacgcaguaugccuguuugcacaauuuaacugacaaaggcauuggugaagaaauagacaacgagcacucuuggacugaaccugugucuucugaaaguuugacuucuccuuauguguggaugcuagaugcugaagauuuggcugauauugaagaugcuguagaguggagacacagaaauguugagagucucugugugauggaaacagccuccaacuuugguuguuccucaucugguuguuacaguaaggacauugugggauuaaggacuagugucuguuggcagcagcauugugcuucuccagccuuugcauauuguggucauucauucuguuguacagggacagcuuuaagaacuaugacuacacucccagcgacuucugcaauguguagaaaagcauuaaggacuacauugcccagggggaaagacuuaauuuauuuugggagugaaaagucugaccaagagacuggacgaguacuuuuguuccucagucugucuggauguuaccagaucacagaccauggucucaggugggugaucagcccuaguuguuaggaaauggauguauuugcacaugaaauauuacauuacugaucuaaguuuuucacuuggcuuuuuuaagcaagaaaguuaaccaagguuugcuacaaguauuggaguaauagugcuucugauaccaacaugaaguuucauuuuagucaguucaaauacauuguggaauauagaggaauauacauuuagaaguuuaauugcuuaguaauuggccacauuacauuuuuauaauacaguuugguagauaaauguauagguuauaaucucaaggauauguuacagaaguaaauuuuauauugaggacuuugucaaccaugucuguugugguuuggugugauuuuuauaccgugaaguaccuauaaaccaaauugcuguugaucuguguccauucguugcugcuguuguugagacacuguuaguaaguaaccuuggcuggccuggugcuugucuuguggaccagucuagcuuugaacuugaggagauccaccuagcucugcuuccuaaguguuaugauuaaaggcagcacuuacugcuuucuugaggcaaggucucacucucucugagggugccuucauacuuaccgcagucucuauuucccagcacccacgugggagcucaugggagccagaaacauucuguaucuccaguuccaggugacccagugcucuucuguccugugcaggaccagguagcaauuuggugcacacauacauaccggcacacuaccuucaguuucagcauugcuggagaucaaaccuagaccuuuguuugugccagcaacucuagcaacucaacuguguuaacauccuaacccuauaggcucaaucuucagcguaguauauuaauugcuccaacccuuuuaaguggagagaagugggaguaaaguguugcauaucucuuagaggcugagaggcagaucucagcagccagaucuuccuuauguuagggggaccccuuagauauauuagguuauggauauucuuuuuguuuuuagauuuauuuuuaauuauguauguagguguauguuuuugcauuugcacauauauggaggugccugcagaggccagaagcaauggauccucuggaacuggagcuaugguugguggugagcugccugaugagggugcugggaacacugcugggucuacuggaguuaguacucuuaaucuccgagucaucucuccagcuccaguuauacaauguuagaggcaguaaaugcagaaacauacacacauauaguuuaaaauaaguagaaauaaucaaauacuuuaggauuuuaugguuuuuaaugcuacuguaaauagaauuacauucuuaauuuccuuuuucaauuaguguauagaaaauaauaguuuugagacaggcauucaucguagaggcuucccucaaacucuuucagcuucccaaguuccgagguuguagauguaugaaugcccucauguggacaacguuuaguaacaggauuggguuuguguguugguuuguuacacaucuguuuugauaacuuuucaguuguaucuguguuaaguauguguuuuuguuuuguuucggguuuuuuuguuuguuuguuuguuuguuuguuuuguuuugacccuuuucccccaugaacuaacccaggacuuuggauaugucaaggugcucugcaguugagcuauacccuaagucuuuaaggauuucuacuuaucucauugauaaacagaucauuuaaauuauaacuucccuguuugggugccuuuacuuuguuuugcucauccaguuguucugacuaaacauauaguguuuuaauguaaauagaaaugaccgugcaauauuagugaccauaacuuuguaauaaguuuagaaauuugucuuccaccuucuguuauuugagauugguucucuggagucucuugaucuuaaaugugaaucuuaaagguagcugcaucacugaaaagcccucuaugagucauaaaagcuguacccagcucucucuuuaauuagcucuaaagaagaguuuucuuauccuccacaguuauuuacugcuugugugauauuggaagucuuccuuaugagucuugagcugggucuuauaaguguggugaacuucgugcauuaguuuugugaguuuacuaagucuucugagcuucucccucuaggagagaaugucugaauuuaggaggaauaguauacaauaacccuuauucuaacuuuuugauucauccuauacccacaucccugauauuaucugaguuuuggaggcccugauuuuaucuguguuuuggagggggugauaaacaaaucuggucuuuuucuuccauuugugucugagcauucauuauaacaccuucuauaguggcagcugacaccuaaucccaguagcuugacaaauucugacucucugaaaaaaacugcuuaaaguuuucguccaugacuaagauugacagccacaguagucugugagcauaaacacaaauauuuaguagaauccaguauguaggaauaucacauuuauuuaaacaaaacaguaguaguggccuugcuggcugccagaacaugagagagguagcucacuucugauagugugacuuuuaagaauacuuuuuccucuguguguaaggugccuuccuucaaacuguuuauguuuuuuuugggggggggguucacaggugggguguuaguaagggauuuauuuagauccagaaucccagguaguccaggcugaccucagacuuacuuacguauucaaagcugcccuccuugagcuccugaugcugcugucuugucuuucucaagugcugggguuaaaguccuggagugcugcuguuguagggaugcuggguaucucgcuaccucccaugaguuuggcagggcaauaagggggaauaaagcuguguacuugcuucccagaccugcuucuggagccggaucaugggcucugccaggcuccaggagccucuucauaggccauacuuggcugcucaaaggcacuagguugagugaauaaucuugcccuucaguauacuuuucuaggggagaaaugacaguuuacuauagggaaggaaacugccccuagaacggaaugaucuuuucuguucacaccaccacacacgagucaugcaccaaagccuuccagagaccaccaccaggacaacaucugacuuugucauuuuauuuuuucuaauguuacauaucuuuuagaagcagcuggagagauacuguauuucagaguuuaguccccugagagcagcuuuagaaucaaguucugagcuuauaaucucagaaaccuaugugacacuugagucuuagaagaggaaacucugaggcagacuugauuucacaugagccaaaacccuggugucugggguugaagagauggcucagccaucaccaacaugauggcuuacaggaaguccauaaguucaguuccaggggaucuaacucuucuggccuccauugguaccaggcaugcacaugauacauagacauacacccaggccaaacacucauagguguaugauaaaguaaaaccaaaacuaaugucacugacucugaagcacccgucagcaccaugggcccaggauccuaggucuuaguuggcacagaagacagugcgccaucucaaacugggaauaguaugaccgcuuaggaugaccaagguacuuucucugggagaaggguacuauuuuggcucagguaggggacaugaucaugacuaaggcaccgacucccugggacuugauucuugggccaucagggaugacugaugacaucagggaugagguugaaggaugccaugacuccuucccucuggagcagggcagcagauguucaugguuucagaacuauguaaugcaguuguuguguggucacaguguuggcucccucuggcaugucgcagcugcgugaucacuagguagcugucaauugugugaguugacaauugacaagcugucaauugugugaggaacuguaaguguugaaagugguugcaggggugcuagagguccuuacuuuucuuuuuaccuuggauaagaaguucaucccguuugcugguuagggacugggcuuuggagaugagauguuuucuuucagguucuagugaacugguccuucuuguguugguuucauuaaaauauagugcuuauugguuguauuggcugcauuugggggaggggcauuuaguuggcuaucuugcugauaucuccucuaaaaguucuuaaagucauuguuuacuaguucuaccguuuuuauaauuuauugauguguguuucucuuguauguuucucauaauuuuuucucucagauucuuuuaauauuuaauaauuuuugguuggacacuagacaguuugaauuauauauuguugaauuugggacuuuguuuuauucguuaauaaucuucccuuuugccaggagguggugauacaugccuuaacucccaaugcuugggaggcagaggcugguagaucuuuguaaguucaaggcuagccugauguauagaacaaguucuaggacagccaagguuacacagagagagccugucuugaaaaacaaaaacaaaacaaacaaaaaauuaaccccucugagucacuguugcuugcaucaguucuauaacuuguacauguuucaguagcuuuuucuucuuuuuguauuauuguuuaaauguuucuuucccucauuaagggcagaauuuguuuauuauauguuuuuuuguuauuucgguuugagucuggcaucuuugggcauuugugacaaggcauagaugagagagaucuuuuuagaauauauuuucuugcuguacguuaucauaccucagucuuucauugauugggucauacugccuuuggcuaaagacaguauuuuaacuuuugauaucccuuuacuuuuucuuacucucaucauugcccucaaaaggcguguguguguguguguguguguguguguguguguguguguguguguaugugugugugugcauguacacacacacacacucaggcauacuugcacauacauacauacauacauacacacacacauacgcguuagcuguaaacagcuguuuucuccuuuucuaugguacugugcuucuuaugucuuuuuguauuuucucuuuguaacauaguacuacuggcuaaauccuguucaucauucuuucauacauaugccauuaugcuagaaugagaaacauuuucugauuuuuuuucaagacccuucugugucuucuuagaagaguauuugucauacaguauuguaauugcuuguuuguauuuauaguuuguuuuuccacuaagagcuaauaaauccagugacugaacaaaugacugauacaggcacauuuguaacauuuuacauuucagacaccauuugagcuuucagauuacccuuugaaagguacuuuuuauugugaacugcucaaagucuuagacuuuaugaauuauugaauuuuaaguauuuucuuccuuuuaaaauuuuuucuuggagccgggcauuguggcgcacgccuuuaaucccagcacucaggaggcagaggcagguagauuucugaguuugaggccagccuggucuaaaaaaaaaauuucuuggaccaguuaauucuagcacauaggaggcuugggcaaaagaauuuugaguuccagaccauccuuggguuuaugaguucaagguuaacuugaacuguaaacccugucuaaaaaaauucccucuuucaugucaaaccacauagauucugaacuacuaccauuguuaaccugaggucugucgagauggaaaaaugaugggggaaaaucguuuaaaauuagauuauaagauaaaauagauuuaaaacaugcccuuuccaaucuuuaccguucaguauucucugaguaucgauaauuccuguaguucuggcuagguguggcauaugcccguaaucccagcucuuaggaaggagucaauggagaguugcuguuuacugccaaacuguuuuguacagugacuucuaggcuauucaguacugucuggcaagaauguuucaaaaacaagaaacccaacagaauucauaguucguucuuaucuccauauuaguuuacuucuuacauugguucccaauguacuauaacugcauuaauuagaaacugaauuuguuauacuaguuucuuaauuuaucucuucuuuaucaaguuaucucauuuuugauauuuuaauauuccuuuaauuaucauuguauagaaacuugaccguuucaguuuuauucuugauauauccaggagaggaauuccuagguugugagggagacagaauccuaguccucacagaauuaaucaugcaggcguaucuccucaguggaggagauaaugaucacauaccugccuccccuccagaaagcugagaguggaguuuguuaaugacccgguggucuugcuguuuguggaggcagacuuccccccaccuuuugcucuagaggcagaccucgcucaaauuccccagaauaauuaccccagacuuuccucccuagagugcuaccuguccuuaggggagauggcacauguacuugcuauuggucagaaaccacuuuagauuuagcuauggaaccaaccuucugggucacgggaacuuuguaauggaguuucuguguagucagaccuuaagaguuauugugagucuggauuuggacugauguuaccuggaaaccuuuucucaaauugaacuguguuuuaaauaugccaacaaugagaugccuggcauuagaccaccugaagucugauccagguugaugaaguugaucugucgugggcuuucauucuucaucucugugugguucaguucacuucccugucaggaacuacagggauuaccucucacuagguuaugggggaaacugguaauuagguuucagucaucuuuuuuuuuuggaugauuuuuauuuucuuagcuugaugggagaaugaacaguacaacuguaggucucaguguuucuuugugugagaauuaaguugcuauaauguuuuuauacagaaaagugucauaggcuuuauuggagucuucaggaaaaauuagaauauuuuuuugaagucagauauauuucugccuaaggaugagucaguuauugguguuuuauaaggauucuuaacuuauugccaauuugcgagguauguaaaacacuaguggaccauuagcaguauugaguugccaagguuccuguuucuugacugucgcaguguuuguguugcagggcucugacucugggaggagggcugccuuaccuggagcaccugaaucucucuggcugucugacuguaacuggugcagggcugcaggauuuggucucagcguguccuucccuaaaugacgaauacuuuuacuacugugacaacauuaacgguaaugccuuuuuuacagugagauacuuugaagaauuuauuuaacauuuuugaaguucuaauaauuuuuuauaguuuuuauuugcuuucuaguuccuaauugcacaaauugucucacuuucugguuuaauccuuuaaauuuaauaaaauuaaaaugauuugguucuuuaauaaaagcaaaauacaacacauuuuuacuuuguggagguaaguuucuuaccauuguaccagauuuuuaggcauguaagaguuuaaaucacuuaaaaugacaaguuguuauagaaacacggagauuauucuaggauguugggaauuccauuguaguauucuaguguuuacccauuaacaacuugauuuucuagacacagugauuucuuugacaggcucauuuuuuucccccucucagcacugcuuuauuuagugugguggguaacaaaggaagacuuugguaaugugaacucauccucaagacugaguaguggagacuguaguauugagaagagauuggagaagaugccacaggcaugacacauuucuauacuguuucagaaguugaugccugaaccaacugaaaggucaugaaguagggcuugggggcgaugcagguuggaagagugcuugcccagcauucaugaagccccagcaccacagaaaacaguagcuuggugccugucauuuguuugagcacucuggagguacugucaguaaucccaggacagccuuuauuucaaguucaucuugagcuauuuuagacccccaucuuaaccccuacagacacacagacauagacagauacacacacacaguacuagguaaacaaccccccccccccuuuuuuuuaaaucugcucuucauggagccuguuggaacaugcauuuucauguugcucuuuggggcauuugaucucauuuaguagaaaucgaaauuuucagaagcauaauaaagcugcuucucauuauuaauaagcaaaaaaccauccuguauuauaacuggaaacaaauauaaauagcuccauucucuuauucaccuaucuuuuauuuauacuguacacuuuugguuuugagagcccaauucauucucaacugagagggaagacuggaguuuaucccugggagaacaauugacaggauucagggaaacuagagagaagaauauuuuagaaugcagagaaguuagcaaguuuucuguugcuuggaaauuagauuucucuuaaaauaaaugagaagacaggggaucucagcucuuauucuguaagaguugacauguuccuaacaaaagcagcuugguagagccuauauuugcuuucucuugaugacaguguaaccaagcaguggaaaaaugaggcuuuuuuuuuuuuuuuuuaaauccagcugaacauaaaaacaaaauauguucaugaauggaaguuuuuguuuauuguuaaaaauaaagccacgggggacuggacaggugacucagugguuaaguggaugacuccauauugcuauuacaaaggaccagaguuugguucccaauagauacauguggcaggucacagcucuauaacucugacuccaggggcuccagcgcccuguuguggccucuguggccauugcacucauguguguaucugcacgcacaugucugugcagucugaaagaaagaguaaauacagcucuuaaacacaaggcuuccuaaggcuuacaggugucauuuuaagacuaauuaauaugcaauuuuaaugaagauauuuuauuuuauguuacauuuaaguugccuauauaauuuuaguauagguuguguuuggaaacaaauuucauaauguacuuuguuuuacguaauggauauaaguguuuuggugggaaguauuaaguuuuaguucagccuuauuugccuacuuacuuuguacuuaaguguuuuuaaacuuauuggaaaauauuuagaugaaaaaguuaaagugcuuaaaaucuuuuguacuuucucaauauuauuuuuauuuuaaucuguuuugaauauauaauauuagcauuccaaaggaguuauuuacuccuguugaauguaaauuuuuuuauuucuaauuuucaguagaaacuugggagaucugacuucuuuuuuuuaaagguuugaaagcuuuuuacaguacuucaaaaaauacaauucuaaauguccuuucuuaaccugauagaggaugauuuggaagaaauagaaugcuuuaaaguuuacauagaaugcauuuucuaggagucuagguaguugcuuuuaaagcaguacuuagagucaguguguuuuguaaaagaauauacaauuuagaugguacuggaauuguacccacuggugacaccacugacauaguuucuucagaaauacucagcuugcacagaaaugcuuggugaggguuuagaagcccucauuuuuauuucugaaaguagucuuaaucuaguacacgguuacauacagauuggaaaguaacauuuaauuuaaaguauauuuuguuaaaagaaaauguacauaauuaccacauuguuaguaaaagaacuuaaugcugauaaacauuacuuguagacuagauaguaaacaaaaagagagcagucugccuccugaguacuggcagagacacugggaaagauguuagccaucagcuguuccaguacucuguugagcaagacgcuguacuaagcgccgaugccaaacacacauucugauucuucugaacgagucuccaugauuuuuaaauugucccuugguuuggauaugugaggugucuuagcuguaauauuuacacaaaucucugucacuaauguaguuguugucuggcauaguuuagagcucugaaggacauuugaacaauguagugaguaacuuugcugugcugcuuugcauuucaguuugugcauaauuuagcaguuaagguagauuagcucauaguucugaaggugacagucucagaugauuugcucucuuauguuucuaauuuaaguuaaaaaaggaauuaaagguaagugaagguaagugcagacauacucauagcaugagcaguauauacuuacaaccaagaaaaacaugccguuuuauaaauagaauuaacuucuuuguagcuuuuuucaucuaaauauaaaaaaggagucuuuguuuuaacacuuaugccauuuuacucuuuaauuuucuauauucuuacuauaauuuagccugauacaaaauaauuguuugacucccuuuuuucaacagugaggcagaaauuugcuaggaagaagucagauaugcacagggcagugugcuuugacuugugucaugugggagaauagcauccuugaccagaggugucagugagcccuuuacucuuucccuuaaaaaccaggugugcacuuuucuuugaugugucuggcuuugacuguuuuccuaagccacuguguaauucaguauaauauuccuucuuuaucuuucugucucuaagaauaaagggcauguguguaggcaggguauauggaguuguguaguccagcuacuugggaagcuaagauacaaagaugaaccugcaccuuugcagccagcauggaagacagaagaucuugucucuuaaaacagagacaaacaaaaauguguguguguuguauaaauauagacauguauggcuuuuuauuuggaaauucaaauuuuucauguuuucaguaguugcucagaauagaauuauauacugauaaaugauagguacauuuagcauuaauuagauuaagguucaagagguggguagagaugaugugaggcagugcuuggguauuacagaaagguaucagguauuugauguugaagcaguaauaugugauggguggagccaagcuuauuagcaagggaugggugaggauugguguguagggaagcuggaaauauguacaaggaaaacuuggcuaaagacugacagugggagaagaauguugaaguuuaggauucuguaccaagguauuucuaacaacuacaaagauaaaucuuuuaaauuuuagcuuuauguccuauuuuauccagaaaaugcugcuuuauauggcauuauaaauuuuaaauauuuggcauauaacaauuuaaaauggaagauuuugauuuuuuuuauuaaauaaaaauuggccuguaguacuccaguuguauuggguacuuuuaaaaccuacaaccauguauuaucugugucagcaaccugaagucugagcucagucuuuuauuucaugucuuguaugucgugcccauagcccuuauuugaagcuaaucccagacaugucagucuucacaaucaauugcaauucuacacauaaacaaaauccaauguuuuucuuaaagauaauuugucauuuauauacugaaauauaugaacauuauauuucagugacuguaucuuaagaaauucuuuuuuuuuuuuuugcauauaugcucucuugggauaaaaggaaauguuguacuuguggugauacauguagucuaaauuuuaguugcaaguauccuaauuacugacucuggguguuagcauagucaccuucugcaacauacugcagcuccuauaaagcaguaggaugcaaauggguucucaguuaagcugggaagcacugaagggcagugagagguuaaguccauuagauacguucuguagugaugccugcuccaugucuucucauuuuguuuuguucuuguguaucaaucacacuugcaggcucugguuuccugguggaaguguaaagagcugcuccuuauuaguucagugcaccagcuacauugagucuucgaaacgcuagaaacagcccuguaggcuugugucuccuuaggaaagucauucuacucagaacauucuccaacuuugugacauuuuuguuacuuuucuaauuuguaguuauguuccugaauaaaccuagaccuuuuaucuaguaucuggguaauauaguacagcuguaaaauuccaauuauuccauaagugguuuauuauuguaagugaaucacaguuuuauguuuuagauguuuaauuaaacacuuguuugcauucaguuuugggacaaauuuucaucuaaagcuaucuuuuguuuuuauucagaggucuacaaaugaucagaguauggaacauucauugaggaugugucuguauaguacauuguuuuaaacuuugaauaugacauuuauucuaauuguucauugcuguauucuuuagcugacacaguucagauagguuuuauuuuuugucuuaaucauguuucuaggaagaaugcucaaagaagucuuguuucuguggauugucuccuuuuuuccuuggguuuuaagauucuugggaaauuuuguuauguuuccuguuccauggaggauauuuucaguggaaucagacagccauuggcaauuugugucugaauuuuuaaugcaugugcuguaagauuuuacuugugugaugucaaugaagugcaaguuaaaaacagagucauaggcagaacuguuugugcaugaucuccaagaaguuccuccccucacguguuguuugcuuucauacagguccucaugcugacaccgccaguggaugccagaauuugcagugugguuuucgagccugcugccgcucuggcgaaugaccccugacuucugaccuuugucuacuucauuuagcugagcaggcuuccuuucaugcacuuuacuuauagcacauuucuuguguuaacaacccauuuugggugugucuuguuuggccccauuucuuacagucucagaaauuuaauuuagcagugaacuguacaauguuguuuacccuugcaaaauauauuuuuguuuuagaaaagguuuaggauuuuuuguuagggugagaacagucuuucugguuucuuuucaaugaaaugcuuuaaaaaauaucacuaauaccaugcuauuuaaaguuuuucuagauuauuugcauuuuagucaauggggguuauugguucucuuauguguaaacacuguaccaaguuuugcagauucuuucaaauccacauuucugaaguuuuauuuucaaagacugaacauuuuagaaaggaaucucuuuuccccuaacguuuucuuuauuugaacaauucugaggggccaauucaaacacacuuagaagcgagauucuuuaagauuauaggauaaauuggucucuuggugcagcagucuguuguuugcuguagacaccagcuuccacugcugucccuaaacuguugaauucuagaaggauuuuuaaaaauuccacaauuguuugaagaaauguauaaauaaaaucuacuuugagaacuuuaccaagcaaua

SEQ ID NO: 2443 - RNA, 3901 nt, Mus musculus
gugagcuugacuugcuuaauagagcuagcuguacaacccucgugguucucacgucucugcugaucuucgcuucccugagagaggcagagccgagauccuuaggauccuagggauccuucuggucccuccugauuacuugugcugaggcugaggccuugcugucucugcuagguagugcuaccacugaugauucgugguugcuauccugacucuauggaacuggacugcugguguauccaugaaguguuugggagugauugagcugccugccucugcugaccugugaacugaacugccgauuuccagacgacacagacggcaguugcuccgaagaaccaggucacuaccccaucucuuuuauuucccacuaccucugguggguggugggcuaaaagggagguuaaagcauuuaagaaccauuauuaaaaauagguuuugaaaaaaauuaaaguuacauguccuuggacuucugacaguuaguuauuuggaccuuaaagggagcugguaccuauuucagguaguuagggagaacucaccaagauagugugccuuaugugugucuuguagggcuuggucugaaaaacugagagugcuuucccagugaaaaauggagagacuuaggugucaggaaggcaagacacuuggccccagucucugaugucugagacaggaugggucucagagauuagcauaacucaggcauugccuacagauuuuguugcccuucuugucgaugugaccaaauaucuaacaagaaacaacuuaagggaacaaggguuuggcuuucuguuugagaguagagucaguucaucauggugggacaggcaaauggcuggagcacucaaagcugcuccacagacccguaggaagagacagcacaggaagugagggcaagguauuagcccaaggucccauaggucuacuuuguucauuaaaacaaaggaagugaaugcuugaggaaucuccugucucugucucugucucucucugugugugugugugugcgcguacaaguggcauugaggucuauuuacauauaaaaaugaggaaaaaccccaagcacauuuggucuugcauuucaacuuaugagcuaucuuuuaucuuuucuuucuccagugccaaaauucuuucuaaaaucaacuuaccucauuguaacagaugcugaauggccacuaaaaaguuauuacuuauguguaugaguguuucgucuucacguaugucuuuuuaucacauucaugucugaugcccaugaaggucaaggaauugaacccaggucuuuuggagauguagccaguguuccuaacugcugaaggcucucacuagcccugauuagcuuuuuuuuuuuucccuuucauaacggcaaugaucaacucuaguacuguacugagcucaugauucuguuuuauaauggcaaccuuguugucaguacuucuuuucaaagucaacccucugguggggacaguacuaggucauauacucaaguaaaguuauaugccuuagaauuggcugauucugacuaggaauucuuccucaagucuucacaaauacuguugggaaauucugggaaaugccuucugucaguguauuuucaguuuuccagagaacaauuugacaccuuccuccgcuucauguuuacuuccuauaagauuaagagugagggggaaaaagucaccaauccaagaaugaggcuuuucauggcagugauauuacccagccccuuuguggggauaaguggauagguggucuguuagaguuucuguugucauaccuaaaggggucacagagagaugacuaaccugcuagacuggacuuuaguagcaauucaaaucuguugugauuguaggaacuuagagcaacaguauaacauuaguuagucuugucucuuaggcugaaguucaacgugaauuagucauaucuauagccagaugauugacugaucuuuacuuggcccauggggauaaugucaacagcuuccuugagagggaaaaugacucauaggccuuauuuuuuaaaaucgcuuauuucuuucauuuuaguccuugaaauaaauccugugaaauagccaaauuccaaaguagcuguauuuuuucuuaguggacuauaauccuuccaauccagguuauagugaaacucaguuuguaggugacuauuuuuguuguuauacaccuacuaaaugaggcauauauaauaugauguauuuauaguuaauaugagaaaaaucacaaggaugcugggugcaucccucauucuuucuuuauucugguauucuugauccagcuacugaggaaaaucucuucauauagcucuauguaacugguacacugaagucggagucuauauuccaagauggcuagagugaaagauuaggauauaacaaaugagggguuagcaaaugucuuuugagaauuguuaaaaauauggaggcaaagcccugcuuaaacagcggagaaaagaaggggaaaagagggaaacagagaagggaacagaggaaagaagaauaaugggguggagagggagggagaaaucugucaagacuuaucaguucuguaagcuauuuuuguuguuguuguuuucuuuuucuuuuucuucagucaccucuuuguuccaacuaauacaguacacaggaacaaacuuaucgucagaucuagauacauuuggccagaauuuuauguacugauuugugaaauccugggcaaugucuuaauuuccuuugucauagcuguuuucucuaacauuguuuacagggaguauucgugaugagguauuccuauuagcacuucaaaaauacacguacuccguuuuccuuaaaaucuuaugaaguagguuauuuauuccccucaucucauuuuacauaagagaauacugcggucagaacacagaagucaggucgcucuccaagguuaguacaacuagaguuuggugaaaccaugaaccuaagcuucaucuccagagucuguuuuccagcucaauuugcauguuaauaucaaaagguaaccagaacuagcugcacuaauagaaguaucuuuuuauucauuuucugagagucugguuccuuuuaaccauugacaugaauuugggguaggaaauacaaaggugaauaauguagcauaucuucugcuuacuguucaaaguuuaugguuguugagaaaacgacacacccuucccagguucucagccuugcccguguuucucccauuuuuccacgaauucuaaagccacggggugagagccggcucugauacuugggaaaagucuacuggagggcuuagaugaggacaggugacgugcacuggccuuucucuaggcagugaccucauuuauggcccuuucuuccugucugagccuccucggcuuaaaauggcgggauuugugcuaaggcucucucccuacuagacagccaugauggcuccccgccccccccaccccccccaaacccccgcaggcucaucuggccgcucugggacugucguuccugaucugagguguugguccucccucugguguuuccaguuccccagggccaccaucccacucugcuccgugccaggaggggugaggaggggcugccagguccccagcucucagccgcaggggagaggccaugcuaggcccagagccagcaucccaggccuagcaaaacccgaacgaggcagcaaaggcggcugagggcucggcgcgcgcacagcccgcccguccagagcacgcaggcucgaucuggucacgcaggucccugccucaaggccaggcacccggagaagcgcccuugaagacccucgcccugggacagugcgauuuuuuaagagauguaacgcaagggaccagggacgaccaugcccaccggaggagagagcucugggcgccucagcgcgcgcgccggucacgugggccgcggcaccgcaug

SEQ ID NO: 2444 - RNA, 1043 nt, Mus musculus
guuagugauuucaaaauguguuuuauuaaaaaucauuacagggaaagauacauauguacaucuaauuaaugaauuuauagguuuuuuuuuuuuuaaucaaugguugucuuaaccuaaaaggccacacaagacuacugugauuaucaaaaacacuauaguauucuaaguaaauagacaagguaaaccggaauccaaacgucaacagucucagagauacucgcacaggggcugugcgucacucugggauuuauuaggauuuaucgccugggucgcggcugauccuggaagcggaguggauccaccaucagccgguggcucuggcgcugcugcugcugcugcgacagcccgccugagagcccuuguucaucagcagcugcuucuccccggcccacgcgcucggagcugcagcucgcgaccguccccucagacucagcccuggcaagcccgguuuccgccgggcuucaaaucacucccgcgagaggagaugcuuccgcgguaacgcggcgagaacgccuggagccgccgaggacuucgugcaugcgcucaggccgauccggcucccggcucccagcuccgcacuagccggcguuugggguugaugcgcgggcagguucaacugcaggguuuuggguuaaguuugucugcagcugggcgucugguggaggaaaggcugguuauaauggagcuggauccgaaaaggugaccuucuggauuuacucagagauaaauuaaguucugauggaagaagagugagguaauauucuguaucccagaggacagaugcacagaucagcuccuuuaaugaggcugaagugcuuuggagucuuagcugggucccuggagguccgggagccaucaguugggggucuccugggaagauguuuacauucuaauacuccuacagcuggcaccuggaaguuacuaucuguaagauucccuguauucggacaauauagaugacgaaggagaagacaggugauggagccgggcuuuaaagucacuaagucuuaaugaaugcuuuuaaaacauaauaagaucauuuu

SEQ ID NO: 2445 - RNA, 771 nt, Mus musculus
aggcuucuacuuccgggucaaagccauggcgguggcaaauucaaguccagucaauccaguggucuucuucgaugucagcauuggcggccaggaaguuggucgcaugaagaucgagcucuuugcagacguggugccuaagacggcagagaacuuuaggcaauucugcaccggagaguucagaaaagauggcguuccgauaggauacaaaggaagcaccuuccacagggucauaaaggauuucaugauucaggguggagauuuuguuaauggcgauggcacuggagucgccaguauuuaccgggguccauuugcggaugaaaauuuuaaacuuagacacucugcuccaggccugcuuuccauggcaaacaguggucccaguacaaauggcugccaguucuuuaucacguguucuaagugugauuggcuggauggaaagcauguaguguuuggaaaaaucauugacggacuucuagugaugaggaagaucgagaauguucccacaggccccaacaauaagcccaaacugccaguggugaucucacaguguggggaaauguaaucuagacaagacggaacuagguccucugcuguuuuggugugacauucucucucaagucugacaagcuggacuggccucuguguuugcuucccugucuccacaguaugcgauccaggaccuggaaguaucacaaaugagaaccaaucauccuguuuaaauuuuggacuguaaauaaaggaauuuuuuuaaugcaaaaaacaaaacaaaacaaa

SEQ ID NO: 2446 - RNA, 2944 nt, Mus musculus
guauuucugagaaugcccagaacuuuauuauccugguaaauacagccaacaauuccuugcuugcauauuaucacaugcauugauccacuacuuauaugcaccuagguuugugguccauggaagaauacgcugagguaaagcgucccugaaaagcauauccaaggauguggaaaaaaaaaagcaaauucuaaaacacaaaaacaaaauuuacaaaaucuguuuaaauacuucauuuuguucccauauuagaaauguaucuuguggggaacucgggaaguuuccagcagacaguggggcucugauaccacaugucucaggcugcucccucugacuucauuagcaugaugucgccuguaacauguugaggaagaaugugcaaauggagcuccaagauuccccacagaacuccagggcggucuuccucugguugagcacaucuggauccucuagacacucuggaucucuaauggccauggucugggucgcagcuggauugagugugaugucuucuuugacccuguuuggcuccguggagacagcuucuuggaccuuguugugcucccuugcggagaccucugcuuucuccuuccugggcuucguguuuccacgugcguugggguucaccagcuugagguuagacucuggaaaucucuuucugcacacucuggucuucaagacacucuuggcguuccugcagauauuuuucuguuugcgcagcgugcgggcaaccuguuuccaguagaucuggucuuugucguguuuaaggcagucaguugggucaccagcaaaaacacaagaaaacuccugaucggcuugugugcacuggaccuucaggcugaugcccugcuccuccucagucacagcccaucugcauguggcuuggucuuuggugacaaacuugccaugcgucagagauuuagauguccugcuucucugcuuauucugggccuucccuaacgagggagcugaacccucuacccccuccuccgcugugcuguguggugcguucuuggcucucuuucugaccuuuucugagaacgccugaguagccaggagaaggaaggagagcaggaugaggcuguggagucucaucacgucagcuggguggacaccuguuuggcaaagggaagcgaaugaguggcagggggagacuucaggcugccucccuccacucccacagucuuggcccacauuaaggacugccaagugguccugcguacucucauuuccacuuuaaagaaaguuacaccuccucuucuuacccacugucugagcucaugacucuuccccauucacucagcuucucacuuucucagcccuugaucuacucaugcaacaagcuccaagugccuacaacaaagcaacauccugaagguuauugccccauggagugagaaagucccagccagaccuuagagaauucauaagauacaaucagagaaauuuaaauagcaucagcuagggacucucucccuucucagcccuccuuuucaucuuggaaaagccacucuuuccuucuagaaauuguugaauaaaacagccacuggccccuuggcuagcuccagagagaguuggguuucuaccccaucaucugcguggguaccaaugaccaccuguugggaaaggauauaguaagagucacagaagugucaugaaaaagauauguugacucaggguuaaacaugcacaggguuugacauacugggcuggguguggcugugugaagagaaggggaaagucaugaggaagagucccaggaaggcagggaggugggggaggccacugaccuugauggggccaacuugaaacaggguggagagggaugagaucguauagacugcaagguggaaaguaaggaucaugacugaguucaauggcauaaugccaggcauacagggaguauuuauucaaugccuuuuuuuuuuuuuacaucuauaacaaaaauaaaaugacuuucaaauuaaaugacauaguuucuaccagguauaaagcuacagauaauggcagaggaggcacacgugauuguuugccaacuccuagguguuaagcagugccuuagcauuugauucucaccccucuuaauauacacccucaggcaaccucugggacagcuagggcucagacagauaagcaaguuugccccuugaugggcaaagacgguggucuggaaaggcagagugugucucccuuucugucaguccuuagugcucacuucuugcuuucugccuuuauucuaacucuuuagaaaauagcaaaaagaaacaacgggcugcacaagauuugguaugguaccaaacacgaucaccagaugguucuuuuaaaaacauuaaaucuaugcuuuuaaaaaaaaauugagaacuuuuugucugaaagguaggaaaaacccaggaaagcaccacaauuucauuucugcccauguggaaguaagaaaaggaaaaggccccaagagaguuuagacuaaagcguggcugagacuggaggcugaaagagccagggacagaccuguuucuccuggcacggugacauagcuuucauguucccauaauguggucuggacccaaggagguccaggggcuaagaaguagauaaaauaacucuuaagaggggacuggcaggagggcccugaggauggaggcacuugccaggcaggcaugaugaccugaguucgaugcucagaacccauguaaagguggaaguugggaaucagcuucuuuuuacauguuauccucugcuguaggcauauaagccccccaucuuuaaaaucauacauacuaauuaauaauaacaauaaugauuuuauguauguauuuguacacacacacacacacacgaaauguuuaaaagagccaggcucaccuuucugugagugugcagauccagguguacuggggaaugcaggcuuccaguccucacgcuggggugcagguuguacuauuuauacagg

SEQ ID NO: 2447 - RNA, 2120 nt, Mus musculus
cauaccuauucuuccaacaucugugcagccauucuuucaucucuccguccaucuaccuaacaacccgcacacaauuaauacgcauccuuugaugguaaaaaugucccagaggcgcuauucuuccuuggucuauucucuacccacuuuugguugaauccaggaauguaauugaucaaaaggaccagcguuguguuugucccugauagcacagggauacacuacagccaauuuuucucccccuuagaugauuuuuguuuguuuguuuguuuuuuaguuguuuuaaauaaaaugcacugaguaccgguaucgugucuaaagagccaggaaaguguggagguuagagauuuuaggagcuagcggccuuccaagcagcgauuuaggauuaggugauagagaaggguguucugggacugagcagggauuucagcaggaaauaaaugcucugucccguggguguccccagggcauuguagccucucagaagguccaaucagugcgcucagacucagagcccuaggcuccugcucuuuaaauuaccgagccuuguggagaccccggcaccuggccuuaagcucagcccugaguaaguacguuucugaaggagucgguguuccuuuaguuccauccccaaaccucugccagagacccuagaggacgcaacagguucccagaguccuggagucccgugguccugacucaggcacccuuagccaacccggggcggagcagugggacgggcucucacccaaucacucuuguggugcccuggggcuggaccuuaaauaauucaugaauuaaguggaaggagcccagcuuagaggcgaggggcuggaggguuccgagacccggaggagagcuggaccggagaggugaguugcuccgagugccgacccagcgcggggcgcugagcucccccucuucuagaacacccagggcagggaugaggaguggagaagcucgagcaacgucuuccucugccuccacagcagguggcgggaaccuaguuugucuucccgaagcuggaggggcugcaggguggugugggucucggccagugggcgagcccagggucuggaggacugguuauagagcgugcaaacuuuuucccgcggcgguggccggcuccucuccgcggcacauugcuccgcuccgguacuccuuccauccuguggagggguggaggucgcuggguuccggagacaagagcaggaggcggugagacuuucaggccaccggcccgcuuucgggaagggcggcgagaggagguucggucugggucuugagaacucuuuugcgguaaggaaaacuccaggaaaggccaaggugggggguaggcugggggagggggacaggacgugggacucccggccaccagccaccaucugcuaccuaugugcagcucacagugcuacuggccgcagcgggagggcgaugccggugcaagggcaaaccgccucccugcggccguugccaagcgcacgcacccgggcuggaaguccuggcuccagucagcccuuagggucacacagcaccgagaauuucagcuuuccuagagauggagagcaggagcgcucagggcauaccuugacagaaugcggggaccagggacaacaaagaggaauguggacugagcagagcuucguggcugcuggaggaucggggcucgagcuaaguucccgagaaugggucggagagguuccaauccucaacccggcguucaaacaggacuggguggggaaaugccuugguggcgcuccggacuacaggacucaggggcgauccccucccccaggcgacggcggauuccuggaggcucccagcuucgcgcgccgccucgcagucgguucuuuuguguuccgcagcccgggaaaggccccugagaaggggggaaggugggcaggagggcgccgggucuggcggcagcuuguagggaaaggcagcggagcaaagguaccggcgcuuccugcagcuacugcuuccuccgggagcucgcucuguugcucucuuguucaguuguggacuuuucucaugcccaggcggagaaugguuugcucggcuucuugugggcgguugcuggccuuuguuaagcaagcgaacgguuaaaguccuuuguggacccc

SEQ ID NO: 2448 - RNA, 4320 nt, Mus musculus
ucuuugcagacugcuaucauuugauccucagcagcauuuuuuuuaaugcaugaauugugugacaaauacuaguacuuucaccuuaacacaguuagagcuggaugccgguucaucccgguguguggugacugagcuggaacucugggaagagugcucgccaagaacugcgcucucaccgugcucuuaacauuacugccaugucacguugcauuuuucgacauagaucagauuaagcaaugccugucauccgguuccugcguuuuccccucuugacucgucugcaggguucuaggugaaagauucugcauagccauguauagcucuagcagucaaugaggagcaaguccaugucggacuaagaauacggaacucugucuucuuaacuugguucuguuguugaacuucguagacugcuugcuuaauccacuuggcucugcuucaucgagccaguacuaaauaagucucuaacuuaguugucuuccucuccguggagaccuugguguaagauaagcaugacaucuucccaugagcaugaaacagcucccuguaaggcaagcgcaggaggugagcagauaagcauugcuuguaaagugagaggccugaugucagguguggccaccgugcuguuugugguggaacaaugccgucacuauuguucucuuuguaaugaugacuugacuucuggaacucaacucuugucugauuuguuucucuccuugccuuuacacaucuugcuguaucuccaggagaagaaagaaaaccugaaacccagaaaagcuaacugguuuucuguuggcaguucccacagagauugucaauggaauucagacaauuccuauuccuugcauucuacugucuguggauuugaaauuuuaagccagcuggaggauuauugacacaucacacuguuaauccuuugcuuuguuagcguuaagaugugccuuccauuuggagaccuucuucugucucuaagcguaugacugcucugcucuuuacuauccuaaaggagaccauaaaugguuuuuaaagggugggaggcagaaguaagaagauccugaguucaaggccagccugggcuacauggaaagcccaugucuccaaaacaacccagcaaagaaaccaacaaaaagccucaagaagcugaauauaguaugcaaaauggcucuuuuucuuacauuugacuuagaaaggcaaaacuccuauuguauugucuccuagaaaaguuaauuccuaguuucccuguguaaaaguaugccuguuacguguaagaaaggcucauuuacuauuuuagauaccuuguuaaacuuuguaaacacuucuuuuccuuaaggccagagacaagcuuguuucaugguuucuuagcagucaaccaguauuccuuuccaauuugguuuuuuaaugugcagugcuauuuuaagaaagauauauuuagacauauugcugaauauauaaauauauguaugauuacucacuacuuuuaauaaauaguuuuugauccuagcuucugauuucuaaaguaagcugucucggaugaguaagacuaauaguucuuauuucaggaguaaaggaaaagaauuuauacucuuauuucucaauuaaagguaaaggauuacagaauguuucugugguagaugaauauugauuuuauacugguggaauugauuuacacuuaugauggauauuauuuuacuuuuauuaauguucacauucuucuaauagacacacuuauaauucaguaguaaaauccuucuguuuucagaagacuauacccgaagucacaggacaaguaaagucagauaagucuauagaauaccagagaaaguuuagcaaagccaccaugcacuggugugcugaauaucucauuaggaaguacagaguucuccaggguguaacaggagcgagagggggcauccauacaaacagcaagaucgcuugacaggucaggcccaaggcaguggaagccccuucauguggcaugauugaaaagcauauuccagccaggucuuuuucucuaaaauaacagugggugacuggguguaauuauagugagagaagagcacagcacauuucacaggucaguucuggucuuuacucugacauuuguccuuuuaaaugaguuucgacugggucuguuaauuuucucaguuucuucauuuguauuaugugaauaucuuuuuugugccuccuuuuuaguuguaauuguuauuagaguuauauaaaggaaugaacacuagaacuuuguaaacugccucagagugcaaggaucccaucuguuaaaucuggucuuaucucuaugaauuguugauauggaagcaagcaaaggcuuugagauaguuuauccugugaagcuugggcuuuuggucauuauuauuuuacuguaccuuuaaaaaccguucugugcucuauuagcaugggguugguugugugcagagacaguguuacacuagagcuuacucagagaugggcauuggaaaaauaagauacaugguacuugguucauggucuuauagcagagucugcuauuaggguggcugcauagaacccagguucgguggaagugcagagagcggggacugauggaauacuaaacauuucagaaaaugugcagauaucuguuuuuaaaaguacuuagugcugggcauaguuucucaugucuguaauucugguacuguggaaacagaggcaggaggaucacuguaaacuugaggccaaccagaucuauauaggccagccaagacuccauagcaaguucuugcuucaagaaagaacagcaguggaauauauaaucuagcggugaaaagcacccacuuggcuagaacuuggaaucugcucuacugcuuacucuugguguugccuuagagacgauguccucugccucucugugacuuggagacagccauagcuauagaaucuguuuuauaguuuugaguguuuguacuuaaagaguacacuuucauuguuuacuauuauaccaagaacugaacguggugaggcaggcgagauggcucagcaguuaagaaucuaacuuguguuuaacaccaagauucuugccuuucuagagguaguuuucucacacaguccuuuuuuguauuuauaauauuacugaaacauuuuuguuuauaucauaaccuauuuaugaaaucuaauauaauuuugguuauauccuuaguuaaauguauuugugaugcuuuccaccauagaacccagauggcagaaacagcauuuauagauuuaagugacaaccaacugguuaauuuuaccguuaacauacagaaaggaacuggaguucaugacaccacaucaugcccugugguuuucaucggcuuucacacaaacacugucaagugccucaaggaucuguguggaaggcaagucggaaacagguguuagagaacuggcagaagguuccguuccccucugaaaacaagagaccugugucucgaccaucuuuuuuuuuuuuuuuuuuuuuccgagacaggguuucucuguguagccccggcuguccugaacucacucuguagaccagacuggccucuaacucagaaaucugccugccucugccccccaagugcugggauuaaaagcgugugccaccucaccuggcgugacuugaccgucguaggccuaaaagcugagagcgcuggugaugcuaaagccccuuuagcgccaauugaccccacauuguuuuuguggaccugugaaccaaaacaccaauuacagcaaaaacuggccuuggcagacaccacuguuaaagagaauuugcccaauaaacaaggugcauccaggccuuuuaguuugcuuuuuaaacuauaaaaguacuauguaaugaccugacugugugucucuuuaacacagaagacagacucccguucugcccaagcgucugucucuuguuaggaacaggaagccucccauccuugcaguggcugcucucagggguuagacccagggcccuugggcuguuauuuauaauuaugaucaguggggaccauggguggaagcccgacugccuucauucccugcuaacuccccagucucagaagagugccagcucuagcacccagcagcucuucucuuguagagauucgccuucucuuuugacugcugaguuaucuuguaaaaguguauccuugguauuuauuaaguaguugcaccaaugcugaacacugggauuaauccuacuuucucuguccauauaggucauccuuaaguagaguuggcaguaaauaagauuggauggcaagugccagaaguuggcacugaccugaguauccacagaacuuucucugguggcagcguuugguucucuucugcagcaua

SEQ ID NO: 2449 - RNA, 817 nt, Mus musculus
ugguuuaguugucaguuaaacacuugcuugcaggaauguuugcuuucuaaauuggcaauaccuaaguaaaccaaagucuucaaucucucagccgcuuguucacuuagacuugacuagggcaagcaaauagaugcgaccagguuucacuacgguuucuuugaaaucuuuucaagcuucaggaaagccuuuauguuguuugcaugaagaaagacaaugaagcugugcagagccuuuggugaacacagaccuugaacuucugaagugaagugcauuuauucuucccugguacuaacacagaccuugaacuuuugaaguagugagcaccccugggcugagcuggauacuuggacuuguauaaauuuaacaucauagcacacacucauucaucacagaggcagugcacugagcaucauauacuuaacagguuuaaaccuggauuuucaaccugcaguggcagaaaguccuuacuagggagccggcaugaagccguggcuauugggguggcccuccuuguuuccaucagucuuguaugagggaaaagauagugguuacucccgcuuugguagauggcauuagggaucuaggcaggcaucccaggaacauuucagaaguaccagccagugguuuuccuguguggacucggugugaaccaccuucuucugaccccuggugucuguucuaagagccaggaagcucucacuguugcugaugcaugucuaccugugacugggucugcaguuggccacggcauccccacucacuuagaaauccaggcguucuuuuuguucacccccaagugcuucucucuucugcucug

SEQ ID NO: 2450 - RNA, 1232 nt, Mus musculus
aggccacgguggcguucgccuaucucuucaaguacaucagccagcgacacagguguugguaaaucgugcuuauugcuacaguuuacagacaagagguuucagccggugcaugaccucacaauugguguagaguuuggugcucagaugauaaagauugaugggaaagagauaaaacuccagaucugggauacagcagggcaagaguccuuuuguucuaucacaaggucauauuacagaggugcagcgggggcuuuacuaguguaugauauuacaaggagagacacuuucaaccacuugacaaccugguuagaagaugcccgucagcauuccaauuccaacauggucaucacgcuuauuggaaauaaaagugacuuagaaucuaggagagaagagaaaagggaagaaggugaagcuuuugcacgagagcauggacuuaucuucauggaaacuucugccaagacggcuucuaauguagaggaggcauuuauuaacacagcaaaagaaauuuaugaaaaaaagcuaagaaggggucuuugacauuaauaaugaggcaaacggcauuaaaauuagcccucagcacgcuguuaccaacgcaucucauggaagcaaccaaggcggaccgcaggcagggggaggcugcuguugagucugguguuaccggcugcccaguggagccacgcacucugucacccucuuuccucaugcucagcugagacaugaaacuauugaaauggcuuuaugucacaggagacuuuaauccuuccgauucuuguauaacuuugaguaaaugguuaauguucacuuuaaaagacagauuuuggagauuguauucauaucuauuugcauuugauuucuaggccaauugaugugauuauuuuuuguuaaauguugucuugugccauuaacuacgagcugaauuguauuagacacuacaaagucaugguauuuuaaaucaguuuguguaguuagguuucccaacaccugcaguuaccuaauguuuagcauuauaggacuguccucaaaaaguuugucaacuuucaaggauagaaggaaaaccagaacucuuugacuucuguauuuaucauuugcuuucuguauauauaguuuaauaaccugcuugggugugauuugccaagcuugaacucuaaugcauuugcauaaauucuaccacuguucggagcuugaagcuacagaagcauuguuaggaauugcuuggacacugacuuuucaau

SEQ ID NO: 2451 - RNA, 19320 nt, Mus musculus
cccggaggucccgccuccaggcgcgcgcccugccacgcgccacgugcuccuucucuggagggcggcgccgagggccgagccgagaagauguacuugcugccccuuccggcugccgcgcgagucgcgcuccgccgccugggagugagaggucucugggaucggggucuguccaccgcagacaugacgaaggugaguggaggcggcucgcucucgggcggccgcgcgagcccuggcggcgggcagcagggugacccggcguauccaggccgcgaugugucggacggacgcaucaaguugcagaaaugagcugaacagaaaaguucccuggguuugcaggacaccagccugggcccggcuugcgacgagggcggccgaugcuguuugccgagggcgcguccuuucuuccuaacuggacagugcuggguucugaaggcugagcagaaccgcucacuccaccuaaccaguguuuacugacuccucuaacugagcucugaaaaauuacacgcgccuaguucgccaauucuuuuaguucucacagagacccuagaaaggacgacgguaggauugucccaaagccugcuacgcuuccagaguagccagucacagggccuggaccccuccccccgcugaagugaaguggaaggcccugggggaggaaacugcuggauuggguuucuguccuuuuaggggaaaggguuuuauugagagaggucaucuugaaauuggaagagggucuucuccauagucugagaaauuaugaaggacccucagaugggaaaagucuggaagggcucauuggaguacuuccaggucauacuuccaggaccuggugagggaggaauguuccagauggagcuuugaacucaggucgccugcaguuaucacagauagcagaggaguuaggcagacaccuuuccagcccuggccgguaacauuggauugucccagguuggucucauggaaccccagaaugaacaaucuugggaaaguuagaaccuagcacuuaccauugcuaaggacgccuguuuucuucaguggaaagauggguccggaguaccugggguguuuuuuggaaagggcccugaccagaaagaaggcaugugcacugucaaaguuuaacuacgcaggagcuccagugucagggacuagguuuccuuaucuggcaaaugagagaaaaguacuccuugaaguggccguaagggaggcaguauuuuaaaagucguaaauugccuugugaagucaaaugaugagcagugguuuuacauccuuauuucagguguuuggggcggggagcgugugacagaaauguggagccacaccauuaagugcuuggcagaaggcccugcuucuucugcccucucugcaaagucacacacuuucccugauugacaggguacuaaacaauguggacaucccugaucugaaauuugaagcacuccaaaaacugaguguucacucacuucugaaugucuguaggaaguccugcagcuaacccuugaguggacagagucaaaacacaaguauuuuaaacgaccgaacccugagacaguagaucugaaacaagugauuuucagguuuaggguuggcccaagaugucucacauaacccaguuccagucuugcccugguagggauuuuagcugcugcgguggaggcugcugcucugcucuuggccucugcggaaaaagacaguuuuaaugggauugcuugccccuucugcaucuggacagccaaugcuuucugggggaucuacucugauuguauuuaucuuucuugauuuuuuuuuuuuuucagggccuuguuuuaggaauuuaugccaaagacaaagaugaugaccugccacaauuuacaagugcgggagagaguuuuaauaaguuggugucuggaaagcugagggaaauguugaacauguaaguguuacuauaauugggguuccuuuuuguuuguguguguauuuugcauugugagacagggucucugcuguguagcucuggcuguccuggaacuauguagaucaggcuggccggcuucaaacucauagacauccaccugccucauucccuggaguucuggauuuaaauguauuugccauaaaacagggcgggguuguaguucuuaaaggccccaagauuuaaagagaguauucuccuuguaucagguaaacuuaauggaacccugaccagcagguucucuggaaaugaaaguauguucuugaagaagcugggcaguuguuugagugugggugggucugcaguucugggaagucaugugguuucuagccagucacaaaccuauugugaaggauugacgcggauccagaaaggaauagauuuccucagcccacucccaaggcucagguucacaacuccuacucuccugucuggcaccagccucuaaaugcacuuuaacugaguaauuuaaaaacagccuaagguccugcccuuuuauuucauggcuggacuuugaaggcuuuucaaauguuaaaguaaagugugggugggucaucugauuagcaaguguacagccugaaauucagucaaucuggagauggccugagaucugaccucucucuccuagauuagcaagguccuagaggaaguaggaagacuuuaaucugcuaaccacauuuggcagaaauagagagagcagcauaagccccuuuaacgaccugucacucagguaacagacuguauguuagagggucccaggcaucaccugauagcuauagcaauucuaucugauacauuguaaguacacuguaggacuuguaccuccucuugcuugcuaguucuuuacuaguacacagccuucacuaggaccuaaaucuuuaacccagaagcuaaccuguuaagaguccagagugcagaggccucccugcaggguuacuguggggccucagccucuguguuccuggucucuggcuucaguagaauaccucuuuuauuuggaaauugcuaucucucaucucaguaaacagucugggaaacaccugugcugaagacagugcugucaagucuguggcuuuggucaccacucuggguuuguuuguuugcuuguuuguuugcuguuuuaugguauuucuuuuaguagaaagguucccaccauuuaguacagccaccauccagugcucaagagggguacuuuaccuauccauaggauugccuucucuuuugaaaaaaaaaagaagaaggaggucauggccacauucgguagucuaggcugagccagaacucacuacacuguccagauuggcccuaaacucacgccaucucgaccuuccucucagcuugccaaguucugguauuacaagcaugagccaccacgccuggcuucucuguuuuucaaucaguguuccuguuccauccagccuggauguuggcuugguacuuuuugaggugaaagugcugcaucugagaagucuagccuguauccauucuguaaagccaucagugaaucccagaauagaagcaguuaccaagagugucugcagaagcuuagguccuucaccaagagagcauguuuaaaacaaccgucuccucuuccuuuagaucuggaccuccucucaaagcaggcaaaaccagaaccuucuauggucugcaucagguaugaagugaagggcaugguggucuggugaauccacauugagaccucccugugggcgcaguuuggcuagcacuuuggugcuuccguuaagcaaaagcacuccuuauggucagaaaggagaauggcugucucucuggcucguguuccucaggguggaggggaggcaccaccccaugcagaguaacuuggaggauuaccucacucugccucucacaucuguuguacuuaccaacacacagggcuccuguuuguuaaaccuagaguggcucucugccagcucuguguaacuuucuggaggagcuguuuuaaacguucauagugguugaugguugacuugguguguuugugggccaggacuuccccagcguggugguggucggccuuggcaagcgaucggcuggaguugaugaccaggaaaacuggcacgaaggcaaagaaaacaucagagcugcuguugcagguuggcuugcuuguuauguuuaauaguugaagguucucgagggcucguucccuuuuguccacucacugccaccagccuuacccugcccccgugcaacagcucagcaaguucaguguauagagaugugucugaccuuaccuagacacagaggcuagcuugugacauugucauuuuuaguauguucugcuuucucuugggagguuugcuuccauuucuucuuagaaauaucuucuaucagaaauugugauguguagacaguuuuccauuuuguaaugcgaccacagugcugcccgacuguagauagcauagaacccuuagauuuacaaacuagagaaaagaggaacagagugugggauacuuauucauugcuagcaaaaagggccugucccaguuggcuugauagguggguuggggaaaugaggccgaugucauugagccacuguguugcuuagcagcggggagagccuuucccacaggacaacugccccaaaugcagucggagaagcacucugaggcagcaguaauuugcuugacuaguccuuggccuggguauuaucauaaaugcuuaguaaguuuacuuucagaguuaaguagcgaugccuaacuuuuauuugagagucuuuguugacacaauuuuaauaaaugcuguugaugauggcuuuugcucgguugcuuggcugaaagcucaacgccaucauuccuuggucccuuuaaucuggcagcuccuggugauugggaagcuuugucaggaaacgcuggcacuucugaaauacucauggcagugucugccucucacugauggucucgccccuagagagguucugugccuuugaccucuguacucagcucggcuagugaggcacauaccauccgcacuuuauagaaggagaaaugaaaguuuagaagcagacgacgguugccaguuuguuccccuggcacaccaccgcgugccccugcuuugugcugacucggucgguuuucugcuucugcugucugaagcgggaugcaggcagguccaagaccuggagcugccgucgguggagguggaucccuguggagaugcgcaagcugcugcagaaggagcugugcuuggucucuaugaguacgaugaccugaagcagaagaagaagguggcugugucggcgaagcuccacggaaggugaugggaggaaaccaggguauggguggcacucgcaggcaggcauucugacagcaugcuuuggagagacgagcugccugccuuucaggguccagcagugccgaguggcuugugugucuccugcuuacugucucagcucucucuacagugugauaguuguccccaagcuccacuccuggcacuugucaugugugugaauccucuguggcuccugagaauuuucuguacuugcuggucacuaagaagcauucacaguguuggcuuuucccagaaggagggaugacuugacagaauauccuaaugagcuuuaauccaauacuucccauugaacucacaccugcugacaugcuaaacauuagaccuguguggaugagagcauuccaccuuuaccaugacaggagaugcuuucagaagauaacugaccacccaugacugcagcccuacuccagucuugaagggacuggucugugcugucagggcuagacaaugagagaucuucaguuccaggagcugugaugccagcggguugcucuuggcacagaauggugguuagugucuguuaaagagggguugggaaugaagguucucuagaaagucacccacguuucaauccugucucuaucacuuacgugggggaaccucaguuaagugacccgaaucuauaguccuuccuuuuuauuuuagguuuauuuauuuuauuuauaugaguauacucuaguugccuucaggcacaucagaagagggcaucagaucccauuacggaugguugugagccaccacgugguugcugggaauugaacucaggaccucuggaagagcagucggugcucuuaaccacugacccaucucuccagccuuuuuuucucuuuuuguguagaagaguugugauccugguguagaguguugaguuuuaagagacagucucauuauauagccuucgguuaguguugaacucauagucuugcugccuugaucucugcagugcagcaaguacaggcaugugccaucauucgugguugaucucauaguuuguaugaugauccaaagacaaaaugugccagccagguggguggcacguggugacugcucugagaugccagcuauuauuuugucugucuccguguugcccauauuaacugcugucaaagcgcuaggaucaugcagcaugcaccuuuguguguucucuucuaaagccaauccuugcugucuaguggguugggauuuagagccuugauuaggcacaguaagguaggagagccuccaauuucccaucugaaucuuugcugcuugcugacuucccagugaguacuugggauggucaucucugcagaggacuggaccuuggguaggaaucacugcauaaccuuugcagguagauuuacagcuucaaauaccuaucagaccacacacauacacacacacacacacacacacaaugggggggggggugucaggucucgcuucuuguuuuuuuuuuuuuuuuuugacacaaaguuucuuuucguagcccuggcuacccuguaaauugcucuauaacccaggcuggucucaagcucagagagauccgccugccucugccucccaggugcagggauuaaaggcaccacaaaggggaaauuugugaaguggacugcucagucagauuuaucuuacuuccucaguggggugggccuagggauggaucuaggucuuuggcaaucauuuuuuuguucguagucuuaauuuuuuuuuuuaagauaagugccucaauuagcagcagaaaggucaguguacuugaggucuuuugagaguaacucuuuucuuccacagcggugaucucgaggccugggagaaagggguccucuuugcuucuggacagaacuuggcccgucaucugauggagucuccagccaaugagaugacaccaaccagauucgcugaaaucauugaaaaaaaccucaaaagugccaguaguaaaaccaagguccauaucagguaauuucugauuuugucauggacucaugggacguacagccaaaagaauagugucugcugucuugccuuuauaucacuuugauggugcaagcuaaagucacuuuggaagaaggaaugucacuugagaaaaauccccugugguguauuuccuugauugacaauugaugugggaggucccagcucacugugggcagugccaucucggaaccaguggucccgggugcuaugagaaaccaggcugagcaagccaugaggagcaaaucaguaaauagcacuccuucauggacucugcaucagcuccuaccuccagacuccuguuugauuuccuguccugacuuuccucaguaaugacuguuuccuaaaaguguaagcugaaauaaacuuccccaaguuacuuuauggcuguaguguuuuaucucaucaauagaaacccugaccaacacaagucaagauccuacaauugaccucugugcucaggggagugaaucgagcccaccagcagcuagacacaaagucagacagaguuacauuugaggcuuguuuuccucaccuucaagaaaguuucaugauuucauacuguguugugggauuuuuuuaaaauccauuuuauggauuaaaauggagacauaacuuucauguuuauuucucuugaauaaaaaauugggaauugaauuccuaggugaaaggauaacugguuaacuuuuuuuuaaaaaauuguuuuuauuuuauauguguggguauuuagccugcauguaugucuauguagugugugagugcuucgaagccaagaagaccagaagaagguauuggaucccagaaacuggauguaaaacaguuauggggcacuauauggacgcuaggcauugaacuuaagcccuuuggaagagcaggcaguacucuuacacugagucaucucuccagcuccuuguuagcaacuacaaagcuuucaugucuuuauguguuguccugucuacguuucugcuuacgaugcaggugaagagugcgguauacugacugagugggcacagggugagaacccaccugccucaugaccuuggcuacaacacaugggugccuugccaggccuuccaagugcuugucaacgguacucacugucaguuccucuaguuuccauuucccuuucaaaagcugucuucagcccauuacacacccacugagcuugggaguucugauuaacauaaaugaacagacucuucuuuuccuuuacuuucaggguuguuucucaagggaucuuuucauguaagggggauuuuucagcaccuaguugugauaagaguucucuuuguuucucuuuguucuuuuaggacagucccuauuuagacacuuucuauguguugaggcugucagcguguaggcuccaggcauguguccugucucagagagugcccugcucugucagccuguaguggcaaugcugccaggucagggauggcaugagguucguaggcaggagugcucagugauggaucuugcugcaaagggcagaacaggcaggaaaauggcucugggaggcugcugcagaagcaggagcggggcugugaggauaaaauggauaccagcggaguccugaggucacuuuaaaugguaacagaccaagggcuucuggcaaggugugcugcagagucuugggaaagcacaaggcuaugggugagcagaggaaaaaagaguuuagagagggcagcacgaugcccaggcggccugugacucacgcugcuaccgagcugcaccacaccccacucaggguagguagagcugcuucaaagaaauacagcucuuccagaagggcaaggcaagcaguaagauaccaaguacuaagcuuggauucagacauguguacacguuauaagcuugucuuuuuuaugugauuuauguuucuuguuucccuuugcaauaaggggacaauuuuaguguaaugguccugacuaaaugggcaggcaaguacaggaguaguccuuggaucuggcuacugcuggucuucucuguuaguacagacuuuguuauuguggcuagcagucaauacagaacacuucauccuuaccccagaaagaacagcaauauggugucuguguucuaguuugcacuacgguggggguucauguuaccugcacugagucugcguuuauuaugagaacuaaauaguuuuuccguucagagacaucucaaauugcacuuggaacuaggagaaaugcugugcuaauguugaaaagacaagcagagaaaccggauauuuuauuccuguugaugaaggauagccuuguuguuuuuguuaguuuuguauguaugccauuauuaguaauacaaaaggaagcugaaugccuugacuuuaaauucccuucuguggacuaagagccuugcuaauuucauuuucaaauuaaaaccagaaauacuugaguauugaacacguuauuaccugagcuuccuuaguuaccaaguauaaguucucugaguaguugucucauccuugguagaggagugccugaugucaguuuacuguugacguauccccagagucagagucaagucuuuccccugcgaguagacugaagcaaaugcuaggcuauggucacugcugccuucagccuguguuuguagccugaugcugggauggagcucauggucuugugcauacuaaggacgagcccuaccacugagugcacugggucuguucagcauuugaauaacuugcacguuguacauuuuuuagcauacuguugaaacuuuucuaaguuguuuuggaauaaauauaacaguucucucuuuuuuuuuuuuuuuuccucuuuuugcccuguagacccaaguccuggauagaggaacaagaaauggguucguuccuaaguguagccaaggggucugaagaaccaccagucuucuuggaaauccacuacaugggcagccccaaugcaaccgaggcaccccugguguuuguggggaagggcauuaccuuugacagguaggucuccggggugacugggcucuguucuggugaacgccguguggguguagugugaugcauaagcacggguuugaucgcgucuuacacguuauagaaaauguacugugcugucaguuuugaaaugcagggcuuaccuaugccuaagacaauugggaguuuuaauaaccaugcuccugaucuuagcccugugaccagcaggcgagggaaccacaauucagaaguucuuuguucagucacauuccaaggagagucaguggguuaggagauggcagcucaguugguaaagugauugucgugcccgcacacaugcaagcaggcacuucuuacauagauaccuucccuaugccuuuucucucucaguagcuaucugccaccagcuggugucagaagaacucuuaccuuuucugucuugugugcuugauaagaguguuccaguguuccaugagcuugucagaucucaugaccuuuagguuucacgaguuaguuaauucaaagauuuauuuauuuauuuauuuauuuauuuauuuauugcugaagagauaguccuuguggguauugguguuaaugaucaaaagcaguaauggaucauagguggcuugauaguacaugaugguguuuguaauggcaccuggucaggcuucauucaaacagaaauaagaggaccuaccucacuucuccauauuucuguaaucauuuucuaucuguauaaaggcuauagaguugaaguaauucagauugcaaguuuagaaacaugaccuucuuuggcagguauguggugccuuugugugugguagugaacucuggguucguaugggauuuggguuuguucuguuuugagacagucuugcugugucaccaaaucuagccuccaaguugaaaucgugccucagccuccugaauucugggauugcaggcacacaccgccacauggaugguguuguguuuuacauuuucauguauuuauuaugugggguauguaugcauauggagacccaagugccauagcagaucaggggaaucacuucucuccuucugccauguggauugagagacucaaacacagguuaucacacuuggcagcaggcaccuuugucccuauccgucucuguuuuuaagaaagcaauuugaacuuuuaacauugcgauuauuaauguugcacaugguuuuccuuugucuuacaguggagguaucuccaucaaggcuucugcaaacauggaccucaugagggcugauaugggaggagcagcaacaauaugcucggccauugugucugcggcaaagcucaacuugcccauuaacaucauugguaaggagggaaggguugccucucguagugcuuccgaaucuagccguaagguagaaccgaaacauccaacaguuucuuaccuucugagaagaaacuuugaaguagcuucucaucaggcagcagcugauuggcugaaagaggcguuuucugucuuggggugacggaguuaacuguguugugcagccagcaggcuguaacuugugcugacuugucuuacuuaggcaaaagugguuagugucaggagcacggaugucacgccguuaccucccuccagcaagaaagccugccuguguggaguggagggugucgucuuggccucauuuacugaugccucauaggacucugcuccccucaaugccugcuacaaauaagcaguuaguacaagaggucuccuggcaucacagaugcgaacuuccagaagcagugcugagaguuuauagcauugcuaauaccgagacucagaggaaggaggagcugggccucaugcgcuguguggggaaccgguugguacucuaaaucuguccgaccugaaucucccuuccugagccauuccagcaucauacguggucuuuuuguucugugaucaguccuuuuuaaaaaacaaaaacaaaaacuuacuagaaaucaauaugcugacauuccaacauguuuuuaccucugaguacuuuuaacaugucuaaggaaauuacauucuauguaaugauaauacaauuacauuucaaaagagauuaucuaagaaaguccauuuuguauauacuugguauuuuuuaagaacuguuuuuuaaauuauauauguuagugugugguucuggguacaugugagugcagguucccauggagaccagagagggcguuggagccauuggagcuggugucacaggcugggugcugggaaccaaauucagguccucuaaaagcaaugcacacucuuagcccugagccauaucucuagcccccauauuuaguuuugaaaucuagauggccagcagagauagcacuuugcaucugucuguuacauucuugccacgagugucauuccuucccuuuccuucacgacacggggagugugagaggucuaggcuguucugcggcucuguaaccugcgguuacuccuucuggauuaggaucaguuaggcaaugcuacaugugcucugccugacacagccacagcugugcaaccggugauaccacguuuugucgcuugugaaagagacgacuguaucugugucugugugcuuuccauggcucaccggcagccuccugucccgaaggguggcguuuuuggauccagcguguuucauguucguuacuauaucuuuccaauagguuuggccccucuuugugaaaauaugccuagcggcaaggccaacaagccaggggaugucgucagagccaggaaugggaagaccauccagguuugugaagggacaacacaacagccccauguggcauuucucagaaccccaucauggccacacaacugcaguguaacauggguauaggacccuggcuccucuuuggggcagggugaugguuuuaguacaguuaguuucugauggagauuuuuaagaguauuuuuuccuucccuguuguaucucccacuaacuuugcuauagguucuaaucccagaugugcaccuggccuguagagugugccacaccaggagagcauaggcucuuagaggugcuugugccaugaugaacuucuuucucuuuguuagauguucaauuagaaaacacugcccugcgcuugggcucugugcucuggcauguguggagcacaagaacacaugugcacacugcucaggaccgugcaucuuuugcugagggaagggaaugggauuagaaaagguuaccaaaauuuuaagaguuuuugagcuugggguuccgauugccauauaauuuuuacuuccuugguuuuguuugguaagagagggaaguuggggaugcaggcaugcugcccccucagcccuguugcucuuucaauaucucuucccaguuuuccuucuuguuaacgacugccauucuaguggaccagacacuucccuacuuauuuucagugugugugugucagcagucaggacagggacuuacaaagccaccuuccagguuagaaacguuacugcuguagcuaaaauaaguguccuuuaacuuccucacaacaggcugaccuuucccacguugccaucaaaugcuguugugucugggucuugcauugauuacucagguugugugagcccuucuguuuuuaucugugcagguugauaacacugacgccgaggggaggcucauccuggccgaugcacucuguuaugcacacaccuuuaaucccaaggucaucaucaaugcugccaccuuaacaggucagacccagacucccugucucggaaaccuuacuuguuuguuggugcagugcacacauuguacucugggcguuauuuugcugaaauuugguuucauuuacucacauccaaaggaacugccucugcaguuauaaaaauguucucaauauuaguucuguuguuuuaaagcauuccacagucacuuaagaaugcacagugcguauguggaagucagaggauaacuugagugacuugaugucccuccagcacguggguguuggggaucagaguuagguugugaggcguggugucaagcacuaagcuaucuuucugguucuucagugguaacuuuuuaacagaugggucaaaucaacucauccugauucaaagaacaagagagguguuuuuuguuauggcucccaucuaauacaaaucugaaaagaucaauacauuucaaaaucagugacauuuguaauauacuaaucauaucauaucugauauccagucaauuuucuacacuuauaguucauacuguaaagacauaaagacauuuuggggauagcaagaucuuuguuuaauggacacacacagugugaucgggcaugcaaggaaagcccuugcuuugggccagcuuggguguauccccugcucacuagcugggcagccacagggaguuucuuggccuccagugucagaaccugaggcuggcucugcuugcuucacagauauuaaggguugggaagaacuucauggagcuuguugaaugccaguguucccugcaaggccuugacuuggcucuguagagacugcagagcuuccugaggggugagauggauggagacuuguugcacaauucccaaccucacaaucuuucauccaaaaucucacccgaggaauucaucuguacuucuuuaagauaaaauucagaucauucgugucuuuugguuuugaucuuuccugagucaaggaagccuuugcuggagcagaagugauuuccuguuucucuuguggguguaauaacagugcacagugguuuaccaagaauuccuuuuuauuucuauauuuuuggaagucugcucuuuuuaacuaauuuuuaaagcugccauacaaagauacaguuucauuugggcaguuucacaaauguuuugaauugggcauuauauuauuucugugucauuuggucucccuauucauuuccuaaaaacuuaaaacuuggagaggcuucuauggcaaggcuggggcagugauggauagguggccuagagccagugagauaacacugacccauuguacugacccuugucaguaagcgugcuucuauauugcaacuggaacugugacaacagcuguagaguuuuagaaaacacaguaaguuaaaauguguacuaugaaauccucuuaaaucaagauacgacauuaagcugggcagugguggcgcacaccuuuaaucccagcacuugggaggcagaggcagguggauuucuaaguucgaagccagccuggucuacagagugaguuccaggacagccagggcuauacagagaaacccugucucgagaaaccaaaaaaaaaaaaaaaaaaaaaaaaaaaaaaagaaagaaaaaaagaaaaaaaaauggcauuaaauauuuaagcuuaucauuuucuauucuuuuaagugaaaauaucacauauuguuuguagcuaguuuuuaauccuuuugugagaacuuuaaaaacucauggaaauauuuauuaguuuaguagaaaacuuuugaggaaaaaugaauauuauaccaaaaccuaccaacuuggaaaauaaggcauuaaauugauuggcuaaaaugugacacacauaucccacauagaugguagaccucaaaugauuacuacuugcuaaaguauccgauauauaauugauagcaaaugacggcagucagcaugcauuaacuccugcugagugccaggucugugcugggaccugaacauagaggacauauucuuaacuguuuagaauucuagaaauaacuaucgaaaauaaaugauaauuaccuuggaaugggcuuguugauaauggauaucauucucuuuucugcauuuuccacaauaaaggggaauucuagcugugagagacauaauagcuacagcagugacuacuucucaagcuuauauaugucagauaacgaaggaccauuacagaacuuugagaccacaguuguggucugaacagcaggagagacuagcacugaccucaggaucugugucuuacaggugccauggauguagcccuggggucaggugccacuggagucuuuaccaauucguccuggcuguggaacaaacuauuugagguaggccuaaaacauacaccuacaaguuacagugaugauaauuuugguggcccuugaauaauaugcuuauacaaauguuaaagugauuucuuccuguugaguggccuuugaguugaaaauaggucauugcaauaaacuucauucaguggcuuuggaguuucuaaagauauuucuaaauuaugggugugacaccacuucccuguccuuauagaugcagaaugguguuagaauuucauggccaagacugaagcucugaggugcaaagggcaugaggccagcucuguggaagcaugccccucuacugaaugcguguggauugagcaguguagacagucaguggguccgggaggaggagucggagucuauucucugcucugcucugcgccuucccagucaucuuccauccuugccccucucccauuacacauuacccugcauucacugcuauuggcuuuaccugucaauaccacguuuagccuaaccuagccuguuuguagccagcaggugacagugauuucuuggugacccuaguccuugccuucugucauccucucuucugacugacuuauguggcuguccugcuucagcucguuugcuagcucugugccuuguccucuucggacaguguuuaguccuuggccugauucgugcucagaguccucaugauaggcuugucuguuccaugccuguuaacagccgugucuccagugcuccguguggcugcuuggcagcuccaucugguggcucauguuuccuuucacaagcuguuaaggcagcuuaccaugggaauagacacgucauccaugaauacauccaugagauuucuuuaauguccuagauuuauuucucacuugacagugcuucucccacgucucugucuauuuugugaagcucacuuucagccucuauaguagccaagcuguuuccuuggaggcugagccaggaaccucuccuggucuuccauauuacccagcaucccucuauuaucaugguacacacaauauuuggguuuuuugaguuauuuacuuuucuagcuaaaaugauguguuuacaggcguaauuagucugcuuuucccagcgguagcuaaugccucugacauacuuauuuccuaaaacaggugcuuuuuggaccuuuugcucuaaagcuuuauuuuuuuauucuugugaaaaugaguauaccagccuugcuuaucugguuugagccuaaaccuuugauggcauagauguuaacacugcagcucagugucagcaagugagugggggguuaagcagugcacaaauggugccaucuuucucaggacuugguguucagugauggaggucuagcaugcaugucucuugcagaccaaggugaccacacccuuccuagucucccacccuaguuaaacucucagagccuaaagguuccaacuaagaauuuacucaauguccuauuuccuaauucugugauaaaucuuuugugaccuaaagcaaucucagacaucucucccacccuugcuuuguagcagcaggcuagaacggcucuuccuucaugcaucagacuguagaguuucucagaaaguacucucacacugucacacuucccuucaggccagcguagaaacuggggaccgagucuggaggaugccccucuuugagcauuauacaagacaagucauagauugccagcuugcugaugucaacaaucuuggaaaauacagguaugugaaaugaucuaaauuucucuuuccaaucauucuugguucccaaacuacccuuuagugucuuccuccuuacagaagauuuuaaaacuaacuucccuucaauguuguacuucuaagcuuacugguauuaaauuuuucucucauggguucucuuaauguuagaaaauuucaaaucuaaagcuuauuuuaagaaaguaaggaaaagugaugggaacuauaggaauccauuacaccgaaaaagaagccuagaguuugucauucauccuacaaagccguaucuaaaaacacagguucuggacgugauuucugcuuaauuucuuaauagauuacaugagauuaacuucucccuguucguaguagauagaaucuagcuaguacaaauguaauauuaauuuuagaagucauuuaccguguguggagugauggauaugccaugguccuguggcauguguguagacuguagagggcagcuuuguggacuggguguucuccuucugcauguaugugaauauguguguuccagagacagcucaggcugugaggcuuguaaaagaagcauacaguccccgcugucccacuggcucggaauguagcuucuuaaugacauguuagugcaccccgacauaaggaaaagugacccuguuuugccuuucucuucagaucugcaggugcguguacagcugccgcauuccugcgagaguuugugacacauacgaagugggcacacuuagacauagcaggagugaugaccaacaaagaugagauucccuaccugcggaaggggaugagugggcggcccacgaggacucugauugaguucuuacuucgauucaguaaagacaguucuuaguucacucacagauuacuccaucugucuugaauuggauauuugaccuucaaaauauuuuugaaugaaugaaaaucuuuuaaagacuaaaaugaauguuguucuuuuuuuuaaucuuaauuuuuggaauacuuuaauaugcuugaaucauggaaaucuaaaugauauaugacuuaauauaggcccuuuaaacuauuaaaacaucuuguaauaauaugcauuuucaagccauauuuacuauuuuuacaagauaggggaaaucuuaaguccauaaaaauggacaaaggccaggcauggggugcagaacuuugaucccagcauuugggaggcagaggcagcucgauuucugaguuugagaccaucguggucuacagagugaauuccaggauagccauggcuauacagagaaacccugucuuggaaaagcaaaacaaaacaaaaacaaaaaaaacaacgcauaccaccaccaccaaaauguagaaaggaaaauauaaugaaugacuuuguuauauuuuccaaguuuugauucuuaagguagauuauuuaaguguuccuauaacuuucaaaaucugauccaaugcaguaaauaaaauauuuccuucuguuaguuguuuguucacuguga

SEQ ID NO: 2452 - RNA, 9058 nt, Mus musculus
aggcgaacugcccgucaugugaccaggccugccacgugaucaggcugcccgcgccugcgcacacaggcccggugucguuuccgcccgccguugcagacauggcggcgucccugggagggauguucacugggcagccuccaggucccccgccgccgccgcccgggcucccaggccaggcgucgcuucugcaagcagccccuggggccccgagaccaucuaacagcacuuugguggacgaguuggagucauccuucgagguaagccgagaugugggcgucucugugcagcccucacaggcgugcggaaggcgcgcagguuaacuccuuucucggucccggcguuuaguagaggcggggcaccggagaauggaagucgccugccguagauuggguacuaccuguggccggucgucucaggucugcccccgcaaccgcgacauuucuggagaccguggccuugaaguucgcccaacucccauccaccucggggcucguuggauccccugcgggucuaguaggaucuggucuucccuggagcgggcccacucggcugagguccucugaguuuccaggucacauacuggacgcuuuuccuguuuuucucuaguguucuguguagaccuuccaauggccccuggcaccugccuaccuguuagcuuguuugggugccaucccuugacuucucuggcuuucgcuuucuauucauuugguaaaugcucuuuguuggcauaaguugaguucucacugugggaggaaaccuuaguagaacgcuuggguccauccacucuuggaugcagggauggaacucaggugugguggcaaacaucuuuaccggauuagccaucgcaccaguccuaaaauacugggcuuuuaauagaagggcacgcguuguuuuuaaccuccguaagacugacuguccauaaagguccaugcuuuaaauguuuuucaaaggauggggggggggggugggcugggaggugcagcaggaacuaaaguuucugaaguuaguuuuugucuuuuuguuuuguuuuguuuuguuuugagacaaguucucagcguagcccuggcuguuuuggaacaagcgcuguagaccaggcugacuuuggacacacaacugucucugccucccuagugcugggauugaacaagugcagcaccacugccuggcuugcaguuagguuugguuuuuuuuuuuuuuuuaagucugcauggccuacugccguuggugaagccccccccccccccgcccccaagcuuugugggccauagguuuucugaaaucugcacaucaugcucacgccccaaaaguccaacaagacuuaacuuuuaccguacacagaauaggcagucugguuggucgagcuguuacaggagugggaaauccuuugacuguuuccauccaucagaucuggagcuagccaggaggauucauugcuucugagaggaacuuuggguguaguuuugacuuguguucggaaccuaaauuugguucugugucuuugugguuuuuuuuucggugcuugcucaaggcugucggggucuguucucagacuguguuccucugucagcugcugucaugcuugucugucugagggcugcuugugccccuguggcgcacucacauguacagcucgguuggcacccuuucaaaacucccucuuugggauuugguuauccgcaugacaccacuuauuauacagacaccuguuacuuaugaaaugccaaaugguaucccaaguacuuagacuauagugcugaaucacacaggcagagcuguugguagaaauaacaguggcugaagaguggauaguaacaucaguuacuuuucugaaaagcuugccaagcuccacuguagagcaugaaagaaagaguagacagaugacaucuugacauaguaauauauacaguucauguaagggucagccagaguggcguggccguggugggguugaaagguauuccagguguggaauaagacagugaggaagaggcagguggcaggaauaagaccgugugaugaggccagcagauaccagugucucaggugccagaccagcugggauuggcuuuaccuggugucuacauuggccugauaucuucucaaguacaggugcaaaguguccacuuauuauugaguggccucaggagaagcccuuucuuuuccuaauagcugcuguguauauaacauuuuuauguucccuucacucaggcuugcuuugcuucccuugugagucaggauuaugucaaugggacugaucaggaagaaauucgaacugguaagaguuccaacuucuuugcacacuguguucuugucagcaaggugucuauuguugacuuuauaucuguguguuuagcccugcauauaucuuggaacauuucccgggaauaagaugugugcagaguccccauaaauugcuggcucucuguuugguucacuagcugacauguuuucugaguccuuauaaauugcuuaaaaugagcuuuucauaugaguauaaugauguaaaacuaaugaaugcuguuuauuuaaaaacccacaaauuuuguugauuuucuuuuucauuaggucugacagaaauauaagucuuuuaugcauauuuuuuuccuuugauuuuucaagacagcauuucuguguguagacuucgcuguccuggaacucacacuguaaacuaggcuggccucaaacucacagagauuugccgccugugucugccucuagagugcugggauuaaaggaguguaccacaauucucccuguuaugcauauuguuaucuccagugucuccuaacuuuuuuuguaguggaaauuguccucaucugcugagagucuggauuguguuucuuuggaagacuuaacaacuucuauguuguguaaagucucugaccugagaagaaaaugaauuaccuauuucaugcuaguuuuacaugggaacuugaagaugguuauuauucacugucauccagauuaaaaucccaaauuaugucuaugagaaagugcuguuuuaauauuuuaacuauucauuuaggugggauaucucccaccuaaaugaauaguuaaaauauuacacauauauuaaauauauauauauacauauauauauauauauauacacacauacauacauacauauauauacacacacacacaucuuguguauauauaaacuuuuucgggucucucuuuuuuuucuuaagguguugaucaguguauccagaaguuuuuggacauugcaagacagacagaauguuuuuuccuacaaaaaagguugcaguuaucuguccagaaaccagaucaaguuaucaaagagguacgaauuugacuuucccucaacuuuuaaggagagcaagugucguuuggauuccacugucucuaagcaagaugaacccucacccugugaguugaaggucuuuaugggucugaugagggugccagcauuuaggacagccuggacacagggcggucauuggagagggagcagagcugcagacagccugccuacucauuucacacacuggcuuuccuggaaaaguuuucuuaaugagcacgcuuugccuccugagaaaaguuaggaaaccaucaguauagaguaaaaguuaauuugaacaggaauuguaacuguguucccaaaucacuuuacaugguaccuugcucauagcaaaugaucuauuuucuuuacaguauagaaaauauuguagccagacaugguggcacaugucuuuaaucccaguucucaggagacacaggcaggcagaccucuuuuaaguucaaaaccagucuuggucugcacagcaaguuccaggcaagggcuauuuuuuuuuuuuuuuuuuuuuuuuuuuuagcagaaggagaaagaaaggaacuugcuggaguucaguuccagcaggauucuggucugaaugguggauguguggagucagcaaaaaugagucugaccaccauguuuuucaaacagauggcucugaauagcuugugcccucuuuauuuauacaaguuccagagcauucaagcaugagcaguuucagaucacuucucuuuaaucauuuccaagcaucauugacauuuacccauuuugguuccuuuuccuccuccacauugucauugaccuuuaacucauaucuaagcauucauuaacuuuuuacuucguaucugugcguacauucuauauugcaagccaaaugauuguauuuaucuagccaggcaucuccuauuaguacuguaccuagacuaguaggagacaugcaguuacaaaaaugguuuuucuuaaagauuuacuuauuuauuuuauguaugugaguacacuguugcuguacagaugguugugagccuucaugugguuguugggaauugaauuuuuaggaccucugcucgcuccugucgacccugcucucuuagucccugcuugaucccgcccaaagauuuauuauuauacauaaguacacuguagcugacuucagaugcaccagaagagggugucagaucucauuacgguagguugugagccaccaugugguugcuggaauuugaacucaggaucuucggaagagcagucagcauucuuaccugcugagccaucuugccagcccuacaaaaaugaugaaucuuuaacaguauguuucuuucuauuuuuuuauuuuaguuuaacuauaucuccuccccuuuuucuucuucuuccuccuccuucuccucuuccucuucuuguuugauuuuugagacaaggucucccugcauuacccaagcuguuauugaacucacucuggccuuaaaauucacgauucugcccccaccucuggaguagcugggcuuacaggcgugcgcccccaggguccuccuuagugcuccugucuaaggggggccuuuccucauuugcucguguuggggauggcugaccucacuuucucucuccccguuaccacuuucgucuguaggaugucucggaacuaaggagugaacugcagcggaaggaugcgcugguccagaagcacuugacaaagcugaggcauuggcagcaggugcuggaggacaucaaugugcagcacaagaagccggcugacaugccucagggauccuuggccuuccucgagcaggcgucugccaacauuccugcaccucugaagcagaccuaagcacuccugccugucuugcagccuugcagucuugccagacacguuuccuuacagaccugguguguuggaaggacucuguuggauaaugaguuuguaucaguuucugucccuauuuauaagguaggguuucauuaugaagccgggaagggccuugaaucuaugauccccugccucagcuccucuaguacucuaaacuccugaauacuuuauaaaaaaccucugucuuugauaaaguaaaguuuggcuuuguuuguuguuguuguuuguauucaucuuuagcacuguuuacuccuuagacuguuagaguacucacacacauucuuauuuggccuuugccauuuguuuugacaacauucugugucuucaucucccuuuuuuucuuaagcuaugaauuuggugaaaaaccugaaggaaacaauguuuaguaguuugagaagccacgggauguacaguuugguuaucagccuuaauaggcuacacuagugguagguaguguagacagagauguaaaugugcuguuccaaaacugugagcugccucgugaggaaucuggcacggcagugugaugcuucuagggcggcacagggcgaguguauuucacagguagcucagaagagguuagaauaugcugcuaauggaagauacuuaccuucaugcuggguggguuuuugucugggcuacguuccauucucugaguccuuauucacucugccuugagggcacacacaugaggacuauggcaugcugagugcucuugggcugugcugugcuggucaggguaaggaauggagucccagggaaggcucgggugagguaugaggucacaagccugcuuggauugucuauuugucucugaguuuuauuugcuuguuuuuuguuuguuugucgucccccccccccccccuucaaggccaagcaccucucuuuacccaaaacaaauacuccauaccucuugaauagucagugcaucuccagcuuggcuuuguccauuuugguuucuggagccuuagcccaggucauaagcaucaccauccacucacugccggccuagucugagcacugccaucuggucuguggagcuucagcaugccccguugcugcgccucaucucagggcacaggguuuuguuuguaauuuugucaacuuccuuaaauucuacauaugcuuuaugaguagcgacuauguuaguugcucuauuguaugccuguuagaguuagggacuuccuugauuaugcaaggucuuacuaguuucauguguaugcuugacuguaugauaucuaguuccuggaacaauuuaagccagucuaaggccaucagguucccuuaauuagaauauauaaaugaaacagaguguugaaaaauuuaggcuggcaugguagcauuugggagguagaggaaggaagcucaaaguguaaucucgucuucagcuacauagcaaguuugaagcuguuguagauuacaugagagagaucugcccccguccccucuacuucugucaaaaaaaaccccaaaacaaaacaaccaaccaaacaaaacacuuaauuaaaacccaugcauuuucugaaguacugauugacagcuuggcuguuucuggauuucuuggcuaaaaacuaaauaaacugguuacauuuuggcugguuugucaauaaugaggaggaugguggaaauacugaaaucauucuuggugcuuagugaaaauauuuuuaaguuggucuacauacaaguuacuguuuauuuuaaauugaauucaacgguuagguuaaaauaauuuucccauuuugucaguuuguguguguauaguauuaucugugaacauguuuggggagggguauguguguguuuuugugaaggucaaagauccauguguguuagacauuagagauccaggugguagcuauuuccagauuaccuuucgagacucaguuucucacugaguuuggccuuguuuacuggacaagacuagcuggcaaaccacagugaucuuccugccucucuccuccuuccaagcucuaggauuaagcuacucugcucggcuuuuuauccugguacaaccacaugaacucagggcuucaguuacacacacgagcuuuacuuacagaaccaucccccagcuccaucucucuccuccuaaguggcacuuugcuggcuguugaacacagacauuccaagcugcaugucuuucagggguuuccguugguuugcugcuccuauguguaaccuaauggauucaaggaaguuuccugcuuguuucaguugccuaccugaguaagaccagccuuuccauaugcauggaucccagaccggucgccuucucuaggaugaagcacuguggugauuucugccacuugcaacugucuguccuuggcuccuucccuguaccucacccaaauucugucuuaaacauuucccuugaucuuuuccagcuccuuauuccgucuccacucugcuccuuccuccacagcuguauuugucuguccugcaauugugcuugugaucaucuuuggcaacagaccagaugguacguucacuuccuuaguuucuauacaugaacuuagcuucuugacuauccaguuccaguaccauugguugugccaguccuggguauuaguuugcguagcaugggugcuacagucaggucuguuucuggaauccucuaguggacaguggucaggagcagucagucacccuagucuacacugcagaacuauccuugcacagagagcacacaccugccaguguccagaagcugacccagcagugcuccaguuacucugcugagguaaacaggcucagaacaccaaaccucaucgucaccugaaacgaugaucaggugagacaaaucacuuauaauucucauuggggcacauauacgcccaaaaccaagucaccaggucauucaaccaccagacauccugcuggaugaaaugagugacugugaccuuggcccccuuugguuaauaucaacuugacaggaucuagucccaccuaggagacagaccucuuagcaugucuucgaagaaguuuauguugguugagguaugugggcagcagcaucccaagggcugggguccaauacugaauaaaacaugagcuaggcgucauuauucuuugcucucugccucccaucuggacacugugaccaacuacuucagcucuguccuucccagccaugguggacugaaccaccaaaaucuugaaccauaguaaacuucucugaguucuuuuuugucagcagcaaggaaaugcagaaggcugcagaaaagcagucuugugccuuaccaagaauuacaaugcugagaaaugcccagaucagaaaaggcacaaccaccuguaucgcccagugcucacugcuuauugacaaacauuggaacuuauggcaaacgagagugggcauuuccuauccaaaacuccaaaugcucccagaucuaaacuuuuccaacaaugaccugacacugaaaggggaaacuugcauacuugaugcauugaguaaaaauggagguguaccaagaaaagaauaagguggauauagaaaugucagggaauauguuuaguuuuuggucccauguuuaagauaacuuguguagauucaugaaucugaaaauaugcaaacauuuauuuuaagucuuacuggugauugaauucaggaccuugcacaugcuaaccaugugcuauauaccacugcuaugcacuuuuaagcacuuguggacccaauuguuagguaggaggugauaaagcaauaaaggcugcuugcucaugaguggcauuaguacccuuguaaagaggcagcucuguugcacacgaggccccauaguggagacuuacgaagaaugcuuccccacuuucaucuuggucucuuaccugcaguaaugcauuucuuuugucuguauacucucuccaucauuaaaguuuuaguguaacagccucaacacuccagu

SEQ ID NO: 2453 - RNA, 9058 nt, Mus musculus
acuggaguguugaggcuguuacacuaaaacuuuaaugauggagagaguauacagacaaaagaaaugcauuacugcagguaagagaccaagaugaaaguggggaagcauucuucguaagucuccacuauggggccucgugugcaacagagcugccucuuuacaaggguacuaaugccacucaugagcaagcagccuuuauugcuuuaucaccuccuaccuaacaauuggguccacaagugcuuaaaagugcauagcagugguauauagcacaugguuagcaugugcaagguccugaauucaaucaccaguaagacuuaaaauaaauguuugcauauuuucagauucaugaaucuacacaaguuaucuuaaacaugggaccaaaaacuaaacauauucccugacauuucuauauccaccuuauucuuuucuugguacaccuccauuuuuacucaaugcaucaaguaugcaaguuuccccuuucagugucaggucauuguuggaaaaguuuagaucugggagcauuuggaguuuuggauaggaaaugcccacucucguuugccauaaguuccaauguuugucaauaagcagugagcacugggcgauacaggugguugugccuuuucugaucugggcauuucucagcauuguaauucuugguaaggcacaagacugcuuuucugcagccuucugcauuuccuugcugcugacaaaaaagaacucagagaaguuuacuaugguucaagauuuuggugguucaguccaccauggcugggaaggacagagcugaaguaguuggucacaguguccagaugggaggcagagagcaaagaauaaugacgccuagcucauguuuuauucaguauuggaccccagcccuugggaugcugcugcccacauaccucaaccaacauaaacuucuucgaagacaugcuaagaggucugucuccuaggugggacuagauccugucaaguugauauuaaccaaagggggccaaggucacagucacucauuucauccagcaggaugucuggugguugaaugaccuggugacuugguuuugggcguauaugugccccaaugagaauuauaagugauuugucucaccugaucaucguuucaggugacgaugagguuugguguucugagccuguuuaccucagcagaguaacuggagcacugcugggucagcuucuggacacuggcaggugugugcucucugugcaaggauaguucugcaguguagacuagggugacugacugcuccugaccacuguccacuagaggauuccagaaacagaccugacuguagcacccaugcuacgcaaacuaauacccaggacuggcacaaccaaugguacuggaacuggauagucaagaagcuaaguucauguauagaaacuaaggaagugaacguaccaucuggucuguugccaaagaugaucacaagcacaauugcaggacagacaaauacagcuguggaggaaggagcagaguggagacggaauaaggagcuggaaaagaucaagggaaauguuuaagacagaauuugggugagguacagggaaggagccaaggacagacaguugcaaguggcagaaaucaccacagugcuucauccuagagaaggcgaccggucugggauccaugcauauggaaaggcuggucuuacucagguaggcaacugaaacaagcaggaaacuuccuugaauccauuagguuacacauaggagcagcaaaccaacggaaaccccugaaagacaugcagcuuggaaugucuguguucaacagccagcaaagugccacuuaggaggagagagauggagcugggggaugguucuguaaguaaagcucguguguguaacugaagcccugaguucaugugguuguaccaggauaaaaagccgagcagaguagcuuaauccuagagcuuggaaggaggagagaggcaggaagaucacugugguuugccagcuagucuuguccaguaaacaaggccaaacucagugagaaacugagucucgaaagguaaucuggaaauagcuaccaccuggaucucuaaugucuaacacacauggaucuuugaccuucacaaaaacacacacauaccccuccccaaacauguucacagauaauacuauacacacacaaacugacaaaaugggaaaauuauuuuaaccuaaccguugaauucaauuuaaaauaaacaguaacuuguauguagaccaacuuaaaaauauuuucacuaagcaccaagaaugauuucaguauuuccaccauccuccucauuauugacaaaccagccaaaauguaaccaguuuauuuaguuuuuagccaagaaauccagaaacagccaagcugucaaucaguacuucagaaaaugcauggguuuuaauuaaguguuuuguuugguugguuguuuuguuuugggguuuuuuuugacagaaguagaggggacgggggcagaucucucucauguaaucuacaacagcuucaaacuugcuauguagcugaagacgagauuacacuuugagcuuccuuccucuaccucccaaaugcuaccaugccagccuaaauuuuucaacacucuguuucauuuauauauucuaauuaagggaaccugauggccuuagacuggcuuaaauuguuccaggaacuagauaucauacagucaagcauacacaugaaacuaguaagaccuugcauaaucaaggaagucccuaacucuaacaggcauacaauagagcaacuaacauagucgcuacucauaaagcauauguagaauuuaaggaaguugacaaaauuacaaacaaaacccugugcccugagaugaggcgcagcaacggggcaugcugaagcuccacagaccagauggcagugcucagacuaggccggcagugaguggauggugaugcuuaugaccugggcuaaggcuccagaaaccaaaauggacaaagccaagcuggagaugcacugacuauucaagagguauggaguauuuguuuuggguaaagagaggugcuuggccuugaagggggggggggggggacgacaaacaaacaaaaaacaagcaaauaaaacucagagacaaauagacaauccaagcaggcuugugaccucauaccucacccgagccuucccugggacuccauuccuuacccugaccagcacagcacagcccaagagcacucagcaugccauaguccucaugugugugcccucaaggcagagugaauaaggacucagagaauggaacguagcccagacaaaaacccacccagcaugaagguaaguaucuuccauuagcagcauauucuaaccucuucugagcuaccugugaaauacacucgcccugugccgcccuagaagcaucacacugccgugccagauuccucacgaggcagcucacaguuuuggaacagcacauuuacaucucugucuacacuaccuaccacuaguguagccuauuaaggcugauaaccaaacuguacaucccguggcuucucaaacuacuaaacauuguuuccuucagguuuuucaccaaauucauagcuuaagaaaaaaagggagaugaagacacagaauguugucaaaacaaauggcaaaggccaaauaagaaugugugugaguacucuaacagucuaaggaguaaacagugcuaaagaugaauacaaacaacaacaacaaacaaagccaaacuuuacuuuaucaaagacagagguuuuuuauaaaguauucaggaguuuagaguacuagaggagcugaggcaggggaucauagauucaaggcccuucccggcuucauaaugaaacccuaccuuauaaauagggacagaaacugauacaaacucauuauccaacagaguccuuccaacacaccaggucuguaaggaaacgugucuggcaagacugcaaggcugcaagacaggcaggagugcuuaggucugcuucagaggugcaggaauguuggcagacgccugcucgaggaaggccaaggaucccugaggcaugucagccggcuucuugugcugcacauugauguccuccagcaccugcugccaaugccucagcuuugucaagugcuucuggaccagcgcauccuuccgcugcaguucacuccuuaguuccgagacauccuacagacgaaagugguaacggggagagagaaagugaggucagccauccccaacacgagcaaaugaggaaaggccccccuuagacaggagcacuaaggaggacccugggggcgcacgccuguaagcccagcuacuccagaggugggggcagaaucgugaauuuuaaggccagagugaguucaauaacagcuuggguaaugcagggagaccuugucucaaaaaucaaacaagaagaggaagaggagaaggaggaggaagaagaagaaaaaggggaggagauauaguuaaacuaaaauaaaaaaauagaaagaaacauacuguuaaagauucaucauuuuuguagggcuggcaagauggcucagcagguaagaaugcugacugcucuuccgaagauccugaguucaaauuccagcaaccacaugguggcucacaaccuaccguaaugagaucugacacccucuucuggugcaucugaagucagcuacaguguacuuauguauaauaauaaaucuuugggcgggaucaagcagggacuaagagagcagggucgacaggagcgagcagagguccuaaaaauucaauucccaacaaccacaugaaggcucacaaccaucuguacagcaacaguguacucacauacauaaaauaaauaaguaaaucuuuaagaaaaaccauuuuuguaacugcaugucuccuacuagucuagguacaguacuaauaggagaugccuggcuagauaaauacaaucauuuggcuugcaauauagaauguacgcacagauacgaaguaaaaaguuaaugaaugcuuagauaugaguuaaaggucaaugacaauguggaggaggaaaaggaaccaaaauggguaaaugucaaugaugcuuggaaaugauuaaagagaagugaucugaaacugcucaugcuugaaugcucuggaacuuguauaaauaaagagggcacaagcuauucagagccaucuguuugaaaaacaugguggucagacucauuuuugcugacuccacacauccaccauucagaccagaauccugcuggaacugaacuccagcaaguuccuuucuuucuccuucugcuaaaaaaaaaaaaaaaaaaaaaaaaaaaauagcccuugccuggaacuugcugugcagaccaagacugguuuugaacuuaaaagaggucugccugccugugucuccugagaacugggauuaaagacaugugccaccaugucuggcuacaauauuuucuauacuguaaagaaaauagaucauuugcuaugagcaagguaccauguaaagugauuugggaacacaguuacaauuccuguucaaauuaacuuuuacucuauacugaugguuuccuaacuuuucucaggaggcaaagcgugcucauuaagaaaacuuuuccaggaaagccagugugugaaaugaguaggcaggcugucugcagcucugcucccucuccaaugaccgcccuguguccaggcuguccuaaaugcuggcacccucaucagacccauaaagaccuucaacucacagggugaggguucaucuugcuuagagacaguggaauccaaacgacacuugcucuccuuaaaaguugagggaaagucaaauucguaccucuuugauaacuugaucugguuucuggacagauaacugcaaccuuuuuuguaggaaaaaacauucugucugucuugcaauguccaaaaacuucuggauacacugaucaacaccuuaagaaaaaaaagagagacccgaaaaaguuuauauauacacaagauguguguguguguauauauauguauguauguauguguguauauauauauauauauauguauauauauauauuuaauauauguguaauauuuuaacuauucauuuaggugggagauaucccaccuaaaugaauaguuaaaauauuaaaacagcacuuucucauagacauaauuugggauuuuaaucuggaugacagugaauaauaaccaucuucaaguucccauguaaaacuagcaugaaauagguaauucauuuucuucucaggucagagacuuuacacaacauagaaguuguuaagucuuccaaagaaacacaauccagacucucagcagaugaggacaauuuccacuacaaaaaaaguuaggagacacuggagauaacaauaugcauaacagggagaauugugguacacuccuuuaaucccagcacucuagaggcagacacaggcggcaaaucucugugaguuugaggccagccuaguuuacagugugaguuccaggacagcgaagucuacacacagaaaugcugucuugaaaaaucaaaggaaaaaaauaugcauaaaagacuuauauuucugucagaccuaaugaaaaagaaaaucaacaaaauuuguggguuuuuaaauaaacagcauucauuaguuuuacaucauuauacucauaugaaaagcucauuuuaagcaauuuauaaggacucagaaaacaugucagcuagugaaccaaacagagagccagcaauuuauggggacucugcacacaucuuauucccgggaaauguuccaagauauaugcagggcuaaacacacagauauaaagucaacaauagacaccuugcugacaagaacacagugugcaaagaaguuggaacucuuaccaguucgaauuucuuccugaucagucccauugacauaauccugacucacaagggaagcaaagcaagccugagugaagggaacauaaaaauguuauauacacagcagcuauuaggaaaagaaagggcuucuccugaggccacucaauaauaaguggacacuuugcaccuguacuugagaagauaucaggccaauguagacaccagguaaagccaaucccagcuggucuggcaccugagacacugguaucugcuggccucaucacacggucuuauuccugccaccugccucuuccucacugucuuauuccacaccuggaauaccuuucaaccccaccacggccacgccacucuggcugacccuuacaugaacuguauauauuacuaugucaagaugucaucugucuacucuuucuuucaugcucuacaguggagcuuggcaagcuuuucagaaaaguaacugauguuacuauccacucuucagccacuguuauuucuaccaacagcucugccugugugauucagcacuauagucuaaguacuugggauaccauuuggcauuucauaaguaacaggugucuguauaauaaguggugucaugcggauaaccaaaucccaaagagggaguuuugaaagggugccaaccgagcuguacaugugagugcgccacaggggcacaagcagcccucagacagacaagcaugacagcagcugacagaggaacacagucugagaacagaccccgacagccuugagcaagcaccgaaaaaaaaaccacaaagacacagaaccaaauuuagguuccgaacacaagucaaaacuacacccaaaguuccucucagaagcaaugaauccuccuggcuagcuccagaucugauggauggaaacagucaaaggauuucccacuccuguaacagcucgaccaaccagacugccuauucuguguacgguaaaaguuaagucuuguuggacuuuuggggcgugagcaugaugugcagauuucagaaaaccuauggcccacaaagcuugggggcggggggggggggggcuucaccaacggcaguaggccaugcagacuuaaaaaaaaaaaaaaaaccaaaccuaacugcaagccaggcaguggugcugcacuuguucaaucccagcacuagggaggcagagacaguuguguguccaaagucagccuggucuacagcgcuuguuccaaaacagccagggcuacgcugagaacuugucucaaaacaaaacaaaacaaaacaaaaagacaaaaacuaacuucagaaacuuuaguuccugcugcaccucccagcccaccccccccccccauccuuugaaaaacauuuaaagcauggaccuuuauggacagucagucuuacggagguuaaaaacaacgcgugcccuucuauuaaaagcccaguauuuuaggacuggugcgauggcuaauccgguaaagauguuugccaccacaccugaguuccaucccugcauccaagaguggauggacccaagcguucuacuaagguuuccucccacagugagaacucaacuuaugccaacaaagagcauuuaccaaaugaauagaaagcgaaagccagagaagucaagggauggcacccaaacaagcuaacagguaggcaggugccaggggccauuggaaggucuacacagaacacuagagaaaaacaggaaaagcguccaguaugugaccuggaaacucagaggaccucagccgagugggcccgcuccagggaagaccagauccuacuagacccgcaggggauccaacgagccccgagguggaugggaguugggcgaacuucaaggccacggucuccagaaaugucgcgguugcgggggcagaccugagacgaccggccacagguaguacccaaucuacggcaggcgacuuccauucuccggugccccgccucuacuaaacgccgggaccgagaaaggaguuaaccugcgcgccuuccgcacgccugugagggcugcacagagacgcccacaucucggcuuaccucgaaggaugacuccaacucguccaccaaagugcuguuagauggucucggggccccaggggcugcuugcagaagcgacgccuggccugggagcccgggcggcggcggcgggggaccuggaggcugcccagugaacaucccucccagggacgccgccaugucugcaacggcgggcggaaacgacaccgggccugugugcgcaggcgcgggcagccugaucacguggcaggccuggucacaugacgggcaguucgccu

SEQ ID NO: 2454 - RNA, 2515 nt, Mus musculus
gccacacuucauuuuagcuauccaucgcauguaagucacucccagcuaguuaccugguugggugguuuuaauuuauuccuucagaugguugaaaugauuuucuaauguccuccuucaaacagacccccaggucaguuuagaaugaaaaguacuugguaaaccauuccugaugcggggagccuugcuucuguggggcuucuuuggguugggcugguucgccaucuuggguccuuugaaaaaaagacaauuuuuacaugaaacuaugaaacuuauucaguaaaaaccaauacuguaccaucuuucccggggaagcucuuaacugcuucaauaaugccaagucacacugacaaguagcccuagcuaugacacacacuucugugucaggucugaagguagggauaucuuaaagguuaguuccuuuagucacaccauucugaucagguagcuacuguaugcauuuuuaagauaguaauuguacuggcgaguuuugugucaacuugacacagcuggaguuaucacagagaaaggagcuucaguugaggaaaugccuccacgagaugcaacuguaaggcauuuucucaauuagugaucaagggggggagguccccuuguggguggugccaucucucggaagguaaucuugguucuauaagagagaaagcugagcaagccaggggaagcaagucaguaagaaacaucccuccauggucucugcaucagcuccugcuuccugaccugcuugaauuccaguccugacuuccuuggugaugaacagcaacauggaaguguaagccgaauaaacccuuuccuccccaacuugcuucuuggucaugauguuugugcaggaauagaaacccugacuaagacaggaauacagggaacuuuagaggucaccugcccaaggccacacagccaagaaaaguggauuuuuagauacagaucuuaagugaugccauaacaauuaguaauuuuaaagucuagcaccaaaauucucaagaacacacuuucuauuaucaguggucccuucuggcuaggcuguuuccaaggcugggcuccuacuuuagaucagaugucagaugccuuaguaggugccuaaggagcccccaguuucuuuccuaucuuuggagagacaccuucaccugccgacacacacacaccuugaggcaguuuucccaucuaguaacugggugggcuuguaaggcuggcuacagcugggacucggguccaggcugggugacuuaguuaugggaggggcauugauccuggagcucaggucuccgcucagaaaguucuucgcauaggaggcaagguuuggcacgcugaccacucggcugggcacuuccuccaucuucuuuuucuguuuguguuagaggaaagguguuagcgcuuaccccagaauaaaugcaaauaggucgaugccaauaggcucauccaacccaaauaacaagggaaagaaguaacaauccuacuuguauacuaaaauauuguguuaauguugggggaggcagggacagguauauuaucacacaccuuucauagcaacacucaggaagcagaggcaggcagaucucugagugcaagccucgccugauuuacacaguaaguucuagaccagccagggcuacagagugaaaccaugucucaauugcugucauuuuuuuaauugauaauuuuauugcaguccugggaauggaauccaggucuucaagcuugcagacaauuguucuugcacugagcuauggucccugcccuucaaaccauuuuuuuuucucccaucuuuauuaucggguucauucagucuagguuuguuacuuugugagcuaugaaauaccgguucuuuucaacuuuagggaucuggugauaggagaugagagagucacuaugaagaccacaaguauuauggagagauaaaggggagugggauauucucucccaucaucuagauggagggaauacuaauagucauaaaggucaagucagaacgcacccucucaguacuguucgcuagcgcuguagacuacuucuggguuuucccagcgacugucccaccagcccaucaaugcgcugcugcugcugcugcuuucagaaggacagaugugcagacuguaugaugugcuaaaauuaauuuaccuucauggaaggggucaaguauccuggguggggauugaaagagaaggaccgauuccgaugggacacugcacuggggaaggcugcguaaugaaaucuucucucuuccuggaaaaccaaagcaaccagguuuuaaagagcuuaggcauggaccacuggcuuugucuagaugguggcaggacagaagacagaagaagagaaagcccuggaggaggguaggugaguggcauccgagcagggcgucacuggagcacguaggaaguaccuuccccucuggcaccucauauaaccagcaaagggaagggcacagugccuuagcaagugaaaacaucuaacuacacugagcaccuaaaaggaaaagcuaguacaaaaguuaaaauaaugaaua

SEQ ID NO: 2455 - RNA, 1504 nt, Mus musculus
uggugcugagauggaaguagagaguuucauucagguaagauggccgucaccuagagaucugcuguacaagacagugccuuuacucaacaaugaugcacaguacaugacaaguguucuuccuacaauaccagaaagaucaaccugagagauaaauggcacuuaauuucuucauugaacauggaaauaaacucagaaguucuuuuugcuuauacucauugaugugugauguucagcuuugugacacaggagacagauuucuauugauauuugggugugguuugccccugaggguuccuauaagcaucccuauaauacuggaggcuguccacgguuagaggucauaggaacucauggguauggccuagcaaacaguucuaggucacugagauacaagacuacucuaagaagggaauacugguucauugagugaguuuuggaaagggcaaguaguaacaagggccucaaacugauucucucuggauuccuguuuuguaggugaguucuuauauuugcacaugccugggcccucuuucauagacguucacugcagcugagccacacuccaaaagggguuaaauaaaacucuuuacaaagccauaaagaugccuaagguauuucauacgacacaaaacagacuaacacagcaucuucuucaaaggaagaaaagaccauuccuucaacaccagugauuuaaaaaaaaaagacccauggguuccucuaaaacaaauguguguuuuaggaauuuccuaaccuuuuacuuauugggacuaaauaaugaccuugucuguucccaucauucagcuaucaugucagguccaaguuuauuuaaaggugcugaccauuagcaccuuuuuguaggugcugaaagaauaaccagcauuuucauucccacaagcauggggaagagacacauagcuugacaaucuuaagagaccuuaaaaaauccccccccccccccgugaugguucauauauuuuuggaccagggaguggcaccauuuggagguauggccuuguuggaauacugccuggauacugccaugcucccaccuugaugauaauggacugaaccucuggacuuguaagccagccccaauuaaauguuguuuuuuauaagacuugccuuggucauggugucuguucacagcaguaaaacccaaacuaagacagaaguugguaccagggacugggguauugcugugauaggccugaccaugcuauuugaaagaauguggguuuugggacuuuggaucuggaacacaguggaaugcuuuaaauggggcuuaaugggucauccuaguaggaauauggaagauuuuguugcugggaguaauuugaacuguguugaccuggcccaagagauuucaaaggagaagaauuucagaaaguggcauaaagugguauuuuggugaaaaaauguggcuacuuuuugcccuugucugaaaagucugccugaggcuaaggugaagagacacagauuaauugcauugacaaagggaguuuca

SEQ ID NO: 2456 - RNA, 35210 nt, Mus musculus
cacucggagccuugcagggcuagggugucggaagccgcgggaaacugaguccuccucggaucgcgaaccacagucucucucgggcaguucccgucccggcgccauggcagcgcagaagaagcggcuuucugugaaggaggcguuucagcuggcgcagcagccgcaccagaaccaggcgaagcuggugguggcgcugagccgcacguacggcgcgguaagcggccuggcuucggcuuccgggcuucgccuucugcccuugcgcgccccgcgacggagggaugggauccgaggcucgcccgaggucucccggccacagccagugagcagaacgcccggcgucggccacacgcagucacccgucuucuccauccucaucccgccaggggaugcggggaguuauccguuauccucaguuccucagugacuuguugaucugcgcagggaaucucagacgccuuuauuuccuuggaggucucugguucaucucaggcaaucgaugaaguuguuucaaccaacuccuaagcuuuaaaaccaccuucauuucaccagcuagggaaaccauaagcacccagucuuucccguacauggcaauugugugucgaguguagcggcggggaauuacuggacagcgaaugugaggaagauacauuguuuuggaguucacggaaaguuaaggacauauaaaagugaucaaggguagggagcaaaauguguaaguuaugacagaaggaaauugacggaugcuaggaaggccuaaguaaaauaaacacaaagcuguugauuuugagucauuuauggcgaagcuuguuuugcauuaauccgguaagaaaaauaccgauaauccaaaggcguugagagaaaaaugagauaauuuugcacuguucagauuuaugcuuuguguuuucucagagguacaaauuauauacugaagagaaguuugugcggauauauuuucccuuccuugauuuggauaauugauaguuuauuaagaaaccuuagaguuuaaccuaaggguaacacuuucagcaguauuauggcaguguugggaauaaagaauuuuuauuaaugcagcuucuggaggcguuucuucucucuuucagauggaugauaaaacagcuuuucaggaggaguuuauucauuaccuuaaguaugcuauggugguauauaagcgugaaccugccguggagagggucauggacuucacagccaaguuuguuacuucauuucaccagucugaugaggaagaagaggaggaagagaacgaugguggcauuuuaaauuauuuguuuacuuuucucuuacagguacuguaaaagcuacuacuuuggggaaguaauauauuuagcuauguuuguuauuuuccacaguaaaauaucagugauagagaaaauguaugugaauaagauaagucuuuucuggaaaccucaacugucauuaagauaaaaggauaacuccagcauuaaaaauuuaacuuuaaauucucacuuuugguguaaauguccucucucugcgauuaaguuaaagaaauucuauagagagggauaggcuuauuuugugacagcaaauaguuuuucagccuauuugagaguauaacaucugccucguaugcacauacaauauaacgucucugcaaguaaggaguugcuauugucuuauuuuuauuuuuuuccauaguacuagggauuaaaccuaacuuuacacauguugguauacugaucuuccuaucuuuuuacuuuguuuugagaagauuuuuuaaaguugcccauauuguccuugagcuuacuuuguagccuguacuggcuaguuugugucaacuugacacagcuggaguuaucacagagaaaggagcuucaguugagaaaaugccuccaugagauccagcuguaaggcauuuucucaauuagugaucaagggggaaaggccccuugugggugggaccaucuuugggcugguagucuugguucuaaagagagcaggcugagcaagccaggggaggcaagccaguaaagaacaucccuccauggccucugcaucaguuccugcuuccugaccugcuugaguuccaguccugacuuccuuggugaugaacagcaauguggaaguguaagccgaauaaacccuuuccuccccaaccugcuucuuggucaugauguuuuguccaggaauagaaucccugacuaagacauagcccgaacaggccuugaacuuguuguuuuucacugugguacuguaggccuacacuaucuaccuggguauauugccaacuuuuaauuuugaacauaaaguuaaaaugguccuggcuguuuaagaguggaaugugacuuggaguaacuuuugauuuuuuucuguguagucucaugaagcaaacagcagugcagucagauuuagagugugccagcucacuaauaaacuacuugggaauaugccagaaaaugcccaaauugaugaugacuuauuugauaagauuaaugaagccaugcuaauuagauugaaagauaagauuccaaauguaagaauacaagcaguuuuggcucuuucucgacuccaagaucccaaggacgaugauugcccaguaguugaugguauguaugguuuucuaaaucuuguuucagaauguugacuuuguuacuuuuucaguauuuagauuuuaugcauuuguauacaugaguguauagguguuacauuugugugcagacagagguuauaaucugauguucuuaauuguuuuuugagauagcaucucugcucaucuacucagacugcuacccaguaagccccaggagucuccagguucuuauucccaguacuaagaucauaugugcaugccucuguggcugguuuccaugagaauacugggcaucagaacaucaggucuuauguguuugcagcaaguacucuaccaauagauacguuuuccuaagcuaguauugaauuuuuacuaauuauauaugucuguguguuaucuaaguaucaauccaacaacuuaacaugaaagaaugucaucagcacuuuuaccucugccuugcucuucaguuguauucuuucuuucagagguagaaauaauuacagugaguuuugaauuaauugcccuguuuacaugaaaaauuacauuuuaaacaaucacauguuuuucucuguuaaauuuuguuugccauuuuuuugugagucaaacuauauuuuugugucuuuuuuccccucaaauuuauuccuaauuuuagcauucauuuagggugauauauauuuauuuuuugcgauauuuuaauguuuuguuuuauguaguuuuauucugaauggugguggcccuucuaguuguuuguaguuguuugcuuuaagaacagugcuagaggcagggcaugguggugcaaugccuuuaaucccagcaacucugaaggcugaggcaggcagaucuccuagguuuacgaccagacuaguguggaaugagugccaggacagccgugguuacacagagaaacuaucucaaaaacccaaagaaacaaaacaagaaaucagugcuaggacuuuucuuacucagccuuugguacauagaugaaaugcuuagagauagacuuauauggguucuacucuauuaggggaggugauaaaguauucuaaagaagauuuuuacuuuuaauauugucaguaauggaacauaaaggugugcagugauccacauucucuuuaguuuuagcacauuuuaaagguuggugcucuauuaguaauuguuauuguuacccagcuucauacauuuagcaucugaucaucuugaguuguuuaagguuuguauuacauuuugagaaguguuaucacuaggugauuuuguaauguuaaaaguguauacuuggacaaauggaugauaaaauuuaaucacucaguguagcuucuggugcagucuaaagauccacuaaacagguaugaaaugacugccaguauaaucuggcauacucuuuuauuauagucaguuuuuuuuuaauauaggaggcguauacucaaacaaugguaaaaguuuauuaaacacaugaaccugugcauucuucaaauuaaaguguaaaguuaaaugugagccuucagaguuucccuucugaauagcucuucuaacuguauagucuuugggucugguuaauuucuguguguguguguguguguguguguguguaacauuuuauaguaaaauuuaaaauaaaucaaaauaauagguccuuauauaaaaccauaucaacuuaaaauaaauuaccuauucuaaucgucaucugaccuuugggguuaauuuuuaaucacaguacauuuaauaauuuaaaguuuuauuuucagaaggaaaugcuaguuuuuuugcuagaagugaauauauaaaaguaauaucuuuguuauuuaaaaaugaaagaauguggaacuucuaugacuuaacauuauuaauguuaaaaugcguugcuuuauuuuuuagcauauguuaaugugauugaaaaugauucaaauccagaaguuagacgugcaguguuaucuuguauugcaccaucagcaaagacuuugucaaaaauuguaggacguacaaaggauauaaaggauacugucagaaagcuggcuuaucagguaaauaaguucaauaucuucuguaaggcauguuuuugaaagaugaaccauuuuaugguauuuuggaaaaaacuuggugacagugauuucuuuuuuuuuuucaguuuaggacuuuugaagaauauagguaacuuagaguauucuuauauuaagcauauuaacagacaauuuaaaacuuggguuaauuuacagaagaauguaguauucauaaguaagacaucucuaaaguguauugagauuaauggccaucuuuuaccuuuuuaagguguuagcugaaaaaguucauaugagagcuaugucuauugcucagagagugcugcugcuucaacaaggucuuaaugacagaucagguaagauacauaucuuuguaaacauuucauuuugaaaugagacuugaauuuaauaaagguaucauuuccauaaauaaauugaaacauuuugggguuaaagaucuugguguuuugaaggagcaaggcauuucuuucagacuucugugcuuuagggaggggaaggcuauucuaaaucuuaugcauuuacuucugcaaacaucugauagaaucuuuuuaccucaucuuuuuaaacaguacuguccuguuuuucuauaacuuaacauaaauguguucuguguaucagaaacaauuaggaaugaacagaccaguauaaugccccacccucuccucuguuaaacuagggaaucugcuuuucugaaggauggucuaaaaauucuuaacuccuaugaagccauuuaguuucaguuucgcuauaccaagaaagcacaguugaauuugaguauugucagaggacugacuaggaugcccuuaaaucagcaguucucaaccuaugaguugugacuccuuuggguguugaacaauccuugcacaggagucaccuaaggccaucagaaaacacagauauuuacauuauaauucauaacaauagcaaaauuacagcaaugaaguagcauugaaaauaauuuagugguuggggauugccacagcaugaggaacuguaguaaaggaccacaguauuagggcugagaaucacuucuuaaaugauaaaaauaaaguuuguuuaguaaaguauauugugauucaauacugcaaauagaauucauguaauauuuggggucagucaacaagugaaaugauagauuucacauauucugaugcaugauguucauugaggagacaauauaaagacauuuuuccauaggugauguaggaguuuggcuuuuaauuguugaacuccauuugcauuuugaaauaagcauucucaugacuugaguagcacugcaucuuuuuuguuagcaugcuuuguucuaccuauaacuucgauuugaauuauaaguucaguguuaacaaugauuugauaacaguuaggauggggcuuccauggggggaaagggucuagaaugcgcauaguuaacuguuuaguugacuccccagaugcugugaaacaagcagugcagaagcaucuucuccaaggcugguugcguuucacugaagggaauauucuagaguuucuucaucgguuggauguggaaaauucuucugauguagcagucuccguucuccauuccuuauucucaaugacuccucucagugagcuggugggaauuuguaaaaaugaugauggcagguauauaaagacuucauuauuuaaauuguacagaggauuuaaguugaaccuaugcacuuaagaugaauuugucuuccuguauuuuuagguucccucaguaccuuuuaucugucccucuucucuuuaaugagaguuuuucuucccucugguacaaggacuuaguacuuuaugucaggcauuacuuuaguugugcccuuucauuuuacagcuuugauuuuugcacuacauccacucaaaaaccauguugacucaucugaagcuuucucuucugccuuuuuucaggcuaaguuguuuuucuuuuucuuuucauucuuuuuggguggggaaauuaaugacuuaguaauuaaacagcuuaguaauugaaagaaaucuucaucuuauguccauucuuguucuguuuuucaacugcauguaaagauaauguuuucucuuauucucuugcauguaaaggaaguugauuccaguggaaacauuaacuccugaaauugcucuguacuggugcacccuuugugaauauuugagaucaaagggagaugaaggugaagaguuuuuagagcagauuuugccagagccugcaguauaugcugaguacuuacugagguaguuucucuugcuuugagcuguacuuauguugcuuuauuuaccaauuucauagucgucuucaucaaagucaugagaggaaacaguuuagaaacuauuuuuguauaaguagguaugaguggguauguugaauguuuugaagaaucuguugcgugguuaauauacugaaaguguacagucagggucuuacuaucccugucacagugacucauuauuagcagcugauuaguguaacuuuucccugauagaaauuucacugacuuuuucuugaaauauauauaacaaaguuuuaaaaaaauauucuuuauuugcaagcuauacaaaacagguauuaugaugauuagauuuggugcauggauuagugucuuagcuugcguuuuacugcugugaagagacaccauggccaaggcaacucuuguaaggacaauauguauuuggggcugguuuacagguucaaaaguucaguccauuaucaucaaggcuggagcauggcagcauccaggcaggcauggugcaggagcugagaguucuacauccucaucugaaggcugcuagcagaauacuaguuuccuggcagcuaggaugagggucuuaaagcccacgcccacagugacacucuuacuccaacaaggccacaccuacaccgacagggccacuagugcuaccacucccucagccaagcauguacaaaugaucacagcuaguuucagaaucauauagugucauauauggccaguuuuauuauaaguauuuuucaauuaauaacacuaaaaaugaaauaaaacaacuucuauaacuuuaaaaguuuuauuuuucuaaauuaucugucuugauauaccugcugccaauuuuaugucaauuuauccccagcucaggacauuuuggaagagagaaacuuagcuggaaaaaugccgccaauagacuggccugugggcaagcccauuuucuugauguuugauuagggugagcccagcucacugugggugaugcuaaucgugaucugguggugcuggauucaguaggaaaucaggcugagcaagucauggggaacaagccaguaagccacguucuuccauagccucuacaccauuuccugccuccagguucugccaugacugaguuccugacgugacuuccuucagugauggacugugauaugaaacaggaaguaaaccauucccuccccaaguuucuuguggucaugguguuuuauuacaauagaagcccaacuaagacaguauaauuucuacuuacuucacaauaaaacuuuauuuaaaaaaauacacauucuugucagaauucaaauguagagguaaauuuauucuuugcuucucuaguucuguuaaucauuguagagcuaaacagcuaaauaauuaaggauguccauuaucaaaucucuuuauauacauguuuuagauacacauguaggcuucguuuuugaaaauauagcauauuguauauaugcucuuuucugguuuuuaaaauuuuugaacucuguaaaguccucuguugguauaugguguugcaugauauuguaguggcucaugugugcuauguuaagugcucguccuccgauuuacaucugcuuuauucuguuugcuuuaguuacauucagggcuucccaguaguuaaugaagagcagaaaggugauuuuaccuucauuggagauuugaugaaaagagaauucauaggucagcaauuaauucuaauuaugaaaucuuuggacacuagugaagaaggaggaagguaugucuaaauguuaauauuugauugauucccuuuaguuuuauauauuuaggaaccuaccuugguugaauuuuuaaaagauaaugauucugauuuuaauuuuaguguaacuaccaacaaugaaagugauguuauauccuuugguaaaucagguuuuuaaaacaaucauuuuuauuugauaauuuuauacauauauacaauauaucuugaucauaucuaccucaagacucuucccacuccuuugauacucaacauguuccuccuucuaccuuaagcucccccuucacuuuuuuccauuaccugagcccaauuacaguugucugaaagggccaggguauguggccuuccaccagagcaugggcagccuacugccagcuacaccccagaagaaaaaggauucucucucuucuaguagcuauuaacugucaaaaccuucucagcugggguaucuggccucaggagucacauucccauccguacuggaauguugacuggcagcucuuaugcaguuaaccauacuugcuguaaguucuugaguuguguggagggugguauuauuauuccuccucauuuggcuaauuucuuauauuuaaauacaguuuuguuaugauaugacgagauguaauuuuccuagcucuccaaaacuguauauaauuguuuuuaguauacuuguauacauaugccaacguguguuuguuuaugccagcauuaccagagaaaugcacugaaguacagcauuacuagggcuacuauaucauuacauauuuucuagcuccauuaugauuuucuaggaccuccaucagauucguggucuaauguuuacugaaacaucauauguggcacaugaugggauauguauguauggguauauauguauauaauucuaguauaauugcuucagaauaaauaauuucaaauuuuuugguucaauuuuuuuuaaaaaaaagaucaggguauagaaauauauuuauaaucuauauguauguuuauaaauaaauuuguagaaugaguuuuuuuaauauaaagucuguauguauagaauuuuuaccuauacuuacaaauagaaguaaaaacuuaagacaauauaaagggaaauguuaggaaaaaauguauuuucagauggcaagaugguucauuggguaaaggugcuugcugccaaacccagugacuuucauuugauccuuaugacccacgggguagaaggagaaaacucacuucugcaguuucuucucugauggccacauucagggccagacaugagugugccuacucacaaauacacacagaaaacaacaaaauguuuaaaaaauaugauguauuuuguuauaauaguaguuaaaauagauuguuuugauuacaggaaacgacugcuggcuauuuugcaagagacucuuauucugccuacaaccccaauauccuuaguuucuuuaauuguugagagacuccuccacaucaucagagaugauaaugaaaggauacagauuguaagugcaaucuuuuugaugaagauaaguuugguuagugacauuaaaauuucucuucagcauuuuugucuuuaguguauuaguguuuauuguugaacauauugcaaaaaugaaaaagaguagaucuuucucacaaacagcuuaaaaugucuuccuuuuuuagccuggcuguuacuuuuuugagucagcacagcaggugugggaggaaagaccaugagauuugcuuaguuauucucagauggggagcaaucauucuguacuagccaacaaguggcucugaaaggaagucauuacuauuauugcuuauauuacuuauauauauggcaugcuuuuuucucuacagaucugaggaaagaauuaagaauuuuaggcagaaaauuuuagauauagagaguaaucuuaggguacaauuuuucauuuuuacuucacuagggauaauuaugauucaguuuuauuguccagucuuuguauuaguugcugucuuguugcuaugaccauaaauaucuguuguaauaauuacuguugucaacuugacaagaucuagaauaaacuagaggacaaaccuuuagguaugucugugagagauuuuagauugagugaggcgugagugacccauuuuauaagcuaugguucugagcuuauaaaggaguaaguaaauugaguaucaacuuuccccuuccuuucucuuuuuccuuuccuuucucccuucccuucccuucccuucccuucccuucccuucccuucccuucccuucccuuuuuucuuuuccuucuuucuuuuucuuuucuuuuuucuuuuuuugacuauaaugcacuaggacuagguacuucuugcugcuuuggcugguccaucuucucuauggugaacugcuaauuccaaauugugagccaaaaugaaugauuccuuaaguuguuuuugccacaguaaugaggcaacuuagggaggaaguggggaaagaaaagaaagggagggagaguuuguuuuggcaugaggguacagucaugguagcaaaggugugauauugagaaaaguucuagcuaugguagacaggaacaugaggcaauuggucagucauauuuuguucacaggaaguagagagaugagucuagugcucagacuguuuugucuuuuugcccuuuugcucaguguaguacugcaacuugugggaugguaauacccacauuuagucuucccucaguuaaaccuccgaaacacccucgcugucagguccaaagguguguuuucugagcaauuccaaauccagccagguuagcaauguagauuaaccuguauuguuauauguguaucuacauguaguguuuagaauucgauggagcaguucgcauuugcuacuauaaaguauagauuacagcuuguacuuugcauuguaccuuuaucaggucacagaaauuaucucagagauucgugcacccauuguuaauguuguuguugauccaucugauacaagaaagaaagaacucaagguaugucucuucuaaauuaaagacgugccuuaguaaugucauuguuucucuugccauacuguuuuguuguguucucauaaagccaagucaauguguguuacacuauaaggacaugcaaauuguuaccagauuauaaaagauuuucugaucuguuucaggaaaaugaaaucuuaauguuugauugcuuaaaucccaagucuuugagauauugugacagauuuuuauauuaauuuuuauuuugugaggaugaucaauuucuuucuuauuuuagauggcugaaauaaaaguuaaacuuauugaggcuaaagaagcuuuggaaaauugcauugcuguacaagauuuugaucaggcaucaaaauuaaaagaagaaauaaaaauauuggaagaugccaaaauaaaccugcuaaaagagacugagcaacuugaaauuaaagaaguccacacagaaaagguauaugucauuuucauacuaaauguuaacugcucuuagcucaacaaaccuuauuuuuguuaauucauuaaacugccagaauuuauuuacuuuggagggaguuaugacaauaccaugaauaaaagugaaaaaauaaacuuuauuuuuaaaacuucugauguauauauuuagauuugugguauuugagacagucucacugcuuaacccuugcuggucuggaacuugcuauguagaccaagcuggccucaaacuaacagcuacccacuucuuccuggugcugggauuaaagggguaugcccacacccagccagacauuuuuggauuuugaaagauaccuuuaguuuuuauagcuaggacuuguuuccuugucugcuaaccccugggauuugaauaguuucuuccuucuuggggaaacuaguuuccuagugguuuacuuggaaguuuuauuuauuuuucuugaacggucuaaaaaggaauugcauccaucuuucccuuuaguggaaggucuguagacuuucuguuguuaagaaaaaaugucuuugauaaagaaauacuuugagauuugcuaucuuuuaucuauuaguaaauguauguuaaagcaucuguguuacuguuuuaauuuuuuuguauauuuaaauuuuuuuuuaauguguaugacuguuuguuugcauguaugcacguguaccaugugugugccuggugcccuuagagguccgaagaggguaucaucuccccagaaacuggaguucagaugauuguaaacuggugugugggugcuggguauagggcuugguccucugcaagaacaaaguaaucauagccacugagcugccuuuccagucacagcguugucauucauuuuuaaugaaauacuugaguagaauuugaaguuuuuucuuuguuuaacuuaguuguuugacaaaaauuuaaucucuuuaaaaguauaaugacuuugcacaucaauuaauuuuaugguaucaauuagugacuuuuauauuuuaaaggccuugucuuuguauugaacguacuuacuauuuuuuuuaaagaguuguuuauuuuauuuauaauaaaaacauuuuagcuguguucagacaaacuagaagacggcaucaguucucauuacagaugguugugagcuaccauguggucacugggaauugaacucaggaccucuggaagagcagugaguguucuuaaccacugagccaucucuccagcccauugaacauauuuauaauugcacuugauuuagggaaugcuuaagagagugcugcauaggaaaguuuuagaaugauuguguauccuuuucuagucauaaauauauccuaaaauaacaccucacuuucccagugaguaugacucauuuguuuuuauaguuuauuuauauuacauauuuauacucuuuggcuuguccuaggcuuuaaauuugagaaacaaauuuaaacaaaaaccuuagaauaaaauuaaagauuuucuaauuaaaaucuuugaccaagugugguguugucuaccuauaauaguacugagucagagggagaggaucugggucaaggccagcuugggccacauaggugaggcccuccuuuaaagaucuaagagcaggagaggaagcucagucugagauggcuuaccuaguauacgugaggcccuagguuugacucccagcucuguccuaaacccaucugucccccaaaagaggaagcauuuguaaagcugcucugccugauuaaucugauuaauaaucucuuuugaguuauuugaacauuuagugucuuuugucuuauuugagagcuacaacucuauuguaauauaauucuaauaugauagaugaugugaucaggaaacuguagaaauguguuugagagguauguaauucauaaccucauguagaaugcuacuaguuuuccuacaggaagaaauaaauuaacuagagaugugaauaaaauuagugcauuagacuuuucauuguugugagaaaacaguugggaggggucauagcuaggguuuuacugcagugaacagacaccaugacuaaggcaagucuuauaaagacaacauuuaauugggacuggcuuacagguuuagagcuucaguccauuaucaucaaggcaggaucauggcagcauccaggcaggccagguacaggcagagcuguaaguuuuacaucuucaucugaaggcugcuaguagaauacugacuuccaggcaguuauaaugagggccuuauagcccuugccacagugauacaccuacuccaaaagggccacaccuucuuuuuauuggauauuuucuuuauguacauuucagauguuuuccaggucuccccuucggaaacccccuaugccauuccuccucccccugccucuaugagggugcuucucuacccacccacuuccaucuucccuggcauuccccuaccuacacuggggcauugaacacccucaggccuaagggccucuucucccacugauguccaacaaggccauccucugcuacauaugugggcgcaggcaugggucccuccauguguacacuuugguuggugguccaguucccaggagcucugggggguguuguuccccccauugggcugcaaacccccucagcuccuucagucccuuuuccaacuccuccaucagggaccccaugcucaguccaaagguuggcuaugagcauccgcuucuguauuugucaggcucuggcagagccucucaggagacaaccauaucaggcucccuucagcaaacacuucuuggcauccacaauaggauccagguuugguaacuguauaugggauggaucuccaugugggacagucucuguuuaguuuuuccuucaaucucugcuccacacuuugucucuguaacuccuuccauugguauuuugucuccauauuuccucuugugauuauuuuguucccccuucuaagaacacugaaacauccacauuuugaucuuccuucuucuugggcuucaucuggucugugaauugaaucuugguuauucugaacuuuuggguuaauauccacuuaucagugaauacauaccauguguguucuuugugacugagucaucucagucaggaugauauauuuucaaguuucauccauuugccugugaauuucaugaagucacugguuuuuuguuuguuuuuuuuguauguuuguuuuuuguuuuuugagacaggguuucucuguauagcccuggcuguccuggaacucacuuuguagaccaggcuggucucgaacucagaaaucugccugccucugccucgaagucaauguuuuuaauagcugaguaguauccauuguguaaucauaccacauuuucuuuauacauucugcuguugagagacaucuuggcuguuuccagcuuuuggcuauuauaaauauggcugcuaugaacauaguggagcauguguccuuauuacauguuggagcaucuucuggguauaugcccaggggugauauagcugaguucucagguaguaagggccacaccuucuaauagugccacuuccuggaccaagcauauacaagccaucacaggaaggaaggaggguuuauuuuaguucauauaguuuuagagguuucugugagcgagaguugagagcguguuguagcucccacccugacagacagggaguaggaugccuaugcugcuuuguuguuguuguuguuguguauuuuccuuuacugccuuguaguuuuaggccucuagccuguggguuggugccacuuguauucaggguggaucuucccuaccuuuaauugucuuuggagacagccucacacacauccagugaugugcucuauuaauguuuacucgcugcuucucagcccagucaagucagcagucaagagucaacauaguacaccuaguacuauauaacacauaguggaaccuaauaagguaaaggauguuuuucccugugguaggccaguuaggugauuaccucuuuaaguacuucacaaauguaaauucauuauucuuccaguccccaagucccacugguuucaaaccuaaauaauaguuacuauaaauuuauacuuuuaauacacuuugugcuguuuuuuucuuagugaguaguuaaagaaguguagauguuguaauuguaaguaugagggcacagaguuuaaaauacgaugcuugcugugcuuuaaaucuuccaguuuacauggaaagagaauuggagaggugacagcaaauuggaaaaaguguuaugggccagacaaauguaaggccguggguaaucaauauuaaagaaucuaccucauucagagaugaugguggauacaaggauauuuuaaagaauaggaugaguacucuguaauacaggguuaagauuuuuggagaauagauuagagugauaaaugucuagauagaguuucagaaauauggccugagaugauagcauugugaacaaggugaugcugaauacaaauagaagugacguaugucagaguucuuuaagguuuaguaauaggaagaagagagaaucaagaguuuccugggccucuuuuugcuuugggcaaaugaaacuagauggucaggauaugacgacaguuuacgaguuagaagcuuaguaauggguuaguuccauuuuguauguguugaguuugaggagccugugaaacauugaagaaguauguuauauuaauugauuagaaguugaaaauuugaaaauaacuagguauuauguaacaaaacuuuuccuggagagacucaauguacacaucuacucaccccagauagugauuccaugauagacugaaguguggauacaccaaagaccaccuuaguuaaccaaugauucuuauugggguuaccuacagaaauaugagugaaggguuauuuauaggagcagaagugagugacucaaaggguagcuacauuaccaaaagccaccucagugagggugacagcucauaaagcugagaacguggagcacauuuuagucugcagguagcauguuggagagaguuuguuccaggugccucaguuggucuaaaccucuaacaggcaacucaacugguuucugcuucuuagaggcagcuguuguuagucuucuuugcaggugccuuguuugaaagucuuuucagcucuugcuacuuacuuuggcaaggggaggggccuagugaaucuggucaauuucagauacuucuucaaucuguuuugaguuguuuaacaauccugauuaaagcuuccuuuuagaaugaaauauuucaaccuaggaggaaacuguuacacaaaacugggccagcucaguugaaaaugaaaaauagaguucaugguuggauaagguucccaaaggaacaaagaguaacaaucugccacagaaaaagucucaagagagcaauuguuuaagggauauucuuacuaacgauggauaugucuuuuauuuuagaacgaugcggaaacauuacagaagugucuuguuuuguguuacgaauuguugaaacagauguccacuucaacuggaaucacugcaaccaugaaugggaucauugaaucuuugguacacugcuggccuuugagacccuauacuccucuaccuuauuauauaauaauguucauauuaauuaguaauuuaaaaauuaauaauuaaaagacuaccauuuuaaacaucagauaaauacagugaacuauguauauccauagugacuacuucauaauaugaagaauaauugaaauaauacauuuuuaaaaagccacuuguuuauugaaugcauauuaucuaggaaaugcuugaaauaaaguauacauaaaauacaaaacuacagauagccauucuggaucuucugcucaagugagggaaauauuguuaaaaaauagauacuauauauauuauccacuuauauguguguaauauaacaaaaaugaggccuuuaguggggguaagagggucaugccaugggagggaggggacaugaaagugguugaagggagcaaagggaaguggaaaaaaugauguaauuaaaguauaaaaauuaguuacuuaugcuauugauauugguuaugaagauuuauauggucaugggugagcuuaauaauugcagguuugaccuauucauggaaaacgguccugcuaugauauuuauaagauaauaugugaaaaagagggaauaagacuuacaacuguaguuacuaaaacaauguguaaguguuaaaaacuuacaucgauacaugcaguuuuagaauuucuauuucuauucucccaucucuaaguguaguuuuaaagaugggaggauauaaauuuaucccacuacuaauuuuuauuauuuacagucuauaguaauauuuugaguauauaagauaaaguaggcaucaaaaucagaacagcugagcagugcuaaaaacaaagugacgcauggucugcagcgagacugcugagguauuuauuaugucucagcauugagaagccuuuggaguguuacauacugauaggaaggaaaauugcucugccuagguucuauuuuucaacuuuauaguuaccccuuucauuuuuguucaaacuggggaaacuuuguuaauaguguagaaaugaaauacccuugcaaaaucauauggaaaucaucauuuugaccaugauuuuaauauggcauuguaaauuucuugccuugguuaaaauuauuuuaauuuuuacuuuguuguagauucuuccuggaauaauaaguguucauccuauaguaagaaacuuggcuguuuuguguuugggaugcuguggacuacagaaucgggauuuugccaguaaacacuuuaugcuguucuuacagguaggauuuauuuuaugacucugugucuauuucuugacaugcucugcaucucuggggauacguuaaaauucuagguguguucagaugccuaauugaugaucguggauaaucuuuagggcuucaauuuuuaucuugauaguuuauaaaaaugucuauuucauagagucauguagcuuauaugagugcauacuaugugcuaucacuguucuuggcuuaggagaaauguaguaggaaaaggacaaggagaaccaaccugaauuugugcuguuggagcuuguuuuccugaaggggaaacaagccggauguaucuguuaugccagcuaagcauagacagagcacaguagcagcagccaugggagugagaugaggcacaguggcugugcccgugaugcuggccugagucuuacuuugaauuacauuuuucuaauucagacucguagaggaaaguuagaaagaguaguccuuauaaauacuugaaagaauacggucuuuucucuuucuuucuuucaaagauuuuauuuuuuuaggucugcuguguguguguagguacucauggaagcccaaagagggcauugagucacccacacugggaucauaggucacagacacauaugccugacacagauguucaugugaacugagcucguguccuucgcaagagcauaacuacucuuaacugcugagucaucucuccagcucagacaguuuguuucuuaggaaagagaauagaggagagaggucuuagggguaggacuuuacuguuugaggaacaagaggacauauggcuaggaaaauaagccaaaugcagucuaacaggagaaagacugugggaugucugugugcuccaagaacuuacgcuguaaaaaugcagauuuccauuaugaaugagucagggaagaaacuguugguuuguuuuuacucuuuugucccaacccacccacugcauaccauuuuaccucuuaaagccucuguucuguuuugauuucauguguccuauuauucuccuaacccuuucuuuuucuuucuugggcauagcccuggcccacuuauauaccuacauauaaauacuguuaacuugggauaugaaagucuaauaacuuaccuagguuaaaucaguuguuggaucuggccuuuuuuuuuuuuuaaaguuaaaaguauuugaaugauagcagauucaagggcagaaaaccugaaguuugccuauauuuuauauguuacuuugaaguauaauuuuuaauuuuuagauauuuuuuauuuauuguuuagcuuuuuaaaaaguuauacaacagggucuaugaucaaaagaagauaacuacuaaauggauucaaucuuguaaucuuuauaaagguuuuuaaaaauuauuuguuuuugauauuuugagacaagguuucucuauguagccuuggcuauccuggaccuugcuuuauagaauaggcuggccucaaauucagacccucugaauaccuuauugaauaccucuguucccagagugcuggcauuaaggauaugugccaccaugcacagcucuauaaaagguuuuguuuuuuugguuuuuuguuuuuuuuuaauuuuaaauaagcauucucagggcucuauuggaagguuuuuuuuguuuguuuguuuuuauuuuggaauaaaaaauaucaaacuguuaguaauaaaaauugauauaauguauaaaggucuguuagaaaggcagaagaggggaauuaauuuguuuuaaaaucucauuaggauugaauauugguagcuauugcugcauguaaagguuaaugagaguaugaaggaaacaguugaugcugagcuaguagcauauuuggaguuuccagagccaucguaacagcauguaaagagaauuugguuuuggcagauuuacagggcucauucucaaagcauggaguggauauguucuugacauauucuucaaaguuuuuagaauaaauaauuuuucuaauuauaauaauuugaccaauauagaagugaucuuuguuuauuuuaaaggccaaguuacauuguauaauauaguuaaucuuucauaguagaaugccucugcccccaugguuuuggaauuuguuguguaguuuuuaacucaagauagauuuaaacuauuugugugcauauacagagaucuauguuggauaucuuucucagucucucuucuaacucugacaaggaccucucacugaaccaggaccuccuggauuugguuagguuagucggcuaaugaauuucagggauccacgugucucugugcccccaguucuuugguaucauugugcacugcuaugcaccuagcuuccugugugguugcuguuuaucugaaaugaggucuuccugccuauguuugacaggcccuuuauggauuaggucauuucucuagcucccuaaacugcuuuauaaaagacuacuugauaccugaauucacuauuaaugaaaucugaauuuacuaaguaaugagaaaaauuuuccuucaaagaaacuuaauaguacugacuguaacaaagguuuaaauggauuagaauauacuguauuaauauuuuugauaggcagguaaaacaauuuauauauaaaacacagugcaguuuuucuggaucuuggacaaaugauaaaacuuuaucauaguuggaguucuuuuuuuucuuuuuucuguuuuguuaugaaagaaccaaauagcacaguccaucuggacgcugacucugaaacuuuuuuccacugcaaaaauuaagggcuaaagcuccagauguuaugagauaaacauacuucuuuuuuaaaaugaaaacuuuaauuuuaauucuuagaaauguucacacuuaacacucauugagauuuaauuaagaaaagauacuaauuuuauuuagguuauagaauuaaguuguuuuacugaaauuauugggggguguguguucaugucuaauuguagguuuugcaaaucgaugaugucacaauaaaaauaagugcucuaaaggcaaucauugaccaauugaugauguuuggaauugagccauuuaaaacccagaaaguuaagggcguucaaugugaaggugaagaaauaaacugucaugauaagcaagaagaaaaugaugcuggagagacugacccagcuaagaguguucugaaacuccucuccgacuucuuagacagcgagguaagaagucacccagcucuacaguuaggaagcauuugcaacacguguuuauguucuuugcuugaauuuuguacucguuuacuuuuaacaggauuuuauuugguuuuaaaaaaaaaucuuaauuuaaaauguaaauuucacaucuacuauauuuucauuaucaaacuaguguucagagaacugaaagugcuuuugccacauuucuguuacuacaguaacagaaacgaaauuagaacaaguuguauugaaaauuaacauaguuuucauuuuuaaaaauacuuuuuauuauuuaaaacaaguauuaaauuuauuuuguuuuuucuucauuuucuuuuuggauuguucacugcuguaguauagaaucucagcugagauuuguguguguguguuuaacuuuauaacuuuuuugaauuggcuuauuaaguaauuuuggaaaaggaauucuggggauuuuuuucuguguagaaccaugucauuucugaauagcuacaguauuaauuccaugucuuuuauuucuuauuuaauuguucugcuucaucuaguacaguguugaacaccagccguuaagugucugaagcaaauguccuugucauauuugugaguuuaguggaaaaguugagaaucuuguuaauaaauguguuaguuacaggguuuuucauaaauacuguuuaucauuuugagauaauuacuuucuauucuuauauccuuggcuguuuuguguuuauaucuuaauaaaaagauguuugauuuugucaauuguucuuucugcuucaggcaauauagucaugagggauuuucuucucuuugauauguuguaugguauggaacauuacuugauuuucauuugcaccaucaguggauuucuggguuaaguucugugugcucaugauguauaguccuuucacuguugaugagcuagguuugcuacgauuuucuuugguuacuucaauuuuaaauuuuguuuuccucacagucagauuaauugcucucuucuuguuauuacaguguaauuuaaguuaucauuuugagauuuuuuuaaaauacauuuuuuaaaaauuuuaaaauggagauauuuauuacugcagaacuucccugagcacuguucauugcaaucccauaaguauuuuauuuuaguucugaucuuugagacagugacauucuguagcccagguuaauuuaaaacuuacuguguagucaagucuagcuuaaaaccuguagaacuccuuuuaucacaugcauaauaaaauuaauuuuuggauaguuauuuuaaaauaucacacauaaaggaaacuagagauaaaaacuuucuaaugaaugucauuuuugcuagguaucugaacucaggacaggagcugcagaaggacuagccaagcugauguuuucugggcuuuuggucagcagcaggauucuuucucgucuuauuuuguuaugguauaauccugugacugaagaggauguucgacuucgacauugccuaggaguguuuuuccccauguuugcuuaugcaaacagguagugagucacugauuaaaucuuaccuaaagucagguucagcucuccccaccugaacuaugucucggccauuuuguucuugacacacuuuucuauagaugaaucauaagaauguaacauacauuuuauauacccagauuucucuuuccugcauauguaagguauaaaacgaacuauaucucuucaauagagaguuugugaauauuuuagauuuaaaacuuuucucuuaaauaauguuuugccaacuugcgaaaacauuggagcuuuuuuguuguuguuuuuuuguuuuuguuucaaaucauuucauucagcagcuuuaaguuggaguggcaaagagguuagugggaucugaagucuucagcagggcagauguccuuggccuuguacuaaaaguccugauuucuuuucaauaggacuaaucaggagugcuuugaagaagccuuuauuccaacugugcaaacacuggccaaugccccagugucaucuccuuuagcugaaguagaugucacaaauguuguugaauugcuuguugaucugacaagaccaaguagauuaaauccuaaggcaaagaauucucaggauuaucagguauauaugguagccuguggauagcaaauauaacugcaugaagaucauuguuguuugauuaaagaagccuucuccugggauuuuugaaaucaugaugaacuacauuuauauuuugagccuuuuguuuuucuaguauauaagacaguuaugggaggcagggaagugugucuuuggguaaauguggagaaaugaugaaaauagaagugaucauggcaaauguuuugcauccuagaaguuacuaaaacaacaucauuuccauuaccauucuccccacuuagugaggugaucacugaaguaaagacuucuguuacuacgucugcaaauguuggcuugcuuguuaugcuguuaauacugaggagggaggacaguuuaaagguguuuaucucaagauuuuuuuuuaaugaagcauauaauagaacuacaaacuuaucuauaaauuauaaugaaauucaauuuuaaaauucuuuaaugauguuugaacacuuagaaauuugauggguuaaugauuucagaugccaacugcaaguuaacaguuuuguucuaucuguauauuuauuugcuauuuagugacugcucugcucgaaucacauuuguuauuaggaggauuauauuacaaaggauauuaagcaaaauauauuaauagugauuagccaucaagugcuuuuggacuucagaaaaguauaagauucauuauaggaaugauguauguaucauuaguuuuauuuuccuuacaggguauuaagccuauguauggucugacaggugcuagacaacugucuguuuuacugcugaacuauauccccagcccucuugucacuuacuuugagacagggggcucagguaggccuugaauuugcaguuguacuaucucugcccccaaguagauaggacuauagguguaugccaucagacuugucugauacuaguuuuaaaacucauuugaguuuuaaaaauucucuugugcuugguuggauuugagaagugauuuaaaguagaaaggaaagauguauaccuaaagauguauacauaauaaauguagaugauuauacaguggcuggaguuggcccuauuuguaguguauauauaagacuuaguauuaaaggguuaauagcaugagauuuaguuaucaagaagacucauuuaauggucacuuacgguuauaugagaugaaguggugagaagauuuggggaaaguuugagaggcaaaugagaugguaaacucugaggaaagucuacagucuuuagugaguaacaguagacuucauagacuucuugggaaaguaagcaaaguaggcuggggcauaggcuggauuggauuggcaugcaagaguuucaauugauuuguauaagggguuccagaauugagauguucuuugaauugcugaaaauugaaaauaagcugugcugugguaccuuuguaucgguuggcuagucauguggugugaauugaccuucagggggagugcuaugauucuaaaacaguuccacuuucaucagcuggauuaucucaacaacuggaugcuccuucagucguaaaagggcagaccugcuccuuguaauaaagagaggagcuucuuuuggagucagggagggcaaaauuuagguuuagacaugaggcaaaugagacuuuugcaaguuagcuagaaagauuguuugauauauagaaccguauguauugugaugagaacauuuuuauuuuauaaagauuuuucuuuuuaauuuuuuaggccuuaacaguacaugacaacuuggcuauaaaaauuugcaaugagaucuuaacaaguccaugcucaccagaaaaucggguuuauacaaaagcuuugaguuuggucgaacucaguagcaauguuacaaaagaucuccugcuucuauuggaugagauucuggagguaaagcaauuuuucauauucgaguaguuuguguuuauguauaucaagguggauuuagauggauguguuaaguaauauauuauuauauauuaugcauguucauuugaaguaacuguuuucaucaauuucauguaauuuaagaaugguuucaaacuugauauggcauaugacuuugaaagaugacuuacuuuccauuucccacaucccucacccccagcauguaacagauaggacgugucugagagccuuggagaagauuaagagucaguuaggaaagggagguaaagaaucugacccagguguaguaacacaggaugucaacacaaccacagcaguucuucaaaaugaaaacgguaaguauauacugaccugaauaucuauacaauuauaguuuuuauucuuacugagauuuuuaguuugacugaauuucagaaacaaucaaaaaacuuuuucuuaauaauccucuugaaaaaaagcuauuaauuauguguuuauuccaccuuucaaucuauuugaguacauuucuuacuaacugucuuuccaggagcuuuuacuuuguaggauucacacuuuuggaauggugauucauuauaaccauucaguagcuguuaauaggacuguauuuuuuguauuuuuguaugauuccauguauggaagaauauaugacuccugugagggauggaaaaggaacucaaacaucaaaaucuacacaaggaaaaucuaaaagagguaaugugugcauugacugcaccuugaagugcaguuguuuucgcgggacacacuaccuuuguaagcguccucaucuuugggaugggaacuucugaaugucuugggaaugcauagcugcuuuacuuccuucaggugauacggauuauugcuuuuucucaagauuuuagguucauuguuguuccaugugcuuuugaauaaauauauauacaaaaaagggcucuuaggggauaaauuaagaauagguuaaguugccaggcauggaguauauacuuuuaaucccagcacuuggguggcagaagcaggcagaucucugaguuuuaggccagccugguuuacagaaugaauucuuggacagucaggacuauguagagagcccaguaucaaccaaaaaaggaagaaaaaagaaguuaaauaagaguuuuauuuugcaguauuaguauuagaaguauuaggucuuuugugugugugaaugaauauuguuccccucccaaguuuuugcauuuguuuuuacuuccuuuuccccaucuaauuucauuuuucuuccagucaauuucccaagggguauccaacaguagaauauuuguuggaauaaauauauguuuaauaauagggggccacuuugaaaaacaucugaaauucaaggcuuuuaaaguuguuuuauuaauuccuuauuacaaaagcaaugcaugcuuauuacagaagacuaagaaaguacauccaggcagaccuaccaucaagaacacuaauagucacacccaugagccaaacaugauuuuaauuauugaaaauaguuuuauggcucuguucuaaguauguuuaaucuuuucuagaauagaaucuggccauaacauuguuuuauaacaaaccaguuauuuaaacaauuacuggauauuguuccaaauuacuuccauauuuuuggauguuuucuuggggauaaauacauuauugaaaacaaauaagauaugagguggaaauauauaacaaugaauagaauauacaguuuucauauaaauugucaagugaacaauugauuuugaucagauuauuuuuaguuacagaauaaaguaugaaaacuccauuuuuuaauaguucaaacuuaauguauacauacuacauguauguauacauuauauacaauuaagaacauuguaggccaaauuuguuaugacuuuuuucaguauagguucucauauauccuaggauagcuucaaagucacuauuuugaccuugaacuucugauuacagguugggacuauagguguuggauuaccaugcuccauuuuacaugguugagcaaaccaggauuucuacaugcuaggcaaacacgcuacccacugagcacagucccuaguccuuaguuuucaaccuuguagaauauagcaaacccuggugaauaaaggcucuuauuuuuuuaaaaaacauugaguuauauuuaugaacacauuugaauuuucuauguauaaguuuaaguguuuuacaagcaaccuguaucuugcuguguaaacuucuuuugaagccagguacaguguuagauguaauaauggcuguucuagaggcugugugaggauagcuugagcucaucaauuugaggacagacuagcuaagcaauguagugcuucaaagauaaauauauguaauaaaaaugcaguuccaucuagaaacuguucauugauugagcuugcccuuguaagauuuuuguuaguuuuucuauauuaacucuaccucugcucuaagagaaaacuguuuuauaugagugugugaucauucauuuauguguguauaagucuuaauguggagacuccuuagucauggucuacuugcauuugagucaagacuuucucacuggccuggagugcuccaaguaggcuaggcuagaugaccaccuagggaucuaggcagagccccugcaugucucugccuucccagugcugggaucauaagcaugugcugccacaccucacuguuaucuggguucuggcacuuaaacucuauccuuaacaaagccagaacuuuuccaaaugagcuaucacacucagccugagaugguuuugucaucacaugugaccuaaaguuugccucuuugucacauauuuguagugcucauccaaagaaauuuacauaaauuuuaguauuuucccccuccacuauguauugagagcgucagaguggauaggaauaaggaaguguauuggaaaagauuguugugcugaaaguaaaagauuuggauggcuugguaaccagauuuagaaacacgaaaccauuaaacauugugccaauaagcuaugcugucuuuaaggauguagaaaagcgccaguuucaucuaagaccaacaggagacgccagauugcugggccagacucugaaagguacaucauguauuucuauaagacagaagaugccaaccaguuuuuuuugcucagaaguauauagaauauuguaauuuucuugugagagaaacuuuguauauuaccagauaguggaaaccauaauuaucugugaucuuggucaauagucuaaaaauaucuagaacauuugacuuaugaagaguuguauauuuuuauuaguuggcgucaguuuuaguuugauauauucucuuuguauggaaacaagaguuuccauguauuuccauguuuucuguuuacaugaccuuauauauguaacucuuaucuugauuuagauaauauuuagauucuuugaguuacaauuuugcuuauaaguuuaaaguacuagugguuuguguuaauaguuuuuuuuguuuguuuguuuuuugucacugcaaagacaagguugagcuugagaaguuuguagcugucuugcauucguuuagucauuaguauuggaccuugcauguuuucuuagauuaagccuuggcuaaagugcuuuugggggaacuuuacaauguuuuagcaguauacuaaauaaauuaagauaacauaguaauguuuguuuguuuguuuuuucacuugaauucuaaauccuuuaggaugauuguaugguccccaugugauuacaagcuuuacuguaaaagcuugugcuugcuucuuucccuguauguaugacaccagguuuuaacaguagauuaaaaaaucaccagauuaguuagauuuuucugauucacuuggcaggacacccauccagccauuaguuuuuugguuauugcuugaaauuuuaguuuuaagcuuaguuauuagacucaggcuauuacacaauauuggaaugugagaaaccaaaauguuuuauuuauaaauauucugauuuuuaaagcuuauaucuaaaugcauguguuuuuuuacaucuguuuagugaucaugaaccaccaucagaaaugaagaugagauuacccagacgagccaaaacagcugcgcuacagaaaaguaaacuuaaccuugcagaguuccuuaaugaagauacaaguuaagagagcugauaaggaugaaguccuuugaaguugugcuuauaacuuugcuuuaauaguuacuaugauaaagucagaaagccugcucuguuucaggaaacaugaaugaugccacaugacuucagacuccuuauuuacauuaaacaauggcuuugagaaacugcaucauuccuauacucaguauuuauuugauaacuuuaccacaauggguaauuucucuuccuaaauuuuucuauguaggaacacuauuuuaugaaugaauucuagauuagggugcugcccacacacacauuaaucaugaaagauacauugguuuuuggcacaucaaaacauacucuaccuugaauaauaaauaauacuaaugggaaauaaaaguccuaggaaguaaucuuuauguacugauuuaugagcacaguuucuucacuguucauuucaguuaucuuaggaaauugucauugcugugaaacauaaaaguagucccuuuucuuucugccauacccaaggaaacaccuuuuauuuggauaaaaauguccuaacaugaaauuuuuauugugcuucugcuucauuaaauuuauuuaucagaggccauuuaacaguuguucugagauggaaugaaagguauugcuggcuuuuaaaaccaaaaggcuauucagucuauacacauaacaugugcuuuauagaaaugagaaaaggagucagaguuacaaagcaagaaugcuuauuaagcaaaaggaaugauaugguaaugauacaaaccaaugaaaaacacuguuguccaucuuuuggcucuaugucuuuuccugugcuucauauuucuuauugauauaguucuuguuaaauccuugucuuaaauucauggggaacaggaagugagcagggcuagaauggcaugguguaagggaaagccacuaggaaugaacuaucaucucauuuagacaugugcagaguagccaaaaggaaagaagcuaugaucauguagacacuacugaaguuugcuuuucucugacuuuaagcaccaauccauuaguagcaguuuuacuacucagauuuuagacaauagcuguggcugcagguauaccuagcaucauuagcauuacuaaggaauauuguccuacuucugcaagacaccccuguaaacuuuggaacaaacugcuaaaauacaauacaaccaauagguuuaaaaaacauaaccuuugguguguguguguguguguguguuuguuuuuccauucacaauugugaacuuaaaccaguguccuugcuuaccaucgaggcacagauuugcugaagaguaaacaugcaauugugccguugcucuuacggcccacagaugagugguuuaaauuacagaaagggaacugauaacccauuuuuuuuaaugaaugaaaacaugcuauuuaauaagcuaaucaaucuuuuucuauacauauauaacuuuagaagagauauacuucuaacugauaccuuugccuuucccaguuugcuucgagguaguuagcauccaccuguuacacaacuguucacggguuaggucauuaucacacaucuuuacaauacaagcuuucuaaauuacagaauuuguuauaugugaaaacugcacagaaauagaacugggcaauuacauauuuaagcugagagcauuaaaaaauucacugauaaaaagagaacaucaaaaucugcuuuuguuguaaaaucccacaauggucuuguauaauguauguaaaaacagaauuauacuaaaaugauuaaugcuaaugaccuaauauaaagacagaucacuggacuagaaacaguuuaguaucaauugguuuucaugagaaagaauauugacauagaaaauaaagauagugcaagggcugcagacuaauuuucuucacuuuugagauuuugguuaugaacuguacagcuugcuagagaugcugcuguuagauuccauucaauaggaugauuaaggcacaucuuaauggggcucaaugggcagcuugcuguguucccaucagacaaauccacuuucucaucaguuuucauuuguagcaugcuguaaaaaaaaguguaaggcauuuuaaguuuaaauuucaaauugucaccuuuguagaacauuuggaauauuuuuuguacucuaaaacaacuaagcaaacuguuuaucauccugacaccacuaguucuacagcugucuuagugaaccgagugugaugaacuauaucaucacauucauguguaaauaugacacaugcacucagguaccgcaauacaaaagccaucagucacugcauuaccuuaguuuacaucagaaaggcaagguucaacccuuuaacaucagaacuacuuuuaagagaaugaacauuuguuaauuccugcuguguucuaagcucguucacaugcaguaaguaaucauuuuuaauugcaggaaaaggcagauaugguauugauguaaaccaaugggaaacacuggucuucaucagugauaaauugagucucugaaacuuaaguacaaauacgagucaugucauacuguaacuggugugaaacuagaaacaucauuuuuccucguuucuugcugcuucuguuaccuuucuaguggacugauuaucauuaagaguaggcaaaaaaauaggccuguuugguaggaguguugaguuguccauccaaucuucucuuguggccagcuuaccacaggaacacaggcagcaccuacaggacaauccggaucccgcuugcugauuacauacaacucauuuuuuucuuuuucuuuucuuugcuugccuaucuguccuuccguuaguuucuuccuuccuacacuauguuuaccaacacuggcugacagucucaguguuuguccuuuuuuuuucccccuccuggcacaguuguuuucuacuauauuuuaccaaaaauaaaauuuaaauuauguaauauuucaaucuauauaauuagauauuaauaaaauaacaacuauaaguuagcuuguuagucauaaaaauauuaagcaaaaacugauauaauuauuaaauguuaauauuuuuuaaaaauuuaaaauaauaaauggcagaucuaaaugacaauuaccugaaacguuaaauuuugaaaaaaaaaauugguuuauuuguuagacugagguacguggguuauuucaugguuuguuuuuuuccaaguuagugagacagugguguuuuucuuacuauaugaauugcuagcugggcgugguggcgcacgccuuuaaucccagcauuugggaggcagaggcaggcagauuucugaguuugaggccagccuggucuacaaagugaguuccaggacagccagggcuacacagagaaacccugucucggaaacaaacaaaaccccaaaaaagaauugcugcuaguuuuaagaaaaauaaaaauaguauuuuuacaaccuguaauuuuguuuaaauuauauauuauguuuauguuuuguauguaugagugcugucuuucaaaagagauuaucagauucucuggaaauaguuacaguucuuugugaggugccugacuugcaugcgggacuuaaauuugaguccucugugagacgaauaugucucccuuuacugcuacacuuucaucucuagcuacagaaaucacuucuuuguaauuagagaauuuuguuuucuguucuguuguguuacuggaugaggccugaacuugagauaugcuguguuuggcgauugauguaugugagugagugacaggugguuaaaggaaguauaacauccgucucucugagaacauaaggcaagcuauagaggggugugggcuggcagcugacauaccaaguauaaugccaaaaagaaaaacaagucauggccacaaauuaaguuuugugugacaaugaugcauuuaucuaaggaaaguaauauuuucauaaguaugguauucuuuucaguacuuuaaggaaguuuuuuuuuaaguuaguuuucuagagugcuauuacuacagagacaacaaagggugcacaaaacuauauaugugaaaaaauacaagaaguaaacacuuuccuauuaguaauguuaaugugcauacuaauauguuuaauucauguacuuaaacuauuacaaaguucuuaagaugcuaauuguaaguccuuaacauuauaaaagcaaaauuauccuugucuauuuuuauuuguaugaaaaagaugacaccuugucaacuuaagcuugugagcaauuuaaaaugcuuuaaaaacuauggagcuauguaucagcuaaaaugaguaguacugacucuuccagucaaaggaggaagcugaaggagguccuuauccuaaaucagguuucucugucaaagcagucaaccuaacuggagguggggguugacugauacacagggacacacucucaagugcuuauguaggcaucucaugcuauuucaggauuuguaaucucucagguccuaagacaguuuacagaguauguauguguguauguauaugcauuuguguuuugagggucauggaauuucaacugcuugugauaugacuguugauaauucuaaggauaaagaaaauuuagugugucuaacuuuaaacuaauuuaggcuuguacauuucuagaacuguaugucacaguaaauugcaauuuugguuaugugacauuagcugacaguaaacuuuguuagcuagacaguauucaaagaaacaguaaauuuucaugugacuuauauaucugaaaauaucauuuauagaauacuuguuacggaccagacaagcucuguaugaaaagucuuuucucuguuaucucauuuccagucaccauauauuaaaccuuaucuacuaacuuuguucuaauucugccaugauucucucauuuaauagcuaccacuuaauucucacaauucuuaugauauacagguuuauuaggcagcaguagccccauauaggaaagccauguugaauacaugaagcuugauucauacccuucaauucuguaaagugggaagaauguuagggcacaggaaugagagagaagucauugcacagaaaagcuggguuuuuggauuguguaaugacuguagugugcuuggcagcaucagauuuuagcuggacaaaugaauucuggacaauuaaaugacuuugcuuuaaaaaauguuacagauauucuaaauacuuauuauggucaaguuugagucuauaguuuauugucuccauggauuua

SEQ ID NO: 2457 - RNA, 1236 nt, Mus musculus
gagugaaucacguucagagcuuucucuuccugauucuggggaaacaucugucacagagggaggaaaaguagaaacuuccaauggcaaagccaaaaaugcaaacacaaggcaaaagugaaucaagcauucccucagcaaaggccaggagauucuccacgacuaucuccacagguccuugccauguggggauccaagucaggccuugccauaaggagaucuaucaggguuacaguaguacaccucucugagcagaggcuuggucaccaacaacaccaccaacaccagaugccuuggaaauggaguuacagacaccagguauaaacuaccauuuguguucuuagaaacaaaccuagcaccucuguaagaguaggauguguuuuuuaaaggcugugcagugucugcaggccucaucuaauggguuuuuaagugaaacucaauucagcugcuguucaaacaucaauuuuucgaagccaaauauuguaaagcaguacaacuugagucauacaauuuugaagcgugguguugagugacaguaugaaaauauuaaaaguauuuauuccugucauuugaaacauauuguuucuguaagagcagaaaaccuugugugcacaguaaaaagaagaagaaaaaaccugcaguuuuugagauacgcuaaucuugcagcugaacagagcuguuucaggcaguguuuugguacuggguguuguggcaugcacagugcaaaguucaggugcuucaugcaaagaaccaaggcugaaaucacaugaugcaaccugggggcgucugggaaagccuuggauuuguuacauacuugauugugaguugaguuauggcugugugugccucgaagcuuguuacccuugaauucauacaggaucauaagccacagcaaaagaagcuacaggggagaggauggcauuugaagcuuaauaacuuuauagaagauggagaaaaaugaagagacacacagaugcauucugccccuugccacaugagcccuguacugccucaggacugccaguacaaagagcauggcugccugcaaccuucagccuuauacauccagaacuuuaccccaaauaacucuccuuccugaguuccaagacagccagggcuacacagagaaacccugucucgaaaaaaccaaaaggaaaaaaaaaaaaaaacuccuuccuugaaacugucuuagcagcagaagggacaaaguaaaacaaaagcgaaaaaaaaaacaaaaaa

SEQ ID NO: 2458 - RNA, 4186 nt, Mus musculus
uguuuuaugaccaaggauagaaaagcagaauaaaccacuggcugagaaaauguaggaaucaaaccuucacucuuaauuauacggucuucucugaaacauuucacaccuucacagaauucagcccccagcacacaaggauuuggagacuagaaggugucuaagcagacaguaccugcugccauuguucaguuacaauaauacaaagucuugcgggguauuggauggugaccauggagacaaggaaggagccuuaauauaauaauauaagggccuaguaguuggcuuaaaagagcaggugaugcgucccauuuuuggcaauuacauauuccucuaauguuuuuuccaacgaaugacuaacauuuauauaaaaauaacaaaaguccuagaaaugaccaaguaaauaauauuuguuugaauacagguauuaaccgugggugccugggaaaacuggugucaccuauuuaaacuuaggaaaucauuaaaaaaaaaagucuaaagcaugggaugcaaaauggugcugaagcuccagagagauaaacugaacuuaagaagcuggaagaguacccaaaaacaacuuagugcucaauaagugcuuauaaaacaauaaaugccaugaacucucuacucugagaaucaaggagcgucauauaaagcaggacaaccccaugccuacuuagccugaugagucaaagauagaacacagucauuaugccagaaaagagugacagggggaaagguuggaaagcuuggaauaagcuauguugacagguuucuucacacuuuguggguagaaaaaaaagaagccagugaaugagguagguagccagugaggacagaaggaaguggcucucgucaacuaggguaagaauagguacaguaggaccaaaacuugugguugcaccuaagaacuuaacacuggauaaucuucccacaaggcaugugcacauuaaagaaagacguccccagaaguaugacugcgagucucaggugagaaggagcauugcuuccauggucuucucugcaguguccccaacaacucagcucuggcauggacuuaugugcucuaauuauuaagccacccaacaguuuccauccaucucagaaggcaacuugggaaaaaaaaucucuuuagucaacauagcgauucacagagccuacacaucacaaucagagaauuuccucacccaucauucaaucucuuccuugaauggaggaauguucagcacuacuuucuucauaugcacugaugauucaauguguaugagauuuacaguccaauaccccuaauuuuguguugucugagaugucaugaggucaguacucuucucaccaagaccacaaaugaagagcauguaacccucuuccaauuaacaaaagugucaucuguggguugaugugagagcagagcacuaauuuucccuuuagaauucaagcuuccaacugauagaggagcagugacagcagaaagguaagcauauaagguaauugguucccagccaaacaucuuggaaagucuucauggccccaugacccuuggacaaggagccaaggagacagcuaugccuuucuccaagugccagcaugccaccaggggaggcauaccuggcucugaaugcuuguuaucuggcagcaucugacccuucgugucucucugaagccaagugcagcugucagaucaaugccugcaggcuggaacugcuacaguccugggcagaguccuacaaccaguuguuugcacucgcauuuguagcuuuugcuucuccaaaccccuuuggucaauucuucaucacugccugcaucagugccucuacagugugaaggccacuaucaagauagagcauugggaucaggguccuacucaauuaacaauccaucaauugacaaggugucuccuuuauucccucaacucuugucuaucuucacuaaauacaugcagccucuggcuagacacuggaagccugccgucccugccccaguagacaugaagguauaauaaggcuuacauaagcaaugcucuugagaagucccuuggacuuacuauuugagagcauucagauaugacccaacaccaaggccauaucuagucuggaauaccccacuggccuuuccuucuugcuaagaggcccacauggagugaaggggacuuucugaggauaccaccaauagcaggcaaaagucauuaaggagaagucauuuugcuuugaaccauauuaggcauaaaguuugcaaauuuauuccauuguaaauaaguccucuugucuuguaacucuuuugugugauucuagaaacuacagaugacacauccuccugaaauaugaagaggcaaaauuaagauauugcuaaaacucacuaaaagaaaaauugugucauuuuuuauuaauguugauaagagaauaacuuccauucauucucccuuuuagaugagauaaaaugaaaaauuuguacacugaguaagguuaggagguccucaaauagagaaagaaagcaagaaaaagaagauauguaccccugaaaaucuuuugaguugaaacuuuaccuguguauuuauuacauaaaugcuauaaauaucuaacuuauugaacacuugcuauaugccaaguguuuacuauagacuuuuguaauuuuauguacucucucuacagcaaaucugcuagaaaaaaaaugauaaaaguccuuguuucaaacaugaagacaucucuuccuuguguccaaggucacaggaagaaagauaguagaaccugguuugaauccaggucccucugacuuuaaaacccaagcucuugaucauugggcugaauuaacugccaaguaugaauaaaaccucauauuauccuuuacaaccaaacagaaaggagacauuugugcaugauauaauaggagaaaauggggcuuuugaugagcgauggccuuguggcaauuaaauuugcuauuugagaugguuugguuuguucuaauaacaauaagaccuucauucacucaaaguucaucauucuuuaugguagggaaauaaaaauguacuaaaaacaucgcagauacucuaguguucagaauguccguguuaauuuuagcaagcccuagugcucuaaacaucugcuucauugagagauacccauugauaacacaagggaaggacaaaacacaagagcaguauaauucaggaacuaucuucaagggcaaaagauaucaucaggguguaugauucuggacuugagucaaaagcagaggaggcuggaaaaugugcucucgguugucaagagaauaaaucuccuccauucuaggggugggaagugaagcucauuagcauagagagaaaguccucuggacucugcaucgaccucccguccacacugcagugcguuaagggaguggaaggcggugccuugacaugcugaaaauggguuuaaagucagccugcaucauuugguagcccugcuuuuuaauguaugagacccaucacucucucugggucucaauuucuuuauccauccauaggaauaacaauaauaauaccuauuuuaugaagucacugugacaauucaagagaagcuaaugcauacaaaaugauugugacucuguccaucaaaugguaaaugucauuuguaaacauuuuccacuaucauuaucauguauucaaaguggccguguggaauccacucuacaacaggaaguagcaacaucagcguuccuaacaagggcuugaaaauuccaaggugagaugcagaaccuacucugaaggguccuuuggaaaaugcaaaaaaaaaaaaaaaaaaagucuaauuagauuuguucccagaaagaaaaaaaauugauuuucucuuucaauaauuuuguuaauucaauuuucucuaccaccuuugccaaaggccaggacauuaaagaacaaauucuagucucuguuaccucuuccacugugucaguaggaaaaaaaaaaaaaaaaaaaaagaaagaaacuuuugcuagcauucuagaagcaucaagaaaaaaaaaugacuaacauaucuuauaccuccccacaaguaaagagaauaguguaaguauaaaccacuuauugacauauaacacuaggaaaaaaaaacucaacuaaaauuugaauaccuagugcugguagagauaaaauuaaggacaaaugcaaaacaggagcaagcagcaccauuuaagcagcacugugaagcauuguagcuaugag

SEQ ID NO: 2459 - RNA, 1229 nt, Mus musculus
ugacugucagccuaguugaauccaugagcuucagugagagaucuuuccucaaaaauuaagguagagaagcaacuaagaaagacauuuuaugguccaguugaggguuagguugaaacuugccaacaaguagaacacuguacauuggacacuccaguaaccauacauggcuuccacuugugaacgguucuccauuuacauccugugugaguaccugacagagauggcccccggcguguacccggugcaaggcuaugugauuucauuuggccuuuaugguacccugcaugagugggugcuguuauuaucucuauuuggcaaaugagggccugucagagaaguuaaugacccugaugcaaguucccgagcugaucaaugacagagccagggucaaaaucuugaaaccuaugcucuagucauugugaaaacaggcaguggagucccuagagaagucugcauguagauagaaaacagcugcguauggagguagcucuugguuagauggaggggugaguacucucuacaguggcuggaggugaagcuuagugagccauggaaucuugacuuugccuuuuacuauuauuaaaggcaucugacacuuauucauaaucuaaccucugugugucaguuuccuccauuagcacuuaccuuaugauguugccuuaaggauggugucauugauugaggccugcacauauccucaggacucaaugauagcuuccuaaaggaggccugugucuuuugcaguaucuuauaucuaagguuacccccacuuaguauuuuuaaaguauuuccaucucuguuaaugaagacaaauagucuugaagugagaagggccaugaugggaaggaucuuaagagcaucuuugagggagggaugggaugcaggaggggaugucccacgacuggcagcuuaacucuccaugauggauaauugaacuccacuuacuguaauuguaggugagcacauggccacaagcaagucacauauguagaucagccuugcccaaaugccaucucaaugaaugggccccgaaugacaaauugaaaauuuggcucggcagaaaggaacauagaaaaauacaagaaauaaagucggccuaggcaacuaaagacugacuuacaaacuccaccuuaauucccuauacucuuuuuccccauuaagcagcauagcacaaccauuaugaaaaccagagaggaagugacauuucuuuaacaaucuugaaggaaaaa

SEQ ID NO: 2460 - RNA, 40346 nt, Mus musculus
cggaggcgcgcacgcaggcccugcccucgucgcggccgccauuuuagcuccugguucgggccgcacggagcgggcugugguggcgggagggguggggguccccgcgaguugagccgcgggccucuugugcguggauccggcugccggagucucucuucuucccuccuuccuaagcguccgcuucugggagugcgaggauguccaagaggcaucgguuggaccugggggaggauuaccccuccggcaagaagcgugcggggaccgauggguaagccaggccggggcgcgcagucgcggcucgggcuuuguuggaugguggcggggagcaggcccggcugccgagccuuugucugccgucggccggcuggggcgcgugccgagugugugcggccggggcgagcggccuguggcggccacgaggccgcggaacggcgggcgugcggagcgggccgcgaggccucggugcucgcgugaggcccgcagccggaaccggauggccaagggcacugcccccgugggcggcggcgggcgcugucuguuuugggggaggauagaggcgagccgaccucggggcgcacuguuuggcgggagacgaagggccuucuuccauugaggcacuucaggagaggccguugccaacuuccgcccucugccugcccucccgccaucuccuuuauuuccugcuuugcuuaaaagccggcuuugcuuuuaaguagcaucacugggguaggccugugaaaacacguauuucccccuccgcucuggaaguuauuucuaucuccuccccacuuuggacgcacuuuucaaaaaagugaucuuaagcguguuugaacaaacaacacccacgugcagauugagaaaggcuuacaccgauuccuggucuggcauuuuaguuccuuuucuuagacuuuucgcaaagacagggcauuuagcaaguaagcaguuguauuaucauuuuccagucuuuucuuucacaguucauacuuaaaauguacuuuuguuuauauuccuacccucccauuuuaauuaguuguauguuuaugcuucggcaguacagggaucuguuggguuaauuaaaaaauauauccacggaaguccaaauguccaaaacaguuguaggauuuuaucauuuucuuaugucuugugacaccgacucgcugucaagucagauguguggucucuugaguuuuuguuaacggaaaguccuuugggauugauuucuaacuaccagugugagaauaggucaggauaggaugcguucugucgcucuccuuagguugaaauauugaauacggaaagcagguuuguuauguuuugauuguguagguuuuuuuuuuuaaagcuuauaacacuaagcauuguaauaauaaaacaucccaagacagcuguucucucaagcaaacauuccaaauguuaguaauugagcuccaucaguucuuagguagaaacagcucaugaauauucuccaagggagagcaaaguugcagugagcuuuuuccauagauuauagugguauguagaauucuccuuuucucaacaggaaacuuaguacuguaguuaggcaucacaaccugucauaaauggcauuuauauuggauugauaaaguggggaacuucugugaaguuaaaguuaaugucacauuuggcuaagaugcaacuaauuucucuccuuauagaggucacauugggaugaacacugaguuugugcaagcagaguuuuuuuguguguauguucacgacucaaugcuuuuauugcaauuggggcuccacauuacagugauuauggucauuucucuugcaaaacauacaacauuggcaaaauggacuuugcguauaucgcggguagcuucauguuuccucugaauauuucauauuugucacuaaguacaggagaguccuugauuucuagagauucugcaaggcaguuuuugcaguuuccuaaguuuuuugaguaccuuuucuuauagaacugguuuucuuuagcaauacaguauuugugcuugguauuuuuuuuuuuuuccuuacuugauuugaaggcacuuuugacugccagggacucuuugcuucccucccucccccucuuugcucuuguuuaguguauuugacagcauaggcuuguucauuuugucaccccagcugucaccagaccuugcugucuccauuccagcacguguggguggggguggggguggaggggcggccaggagaagaaaccacggagucaguuaccuccucuugaccaugauggccucaggggucaacccaguuuuucagucugagccaucucaccagcucccaagaaaucugggaaggacauuuuuauccuaaugguucuuaauauuccugauaagaauuuguaauuauguguuucacuacaaucccgugguagcugaaauuaaauaauaagaugauaagaugcaaagggcaagaaauuuucacacauaaauguauaaagaaaaaagcaguaagcuacuacaaaucauuauuuccaucuuuggaguccauacuuauuccuaaauacaaaauguaauaucagugagcucuugggauuugggucccauuggcuguguaguacaguaguugucucuugucuugcucauugguguuaagugcuuuccucgaauuuucuguagaugaaaguaugaguauccuuauguaugcacguuaaugcacaugcuuagaaguucccaaagugagacugucagaaaaaaaguaguuuauauaaaauaucuagaguagaugacuaguuuccauacuuacuagcaguauauuagugccuauuauuauuccaaguacaauuuaaacugaaacaucaguaguaaccaguguuuguugguacauuucagauauuccaggcauuauuacauguauuaucuuauuaaauguuuuuaguuccaucuuaaaagccacagcuugcaugugagcaagaaaacauuguucuuaauaauugucaguguugacuaaagugcuguuuaaagcacuuuuccuuccuuccuuccuuccuuccuuccuuccuuccuuccuuacuuccuaaaaagagacagcaucucucuacuacugcguagcccuggcuauuagaaacucacuauguaaaccaggcuggccuccagcauaagcaagagaucagccugccucugccuccugagugcugggaguaaaggcauguaaccaucacacugagauuguuuuuaguuucuuuaaaguuaaaagcauugcuucaacuugaaaauuuuuaugaacaaaacuuuuauaguuaaaguuuccauuuaaacaagaaaauguguauauggucaugucuauaauguauacaauguggagaggccauggauccucaucuaacagaccuuuuguaucaucaucauucagaguagccagugugaacugcagcagcguuccuaggcauugcaucaguuuucugcauaucccuaaauguuucuugauaguugauguuuuuuccacuuugcagaguagauaaagugaguuuuaggccuuugcugugguuuuuauuuaaauuuucaccucacugauuagcaaauccuuguguuuugcauuguauuucuuucucugcuauaguaauggagcuguaggugaagugugucuuggaaaaagguguguguuaguauaaguguuaauuuaccacauaacauuacauggacugcuaugccuuguguuuaucuuuccugaaguuuuuguugcuuuggaaagguuaugucuuaauugucuugguaguauggaugguguuuauuacauuucuuauuggcuuuccuauuaggguaauaacuacagacaugaacccuuucuaaacuuuucuguguguuugugcucauuuguuugagaugggagucucacugaauuugaagcuaauuuuucccaucaaacucaaaauucaucugucucccucccuccccucucaccuggauccugggguuacaggcccaccugaggcacuagauuugaacucagguucucuagcuuucacuggaccacuaggucugcaggauaucucauccuugagcuauuugaauuuguauccuuccuuuauccuuauuuugaggugaucuagaacccaguuaaggagugcguagacaaaauuagaaacaaaggccaugguugaggucuauuucagagacagacuuagcuugugacauuuugagacuuuauuuuguauuucuucuuuuccccuauuuuucuuucuuuuauuaaaugaaaagaguuuaaaacuugucuuauugaaaauagauucuucucauauaacacaucccaaucauaguccuuguucugugucucuguguuguacgugugugcgugccaguacauguguguguccccacuccaccuguuaccuacauacuuuuaauuauuuugggcuuuggcugacuugugaggcuuuauuuaguugugugugugcauguguguuuugugggauuugggugugggguuuuugcuguucuuuguuuuuuuggugguugggagggaggggaggagguugguuuuguucuuuuuagucaggguuucucuguguugcccuggcuguccuggaacucucuguaguccaggcuggcuacaaacucaccugccucugccucccaagugcugggaugaaaggcgugugccaccagcacuggcuuuauaauucuguaguggguaucauuagaauggagguagagaagccacaggcuagugaggcuuuuccucacuguaagauuauaugggauagaaucuuauauuuuaggacuaagauuggauaaaguuaacaguuucccacugcuguggcuaaaccauucucacagugcugugcuuaguuagcaucuuagcuguguucuguuuaaggucuugacucuugcucccccauuacauuguggggagagagagagugcucuuucuugcucugguguacugauauuuaggucacagaaaauggacuuuauguguuguauguuaagagcaaugacagguuuagggguuuguuuuugucaaaucuccauauugccucauuaauuuagucuggguccccaaaccuuauggcaacuuaugguauaugagcuggucugaaguuagaaugagugagcaaacagguuucuuccgucacuaacuacucagaccaccuucagaugcaacucaaagccauauuguuguauuuuaaaauuucuccauuaagaauauauguaguagauaucagaaaugacuucuuaaaauaacuucagaaaagugaauuacuuaguuuuuaaaacaauucuguauuuugugaauguuuuuaauuugacuacauuucauuucaauuggucuagguauucacagagacccccuugccucuguguccaaaugcaggguuuuuaaagguguaugccacuauacccauuuucagguguccuuuucauuguuguuuuguuuuuuuaauuaccuuguauuuuguguugaggaugugucuuguguauucaguuaagacugucagacuugggagcugagcuauugugguggccugugguucaguggcuaucaugcuuaagguuuuagaaggauggaacuagagacuugguaguaaagaguguuuaugcuguuauguaaagaaucuggucguaauuuuuaauaacuaauugauguuuuugaaaucacucugauuucuaaauuuuugcauuauuucuaggaaagaccgggaacgagaucgggauagagaggaccgaucuaaagaucgugaccgagaacgugauagaggagacagagaacgggagagggaaaaagaaaaggaaaaagaauugagagcuuccaccaaugcuaugcuuaucagugcuggauugccaccuuuaaaagcuucucauucagcucacucaacccacucggcucauucaacacauucuacacauucugcccacucaacacacacuggacacacaggacacacaucacuuccacagugcauuaauccauucaccaaccugccccauacuccucgauacuaugauauucuaaagaaacgacuucagcucccuguaugggaauacaaggauagauuuacagauauucuuguuagacaucagucauuuguacuuguuggugagacugggucugguaaaacaacacaggugaguuguuaaauaccaugguaaauguguuaugugcauguuuaaacuuaagaugcugauugggucuugguaguucuuuuccauugucugucaacucauuuccaguugucuuguagaguaccuugaagaauaguacuuugaugaguacuuuuuaaugacuuuaagagugugauucaaguagagaguguuuaguuuuuucugaguccacauaggaaaaaaacugguauauucucaucuuguaaguaugacagaaauaauuuccaacacauuuuacccugggacaauacagacuuagaaauacaaaguuuguuuucuagagcuugaguagagaaaucugaacaauuggagcaguugcuucuacucccaaguauuuguuagaauauuuugaauuaugugaauaguguuuaaaaaaaaaaacuugaacuugccagucaugauaaugcauaccuuuuaauuccagcauuuagggaucagguaggcaagucucugaauucaaggucgguuuuaucuauauaaugagauccuuucuuaaaagaagaaaaugauuagaaacgcuacaagguacaaagugugguugugaccugcauccaucugccucuagcauacaguacuaaacacuguuaaaugugucucaccaggugcccaguuuuuaaacaugaacaagucgaucuuguugauagacaugcagccuguuuuauauuuuguauauuauugcaucuauuuauguguguauguuuguguauggaugcacccaugccguagcacauguguggcaaucagaauaacuuagaguuauuguucauccuauggguauugagaauugaacucaaguuguuagccuuaauggccagugccuuuaacucccucagcugacauaccaaccucaggcuuuguuuaaugacuucagggauaaguauguuuguagauuuugaaauggcuagauuuauuacaguuguacuccauguagcuaaaucuucuuuccucauggagcauagcaaauuacucuugaaacaucuauaaacuuuuugguuauaucccugaacuguuaaucugaugguugaaugaaguacuuguggauuuaauaggcacuuggaaagccauuaguuaaaaaaaguuucgucuugacuacaaaaguugcuggacaugguagacauuucuaaaauucgggaagauacugaaauuaacuuuauaauugucuauuuaauaugcaaagauaaaaggcauuuauuggcuuacucuuuacguuuuuaugaauguaggguaaacauuuauaguuggcacaugcugcuaagcaagugcuuaucacuuaucacugaccuguacauucagaccccccugccccccccccuuuuuuuuuaaggaaggaucuugcuauguagucugucuaggcuugcuucuaguuuacuguccugcugccugaaccuuagguguggaccaccaugucuggcuuaggauuuuucuuuaugugaucaaaguugaguauuucauagagacauuuugauauuguagcaaccaaaaauauuaaaagacccaauugagggacaacuugaugcuaauaagaacucaaacuuuuagcuguggaugaugacaccuuuaauuucagcgugugagaggcagaggcagggcaguuugaaggcagcuugguauacagagagacccuguaucaaacccuuaacuuuuaaauuuaauguguugaacucuuguaaaaaaagauucaugagaauguagcuuuaacuuuauuaauaucaguagaauuuuaaauuauuucacgugcuauuaauaaucuuuguuuaguuaguguuuuuuggaaagucaaaccauauguauuuuucaugcuuuuccauuuuaaguuuuuuuuuuaaaaauaaaauagaugcauugaagguaguuugcauugaacagauggacaaacauaaaaagagaaccaagugcugucuauuaagguggaaacuagaauugggaauauguaaaauauguacucuacuagaaaaguuuugucugaaaaaaauuugaugugggaaaaaaauucaaguuuauacaagauggguuuucauuaggaauuaauauguaaaucuauuacuuucucauuaguuauuuuaagaguacaaagaacuuuuuugaguucuuugagauuugucaaaauaaccaaaaugaaguuaagucauucauuucauuggaauggauuuuuuuuuuuuuuaaaucugaagaguuuaaagaacuuuuaaccugcuagucagugcuuugaauuucacaacagaacaucacuucuuaccuguuuuuggaggaggguuggugaaacgaagguagauccucaaagcuuuccuaggaaagcacugugcuggccuccagaacuaggaagauagucuugguaguucuucauuuaggcccuugaaagacauacacuaguuucuuuggagaaaaaguauaauugucuccccuuugaguuauuuguuuuaugcaugaacuagcccuaauugaaaaaguaaucuacauuauauaacaguauaucagcuaacauuucucaucagaugucaucauauaaauucugaaauccaagcuucuccauuccuuaggguuucagaagcuuugaugagacagaucuagguacuuuuguggaggauucuuacugaagauugugagcauuuacaucuuccuguucaauuaaauggcuagagaacuaaaccaugagagaagcccuucccgucuacguaguguaguaaauaggucaccauaaugacccaucuugagcuucacauuuucuuuuccccuuuucccuuggcugcuguucucaguccuuuugaacuugaggguggccguuuugauaacuuuuaagaugguaucuaaggugcugucaccgugcauccuguugcuccuaaggaaaaguuaacaguguuaggaugaccuuuugauggcuugcaguuuauauacucgugccuacauuuuuauaauuaaaagugugguuuucaaaagugcacauugcuauauuuaaaggaucgaauuuaaauuggauguuucuucugaugcuuagaaaauacuaaugguacgagcuguucuguagagcauauugagcauagucugagcugaccuugucuucccagagugugauuagguuacaucuguguuguguaugaucccuucuggcuuacagggcucauguuauuguaacuggagucauaacuucuuugcauaauugaauuuugccuuaaauaauuagaauaaaauauaauauuagauacagauaguuuguaugcaggcagaguacaaauaauuuaaaugugaaauuauuucauagauaccacagugguguguggaguauaugcgauccuugccaggacccaaaagaggagucgccuguacacagcccaggagaguggcugcaaugaguguggcucagagaguugcugaugagauggacgugauguuaggccaggaaguuggauacuccauucgauuugaagacugcaguagugcaaaaaccauucuuaaguaaguacucuaucuuuaaaauggauacuacucuagucauaguuuuuuuuuucuuccauuaguuaaggaguuuuacuaauggaauuaccaguuuuaaaauacaaugaaguggacaugcuaggcgaugacuaauuaguguuuuuucuuggugguaaugcucuucaauagauauucuguuucaguuauguggugcuauaucaucugugaaauguuacaaauaucauaaaaggugauaaaggguaaaaauguuaguaaaauuacuuucaggacaaaugcuaugugagugggauaugauuuauuuauggguaagggaaauuguguaguucuugcucugugugagcucaugggggaaucuuguucuguaauaacgugguuauacuauuucaagguccuacuucuuuauaccugcugugcucuugaccauuuugagucuuguagcuuauuuacauaaucguuuucuguguuuuagaauuaacauucugcuaaaguagugaauuuguugucuaacaaaucuuacuuucuccugcugauuuuauguauccacauuauagacauuuagucacuuuuagaaauaacuuggucacagugcaguuuucaguuguaaaaacaacuuggaaugcauggucagugacuugaaccugugguguggauaugcccuauaagaugauaaaugagauugauuggaguagcaaaaaugguauaguagcauaguaugagauucuauauccaccaucuucagucuuuugauucaucuguauugagcauugaucugucauuuuuuagcuaauauuucacuuuuuaaaaaauaguucuuucugggcagugguggcacacaccuuuaaucccagcacucgggaggcagaggcaggcagaugucugaguucagggccagccuggucuauagagagaguuccaggacuaugcagagaaaccccgucuuuaaaaaaauaaaguuucuugggugcauuucauuugaacuucauaauuuuuaauauaaucugcuuauguuuuucuccuuucuuucucccucccucccucucccccucccccaccuccccuccuccuccuccuccuccuccuccuccucuuccucuuuucuucucuucuuucugagacaggguuucucuguguagcccuggcuguccuggaacucacucuguagaccaggcuggccuugaacucagaaauccaccuccucuaccucccaagugcugggauuaaaggugugcgccaccaugcccggcauaaaguccacucuuaaaaaucuguaagaugcaguuaucaaggacuugaaaauaaaggacaauuuuuuuuuuuuuuuuuugcuuaucuuuaaaagggguaucuuuucaacauuugacuauguaccaaauuuuucuaaauaagcuacaguuaaggggauuaaaacaguuuggauuuuugagaaaguuacaagccauauuaauagcgugugugauagaaaguagaggaaggauagacuuucaaaagaugaaucuugucaaagacucagucuguuuauaaagaguaacaaacaggugcgcuaguucacagugaaaguauauuugacacuaucauauuuucuucaguucucagaaauuguuauuaagcuuuaaaaauuauucuagauaagguaagcuuauugcuauucuacaaucugcacacuauccauuaaaacuaaccugguauuguuaauugaauugggaauggguauauuuuuuauuuucuucaaggagagaaaaauuguaaugcaacucuuaguaggaagugugcuaguggcaguuuuaauugauaggacugcuucauuaagaaguguugugaaaguaccuggauauauuugcauuaacucacugagaacccagauagucaaaauuguuaaagccuuaacaugaaggucaguugugucugaguaggaagaaugugugcauagacaggucuuuacccugcauuagcuauuuuucucucuagaaauuaaaguguuugcauauucaucaaauagucaaaggaacuuuuaauacagaaggauaguagagaagacugaauuuuaaagauuuuucuugaguaucucagaauuuagacaguaugaggcuacauuugugugucuuuaaaauuaguccuacauacuacccauaauauauuuucaauguuugagacccauuacauucuacauuagauauugugcuguuugcagaggauuuuaucuuguacaaauuagucaacaugaaacuuaugagaaaaaaaaucagacauaguaucaaggaagccaaagaaacaguccaguuugaaaacuaguggguuaaggauaaaugccauugugacagucaugauucaucgugauguuuagaagaugacauugauauauaauacuacugcuauggauugaagaacuuaguaugaauuguaacaaaucuuagaacauuucucaguuuauuuucagggaacagaugacuuugaaagggaacaguuugauauucauaucuguaggaaaaauacuuuggaguugaguuuguagcaguuauuacugguuguugaggugauaagacguuuuccuccagcugcacaauagaaguagcuugauauugaggaaauccagcuauuuaccaagaaauaguacuuuagccauuaaacagugcuuuauguauugaacaauauaguaguaagaaauuaaucugguuuauaucgcucaagagcaaauauaaauacaaaguuucagauaucugaagcagaacauguuuauauggaagaauaacuuaaggaaucacaauugauggagaaacugguuugguucuuggugguguuguggagucuaacccaggaccuuaacgcuugugaggcaagugauuuuuaccagugagcucuauuucagucuugucgacguuuucaguccaagauccaauagacguuuucaguccaagauccaguagaagcaaauagaaagauucagguauagggugaaagaauuccaggcuuaugggauaaugugccccccccccccaguagguuugagcauggcccguugcacaugugugaguauguaucagaacaacuuaugguucucucuauugugugugugcaugcuguuuugagauagggucucuaucguccuuccuguccugguuuuugcuuuagaaauuaggauugucuagaacugaguucuaccugagcuuccugaccauguggaacaguuaaguuuuuugcuugagaaaguaccacaguuauuuugucuuuaauaaaacuuuucaagcauugaacaaacuuacauaagcauuucuaugccagauuacucuuaaguuauuaaagaacuaaauuauggacacaguauaagaucaaagguggcauuuuaaaucugucuugcuuaguggagcuaaaaauuugggagagaauuugagucuguuuccuaugccugccuuguaugggagcuugguggguucuuccacuuaugaggaagucagaugggcaauagaggaguguguagcuugugacgacaagaaucuugaagaagguuuagcaaaauuaugaaaaggggaagauuucaauaaagggccuuucucugagaucuuuuaagguucuguugaagcagagcauggcaaucuacugauuuauguaauuuccuuuucauucucaaucuuuauugguuaucugauuaacuuuaguuuggggauuuuaaaggagacuccguuuggaguugguauauaaaacaaaguauugauuuuggagggaucugaguuuguucugauacucuacugagaauuuuaucucuuauguaauuugagguuaagcugcaaggaagccaagaaaagguaaagacaggaagccacgguugaaauaugagagggaaaaugaauaacagacuugaacuucauuguauaaacugucacauguaaacccugaaggaaauacauugguaacaaaaaguauuuuuauccaaucuagguaaaaaaaauuuauagaauuguuuuaauauaaagguaggcauucuucauaggcaagaacaugaaagaagucaaaagaucuaccaagcaaaauagaaacacuguucaguaaggcucuuggugguagggaacauuuaagguugguacccagaggauugugauguaguagugccuggcaaauuuaauacugaagugcuaacuguguaagaacuguguaagagucuggagcaauagccaacagggcacagugacuuaacagauggggaauuugaguaccacgaugauucccucuauccuagggucuugaguugggucucagccuuguuauuagugugauaauuaguugcaaguuuucagaggaaaagggcugauaacugccucaaggauucugaguauguugaucuguguacagucgugauauacugacacucagauuaauaguguguagucaacauggcuuugcuggugguagugguaguaguacauuucuagcuugauacaucauaggaucuuacuaaccagcuuuaguuugaaugaaaauggcuuccaugggaucaaauauuugagcgcuugguucccaguugaacuguuugggaaggacuccuccaaggagucuucuuggagaugugucaauagggugggugggccauugucuguuucugucuccccagcuuccaagugauagcaagguaagauuugagcuacugcuucaguaccuuuccugcugccauccucccuguucaaggacucacccucugaaacugaaaacaaaccuccaaaaaaguugccuuggucuuggugucuucucacaauaauaggaaaguaacuggugucuauuagcuaaauuaauuuaaaaggaccuuaagaaagcaguucuauguaacacaauaauugaaaugcaguuguggaguguuagcaugaauuaaaauuugauguuugucauuguggaaugaauguaggcaaauaagcuuagggcuugagauaagagguuuuuacaugucugcuacuacuuuaagccacaauuguacaauuuaaaaguaauuuauaguaguaagcgccauucuuauugaaguauaguguguaagcuaacugguuuaguuugaucuuuguguucuaaggcuggagaguaaagaauaauugguuaguugaauauuuaagcacgugacugaaauaucguuacuuuucaaguggaauucuuucuuuuuuuuccuuucuuuuuaaucugugugcuggcaaugugcugugcugcuuuuagaggucagaaguugguuuuucuaaucauuagcaugaacucagguccuuagguuuacaagggaaaugcuuuuugcacccugcaaauagaauuagguugacuuuuaucaguguaagcuaacuugauuaucuacuuauuucuaauauuuaugcacuugcaaaaaaaacacuuguagaaggcucgcuuugaagacuugcuuuguuugcacagcuacuguuggagaaaauacuggauagaaaguacaacucagcuuucugucauucuggucaaaguguacaaaguauuuauugccuuuagagcugggaguugugaaaguauguaaaaauaauuugguuuuuguuuguuugcaguuauuaaauuuuaaggcuuuuucuugauuagaugucuuaaauuugaagcauaggcuaaauauacaagacauaacaaaacaguuguguguuugggugugucugggcuaagcauuucagccaaggaugaauguguauguauguauauaugccacaaagggcuuugauguuuccuccugguuuuugcuuuguuuuauuagaacauuaagguauuuaaaauauuguauauuucauuuuuagaugagcacaaaucuaguauuucucacuauaacugauaauuugauuuacuguuguuaguuauucuuuuuuuuaaagcuuuuuuuuauggaaagcuuuauuauuucaguuuauaugaauacacugucucuguguucagacacaccacaugagggcaucagaucccauuacaggugguugugagccaccaugugcuugcugggaauugaauucagaaccucuggaagggcagucaguguuuuuaacagcugagccauccccaucccccccccccaccucuguugaauuuauucuugucagauugaacgugauccugugaaaauuaccaagaaauauuuuuugauauacugagcuaccuugaaaagugguaauguuaccuguuauuaagauaaaaaauucuucugaagacuuaaagaucauuucgagugaccaguuuauaauggaaauaauugauagguucuggauauauauauguagacacugagauuaucaacuauccaaacguuguuuguuggauauaucuauaacauaaccagggacuauagacuguuuauaaagaguuucaguauuauuaaauauuaaaaauuuaaugacuaucuccuuguaaaacuuuuauucauauuuuaaggcuugcuugaaguuuuuauuuaauccuguaaguauuuuaaguuagccuaucagaaguccuauguuuuaauacauagauaagcuacgguaaaguugaacaacuacccacgauuuggggacugucuuuauuauagaucuguuucugcuaaaugaaagccguuuuuguuuuguugugugaauuguugucauccagaguuuuuucaauagcuagcugcuguauaauaaagaauauaaaaauaaaguugacauguuggguuugcauuugugaaaauaaaaauuaaaaauaaucugggagaaaaacuugguuuuucuuuccuaaacuguaaacuugauguaagauuggcauucuggcugggcgugguggcgcacgccuuuaaucccaguacuugggaggcagaggcagguggauuucugaguucgaggccagccuggucuacagaguaaguuccaggacagccaagaaaaaacacggaaaaacccugucucgaaaaaccaaaaaauaaaaaaaaagauuggcauucuguuauuuuuuguaaaucuagaaauuaaaauauguaggaaaauguucagaguuacaugaaaauacuaggcuaauuuauauuaaagacuucagaauucacacagaugcuuguguacugaaacaaguccugcaaggacaccauauucaaagaugacagugucuuucagaaaucucaguucuguauaauuuaaagaauugcauucuauaaacuuguuuguguucguauaucaguguauguauuugguuuuuuuuucucuuugcugugaccauaaaccagacaaacaauauaaagggaaaagcuuauuugggcuuaccuuuaagaaguggugggauacaucaugaaaaagagugcauagugguuagaagugugaggaggcugaucauaaucugucugcaguggagaagcagaaguaacacucaggugguuucuagucuaggacuucagccuauggcauauuugcauccacaucuugaguggguccuccccccuccccacuuuaaaguuucuggaaacaccuucauuggcacacccaguuuguuuuuauuaucucucauuaguuaggaauagcuuauauauaguuuauuggucuauguuauuuguauauauuuguugaaacaaacaagcuagguuagggcuauucaacaauuuuggcuuuguguuuauuuuauuaaauaauuaugauuggaagccuguucaaguuacuuguaauaugcuagcuuugaaacuuucuuauaaauugagguacaucuuagaaucaguugaagucuuguaauugauaggaguuugguguuugucauuuucugugaauauuugauauugaucuaguuuuguguaucaucauuuuaaauauauagugauuuuuuugaaauaacagaauuaauaugcuaauuaaaauacuuucagaaauacaggguuucuuauugaaagacuagcaauugauaguccagaaauguguagaaacaguucugagguguaauagguauuugagcaaauauuguugaaauaagaaccacuucuuucaugucccccuaaaaauuaaaccaagaguuuuguguacuuaaggcauuuacuggauugccuagcucgugucagcagcucaucugaaaauaauuauugcacaaugcccccaaaaagagaaaaauuucaaggcaucaagaagccauaguguggcuuaucagcuaccaggcugguuuguuaugacauuguuuuauuuacaguuauuuuucuuuuauguucuuaaaauaaaaucuuagaguugauuccagaaauagugaugguuuauuuugaaaagaacaguguagaaacacaagcuauauaaauagggaccagguaugaugacucuugccagcacucaggaguccaagucagccagagcuauauaaguaaguccuugccccaaaaucgacucacaugcauauaaaaauagugaagauguacuugugugccaaauguuuuaaaaaauuuagaauuacucuuagaguaaauaaagagggguucacuauguugucugcugaacugcuucaagagaugguauaaacugaaguuaaguugauuuaugaaagauuagguaugguuagauuacaggacaaagaaccaaaauuagguuguaaauaguggcuuuggauuuuuguuaugucacuuaaaauuuuaaguacaauaauuggcuuuuauuuaacugaccaugaacuguggcguuagcgucuuaaggcauacugugccaaacuuaagaaucuguucuguauuagugacagcacuggccagaauggaauggacagugaccuuaacaaucuuuuacaaaccacccuugaucugauacucuucuguacugguuggauuccauauuaacugccuucucugaagccguucgaagccugguuuuuuuucuuuuuugagucaucauucaguuugaugucauuugcuuuugauuuuacacccaaguaucaguauucucacggugcugaugcagucuauucucagagccuuuaugaaugaaaucauuuuguccuuuaggucauuucauuuuugguguuaaugggagcuaguagacuugugugcuguuagcuguguuacauuauugccuuaaaaaauaggguuucauuuuuacucccaaaauuuacauuuugcauguaguaauauuuuaguagugugauggcaugaaacaacuuaaaaugguuuguuuauuggcuuguuuuaaauguguuuuguuguuguuguuuguuauuuuucaggaauuuuuuuuaagcauuuaagugaccaaauuuuagcauuugugugaaaucaugugaucauucuaucuacaucaacugugauuggguguuguauuauauuucucauauauuguaguauuugguaagauuuuaugauaauacaaccuuuuagucucuuuaaacuauuuggaagcuuaauuuuuauaauuuuugcuuauguuaggauaguuuuaaaauuacauagaugauuuugaccaauguugucuuugugauuauagguauaugacugacgggaugcuacuucgugaagccaugaacgauccccuucuggagcguuauggugugauaauucuugaugaggcccaugaaagaacauuggcuacagauauucucauggguguucuaaaggaaguuguaagacagagaucagauuuaaaggugaagaaguaacuuuuuaauuuuucccccuucccuuucuccggcccugcucacuccagcuccgcucacucuggcccauagguucuuuauuuguuucucauuauagacguugugaagccaacaugugguugcugggauuugaacucauaaccucuggaagagcaguuggugcucuuaaccucugagccaucucaccagcccaacuuuuuaagugugugcuuagauaugcaugugcaggaaugugcacauaacugugggugcuuucagaagccagagguauuaaauuccccaguauaacaugguagaaauacauaagaccauuagccccaaagaaacacuugcuuuuuuuguuugauugcuuuuugagauugguuucucuaauugcuagcccuggcucuccuggauuugcuuuguugaccaggcuggcuuugaacuugaagagauuccccugccuaugccuuccaagugauggaauuaaaggccuaugucaccacacccagcuugcuuacagucuugugugagugugguagcacccaaggccagggagguagauaagugcaaauuucugugccuugcuggccagccaaccuaaagaccagauuuuuuuagauuuugaaaauagcugugcuuaauuuaaggcaaauuccuauuuggucuauugaauuuuauuaauauugcaauguauuaauuacaucaauaaaauagaauuguaucauuacauauuccguauuaacucuuuacuuacauagugagaacgaguguaucccuuacauagaccuaugcauuguuuauuuaucacauauucuaguauuuuaaaauguaaauaacucaacugcacuuuauuccuuacuauguuuuauuuuuguuuuuuuuaaaacaggauuuugcuuucuaacucugggugauucuugaacucacacagugauccaccuauuucacacagugauccaccuauuucuaccucuuuuugaguguuaggguuuaaugugugugccacuauacagccuggauuuuauuuuuaauguuucuuuaaagacugucuuuuuuuccuagggcuggugguaagacaaggucucacuauguagcucgggcuuucuugaacucagaugugccugccuaugccucccuaguucuguucugggauuaaugaugacauaccaucaagcccagccuucaaaucugucuuuauagcugauaauauauacuuaaagaacaguaacuacuuuuucuuucuuugagauuaucuaggaaucuuuggaguaauuuucuguuuuccuccuacagguuauaguuaugagugcuacccuagaugcugggaaauuccagauuuacuuugauaacuguccucucuuaacuauuccuggccgaacacauccuguugagauuuuuuauacuccagaaccagagagagauuaucuugaagcagcaauucggacagugauccaaauacauaugugugaagaggaggaaggagaccuucuucuuuucuugacuggucaagagguaucauuugcuuuauguaauuuuuguguagaaauguccauuagcuagcaacucuaaacuuacaugaccgaggcuggcuauauuuuucucaucucaguccuucagguuuuaaguguaauuguuugaauauaggcaauauuuaaccacuucuuuuuuugaugcucauauuuaaagguugaagaaaaguauacaauugaaaucguagaugguuguaaauuccuuuaaauauauggguaccuuuacaguagaaggucugaguccuauucuagaaugucugucuugaguaugcucaguagauuucuggucuaaaggaagagaauuuguuaaaacaaguucugguuucuguuuaauguuuuuugaaguaagugaaguuuguggggaaauaagaguaucugcaagcuccuugcgucauuaaagauguagggucgcauuccagagaaguguuuuaguccaaaagauccucacugugauagauaacugcaccuaaacuguguuguggaaaauugcucuaaucucaugcaaaccgaaggcaugccucacugcaccaaaaccuuuucuuuuuguuguguccaacuccuauagaacugcuaacuaggugauauuuuggcagaugccacucaguuaagagcuaugaauuugggauaauuuuuuaaaucccugguuuucuggugguaguuuuuuuuuguuuuuguuuuuuuuuuuuuuguuuguuuguuuguuuugucccccccucccuugguuuguuuuugaaauuguccuuaugauuugugucuuuggacaugguuuucuuaaaauacuauuuauagugugaguuugaaauuuuuguguucucagauuccuguacauuguugaacauuuaucagcaucccaaccuuuccaaauauuagaugcagcaauacuuuuuaggcaaaaccagcaaagacauuuagauauugccaauuaguaaauuaucuuccuguggagauacacucccuuaguucuuccgugagcuaaggauguguugaaaauacagauuucuggucuucccucuuuugauacuacucagccuuuuuaugaaguuaaaauggaaauuuuuuuauaaaacuucugaaagaguuaacuaauugcuucucuaauagcaugugaacaacauucaugcucuuaacuguugaagcuaauguuugguauucauuuuguccucuuguguuuggucucuacagcuucucacuuccucuuaacuuaaucuacucugacgaggcauauuugaaagguguuagaaguuucagcugaucucauggagagaaccaaacgggcuuuuuuucugagucagcuuaguguaauucaucucauucauuggggaaaggaaggcaggaagccuccuguuuucagcugugugcuggcauguugugaaaugaaguaaaauuauaguugugaacucuagauauguuuugaguuugaagacuuucagcugguuuguuuugcauagauuuauuauguuaaaagucuuucuuaguacaugaaauguagacguuaggcuuaucaguuaucuguuaaugugugcugggauaagcaaaucugaaauauuaggagucuaauuuucuuuauuuaaauuuuuucacucugauagggaucuuagcuccauguuuacaugccagcaggggcauucucaucuauguagagcauuuaaaagccaucuuuuucuuaaaaagacuuuacuuuuuuucuuuuuuucaaauaaauagcauugauuuuucauuuucuagaaacuugaucucaaaacaaacuuuggauucuuaagaguaauuuccuucuaucaaacaaccuuaagaaauuugcuauuuuuuaguuggcaaaaaggguuauuauucuauccaagaauuuuauauuuuuuaaaguuuucuuuuuaaauuuuguguguacgcaugcaucagauguguaccuuguguucucagggccagagcagagcaggugggugugagcuaccauauuggugcuaggaauagccaguaacugcuggccaaccucaaaaaauuuuuuuuguuuaccuuuauuuuaugugcauugguguuuugccuacauguaugucuaugugagugugccagaucuuggaguuacagacaguugugagcuuccauguggaugcugggauuugaacccugguccucuggaagagcaguaguucucuuaacaguaagccaccucucuagccccaaauuuauauuuggcacagaaacuaugucgguuuaaaaucauuaucaggagaccuaguuugauacaaaaccaauuuaccugaaaaauccuuuuauuucucuugaugauauucuuugaguaaacaacuuguuacuguagcugucuaguuaaugcaugaaagauuguuuauuaauuguuuaaucuauuuucaaguuuaauugcuucagcaaacauuuauuguccaccauccaccuuccuuuuuaaauccauuugcugccuccagagcugcugcuccuuucccaaaugcauuuauugugucuuucuuuaaauuuguauuuaauacaaaugcauuggauuaguuugccaugguggagaauauucugaaguggcucuaaggcauuugugucacauacuuaugaaauaucuauguugauacuguaaaggugcuuguucuuauuaggcacaaugaagcaauucuuccauauaauugcauuagugauaugugacauuaaagccuaauugcuguauuuuaaauaucuaacacaucaguuucuuuuagauugugaaaaugaaaagguuaugggugcaguuaaauauuccugggugagaaauuucaauuuuaauaaaauuuguugagaauuaauuaggaugucugagucuucaagaaaagggguauggaaugcaaauaugguauuuacauauuuggcucaauacagaaaucaaaauuucuuugguuguuucaaaaucacacugaaauuuaauuuugguuaccaaguuugaaauagguuauccaugaaaugaaggcagauuauagacguguugaauggaaugcauaugaagaugaguuuuguuuucauacucuuuuaacauuuuuauuuuguaggaaauugaugaggccuguaagagaauaaagcgugaaguugaugauuugggcccugaaguuggugauauuaaaaucauuccauuauauucuacacuuccaccccagcagcaacaacgcauuuuugagccaccaccuccaaaaaaacagaauggagcaauuggaagaaagguaacauuaaauacucucuauagccuuauuauuaacaguagaaaaccuaugagauaccgucacucauaaauuagaagcuagaugccaugguacaugucuauggcagaagaggcaggaugauaaagaauuuaaaacuagccucgguuaugaauggaaccugccuaaacaaaaggaguuagcaccaauucaaggcagccuugcuuggucugcauagugagacccugucucccaaaagaaaacaacgaaacgcauaaucacugccaucagccauccaaagcagggaugagcgauuggccacaccaguaaucuguauuucagaagagaaggaaaauguauuaaauuacacuuuuguuuguacccuuuaagaaaaagaacuacuuucucccacagaggugacuuguucuuagcagaugguagaauauuuaggaugaucugaacaaggaagggaaaguuggccaaauauugucuuucuccuguuagauaugacaguccaaaacuaagugacuuuuuuuuuuaagguuugugcuuuguccccuucuuagaguugacuaagagaauagaauuuuaagucgacaaguguuaaauguuggcucuauacagaaucugagacauuaaucacacugaauaaauacaugaaguccuugaaggcacgauucauauuaauauuguuugguagagggauaguaguuuucuugggugagggagcaaggguacuccaacugaggcacugugcucaguaccacuuucaacauaaguuaagauguuaaaauugaggucuuaguaaacuugaaaauaagacugcacuguugaaaaauaccagagcaugaauucaacuugagaagguucuugcuaguuucugaccuacuuagcgcuucauuggguuaaaguucccaucagugcauucuuuaggacauauauucugugguaguuaguaugcuguccaggaagagccugaaggacuaaauuuguggugaaaguauuuguauuuuguauauuugucauuuuacagugaugauuuauuuuuaauuauuacacuaagcucaaaguuacggcaauauauaaaaacagaaacaagaaaaacuuagucuagacuggucuugacagucauucuacuugaguuuucuuaguguaggaauagcguguaugaggcaccauucuaggcaaaaauagguuuuuauccuguugccuaagcuauagcuaauuacuguuaagccucaaaaugcgaauugcucagugaaaugggacauggcccuuguggagaugguuccaugguuuugaaaggaggguuauugaucccauuauuuaaagauaguuaaccacacacgcuaauaaaugucuuugaauuggaggggaauauucuucauguucugguggcuaaaaaaaaaaagaaaauuagcuuaauuuagguaauuauuguggacaaacaguauucaagcagggcaauccaagcucccuaaauucuauuugaagagcaguuagugaacuaaauauugguuuuauuuaguuacagauaacuuaaaaauuuucacacugaugccagcugacugagggcuuauuuucuacuacagcaguguacuuuaagagaguuuccuaguccugagauuuuaacacuuugcuaauuuugaacacauauuacaaaguuauaguccagaacaugcauuaacauuccuacuuuccccaagcaaaucccuugaccacuugaggaucacuuugcugguuaguuccuaauugacuggugagcugcuacauccagaucagguuuacuacuugcuuuaccugguugagguugcaguacagcucuguaaaccgucucuugcguaugcucauucauaugugugugugugugugugugugugaucuagcugcaccugcuguuuucagauuuaguggucaaaucuauggaaacaagcuucauucuaacaacuauugugaaaauugucccuuuuuguuccuaaaacuacuacuuuuuauggcuuuaaaauccuguccuuucugugguagagacuucagugacuaucaaacagaagacccaggaauuugaaauaugccuagcaacagauacuuaaaaguuaugacauggaacuguauuuguauuucuaauugaagcaggaaacccugcuccauaguuuugguuuucuuuguguuacuugugggcaucauaaucuucaaauacuaaauuuuaggaaaaaaauauaauucccaaguuugaaguuacgcccuguucuaagaagcauggugacguuuacacuacccauuuccucuuuuugcgcacaaugugaaccuccaucuauuccucauauccagaggguguaugcuacuugaaaauugauuaucaagugacaccaguguuuauguucuagcauagauacucacuuguaauuccuuaaaguugguaacaucgugaacuuuuaucacauuguauauuagaaaaacccugugaaauguacuuuuaauauaacaaaauaauugucgugcuuugcugucuuaaauacauucagaaccaugaucuuuuuacugaagaagucaaagguacaugauucuagguauuuauauggcauuucaaauaucagaucucuaaucuuguuccccacaaaccuguguuaacuauaacuagucuaguauggggaguuuuaaaaagcaaauugacacuuaacaguuauucugauacuugguuaacuuuguucaaguacagcaaaacuuacaagaauagugcaguggguucuacucuucuuaccauugguguuauuaggccuuguuucccuucuucuaauuauugauuguauaaaauaugugaucuauagaaagugaaaauaacuucugcuguuuaucaguguuuuucuuaaguuggccaguguaaaagacauuuuuauauuaaaaaauucugaaauacuuguugcuagaugcuaagguuuucugcuaguauuuuggguaauuuuccaguuauauaugaaaucuauauuaucuaaacuagugaacauuaacacugaauuuaagcuuuuugaauuaaaagauugcucuuuuuuuucccgaaguaaacgaauggggaugaauacaaguucucucaguucuuguguguuucuauaguuguacuuauguauaaacccuuggcuaacauucagcuccuauacuaaaaagcuauuuuuaucuucaaguagaagauaaccccauuuuaaaucucaaagcauuucuuugucauuuacacuuucagugucuaaccucaccuugcaaauuacaaaggcuaugugggagcagacuuugauacaucucugugaacuucuugaauacaugucaccaaaugucagcaucaccaucaagaaacauccauuuccuuuuguuuuaguagaaaaaguauuuaaugccauuucccaaguaaaaccaauuugucuccccugcccccucuuuucuuugacaaaacuuaauuuuuuggacuugccagucaagcacucuaagcugagugagcccucucaaacuacuuucugaggucauucuaaaagcuaagaaaaauguacaaauucuagaauagacuaucauaauaguaugugaaaugcaucaaguaucauucccuguaauuuuuuuuuuuuuuuuuuuugcuaaauuacauacucuuguuccuaaaccuuuuacauuucauugugaugaucugccaauucuuacuggauuguaccuugguuuuguuaguuuuugguuuuugcuuuuauauauuuaauuuuguucacuuggccacuuuuauuuaaacuauuggugucuuuguguuauauauguaaaauuuuccuugaaaauauugccuggaaauacuggaauccaugcuuugugaacuuugaagggauagucaaucuaagagguguuauaaacucugccuaguaguguguguuuauuccuuggcuuuugacgcccaugcuacauguccuuuuguauagucacugugcuugauuaucauguauugaaaaagaauugcuauuucagauaaauugaaaugauuaauauuacacuuuuaguuugucuuauuuacuaguuuaaaacuucuuuuguuagugaugguaguaguggcaguuaagucaugguaauuuugcuuaauuucugaacaggugguggugucaacuaauauugcagagaccucuuugacaauagacggugugguguuuguaauugacccuggauuugcaaaacaaaagguagcuauggcugagggugccaaaugcuugcucaucaaauagcuaaaauaguuuuucagguuacuucucuaauuuuggguuucauuuucaaauguauaacaugauaccuggguucucucucgcugucggauuaaugcuguguucaguaaucuaggccacacuuuccacaugguccaguauaaaaguuuuguguccuuuuauguauaaugaugguguuuuaggcauauggucucauguauggagaaaagugguaguaauagaaaauuguggaucaugcuuauguagaucagccacuuguccagaauuaauuuauuuuguacaccuggcauacuuuuggaauacuuuaauccucuagggaaaggagccaguuacuucuaagugaacaguugcuaaaauguucaaacauguuuuagauaaguuauuacauuguaaucuuuagguguauuauuaauagaaaaauuucucauuaaagugaauacaugugacuaacuuacugccuguucuuaagaacagauauuaaauugcugucuguuugucuuuccuugggguaggggacaggcaaaauuuuuuacuaaacaacauagccaaauuuaaguuaagaaagacagauguauguaugcuagucucuuggaaugguagccagaaugccuaaaagaaagguagaccaugagaugaacaguguggaagcugauugucacggucagcaaacugucagauauuugacauuaauuguggccugcgaguguuguguugguuuuaauuaagaaucauaaacuguuugcauucuaauagguauauaauccuagaaucagagucgagucucuucuggugacugccauuaguaaagcuucagcucagcaaagggcgggucgagcuggacggaccagaccugggaaaugcuucaggcuuuauacagagaaagcuuauaaaacagaaaugcagguaaggaguaaugcuauaccaugcgcauuuagaacacugaacauaguauucuaguugaagaaacagaacuuccuuuauuucagcuaaccauuuugaacagugguucucaaccuguaauuugccaucucuuuugggauuccauccaaggccaucagaaaacauggauauuuauacuacaauucauagcaguagcaaaauuaaaguuaugaaguagcaaugaaaauaaugguuggggggucacuauaacaugaggaacuauuaaagggccgcagcauuaaggcggcuaagaaccauuguuuuagagccuuaagugccuuaacuuugccccaaaugauauaugguauugcguauugauacaucugauuuauauuuaagauuucgaguugagguggcuagcuccaaagcuuaaauauuauagaaguaguugaaaaaauuaugaguuuuuuuuuuuucuuuuaggauaauuucaaguauuuuuccccugugagguaguuacauacaaguuauguaaugccaaagcaagagguguaagggggcaaggacagagaguaugaugaccauaacaugcgcguuuccuuuuauuaggacaacaccuauccugagauccugcgcucuaaccuaggaucgguuguguugcagcugaagaagcuugguauugaugacuugguacacuuugauuuuauggacccaccagguaugacugacaacagcgccuucuaucagcucugcuaacugaagagguuucccucuaaauucuguagauuacauaugcauuaaguacacuuaccuuuugcuuccacucugcacuaaaauugguuuuaugggguaguguuaaaacuuaaaagaugguggcaguuaaugaaugagauaaaaauggaauggaaaaauaauugucugcuggcuuuaauuuagucuuacuaaagauauccuaaagauucuggcuucuaaauguaggaguuauggguauuucccacaaugccuggcuugaaagucauuuuaguaugguauuguuugcuuuaucuguauuauugaauuugaugacaauuucaguucugaacuggauccaguaaugaaugaaaaaugagauugcuuauaauaguuuucacuuugucauauuuuugcuuacuuaagacaacucuucuaauagauugccuuuuucucuuagcuccugaaacucugaugagagcccuagaacuuuugaauuauuuggcugcuuuaaaugaugauggagaucugacugaauugggauccaugauggcagaguucccuuuagauccacagcucgcuaaaaugguuauugcaaguugugacuacaacuguucuaaugagguccuaucuauuacugcuauguugucagguaauagagggagagggaccaaaaacccagcucuucagaguuuggguggacuucccuucuguuggcuacuauuauuauuacugucauuaucauuauuauuaucaucauuacuacuacuacucaguaugguaauagauuuuacagauagauuuaaggaauuuaguuuguuuccuaaauaccuuuguaaaaauucuuacaaaaguaaaguuuuaugcacaaaauauaguaaaacauuggcucuauugaguacagacagaaauugcaauaagaauaaaugcaauuguaacugcauuuuuuucuuuagauccauuauuuucauuuuaaugguuuauuaaaaguacugaguccuuguuacauuuaaauugagccuuuccuacaucuauguguauucagugacaaaccugaguuuccgauuuagugucacauagaagaaguaguaauguauaauuugggacuuaaagucaaaaacuuauuuugguguucuuuuacaauggcaguaaaacaccugcuuaaagaaaucuucuuuuauaaacuugaaaauuuuuaaacauuagauguuacauugagaaaauagugcucuuucuuaguggcaauaaacuuuaacuuggaaauuagauuuccagaaaggagaagaaauacugcaacaaaaagauuuuuuuuuuuuaagcuaaaaguaaucauaguacuguauacuacuagugucaguacugggaagaacugacuuuuaauugcagagugguuuauugguuuugauuacuuauugccauaaauuuaaaaauauggaauuaauaauugaguuuucuaaaaauaaaauuauggcauaguucagauguaugguauauucuaauggugugacuuuuacuuaagaaguagcuaaauguuuucuugcagaguuaugacugaucagacucagagcagaugggcagggcaguaucaaugcuuuuaauaaauugucucauuugcagagguggugguagguuguugucugccuugcuuauauguuuguuauauucgcccguuguauuucucccagcgacuuuaguuuuuagagaaaggggcaagaauuauuagauagugugcuuguguuauuugcuaggauuuguuuuccuguagguuuuuauuaucagacacaguaaacagugcuguuguuguguuuagaauauuaguccuuuacaguggccauuguggugagauugaacuccucaagcuagauauugguuuuauguguaguaggaauuagcgaaagcucgggcuugcugguggucgucuuuacacuguugagaaugaacauacagaguguuuuauuuuuaagcaguguuauaauugaaauugcagugaaggaagagucaggacaaaaagcaguuagagcuugugaagcguuuucccucuuuucuuuuuuccucauuaguuugagguucuguuaguguuuagaagcugagcuguuucuguacuuuuaugaguuaccuugcuucaguuacauuagcaagaccuacaaugcuuaccgugauugcuuuggugucuuuuauuuggcuacuuuggcaucuuaaaggggagaacuauaugcgaaagaguaauuuggugcuguguuugaucucauuguugauuauucccauuuucuaucugaacugaucaugauuuuuauuaguaagguuauaagagcuucaaaauauauugaaaagucccaagcuuguuaaguauuuauuuugauacugcuuuuuauaacuauggaauugcuaaagugaauuaaggaagguuauguuucaaaauaauguagcacauauuuuguaaguuugugaauuaaucuugaggcucuaaaaacaacuacuguaguucaauauuuugaugacccuugaaauauugacuuguuucagacuaauugucaauucuuuaauauuggauuuacuuuuauaucaaugcuugauucaaaauuuuuuaaacuuggggcauuaguaacuuauuauuuuuuuuuaauuauuaaaaugcugcaacauuagacugaauaucccagccuucuggaauuuucuuaauucuaaggcgguuuaaccuuccaccacuacugcuauuaucaaacccaagauuucuugaauuuuuuuuuuuuuaauguuuacauaugcuuuugcuuaccggugcuaauagugauacccaccaguugguaauagccacagauuuagggaaacaauuuugauagaaauguggcaguagacugguuguuuuaguuacuccgugggcaaguacagcuuccuaacuacagccauucaguggguugaguggauggccuuuugaaaauuuacaguugacuaaaaggcuauugauaccauacuucugguuauugguagagcuaucagcacugguuuuugaaauaaguugagcuuucuaguaauuugauggccuucagaauagcuguuuugaugccuacuuuuagaucuaguuaaaauaaucagguacucuguagcuuugaaacccucuugucuuacagaugugguuaggugauguaccaaaucaagguaguaaacaguccaagaugcaguuggaggccauccugcccugcccuaugcucugugaacugaccuagcuaggccuuguuccucuaucugugaaugcgugacucaucgauaugggcguuuguguugggcccauaccaaccuuguuuagucccacaguguuuuguucgccccacggaggccaagaaagcugcagaugaggccaagaugagauuugcccacauagauggagaucaucugacacugcugaaugucuaccacgcuuuuaaacaaaguaaguaaacuuagguugaagguguacucuuaugucugaaugucacuugcaauguagaagauguuuuuucaucucaauuucauuuauaaucugugacaagguucguuagaaaaacuccugacuagcauuuaaaguagaauugccaacucuuucaaauuuguuuagguuuauaaucaagggaaagaggaacaaugaaagaaaacuuagaaaauacagugauacaaaugagaucuguauaaauuuacugccaacauagaagaaauugugauacgcuucauauuuuauuuccaaaugucauuuuuuucaguaauuuuguauuacuucauguaaucuucacuaucauuuuuauaauaaaacuaacaaauugaacaagcauucgguuugaguuccuguucucagucauacuacaaauggucuguagaaguucacuugcauuguuucucaccuauaaaauuaagauauuaguugcccacuuaguuauuaaauuucucuaauuuuauaucaaagcaauuaugaaauucaaauauacuaguaguauuuaaguauuuugacuuuuggguaggugaguuuggugaaaauauuaaacaauugauauccaaagaugucuuacucugcuuauuguauuagcaacagaagccagagguagaaaaugaauuagaaaguaauauuaauucccuagaggcaugguuuuuaauuaaaugcuucuaguuacuaggaagggcgugguaagccuugguggguuuuagaccugugacucuugugucuuuguguuauaccagaggcaguaaagguacgugauagaacagauacuuucaaaguagaacagucagucuuacucacgaacugcuaccuuuuaaaauacaagcuuuuggggcuggauagaugacucagugauuaggggccccuuucaauucaguucccagcacccacauuggauuacaacuguuaauucuagagcaucugacgacuugggccucccaguagcuuaccugcucacacacagaauaaaaaauaaaacaaaaugcaguuuuuaaaaacaaaacucucaaaucaccauacuauuauuugaauguuucauguuccauuuauugagauuuuuuuaucuuguaaauacagggaagcuaagaugucuuguuaauaaaaaugacaucuuaauaucuguacaauguuuacaguuauuuuguaacaccuuuguagggaggccucauucuaauaaucuacaagugacuugccuuugaauguuuagaauagcucuugacuagcaagcaucaguuuagauuuuucucugucccauuuaguucuuuguuuuuguuuuuuaucaauuuagaaauaaugguaucuuaacuaacauuaucauuugauuggucaguugguuaguuaguugauuuguccacgcagacauuaaacuuggguaauauguucuuucugaguagcuaggacaagagauguguuuaaccacaccaagcucuuguuagucuuugaugcuugaguuuuaaagauugggaaacuuuaaaaagcugcucuugauuaugguaugcaaaugaacaccuuagagauuuucauugcccagcuuuuggucauauucuuuauuuggaagauguauuucauauuccuguuugcucuuaauucuaaaauggcaguguauucuguaaaaugauaagccuguguacucauuaagucuguuuaagacuugauggacuuuucaguugcuugaaucccccagcacaaaacaauauacuacagauauuauuagaguagccgaggaagaccaaccuaguucuacauuuuuuuuaaagauuuauuuaucuauaugaauauacuguagcugucuucagaagagggcauaggaucccauaauagaugguuaugagcgaccaugugguugcugggaauugaacucagaaccucuggaagaacagucagugcucuuaaccacugaggcaucucucuagcccugguucuaguuuuuaaugcuuucuuuuuuuacacuuuuucaguuuugccacccucucaauuuuaucaguaucaaaagaucugugaagcagaugaugcaguuuuccugugugauugucacuaagaauaggcuacuccaaaaggauucuuuuccuuugauauauuugguaccuuuugagcucuugaguugaauaauacuaauuggaaaguuuuucaagaaaucaguagagaaauaccuuuuugauaauagguaguaaaaauuauuaauucuuggcaugcuuauucauaauccuuggaagacacagauaacaacaaaaucuugcuugucaauugcugacgcaaagguugcugcagucagaauuuagcaucuugguguagaggaggacuaguuuaggcgcaguuagagagcaucaugcuacuuguuugaaguucacuucauuaauguuguauuuuauuuucaucagcuaaggcugugauuucuuugaaaaugagcaaaaucugccauuuuaccaaguucucugaaucuaccagugucuaauaaauccuuuguuggaaacagccagguggcuguuuauagguaaauaaaucaauuugcuaagaaccauugauucacaaucauuguuuuacuaucgauuagccagaaaccuuagaacuguuucuuugaauucauuugaaccagguuuauugcuuguuuucuuuuaaaaguugauaauuagcugggcagugguggugcacaccuuuaaucccagcacucgggaggcagaggcaggcagauuucuugaguucgagccuggucuacaaagugaguuccaggagggccagggcuacacagagaaacccugucucgaaaaacaaaaaaacccaaaaacaaacaaaaaguugauaauuauuuagagaaaauguauauaaauguucucucuuuguuguuuagguuuuacaucuuucucacuaaagauuuuguguuauuugugggucuuuguuauuaucuuuuugucugugggugaaugcaagugccccaggagaccagaggcuucagauuccccuggaccugcagcugcaggugucccagugugagccaugcaacaugggugcuaggaaccaaccucugguucucuggggaaaggcacacucuuaaccacguagccauuuuuccagcgcuguagccuuuuuuuuuuuuuuuuuuuuuuuuuaaauaaaaaguugccuuucaaauuuucuccuguguggaugauucaugguccccucuuuuuccuuccuccccuccuacguuuuagaucaugaaucuguucagugguguuaugacaacuucauuaacuaccggucccugaugucugcagacaauguacgccagcagcuaucaagaauuauggacagauuuaauuugccucgucgaaguacugauuucacaagcagggacuauuauauuaauauaagaaaagcuuugguuacuggguauuuuaugcaaguaaguaguuaaacgaccagguagaauuugcuuuugguuuaguuugaguuaagaguguauaaaauugguucuuacuguuuugucuaguuucuuuagaugacuuauuuaugcagaaucaugucuaaugaguaaaaguuagugccuuaauuagcuaaguuggaaguuuuguuuguuaagauauaauuuuuaaaguacauagcuuuuguaacuggagucuuuguuguaacacauaauacuuuggccauuucagguacaaauauaaauguuagcccuugaguuuugacaaaucuauuaaaguuucucaaaaucuuggucuuaguuuaaaguguauuauguauuaaaagaccaccagugaaguuguuaaaugcaugaauccaaaagucuacaguuuauuuuccucuuuaaacuucuccacauuauuauuauuuuauauauugacuguauugccuaagugugugugugugcguguccacuggaagaacagcuagcucucuuaaacuauugagccaucucuccauucucuguuuccacauuuaacuaacuacauugccuuuguguuuguacacaguacuuauugguauuuaugacuaacuuggagcacuguaaaauccaaguguccuuuagcuauucugaauuuuucuuuauaaguuauuuaauuuaaauguauguauuagaggucauuggaauucgaauaaaaaagcaaauaaauacccuuaguagguuuuuaaaauuuuuauuauguauggguauuuugccuguauaucuggauaacuugcaugccugguacagguagagguuuucagguacucugaaauuggaguuagaguggguugugaaucaccaugugggugcugggaauuaaaucugagucucuugaaagaggaacaaguauucacugcucagccacuucuguagguccugaaaaaucgaagggucagguaaaucaaaaugaugcuugaaacuauucugcuaguuaaauucaaaauacauuacgugaguugaaauugcucuuuaaacuuaucucucaugcuucuuuauucuguccuuggauguuucuuaaaccaguuacauuagccuuaaagccauuuguguucaauagcuagaaggaaucuggaugcauuugguuccauauuaugccuguaaaguaucugucuuugaauuaaaguaucagaaaaaaaguggauuggugguuuugugagaaugucucacaaaagggugacuuuaaacuccaaugguucuuugccuucugaaaugcugggguggcaggugaccucuaauacauacauuuauauacuaguauggacuagcuuuuucuugguauuucuuaguuuuuuucucugacacgcacacgcacgcacgcacgcacgcacgcacgcacacuugacugauaaauuuaagaacuguaguauccuaguuagcuccuauucuaagaagcagcaacaauugaagugguacuugacaccuaguauauauucguuauauauauuuacuaguugucauuaagucaugugcuaugcagaguuguagaguugggaauggcaaagacucuuguccugcauuauuaguuguuagguaucaugaauauaaguguauaauuaggaaaagaaaauaugaaagaauuaugugaucuuucuuucccugcuuuuuccuuaccccuuucuuuucuuuauagguuguugcuuucuuuuugcuuagauuucuuuucuucaccuuaguuaugagugugguaauauuugucuacuuuguagcuaguguguggugcgagacaugccugagauagaaaugagugguugagagcacugacuacucauccggaggaccuggguucaguucuuagcacccacauaacuucuaagaaccaacuguaauuccaguucuaagggagccaacauuuucucugaccuucucaggcagccacauaugugguacacaaauuggcaugugagcauguaugcacacacacaguaaaacaaacucaauauuuuuaaguuuucauguaaauauccacauacuguuugccuaguauuucacuguaaacacuaauuauuuuguuucagguggcacauuuagaacgaacggggcauuauuuaacugugaaagauaaccaggugguccaguugcaucccucuacugugcuugaucacaagccugaaugggugcuuuauaaugaguuugugcugacgacaaagaauuauauccggacauguacagauaucaagccagaaugguaaggaagcacacugucuucaauuuugauuuuaguauuuuguuguggguagaauaugcuuaguagacauauccuugcucauuguauagcuugaacuucucagcuagguguguauauucuuguacguggaccuaggauuaacaugguaugauuuguuuuuuucuuuuguuucuuaagucaguguucuggugagaggacagugggaauauuagugugggcagggaguugaguaccaucaggaauuucuuggugccauuuuguggucucuguuggcagauguuugucuuuuuaauauuuuacuugguuuaaguauuuugucuuuauuuauuaaauguugagggguuuuuugaccuauguaaagauaaaaauuauaucaaauuauucccuagcauauuagcuucuaaaaauuguaauuaagacagguuguucaauuuuuagcaaaaugguacccuugugauuucccuaccaccaccauuuuuauaaguuaugggaaugucagccaagaguggacaggaaaccauuuauguugguuugucucacuuacuauuuugcggcuuccauccauuacugauuuauggcuuuugacacuucaauuguuuagaacauuacccuuuuauuauguuuugccaagggaaaacaguauaguuuauaagauauacaguuuuauauuuguaguucuuaauacugauaaugagauggaguuauuugacuaucaaaaccauaaccuuuaaaauacagguuuaaguguaggcaaaugaaacacuaaauagcuuuugucuuuucauauuaauguaaauaaaguauuagaaaaauuaaucccgauccuguuuccaaggugguaaguuuacagaagguuuauacuuuugcuaagcugauauuucuuaaacuguguuaauaaagauaugauuuuaaaucuuuuaucauugauuuguauuugaacauuugucgucauucagcagcaguauaauuauuagcaacucuaguacuuaaaucuugauuucauaacuuucccccucccccauucuggacagguuggugaaaauugccccucaauauuaugacaugagcaauuucccacagugugaagcaaagagacaguuggaccgcauuauugccaaacuucaauccaaggaauauucacaguacugaauucaaugcuuagaacugaaguuauucagaggacagcuuuaaaagaugaaugaagucaaguucaaguugugcucuucauguugguucaauaauggccuuuauuugaaagcuuuuuaauuuuucuuuacaguaaauauuccauucugauuucauaaauuaaacauuuaugccucccuuuuguguugacacuguagcucauacuggaaaagucgaucaauguuuugcaguuuauugaaaguaguucuauauauaacaauguuauaagcauuucuuuagaaaugguugaaaaugcuucuaaaaugugauuaucgaccaugguaugcaugaucguuguaauuguugacauuccuuuuagaaguugugaaauguuacaacuugugcuucuguagacacaaucuucugucuccauacagaggcacugacuucaauaaagucuauuuauacuaaucuuggcccaag

SEQ ID NO: 2461 - RNA, 16452 nt, Mus musculus
uaguaugcaaaguugauuuauucuccaauguaaauuaaauccauuccagguaucuuaguuagagcuacuauuacugugaugaaacaccaacaccauagccaaauuaacuugugaaguggggagggaagaguuuauuuggcuugcacuuccauaucacuguucaucuucaaaggaaguuaggacaggaacucacacagggcaggaaccuggaggcaggagcugauacagaggccauggaggguugcuguuuucugguuugcuucccagagcuuguuugccugcuugcuuagagaaccuagaaccacaaucccagggaugaccccauccacaucagucaaugggcugggcccucccacuuccacaucaaucacuaaucaagaaagugcucuacaggcuugucugcagcccagucuucuggaggcauuuucucaaucggggcuccauacucucaacuggcucuagccuaugccaaauggacagaacauuagucaguacaccagguccaugagaugacucaguagguagagguugcuugcugccaagaccagugacgggaguuugguccuuaggauccacaugguaggaagagaagugauuccugcaaguuguuguuggaucuccauacaugcuuuauggcauguguaugcauauauacacauguauacucaauaaaaauaucauaaguauauuuaaaaauugucagcugggcauugguuacacacaccuuagaucccacuauucuagaggcagaggcagguggaucucugagucugaggcuagccuggucuacagaguaaguuccaggacagcuggggauguacagagaaacccuucucaacucccuaugucuuuaaaauauaucuauacaaaauaacuguuuuaaaguaaauuucuuuaugauuccuucccagcaaaugcuuuauuuguguaucugucuuauaaacuauauauaaauuacugaggcaggggcugagguugugagguagcucagugguagaguacuuguaugccugaaggggguucaaucaucagcaccagaaacaaauuuugagugaaaauggguugcaaguggaaaauauuuaagaagugcugaacucaauucaaggagcagcucuguuggaauugucagcaacagcaggucuuagguguggaaggaaccacauuagcaaguuagggauccuguaggugaaucugaaaugcaugaaaugaaauguuaggacaugcaaauguguaaacaaacucugcuuucugcgcugucccccuaauaaagcucuaauguaaugacuuagcaaauaucagcagggauuccagacaaaguuccuccagugggcagaaggaccccuuccuuggguugcagccuggaagggucuggguaggaaaugcaccugaccugagcacaugacuucuuuucucucuucucuucccuuuccccucccccucccccuccuuuucccuccucuucucuuccuucucuucucuucuucuaauuuccguccccuucccuccccucucuuucccccucccgcuuccuuccuuccuuccuuccuuccuuccuuccuuccuuccuuccuuugcaaagacucaagagcuaucugaaaaagcugccacugagcagugaagcaaauaacauugacaauuaugcuacacugaaaccauauccacuaugcuuacaucugacaguuuggaagaaaacacaguugcugucuuuagcagguuggaaaccacauccucuggacaguccuguuuucuucuacauucccagguguuugggaaagaugccaacuuuuguugaaggacguucuaaagguguuccaguuaagugagaugaaaggauggaucuauucagcauuguggagguccuaacagaucaaugaauggauggccuucuccgauaucuaaaugaauguugggcauuagauaacaucacaaaagugcagauaccaaaacucaggguaagggaauguucuugagcaacaaccucuuuucuucaguaaagaaugggagaagagggagcgcuccgugaauuaaaacaagcuaaacacuuaccuccaucaaccucacggaugccuuuagcuaucaggaauccagccaaauaagccaugagauaacuggggaauuagaacaguggucagacauauccucauaucaggaaucacucaauuuuaaaugugugauaaaugggcuggagagaugguucaauggcgaagaacacuuguuggagagguuugggguucaguuccuagcacauacacaguggauuacagcugccuaugccuccaauuugagaggaucgaacacuuugggcacugcaugcauguaguacacguacauaccacacaggcaaaacauucauacccauaaaauuaagauacaugaauuaaaaauaaaauguuaccaaacuuuucaccuauuucagugaacagcaaugcucuuaagaaagcgguagccuccagguuacagucgggagaguucuccauuuacaagguggaguaagucagacagucauucaggaauccacacacaaauauccaaagccugcauaauaacaacaacaaagaguuauguagaagauaaauaaugagaggccugucgucaacugaaagaugcagugauaaaaaucacaguaacacaaucaacaugguaucggcaucagggcagacaaaucaguggaaccgaacagugaauccaaaaauagaucucagcauauaucauaauuuaauaugugacaaaggcaguauuucaauucugugggaaagaaugguuuauuuaauaagcagugccgguguaccuggcuauucaucuagagcaaaaugaacuuggcucucaauuucacaagucuaaaaacagauucuaaauggauuaaaaaacgccaguguaagcacuaugccuuagagaaacauucagguaacuacauucaaaugugggugacagagaacauguucuaaaaaacuaaaaccaggaacuugggaaaugggaaauguaugguaacaaaauucaaaaccuuuaaauggcaaaagaugccaaggcgagucaugucaaaacuuguuuagugaagcacgugaaacacagauaagucgugaugggguaucucucacacacagcaaauccagagaaacugguaaagaaaagauaaaacauugcauuauuuuuuuuaaggggcaaaagguaacagggaauucacagaauaaguccaaguaacuaauaaacaugucaaagauuuuuaaacucaccaucauuuuggguauugcaaauuagauuaauaauggauaucuagccagaugugguggcauacaccuauaaucccacacucagaagguagaggcaggagaaacaaggcuagccuuaucuacauagugagcuugauuucauccugggcuucaugacacucugccuaaaaacaucaaauaaaaauacccccacuaauugugaggcauuauauuacacccaugagauuaaaaacauucaaaagacuauuacuauugcaguguuugugaagcuguggacuguuacugucuauggagagaaaaugucuuaaaaacaucuauuaaagaauccacacaaccuuugacccaaugauucaaccccugggcauguagaaauaauuaacaagccaauauggaaggcuuugugcaaaaugguaguagcaaagaauuaaaagcaaagugaaugcauaaccaugagggaacaguuuaauaaaucucucuuuuugcugaauuugcaaauauggcugaauagugucucugcuucauaaaauacuaggcuucuacuuccaagguagaauuggaacuucuugugaacuaggauucucacgagcguagagugagaagggaaagccacuggagccauacggcuccuggagauagacugauguacacugguguguguguguguguguguguguguguguguguguguguguguguguuuacauuuguaagcagacuucuaucuguguguggucacaugagcuuaaggacaauguaagauaugaacgacauaggguuaacagugucucugccucucugggguaagauuuggguugaugcaguagugauuuaugccuuuaagcacucaugaggccucgaggucacccuguucuacagagagaguuucaagacagucaggacuccacagugaaaccaugucucaaaaauaaacaaaacaaaagaacaagaaccuauugugauaagcuauccaugcaucugcgucuuaauguguuuaucauuugccuuucuuaucccugugaccaaagucaggacaagaagcaacuaaggaaggaaggguuugguuugaauugcacuugggguggggcgggggcggggugcauuauggcagggaagucauggugggagaagcagcuuucaguuuugaugacaggaucucuugaagcugcuagcucacgucuagguguaacccaaagcagagaagagacaagaaguggaguaggccauaaacuucaaguccaccagaccucucccagaggaccgcuuccuccagauaggcccuacuucucaaugauucauggcuuccacaaguaguaccacuaguuggaggccaaauauucagauaucuguuccuaugggagaaacuuugcauccagaccacaauccuauguuuaaacauuguaugugugugcauguuugcauauauauauauuuguauguauauuucauguacauguacauagaauaauacacacuauauuagaacaagauggaauuaacuauacccaaguauuugagaaugugauugauaaacuauuaaaauuuuuaaaaauguuaacauaugugauaagauuguuuuccugacaaaguggacauaugcaaaaaggucuacagagcugggcuauauaaaugcuuaugauacuacugagccaugcaaaagauaggaaaggacaaaugccuuguuguuacugugguacccugaagggaguggagguggggacaauaauggauuguuucuuguacacauagcggugcgguuuuacuuguucaaucagccuaaguguuuuguaauuuaaaauaauaaagaaauuaaaaauauagucuuucuucuaaugauaugauagcuuccauucuguguuggauucuucuuuuuuccuuuuccuaaauaguuucuuggccuccuuuuuaagucuuugcucuuuuuuaagucaagaaugaguguugaguuuuucuguauuuuuggucucaccuaagacagucugguugcucucccuucuuaauugucucuuccuugucugcacucuccuaugugggucucaggucuuuuagaccucaguaugaccccaaauggaacucuuggcccucucccacuucucaucuucuccaaacuugaugugaccucagagggguucuacuucgagucaguuugugguagucagagggugcuaaggggacucucuucacuccucccauagacuauccugcaugcuggcugguuuugugucaacuugacacaggcuggaguuaucacagagaaaggaguuucaguugaggaaaugucuccaugagauucagcuguaaggcauuuucucaauuagugaucaaguggggagggcucuuuauggguggugccaucccuggguugguagucuugguucucuaagagagcaggcugagcaagccaggggaagcaaaccaguaaagaacaucccuccauggccucugcaucagcuccugcuuccugaccugcuugaguuccaguccuaacuuccuuuggugaugaacagcagcauggaaguguaagccgaauaaacccuuuccucccaaacuugcuucuuggucaugauguuugugcaggaauacaaaccgugacuaagacaucccagaaugccuuauuuagucaggacccauccuccuauccugacacaauucaugguccauaacucucaacccuuuucuuuucugaucgaacaaaauguuuaugucucgcuuugguuuuuugagauaaagccuaaugcauggccucagccuggccauguagaucucaugaucuuguucugccuccugagugcugggauuacagguguuacacuaguaauacuaaauuuaucuuuuguuguuuaucugaucauauaagaaagcucugagaagccuggcaugauacugccagucuuuaaucccagcacuugggaagcagaggcagguggaucucugugaguuccggggcaaccuggucuacagagcaaguuccaggacagccuggacuacauagugagacccuuucucuuaacaacaaugacaaacaaagcaacaagacaaacaaacacaacagaaaaagaaagcggcuagaggcaagcacaccauucuagucauugauguuagucagaugccaagaacagugccugguccacggaagguucuuaagggcugggagauggcgcuuucuguccguccagccuaguguacuuguuacauuuugcaucacugagagacccuaucacaaacaaaacaaaacaugguagacaggggcuagagagagcucaguaacugggaguacuugcugcucuuccagaggaccuggcuuugauucccaggaccugcuuggugauuccuggucgucuaacuccaauucuagggacacugacagcuucauuuggccucugcagaccccaggcaccacaugaagcaaacagacagaacauccacacccauaaaacaaauaauaaauaaauaaauaaaguuuaaaaagagaaggacuggagagaccaugcuccaucaugacaaguuccugcuucucuuccggggacucugguucaauucccagcacccacaugacagcucagaacugucuguaacuccagagccuagaggauccugacaucaucuguccuuugaagguacugcauguauacagugcacagucauacaacguagaaaaaauauacacacacauaaaaauuaaguaaaccaaaaauccaagauagacaguacuuacggaaugacuacuaaguugucuuccuuguuccacauguagacacaaaacugccaccccuagccucacgagcaacaaaaaggacaaauuagugcaucaaacucgcucuagacaugaaacucugagcuaaaccaguccuccuaagcauuuucacuuuucauuuacuauuuuauuauuuuaugcacgugcgugcgcacgcguguacacacacacacacacacacacacacacacacacacacccuguggugcacagguaaaggagcugauucuuaccuuuccuacauuuuccccaggagugaagucagacggcaccaugcacccagcaccgggcacccggugcccuuuccugcugggccuucucucuggcccacuccuaccucccuuaggcaacgguuuucuguaagaugcuuuuugcucgucuuuaaauccugaugcuugaugcuuuucuucucucucuuaggaguaauucuguguuugcagcucacugaagaaacuuucucuuaugcuucccuucgcugugacaaaccaguucuuccuaaaaguacuucuuccaugcuugccugagauuuggcaguuguacaucucucuuaccggucacucagccuucagccuuggaagucugcuuguuugugacucgguuguccucacaucugcaugaaucugaugagcuggaguuccuggacucugggcccugguggccacccuuccuuuuccaagguaguucuguacagccugacugggcugccagccaccgcuggcucuaugugcagcugcagucuauuaacuguacccucgcccauccuaaccaagacaugaaguaugcuucagauuccaagaggaagugaauggcacaaaugugagauaauaaaaaauguguuccuaaugccugacacuccguuuccuucccacuaaucggcucgaucauaaaaucaaagauagccacccccauccuuagggaacacauugaaaaucucaggcagcuggaaaaguuucuaauuuccuuuuaccauggcucuaguagucaaauuaaagaugguucgaaauucaaacaugcaucuuuaugucuguuuucaaaaucaacaaaagaccagcuuuugaccauugacuucugugcugaauauguuuccccuaccaaaaaaaaaaauguuaguuugagaguuuggggacauguuaaacuauuuuuaucuaagguaccuuagcauagcauuuccugcccacauaauauuucucagccacagaaaaauaugcuuuaaaaauucucuccuuucaaaaaacaauauucucaaugcucugguuuuuucucuuaagauuuauuuauuuauuuauuuauuuauuuaguaugcgaguacacuguagcugucuucagacacaccagaagaaggcaucagaucccacugcagaugguugugagccaccacgugguugcugggaauugaacucaggaccucuggaagagcagucagugcucuuaaccgcugagccaucucuccagccugcuuugguuguuugauauacuucuguaacauguuggauuggagggacaaacuggucucuguucacaccuuuauccaaggccagaaaugaauuaguaaagaucacaaagucacacagucacccagauugggauuaucuacuugcuccuuuuguauuuaauguauaugguuacuaugccugucagcaugcuacauacaugccuguugcccucacagggcagaagagacugucagaucccugcaacuggaauuacagucuguagagagccaccauguggaugcugggaauugaacugugaagggcaguguucuuaaccacuaaaccaucucuagccccuggcacauucucucucucucucucucucucucucucucucucucucucucucucucucuuuaguuuucuuuccucuuuucuuguuuuguguauguaugugugguacuagugaugggacccaaggccuugugcacauuagcuaagggcucuguuggugaacuuuguccuaaucuguuauaguuguuauaagauauugagucagcaucucucucaguugacaagggcuccuacguccccucccagaaacgccugucucauaagaagguggagagcuaggacaaugcauuuacuucauuaguauuuuugcacugucuaacuuaagugcucuaaagccuauaccuuuaaucccagcaccuggaggcagaggcaggcggaucuuugugaguucaaagucaucuuggucuacagagugaauucccggcuagccagucucaaaugaaugaaugaaugaaugaaugaaugaaugaaugaauaaauaaauaaauaaauacaguuuuaaaaguucaaagucaucuuggucuacagagugaauuccaggcuagccagucucaaauaaauaaauaaauaaauaaauaaaauaaauaaauaaauaaauaaauacaguuuuaaaaauuguccuuccaggggauccagauuagaucuuucaacucacuaccucagucucaacacaggguacaguccuauucugucaguccuagcucaaaacuguuauucaugaaaaaaaaaguaauauauaguuauaugaaaaguuacauauauaguuuauauaaaauauucauuacauauaacauauauauguaaguuuauauguauacaaagccccgcuugugugugugugaaugugguugcaaaaauauauuauacauauauauauauaaaacauauauacguaaguuuauauguauauaaagccccgcuugugugugugugugcuugcauccaugggcuaggguucauguaaagucaaaaaucaacuugcaagaguugcuguuuccuucuaccucaguuuuagguaggaucgcuuuuaucuauuuuauuucuauucauugagaaugcauggcaugggggggggggcuugcuguaaaugugggugcucuugaaggccagaagagggugccaacagacgcccggagcaggaguuccagucagucaguucuaugugcuagaaacugagcucagguccuggucagagcagugugugcucugaaccacugagccaucucuuuagacccucucuuuagaccuuuuguuuuguuuuguuuuguuuuguuuuguuuccacacuggggacuccaaucugaccuagacacuuuggggcaauucucuuaucucuacugucagagugcucggauuacaggugugugccgccacacuuggauuuuuaaagauaauuuauuuauauuuguuuucugcacaggacuguuuugccuucaugcaugucugugugagagugucagagccccuggaacuggaguuacagacaguugugagcugcucugugggcacugggaauugaacguagguccucugaaagaacagccagugcucuaaccacugagaaaucucucuagcccccauauuuggcuuucuauguggggucugggaguggaacucaucucaucagacuuauauguccaguucuuuuugcccacccaccaugccagaugaucaaaguuggcaucuuuaagaaagucacuugugcucucgcuacugauaucaaggaaugcagagaagagauccugaaugcuccauggaguaggaacuccaccugaaaacagaggacaggacagaccuauuacucccugucgucacacuuagccaauagauccucugccugagcuggugcugagucuaccuccucccuugacucauuucugcaagcuacucugaagaacuccuacaccucuguaggagaugucggauugcagauaggaguauaugugacauucucccaagagcuccuucuaucucaguucuaaacccuuuacagaguacugggauauaucauuaagaauaagauguaugaggcagggccuccaccuuuuuugaaauuuccccauuagucuaauaccacgauaguaaauaaguucuuccuuguacucaucaaaaccauuuugaaaauuugcucuucacauuuuucacccagaugcagggauguggacgauuauugcucaucaucugcuguauuauuugcagggacaauacacaaguucucucuuuaauccguucuauuuucacuuuuacuugugaaaaaugaaaaccuacuuuucauuccuugucauguuuuggaugcuguucagaacuuccacguggcuguuaaaauguggccaaaaugagaaucuauugacuagaucuuuguagagaugguagcguucgaaagaccaagacaaugggagaaauuaaacaggaagugacaaauuuaacuguaaaguucuugcauuucagugcuauagaaauuaauaacacuagcuggaaacguaguuguuuugugcaccauagcuaagacucauauguguguacuuacauguauagaauaucuaacaaauucaauucaauuauguuuaugauacacuuacguaguaugccugcuauuaauuaauauuuaccuaauaagguaguuuuaauuagaaaaaucuuuuugaauacaucaaguuuccaguagccuuauuuguaacacuuuauuugccucaauuccaguuaacauaucauguuuuagaagcccuccaacccccaaauccuuagcaaacuaaacccuucuucaaacucugagccuacauuuauagcacaguccaucaucccugucuaggaguugcuucaguucugaacuguuuuacaacugaacuccucccccaaacagucaucucacaggugggagagcagggacuaugcuuugcaucauucuaucugcacugccuaacuuaggugucaaacacaugccuuuaaucccaggaccagggaagcaaaggcaggcaaaucucugugagcucaagguccucuuggucuacauauuaauaacauucacaagauggccuagucggccaucacuggaaagagaggcccauuggacuugcaaacuuuauaugccccaguacaggggaacaccagggccaaaaagggggagugggugggcaggggaguggggguggguggauaugggggacuuuugguauagcauuggaaauguaaaugaguuaaauaccaaauaaaaaauggaaaaaaaaacauucacagacaaaaagauaaaagcuaaacaagaaacaacaacaaaaaacuuugcuguucuucauacacagaagucugauccuuugaacacgugaagaguucauagcaauccacauagaaaagaugaagaauccagagagaaauugacaauggagaugaaugcaaaauucacaggagagagguaacuggcuuauccaucuaugaagggguaauccuuuuacauucuaaacccuacccaucacugcauuccuggacguuucuucaacagaggcuucuuuaagaacuauaacaaggggcuggcugaagacacugauugcucuuccaggaaaacuggguucaauuuucaauacccaaaugaccgcucacaacugucuauaacugcaguuacaaaggaucugcaugcaagugguuccaacacaauacuggcuuauucaaccugcuuucuuuucuuaucuuuuauuuauuuaguugguuuuuaaaagauuuguauguauaugaacaugcugucgaugacacaccagaagagggcaucagaucccauuacagaugguugugagccaccaugugguugcugggaauugaacucaugaccucuggaagggcagccaauguuccuaacuacugagcuaucucuccagccccucaaucugcuuauguaacucaagaaaaccugccuagggauggcacccccauaguggguugggcccuuuuccgucaauuacuagccaagaaaauacccauagauaugcccgaacaucagucugaugggggcaauccuucaaccgaaggucccucuuccuaggugacucuaguuugugucaaguugaccaaaaaaaugaccaaauacaccccaucucauggcaauuuucaaaccauguucuuuaccacucauucuguauuccagaagcagucaccagucacaccccuagccuucaccuucgagaucaaggaacacacugcaaggacuaucugggauucuucuggcuuuucuccacuuccagcaagguuucuaugcaguaugaggagaccucuaauccaucccucuaguuucucuuucccgucauucccuacaucucuuuucuuugacuuaguuacccuguuccucucccugauacuaucugcuucacaaaccugcuucuuacacguucuuugaaucaaaauuuucacacacacacacacacacacacacacacacacacacacacacuccgucccugcaccauucaggagagcugauugugcaaugugugggaagucuggaagcuucaggaggaucccuugaaugcggccccugguaggaauaucuacuuauuguauaagcaacucccugccccaugccagcacuggcuguuaaauucccaccagcuaccacugccuacuccuuuaugauuuuauucccucacuugccuccugcaaccugucuaaauuuaauucagaaaucaccauuucuauuuaacacgggcucacagaacauuugcauuugaagauauaaaauacuuaagagcagauggugucaccacucaaagccuuuaucuccugucuguacuguggugauaacaugcuccuuguuggcuagggugggacuugacgaggggacacacauacacauacacauacacauacacacacacacacacacacacacacacacacacacacaauccugccuggcuaauguuacugguguccuccuccacauucacccggccuuggaguguucaacugucaacagacacuguggagcugucauccuuuugaguagcuagcacuaauggcucagcagugacgugugcuuggagcuggagaaaugguuugaacuggaaagggggguaacacacagcaaccaguccucccuugcguauugcuauaauaugugaaaagcaggucuguuuugcaugacuggacccugagaaguuuggaaugaugcuaaaugggaauuccuggguuguuauccacguuggcuguccuccucuuggacacuuucuacucugggaguccucacccaguguucagccccguucagcuuugccuugguuuuugggaaagaauuuuucaguuuuucuugggucaaugugaguagccuggguaaggcacagggguggcccucucccaucuucucuggaguccaaauugaggccuucuaugacauccagcaucugauuuggaaaaaggccauggaccuguuugccucggugggaucugaauuauuuuucauuaugugaccagcauaugugagaggaaaaaaaaaaaaaaaaaaaaaaacuggcucacuugauucaaagagcuuucagccugcagggugaggaaggcacagggcagggguggcccuggcugugacagugggaacgcaaggcaacagaucaggaagcagagagaguggcgcuggaagcagggccugagauaacuuucuaaagccagucaguccccagagaccuacuacccccgaccaagucccaccuccuaaaggcugcacagacuccuuaaagggugccaccagcugggcaucagguggcccaaacaucagccuguggaggacaugucgggcucucagcacaaugaaauucauaucugguucuuccuccaagggcgauuuuacuugagaauggaaguauuuuccuacacugguagugucacauuugaugugaucaauuuuccuacuguuuaaaacccacacaucuuagugacucacaaguaccugagaaaugggugaaguccagcugggagagauggcuuuguggauaaaggcaugaggaguccuaaucuucagcacccguaacucccauugcuguggggaguggagacugcagaucaguuggauuuccuuguggcaagccuaacuccaggcucagcgagggacccggacagagcaggaugccugagcucugaccucucccuccaucugccccaugugcuuguacacaccacacaugugaaacaagcaagcaaacagcauacagugguuuuguuuuguuuuguuuuguuuuguuuugcuuuguuuguuuguuuguuuuaaauagagguuguuugacuuugggagguacuaaggucucuuuuuguuguuucuguggcuccaaggcuccuauguaagaguuuauuuucaaauuagguguguugagguauaauucauaugcaauaacauuugcccaauuugguaugaguuuugacaaacacacgugccaacacaguccauauagagaacaucuguaagccuucuucaaguuuaccagggcucuggcacauagccagccagagucuccagcccuggcuucaacaaucacugaccgcaucugagugcuacaugcaggaucguauaacauguauccuuuggggucugccuucuuuugcuuaaauuaagucauuugagacauagccacucucugcuugugauagcacagcgcacucuauauaccaauauuuuagcucagugguucucaaccuuccuaauacagugacccuuuaauacaguuccucauguuguggugaccccucuaaccauaaaauuauuuuuguugcuacuucauaacuguaauuuugcuacuguugugaaucauaauguagauaucugcuaugcggggaccccaaaaggguuaagacccaaaggcugagaacaaccuccgugcuagaucaugauacacuacguguauaaugguggcuccauagauuuuaaugggacugagaaaugucugccaucuggugacagccgucuuuguaaagccuuguacuugggaugaagaugaggggaacaugccagcguaucaucauucauaagacacucugacacacagcuacacacagcgcagaacccuugcuaaugacaagaccgugucaccggguuguguaucuauuccacuuucuguuuugcuacauauaaaagaaaaggccaaccaugauacaguaugccaagccggaccaacagcagccucaucaaucucuugcuagcugcgucucuccgugaccuuccagaggcugugugcagugacuaaccugugccaucuauauuugugcaagaauacuuuauguuguuggaacaaugguaaaauuuucucagauauguuucucagaauauaucucagucauuaagcgacgagucugcccuuucuguuugcuagauaccauuucauagcaugaaagcacccugguuuguuuagccauuuagugguuacaggauauugggauugcuucuaguuuggagcgauuaugagcaaagucccuacacaaaccuaccuauagaguuuuguauaaacuaagguuuuuguuuccucggguacauucuauagaggcucccugguugguuaucacccucaaacucaccaauauggggggagccgcguauuauuuucccagcguacaaagugguguguaaguuccagauggaggaauacuguuguuuucugggucuuuugacgacugaugugcccucucaguggacacaggcaacaaauggagcaauggugagagcaagg

SEQ ID NO: 2462 - RNA, 7630 nt, Mus musculus
gaaaagaaggagggggaggaagaggaggaggcagcaauuuuaccacaagggacagccaagcuggcuuugcuucucuuggccagcccaaugaccuuccucccauuugcugaccacucccccgggcuggccucccugcugcucgcucacauaacagccagcuggacagcucuggggaggcaacucagaggcucuuccuccggccucuagcugggugcuggccugaacuucaccagagggaaagagcucuugggagagccugacaggugcgugccaaacugaaguucauuucauucuuuuaggagugugcuucuuaaguucuggaaacuggguugggcagccggcacugguuagaaaagguucaaaaucauguuugggggagagaaaccccauuaaugacaggccuggcuuuucuagaguggggaguagagucaugggaagaugggaaggaggguggugggacaaagcuuucugcucugggccugcaguggcugggccaggaggucuuucgugcuauaaaugucauguauggaaggcugucuguggacgcugaggggcuugggguggaguuagggaggaugagcagggacucugaggggucaccuggguucugucagccauggcuuacagcaaaggcuucuuauaaggagccacugaggaagaaaaugccugggggaagggagacacucgaacaaggagucuagguuuaccuggaggugcagaaagaugcucuuuuuuguuucgcuucauuucuuaagagaauauauauauauauauauauuuuuuucaaguguucauuuuuagagaagcccacaaacacacuccaguuggauuuugcucuaggcucugcaggaagaauuccugaagugaagccugagcacagaacauuccuaagugacagcugccucaggagagggucagagucccuguccagugagagagcugggggcaagaugcaugaggcuccuccuguacuucacccucucccgcuaugcucuaacggcagggucacacuaggccacaucaaaggggaggggucuguagguuuuacguucucaauguccccugagaccuaacaucuuuguucuucucaagccaucucuggguauccccuccuuccucggccuucacagaauccccaagcuggugauucucacagcuccaucaaccacucacuucgaaauccugcccuuagcucuucggugacuauguaaccaccaugggagagacccucacuucugugucccugcucucugcccacuuguauccagguaagcacccacuucauagggugcuugccgggauccaaaccucgggacuggggagauggcucugucaguaaagugcuugcuaugagcaagggccaaagucugaucugcagaauccauguaaaagccaggcacaaucauggagauuggagggcuugcuggccuagcgaucuagcugaaucagugaucuacacacacacacacacacacacacacacacacacacacacacacacacaugaacuccucuacagagagauguacacacacaaacauacacauauauauauuccauauauauauauuucaaauauauauauauauuucauauaugccaaaagcuuuuuaacagcgcauggcccaaauauucaacagguguuggcacuucaguuuucucuuugaggccugguagcaagcucuccagagguaggcaugccugcaccuacuugcaacugagaacuaggcucagagaggaagcaggcccaucuacagcuugcagcuuagcacaauugcuacugagcauagaaagagcaauggcagauaaccucagagcguaagugguagucaaguuuuagauucauggggugaguucccgaauccauucuuauaaucaccauacuaaauugucccuccauaacagcuuuggaaagaacucacacuccauucuuuuuaaauggcaccuauucagggguugcggaaggacucugaaagcacaggugaccuucaaccagccccuuggaggcaucauuaaucccuuagggcagccuuuaaaaugugaaaguaucucauuuauaaauaucugccuugacccucaucauggcccccaauagcagaacuggucuuauuuuauagguaaggagccaaggcuguggauuguagcccugugaagucacaguagagucacccuccauguccuucgguuaugcauugcagacaaccucagacagaaauuacaaaacucaaacagacaaaaagccccacccuacaucugcacggaacauagaauacagaccuuuauucucgcaaugacuguuuacgcagcauuuacccugguaacugcaguaagccauccaggcauguuuuaaagaguacaggaccaucugagcuguuucugugcacacaucuugcuaucuuauguaagggacuugggcauccauggauuuuggaauccaugaggcauccuggaaucaaucacccacacaucaaaugagucagcuguguuguaacugagguuggauucuguaccuuuccguugucuuugaauugggcaccaggauauuuaaaccaaaaaaaaaaaaaaagcaaaauccaguuaagcucuucugaauuggaaucaucuugguuuuuaaaaacuagaauccaggcugaaaagauggcccaguggguaaagcaaaaauggggaguuuggauccccagaaaccaugcaagaagcuggaugggcauggugguccacccauaaucucagcacccuggaggaggagagaggaaacccccauccggcuagcuagacuaguagccagacaagaacaagccucaggcucagugagagacucugucuccauacauaagguagagggcaacugaagaagaugucugauguuaaucuugggcuccuacacagacacacacacacacacacacacacacacacacacacacacugaugcacacuccacacuaagccaaucuccuggacucucccaaugccagaccugagcuuccagacguccccaucacugcuuacauacuagcccacuuccucuugggccugguacccacaagcacucacacauucuucucuuuggggcaccuugguguuuggcaacugugucucucuccuuccugccgcugcuaccacacccaugcccuucucugccaacuccacugaguaauaguuuucaugguuuuugcuuuggcucccugcaaugccccccuaacuaguccuaaggcugcuucuuuccaucccuagauuguaccuauugccuuucuccugucuccuuggucuccaaacccagacccuguccuuucuuauuagaacuuaaauuuuaugaaauugauauguaauuuuacacguuuauaaaaaggauguaguguuuuaaaucuguacauugucccccacccccaguguccccaggacaaggcucaaaccucaaccugagaauuguguuaggauggcuugaggacccggccgucuucacuguuaucuuuauucaguaacuauguacccugugccugguguggaccuaggagcuggacagaccugaaagugacagacagaaacacagagacucagagacagacauaggcugaggaccaguuaggaaacuauuacggguacucaagggagaaaccaugaagaaaacugaauuguugccaccacgagcuacaaguaggcugagugguggggaacagggugccuacacuucagaaagaggacucaggacaggcaaaauccaagaugguagcgggaauaguaaggcucaagucugugccagaaggaagagccugggagaucaggcagggaggugggaagaguuaggaauccagaaaggcagcgagaccccccaucuuacacacacacacacacacacacacacacacacagcccuaagacuuccuccagcuauucaacauucagauuuuuuuaacgcaggguuuugacacuucuguaaacacaggacccaacauugugccuggugccucgagacauauguauguccuucuccccccccccuccccccccugcuucccgccccaaaugagaagacccaggcaaucccuuggggacugugguuugugugaaugaauucccaugugugugaaugaauuggaaauuucaaauggcuaagacuugcuuuccucccacgguuuauggggacauuccacaggugcagagaaccucagccauguuggccuucuuguucuacggcuugcuacuggcggccuguggcucugucaccaugucaaauccaggggaguccagcuucgaccuagcagacaggcuugacccgguugagaagauagacaggcuugaccugguugagaagauaggcgacacgcaugccaaagugcuggagaucuggauggagcuaggacgacgaagggagguggaugcugccgagaugcaugcaaucugcaggguacaaccaucagccacgcugccaccggaucagccgcagaucaccggcuugguucucuuccggcagcuggggccgggcuccaggcuugaggccuauuucagucuggagggcuucccagcugagcagaacgccuccaaccgugccauccacgugcaugaguucggggaccugagccagggcugcgauuccaccgggccgcacuacaacccgauggaggugccgcacccucagcacccgggcgacuuuggcaacuucguggugcgcaacggccagcucuggaggcaucgcgucggccugaccgcgucgcuggccggaccgcacgccaucuugggccgcucuguggugguccacgccggcgaggacgaccuggguaaagguggcaaccaggccagccugcagaacggcaaugcaggucgccggcucgccugcugcgugguaggcaccagcagcuccgccgccugggagagccagacaaaggagcgcaagaagcggcggcgggagagcgagugcaagaccacuuaagccucacucagggccuccgagccccgccgcugcacgcauagaugucuccaggcgcccccagacgccucuagucaccccagaggccucuaggcguccuagacagaggccucccagacaccucagucgccucugcgcuuccaugcacgccagacaccucuguauggcccccagaugccuccacgaaccuccgcgcacccuagauguucucccaugucccggacaccguuccucuguguccaggacaccuuaguuaacccagaaaucuuuucacgcccuaugcacuuccacagacccagauccuuaaugcucuagauccaucccgagccccuuugugucccaagacaaucccacaagccccuagucuuugagucugcucucagagaacccccucuuccuccccagagaucgcaugugcucagauacucuccuccucugaggacuucccagugagcaccuuugagaguacucccuugggguauacugaaauaucgcccaccccauuuccuucugcccccuuuuguuuucuuccuguccccauagcacccgagacuccucucuucccuagagaccucuuuuuucuucccuuuguuccuccgaggcgcucugggaccacucugacacccucacccccacccccaaguuccauguucccgaucaccuccugcggaggccccagguucuguuuucaucuguuucccauauggugccugcaccccagggagagcagcuccuuagagagaguauuugggaaccuuuauguugcucauuaaaaacauagcaauucacaacacaaugcacuggccuuguguacuuuuuugagacuuugcagcuuaguuuuguuuuguuuuuguuuuuuuuuucuucccgcccccaaaauaucccugagaauuugcaggucuccuccucuaaugaaagaaguuucuaucauuaauugcuaugccuuuuuggaggacugaggacauuaacaaggacgcuuaaaugugcauguguguggcuucuuuacaaaaggacaccgacacagccgggagccgaagaacgcaaagaugggagaauaaaacccaucugcugugaagugagucccuagccuggugugaaugagguaaguguugagguacccaggcaugccgcuccccagauaucuccagaacagcgacugcacgucuuauaccuuuacccacccagucugaguaccugagauaguaccuccccaggcuucccaagcugguccuucgagguagccucugcuucucccagaucuaggaugucagacaacugacacacaacugaaccacaguuagaaacccguccucugcgcugagugugcccugucaccagaguuagaaguugugcuaaugagaugccgaugaccugggaacccaugauggagaggaaugaaacccauugacagccagauccucuccuuuguugccgugcgauggccaaucagagccauggcuugggaucagcagaugcuucucaucacuggccugcuguucuucuuggguggguggaucccugaacguccuagcagacccaaucagucuuuauucuguccauucacgggguuagccacuaucccuagggcccagagguaagacacaccaggaaaauaacaagaggauauugcaagucucuguaagagcaaaggacugaucauaguacgcucguugacaguguggacucacacaggaagaucugauugaaccccagcucugccacuugcuuccaaacuguauguccugaacaacucacagaaccuauguagagaauagccaauccacaggguuguuuugaggccuaaauuggguguuguuugugagagcugcuuagcagaacaggcauauuuaauacaaauccaauuagucuaauaauagcuacagcuaaagucagacuacgagucugacuaucccaacaguggcucuggauaccuuguaaguuagugagcaucaugcaacuagaggggauucaacaaaggagagcuugccacagagagacuggauuucucuggguagcccuggcuaugcuacaacuugcucuguagaccaggcuggcgucaaacucaaagauccgccugccucugccucccaagugcugggauuaacaguaugaaccaccaccgccugacuuucacuccgagguuucuaagaagcauuucuacagucaaccaaccagaguccauaggagacaacucugucuuugcagcuugggagguggcgagaggcagaaagagaagagaaguuugggagcuauaaggcagacaucugguucuuggcacaaaaccuugggugccaccaagaccgcccacuggacuccacuugaucucuggcuucuauuuuuacuucccucaucuuauagaucuggcuuauggaucucuuuauauuugcuguuuugacuuccuggccugcuugcuaaucaguuugccgguuugacucagagaguuugcguucauugcugggacuuaaacccacacuuguuuugauuuuuuccuguaaaauuagaagcauuugauguaauggcugcaccuacccacagcugguaaagcaagaauaaugcucgaucccguguagcuuacacacaauguagacaauaauuagggaugcuaucuuuagauguuaggauaagcuguuucucagaauggcagggauguuuuuaauuuuuuuuccugaguggggcuuauuagugcacauacacaaaaaaauacua

SEQ ID NO: 2463 - RNA, 7630 nt, Mus musculus
uaguauuuuuuuguguaugugcacuaauaagccccacucaggaaaaaaaauuaaaaacaucccugccauucugagaaacagcuuauccuaacaucuaaagauagcaucccuaauuauugucuacauuguguguaagcuacacgggaucgagcauuauucuugcuuuaccagcuguggguaggugcagccauuacaucaaaugcuucuaauuuuacaggaaaaaaucaaaacaaguguggguuuaagucccagcaaugaacgcaaacucucugagucaaaccggcaaacugauuagcaagcaggccaggaagucaaaacagcaaauauaaagagauccauaagccagaucuauaagaugagggaaguaaaaauagaagccagagaucaaguggaguccagugggcggucuugguggcacccaagguuuugugccaagaaccagaugucugccuuauagcucccaaacuucucuucucuuucugccucucgccaccucccaagcugcaaagacagaguugucuccuauggacucugguugguugacuguagaaaugcuucuuagaaaccucggagugaaagucaggcgguggugguucauacuguuaaucccagcacuugggaggcagaggcaggcggaucuuugaguuugacgccagccuggucuacagagcaaguuguagcauagccagggcuacccagagaaauccagucucucuguggcaagcucuccuuuguugaauccccucuaguugcaugaugcucacuaacuuacaagguauccagagccacuguugggauagucagacucguagucugacuuuagcuguagcuauuauuagacuaauuggauuuguauuaaauaugccuguucugcuaagcagcucucacaaacaacacccaauuuaggccucaaaacaacccuguggauuggcuauucucuacauagguucugugaguuguucaggacauacaguuuggaagcaaguggcagagcugggguucaaucagaucuuccugugugaguccacacugucaacgagcguacuaugaucaguccuuugcucuuacagagacuugcaauauccucuuguuauuuuccuggugugucuuaccucugggcccuagggauaguggcuaaccccgugaauggacagaauaaagacugauugggucugcuaggacguucagggauccacccacccaagaagaacagcaggccagugaugagaagcaucugcugaucccaagccauggcucugauuggccaucgcacggcaacaaaggagaggaucuggcugucaauggguuucauuccucuccaucauggguucccaggucaucggcaucucauuagcacaacuucuaacucuggugacagggcacacucagcgcagaggacggguuucuaacugugguucaguugugugucaguugucugacauccuagaucugggagaagcagaggcuaccucgaaggaccagcuugggaagccuggggagguacuaucucagguacucagacuggguggguaaagguauaagacgugcagucgcuguucuggagauaucuggggagcggcaugccuggguaccucaacacuuaccucauucacaccaggcuagggacucacuucacagcagauggguuuuauucucccaucuuugcguucuucggcucccggcugugucgguguccuuuuguaaagaagccacacacaugcacauuuaagcguccuuguuaauguccucaguccuccaaaaaggcauagcaauuaaugauagaaacuucuuucauuagaggaggagaccugcaaauucucagggauauuuugggggcgggaagaaaaaaaaaacaaaaacaaaacaaaacuaagcugcaaagucucaaaaaaguacacaaggccagugcauuguguugugaauugcuauguuuuuaaugagcaacauaaagguucccaaauacucucucuaaggagcugcucucccuggggugcaggcaccauaugggaaacagaugaaaacagaaccuggggccuccgcaggaggugaucgggaacauggaacuugggggugggggugagggugucagaguggucccagagcgccucggaggaacaaagggaagaaaaaagaggucucuagggaagagaggagucucgggugcuauggggacaggaagaaaacaaaagggggcagaaggaaauggggugggcgauauuucaguauaccccaagggaguacucucaaaggugcucacugggaaguccucagaggaggagaguaucugagcacaugcgaucucuggggaggaagaggggguucucugagagcagacucaaagacuaggggcuugugggauugucuugggacacaaaggggcucgggauggaucuagagcauuaaggaucugggucuguggaagugcauagggcgugaaaagauuucuggguuaacuaagguguccuggacacagaggaacgguguccgggacaugggagaacaucuagggugcgcggagguucguggaggcaucugggggccauacagaggugucuggcgugcauggaagcgcagaggcgacugaggugucugggaggccucugucuaggacgccuagaggccucuggggugacuagaggcgucugggggcgccuggagacaucuaugcgugcagcggcggggcucggaggcccugagugaggcuuaaguggucuugcacucgcucucccgccgccgcuucuugcgcuccuuugucuggcucucccaggcggcggagcugcuggugccuaccacgcagcaggcgagccggcgaccugcauugccguucugcaggcuggccugguugccaccuuuacccaggucguccucgccggcguggaccaccacagagcggcccaagauggcgugcgguccggccagcgacgcggucaggccgacgcgaugccuccagagcuggccguugcgcaccacgaaguugccaaagucgcccgggugcugagggugcggcaccuccaucggguuguagugcggcccgguggaaucgcagcccuggcucagguccccgaacucaugcacguggauggcacgguuggaggcguucugcucagcugggaagcccuccagacugaaauaggccucaagccuggagcccggccccagcugccggaagagaaccaagccggugaucugcggcugauccgguggcagcguggcugaugguuguacccugcagauugcaugcaucucggcagcauccaccucccuucgucguccuagcuccauccagaucuccagcacuuuggcaugcgugucgccuaucuucucaaccaggucaagccugucuaucuucucaaccgggucaagccugucugcuaggucgaagcuggacuccccuggauuugacauggugacagagccacaggccgccaguagcaagccguagaacaagaaggccaacauggcugagguucucugcaccuguggaauguccccauaaaccgugggaggaaagcaagucuuagccauuugaaauuuccaauucauucacacacaugggaauucauucacacaaaccacaguccccaagggauugccugggucuucucauuuggggcgggaagcaggggggggaggggggggggagaaggacauacauaugucucgaggcaccaggcacaauguuggguccuguguuuacagaagugucaaaacccugcguuaaaaaaaucugaauguugaauagcuggaggaagucuuagggcuguguguguguguguguguguguguguguguguaagauggggggucucgcugccuuucuggauuccuaacucuucccaccucccugccugaucucccaggcucuuccuucuggcacagacuugagccuuacuauucccgcuaccaucuuggauuuugccuguccugaguccucuuucugaaguguaggcacccuguuccccaccacucagccuacuuguagcucgugguggcaacaauucaguuuucuucaugguuucucccuugaguacccguaauaguuuccuaacugguccucagccuaugucugucucugagucucuguguuucugucugucacuuucaggucuguccagcuccuagguccacaccaggcacaggguacauaguuacugaauaaagauaacagugaagacggccggguccucaagccauccuaacacaauucucagguugagguuugagccuuguccuggggacacugggggugggggacaauguacagauuuaaaacacuacauccuuuuuauaaacguguaaaauuacauaucaauuucauaaaauuuaaguucuaauaagaaaggacagggucuggguuuggagaccaaggagacaggagaaaggcaauagguacaaucuagggauggaaagaagcagccuuaggacuaguuaggggggcauugcagggagccaaagcaaaaaccaugaaaacuauuacucaguggaguuggcagagaagggcaugggugugguagcagcggcaggaaggagagagacacaguugccaaacaccaaggugccccaaagagaagaaugugugagugcuuguggguaccaggcccaagaggaagugggcuaguauguaagcagugauggggacgucuggaagcucaggucuggcauugggagaguccaggagauuggcuuaguguggagugugcaucagugugugugugugugugugugugugugugugugugugugucuguguaggagcccaagauuaacaucagacaucuucuucaguugcccucuaccuuauguauggagacagagucucucacugagccugaggcuuguucuugucuggcuacuagucuagcuagccggauggggguuuccucucuccuccuccagggugcugagauuauggguggaccaccaugcccauccagcuucuugcaugguuucuggggauccaaacuccccauuuuugcuuuacccacugggccaucuuuucagccuggauucuaguuuuuaaaaaccaagaugauuccaauucagaagagcuuaacuggauuuugcuuuuuuuuuuuuuuugguuuaaauauccuggugcccaauucaaagacaacggaaagguacagaauccaaccucaguuacaacacagcugacucauuugaugugugggugauugauuccaggaugccucauggauuccaaaauccauggaugcccaagucccuuacauaagauagcaagaugugugcacagaaacagcucagaugguccuguacucuuuaaaacaugccuggauggcuuacugcaguuaccaggguaaaugcugcguaaacagucauugcgagaauaaaggucuguauucuauguuccgugcagauguaggguggggcuuuuugucuguuugaguuuuguaauuucugucugagguugucugcaaugcauaaccgaaggacauggagggugacucuacugugacuucacagggcuacaauccacagccuuggcuccuuaccuauaaaauaagaccaguucugcuauugggggccaugaugagggucaaggcagauauuuauaaaugagauacuuucacauuuuaaaggcugcccuaagggauuaaugaugccuccaaggggcugguugaaggucaccugugcuuucagaguccuuccgcaaccccugaauaggugccauuuaaaaagaauggagugugaguucuuuccaaagcuguuauggagggacaauuuaguauggugauuauaagaauggauucgggaacucaccccaugaaucuaaaacuugacuaccacuuacgcucugagguuaucugccauugcucuuucuaugcucaguagcaauugugcuaagcugcaagcuguagaugggccugcuuccucucugagccuaguucucaguugcaaguaggugcaggcaugccuaccucuggagagcuugcuaccaggccucaaagagaaaacugaagugccaacaccuguugaauauuugggccaugcgcuguuaaaaagcuuuuggcauauaugaaauauauauauauauuugaaauauauauauauggaauauauauauguguauguuuguguguguacaucucucuguagaggaguucauguguguguguguguguguguguguguguguguguguguguguguguguagaucacugauucagcuagaucgcuaggccagcaagcccuccaaucuccaugauugugccuggcuuuuacauggauucugcagaucagacuuuggcccuugcucauagcaagcacuuuacugacagagccaucuccccagucccgagguuuggaucccggcaagcacccuaugaagugggugcuuaccuggauacaagugggcagagagcagggacacagaagugagggucucucccauggugguuacauagucaccgaagagcuaagggcaggauuucgaagugagugguugauggagcugugagaaucaccagcuuggggauucugugaaggccgaggaaggaggggauacccagagauggcuugagaagaacaaagauguuaggucucaggggacauugagaacguaaaaccuacagaccccuccccuuugauguggccuagugugacccugccguuagagcauagcgggagagggugaaguacaggaggagccucaugcaucuugcccccagcucucucacuggacagggacucugacccucuccugaggcagcugucacuuaggaauguucugugcucaggcuucacuucaggaauucuuccugcagagccuagagcaaaauccaacuggaguguguuugugggcuucucuaaaaaugaacacuugaaaaaaauauauauauauauauauauucucuuaagaaaugaagcgaaacaaaaaagagcaucuuucugcaccuccagguaaaccuagacuccuuguucgagugucucccuucccccaggcauuuucuuccucaguggcuccuuauaagaagccuuugcuguaagccauggcugacagaacccaggugaccccucagagucccugcucauccucccuaacuccaccccaagccccucagcguccacagacagccuuccauacaugacauuuauagcacgaaagaccuccuggcccagccacugcaggcccagagcagaaagcuuugucccaccacccuccuucccaucuucccaugacucuacuccccacucuagaaaagccaggccugucauuaaugggguuucucucccccaaacaugauuuugaaccuuuucuaaccagugccggcugcccaacccaguuuccagaacuuaagaagcacacuccuaaaagaaugaaaugaacuucaguuuggcacgcaccugucaggcucucccaagagcucuuucccucuggugaaguucaggccagcacccagcuagaggccggaggaagagccucugaguugccuccccagagcuguccagcuggcuguuaugugagcgagcagcagggaggccagcccgggggaguggucagcaaaugggaggaaggucauugggcuggccaagagaagcaaagccagcuuggcugucccuugugguaaaauugcugccuccuccucuuccucccccuccuucuuuuc

SEQ ID NO: 2464 - RNA, 15056 nt, Mus musculus
aaacuaagagaaaccauuuuaauaccugcagccucacgcaggagucuacugugugugguauagucuagugugacucgcucccuauucacuuccacacacagugacuuucaaugagaugguuaagcugagcaguguauauucuuaaacagugccaaggauccugucuucaaacaguuuuaucaacugaaacauccuccaagagcccugcgaggcagcuuggcaaggccauuugcacugaaaucgcuuauucagaaggugucagagcagccacggaccuugagcccacagguugcuuguguucacaucacagcuuggaagugauaaagacugcaggagcagcagaucuuccacaaacagccuugcaggcuggcucugcuccugcaaagucaauggagccgcaaggcacuuccuaaugguggcaucuguucagguucuccagggaguuaagggaagcacugucuuugcacacagucucuaucacaaggggucuggcuagcagcaugagaguucccucuccaugccaugcugccacagugaggcaucuauuguccccacugcggagugcacaggauaaagacguccacuuuccucaucagacuugcugacagccucauuuccugccaaauggaucagaccacacuuucaacccuauggaaagaaacacaaauacccuaucaggauucauugcuaaaugacugaacacacccccuugaucccaaacaaacaagaugauguggaaauugagccaugcaauuuccauguggcugagacauugaaaugggugagugcagccacuggaacccugcaacgaggcagccauggcagcuaugagguauccuuuuaaaggcuuaggaacucuucccugcuaggaagaaauggaucuagccuaggaccaccagacugcaggaguuugguuaauaagcuagaaaaucucucguacucagccaacuuguaucauuuuaaaggaacaucccacacgucccugaagggagcuuugagaacuucucuaggaaacugaaccuuagugcucacccucacacacggucugccagugagggagguauuuacaggggugcucaguaugggagucugcaaagcagaugaucuguugcauacuugauuccauuuuauguccacuuaccaaggacaaacgaggggcccaggaagcuuguaaaaaguacuaggcacugaaauauuagcaugaagucuuagauagcccugacaagagaggaacuaucauaaaauaaugaacaguaucagguuccagggagaagaaccacccacuccacagcaaaguacucauccacgugccccggaagggauugucugagcguuuucaguuuaccuggcgguugcacaucuuccuggacaauaccagcucgauuuacagccugcuccuucucugagaaacacaacagaacaaauaauuacucuuuagaaaggagaugugggcauuuugcuucuauuuauaugggcuaauuacaagcauauuuaggagugugauucaauucagggacgucauuacuuaaagcuuuuagguuauagaagcuagauccuagauguaaaaagagccacacuucaaacaaaaagaucccaaccaacaucuuuuuccugugaucucagcauuuuggaaaggacacaacacaacagaaagaacuguuucaaagagcuggugggugugacauuacaagaggagagcugccgcaaagaagggacaggcacaauuaucagaaaaacgguggcuaaaaacacuccacucaaggacuggacuccaagcuaaauaugcuauguuuuugauaggaaauagagcagaaaauuaaucuuuggguggguggcuuugguuuggauaauugaagcuucccuaauugauugcaggugcugugccaauuagugagcuugcuguagcugcagcagcuaagccuggcacuuuggagaugcacaacaggcagaggccaagagaaaucaagcauuuuaugagugugggcuucgaguucuccgucacaucuuucuaagugguuuggaagaaacccgaagccugugacaacaaagaauuauuaucuuaagugucuugacaaaugauggcuuuguagaaggaagacuuggcgccaaguuuguugacuccuaaguugcagugauuaaaugcaguaaucagaccuuuguuuuaauagaucgacugguucuuuauagccacucucagcucuuauuugcuauuaggccagucugucugucuacuuucacaggcuugcugcgaguacaagaaacgguuccaccaacucugauaguuaccaaauuagcuugaaacuggcgucggaacagaaagucaauccuaaaugacuuaccugguaguguuaucaauacuaacuuuauugggugauggggacugugggaaucuugaugucuaauucuaagacaggcacagugggccaccuauucccaguggccuaguggguucucacugccucuuucuaacuagcagguaaauggcacacagauguuccggaccugcagaagccaacagaccgucuccaagucaagggaacaaugacaccuaacagcacagguguucucauucuggaagacaucacauucugcagaccugagcccuacgauugucgacagggaagucucaaaguauagaugucucaaauuugcgcuuggugcccagccagcaaaacaucacacuggcaugagucuugccaggaacaaaaauagauuuuuccagaccuaagauaucgcuaauauugugaaagcagaaagagguaaaguuugaaaaauaauuguuaugaggcauucuagaugcacagacaaaagaaacuuguaccaaacccguucucuaagaagcagguaccacugcagagcccaagauucuggcaggcugccaggaaucccugggaggaagcugcuagcuggguggcagggacagaaugccuaauugugcuccaaccucucaucaugcaguggagaacccugugagggaggaaucccugucuugccaccuucuugcuaauugcuaacgaggcuggacaggcuggagauuuguucuaaguaggcuauaaucucuucauaaucuggguccugauacagccaccucaguggcuuggccuggacaggcaagcuaaacuaguuccugaagagugguaaucgguauuagcuccuaucuaaauccacccgguucucugauccauuaauguuuuaauaaauacucugaggccagggaagucuuauggaaauucagaagaccacacaaagacacuucauuugagaaugccugcuaaugggaaccugcuaaugggaaaacagaaaccagucucucaggauuuagcacgcucuucuugaugaagcugacagguuucuauuucauugucacuggaggaacagcaaauaucuaugacccaggaggaggguuuagcuacgugaacaaauaagcuaauuacugacuucaguuguaagcaaguuuccauguaaaacgccuaaaauccaacuguggggccagaguuagaaaauuccccacuccaguaucccggcaagcucaacucugcccccuggugcuaaggcucagaucugauuuguaguuuuaauagaggauaguucucucuagucaaagggccauggaacguuauuaaagcuguuuauacaugcugguaggcugacuugcaaugggagauaaaccaguugugcaacuaggugcuguauuuaacccugaccaucacacaaaugcagacucccaagugcuuuuccgaggacacucuaaugaagcgccagcaggaaagccugcagagaaaagccaggccucaucgacuuccccaucuccuuccacacucagcagucgaagagacggcaagucacaaccuggcguaauugggacaaaugguagccuuuggauauggucucuguaccaggcagcugugcuguaucaauaguaaauuuguugaauucugaaguacacugugauuaggcaaaacaauguccuuauucuuagcaaaacccggcccaaguacuuaggaauaaaggcucauaaugucuucaacccacuuucaaauggcucacccaauaauggugaugacugcagucuagcgaguaugggaggaaagcaaacgcagugguuguuagccaccagcaaauccaggugaagggcacaggggucugugcuucuauccuuggaucuuuucugucacuugagcuuucucuuaauuaaaaaaaaaaaaaagugcaacugcaaaagagccagcuaagaaaguccuauaacacaugaccauuccaggauggcugcuucaagcaucucccuguuuaaaaauagcuggucaggcuuaaguacuucccuggcagucccauuuggugcugcugacuaggcucugcaguccguuuacaggagacuccugaacccaaaaugcgcgggagcagccgggaaccacaaacaccaagugggaaacagugaccaaggauacaaauuggucauaaauccaagaggacacagggacagaauggugacugaaacucagacugaggagaacacacagcuguagcagcaggugugaaacaguuggcagggggugggggcacuggacauggaacagcagguaggaagcagcuggcaggggguggggggcacuggacauggaacagcagguaggaagcagcugacaggggguggggggcacuggacauggaacagcagguaggaagcagcugacaggggguggggggcacuggacauggaacagcaggugagaagcagcugacaggggacagagcagcagugugaaacaguuggcugagaccaaagguaccaucucagaguaggcagugagggaacugucggugugggccacaccacugcugcagcucacccaagcuggaacuaguggccauuucagucacugucuuugcaccguaaacacgccugcauacucauccaaaccuggcuggauccagagagcugugagauaccaguuaggaaacaggacuccagccugucucugcacucugcucgauuacacggugaauggugugaagagcauauucuaagcaccuggcauguaauagggaaaaugcccuuacacgaaaggcauucugcacaucaagugauuucugguaaucuuguucuaucagauagauauacaacacaguuucaauugggggcagcaagggacaggcgagaagcgagagaaucaggucuccuccaguuacccaaggaaccaguuacccgcuguccugcaaccucagucucuuacaggcacccugacagggcauuaaguggacaaggucggggagucagggucuaguguccacccagcaauaaacaugcagugacacuggacaaggcagccaaaugucaggaaugaaugagcucugggauuucugguaaaacaacaacaacaaaccugaugauuuuguaguucucuguaucagacuaaaccuaggaaagaucaagauaaaaacaaaagcaagcaaacaaacaaaaaccccugcucuuacucuauccuacuuccuacuaaagagccagacuccaauugcuuguaggauguaaaggcuucaagguaugguccacuaaguucucagacgaacccuaccugcaacaggaagaaaggggaaaagcaacuccugggcuccccccagaagcacaacagaacuguacccaagcugcugguuucagaccaucgggccccaaggcuaacugcuaccuccccaagaguuaaaacaggaugugagcuaucauggauggauugaccuuguacucacuccacugaacaacuguaacucaagucagugagagagcuaaagagcaugcugaaugucaaaaggaagugcaccgagacacacuugucacaguggccugcugcguagcuaucacuagacugucuuuugcccaguuggacagugggggcuuccuucucauuccugcugccuacuggagauuauccuacugaagcagaaaucaugggaccugcucagcccuauacucucugcccagcccuaacucgccacacgcaggcuggccugaaggaccugacacuuuaacucuacauggcuugggucccuaagaaccguaguccacucucuggaacaaucaaaucugaacgaauaacaaauguacaccauauccagagauccaucccauaauuagccuccaaacgaugacaccauuggauauacuagcaagcguuggcugaaaggacccugauauagcugucucuugugagacuaggccggggccuagcaaacacagaaguggaugcucacagucagcuauuggaaugagcacagggcccccaauggaggagcuagagaaaguacccaaggagcuaaagggaucugcaacccuauagguggaacaacauuaugaacuaaccaguaccccggagcucuugacucuagcugcauauguaucaaaagauggccuagucggccaucaguggaaagagaggcccauuggacacacaaacuuuauaugccccaguacaggggaaugccagggccaaaaaaugggaauggguggggagggaagugggggggggggggaggguaugggggacuuuugggauagcauucuaaauguaauugaggaaaauacguaauaauaaaaaauauuuuaaaaaauguacauggggcagucagaggcaaggaguuaagaagcaacugagaggcagaagcaaaccaacagcucagguggaaggacagucacagauggacuguccaccucgggacagaugaggaccaccucucccugggcuacugaaucacuaguuauauuaauacaaaguccuucuccuaagcauuccaucugauuuuauucccccuaacugaaaguggcuggauccucccugacauccugcgguucuucccuucuaccaugcagcauccaggaaucaaacuggggugaucaggccuggcagcaaguggcugaugagccgucuugucagccuccucagaggcaggaaaagcuaaagaacccugggcaguuaguagauaacacuugggcagcgcccuucacuuacagaggguuugccauccugugucagacaacagaagcuguggccuacucugcucaugacucgacaugccagggucacauguuccugcauccacaucugcccuuucucuagcgcuggggaaaccggugccuuuacucugcccaaggccgcauuugccugggcucaggagcccacguuaccuccucucuccagcaccucagucuccuggacucuccugguguucccauggcucccagccuaaacuaaaagcaagauucuauucuuccuagucccucagccugcuucaaggguggccaugcuccuaccaacagacauguacauuuaacagacugcucacuugcucuuuaaucuggugcaaucuucuugcucacuuucaaaccacugacagcauuaaccagguuuauuuuugucaucgccuuugcaagucuaacggauacuuucauuuaucucuacaauuccccaacaaccuaacuggaggccacaccccuuccacgaagagcugucuucucgaugcucuuaacuuuaagccucucuguguccacucccucugaggcuccuuugagggccuuuccucgccgaccacuucucagcccuucacaugcuggugcucuucuaagcacucacuaugucuuccuaucuuggaucacuggcagaagccccaaugcacacugcacgcaccugcuccagcuccagacugcguauugucugccucuagacaaccaucagaggcgcagugguccucaacccucaaccuauucauccgcaucccucaaacuccugccuuccaauugguugccaccaucacuaggaccaccuucuaaguugcugcagucagggagaugguagccauucuuccucacucugggggcuugcggugguuugaguaagaaugacccccccccccauaggcucauauauuuaagugccuggucaccagggguggcacuauuugaaagaauuaggagaugcagccugguugggaaaaguguagcacacaccuccaagaagugugucauuaggggauggcacugggguuucaaaagcccaagccaggcucgguggcuuucucuuccugcugccuacagaugcagauguacaacucuuagcuacuucuccaacacuggccgcaucugccugugugcugccauguucucugccaugagaaaaaugaacugggucucugaaauugucaucaagcucuaauuaaaugcuuucuuuuaaaagaguugccauggccaugguaucucuguacagaacacugaggcaaggugcaucagucacaagucuuugugcaccagucucccagucccuaaaguauucugguacaggcugggcaccaucuccugaugccaaaaaacaauagugcuuuucaauaccaaucuuucuuuccuucaggucccucuuccccacagugggaccgaagcuggugcacaguggauccagucaccuugcuaaaauacuucaauaaccuccacuggcuggacuuugaggauagcaguggguaacugcagaguuuuaauuaagcaagccagaugacugcccucaaaggacgaauggcaggaccagugccaacgauccagaggguuccacauuuccuaacaaaccaaaacagguucccauuacaaauucucaccagagaaguaguaccagguauaucucagaaagaccucaacuggggccagagagacagcucagccaguaaagcacuugccacgcaagcccaguguccuaaauccaacccccacagaccacgcuaaaguaggggaguaagaaaugauuccagagaguuguccucugaucucaccacacauaagcugccguaugugcaccccucaacaacacacauuucuucuaagcuuuagaaaaaaaaugcacacaagagaagcauggggggcauaugggaaagaugaagagcaggcaaauaaagaaaaacagugauguuagugacuacaggugcaggggacgcacgggcuaaaacacuacccaaaaugcacagggccaggacagaaugagguggcaggggacgaggcccaggccagcccagggcugccccacaucuaaacugcaccaggcacaagugacagcuaaaaugcaggcucugaguauaaggaaggaaagcgguuaaauacuauaaauacuggaaacggaaugggcucccagcuccugagcacacacugagcuagcugggcaugcuuccugccggccuaaggcacacaccugcuuguaucucacuccucaccaagaccuccuuuuaaaaguguuuuuuuuuguuuuuuuuuuuuuuuuugguacaauuccuaauaugagacuauacuucacuuaauucacccuaaacuuacaaauucaguucaguaaacaccaucaccacagcggggggaacaggcaaggcucagagugaggaaauaccugccuacauguuauccagcuaacagccaccacaaaggguuaugacgagcacuaaaugucuuagcagaguugaagcacuuggaaggaugaaaaaaacaaaacaaaacaaaaaaaacccaccaaaaccaaaacuucugauaaaaauuagcuguucaguauuauuuacuuuuuaaaaaauuuuaguuauaaccuuugguuaaaguuggucgaauuaauuaaaauaagcuaaaaggcaagcagguguagacagucuuagagccugaccugcccgccuaaagcaacauggucagccaaagacuggggaguauuccuggaagacaugcaggguaaccggcugacuaagagcaggguagccuucacagugugaugcuucugugcacugugggaaauuuauccuggauccuaucuaguacaauggcuuacucucaccuccccuuuucuuccuuagcugugacaagcaaaacaccuccagauagcacaguggcugagaaccacaccccugucuucuucagaacugggauuuuucuaaagggaaccuccaacagaccaagucucaacuccaacucuagaagcuguaauaaaauagccuguggcagggauccauccaggauggagacaaauucugcaggaccuuacacaagcccacauuccuuccacacguggcgcaugcaggaaggcuugaaggcaggaagcacagagaccaucuuagucugagcugaugaaaagaagcugucaggggauucauguguguacuuuaaaaugcuuugccuccagaaaccaaguguuauggcgcuggagauggucagaacauuuacaugaggcuugaaaucgccaagcuucagccucagcuaauauuccccgggggcugggcuggcccucuuccaucuucaagaugauucagguuuccuggagaacaaaaugauccucuaaugccucaucucuccucgcugacagaugguuucagauguaucaaagugcuaauccuugcugagguauaggucuccaggaaggaguguggcuuuuagaaugauaggaccugaaugauuaaggaggaaaaugacuccccggacacucgccauugucaugugagcagccagcuuaaaaaugaaggaaaccagcagaaucuaaaaaaaaaaaaaacgauuugaggaaaaacucagaacccagguuaacaguuuagcuuugaaauauuuccgcuccaagacaucuuagggauuggcaaugaugcaccauaaaaacaccuuucaacucagaaugaucaaagcucuccacuauagcaccaucucagccuggguggauggagcggggcucugcggacagacgccuggguuggaacauuucccucaccacuuacuagcugugugaccuccaucuguaaaauggguagcaucuaccccaagggaagcccgugcaaauucaacgacucgguauaugcuuaacccaaaacauuaaaucuucaguauaucaguauauacugugugugaacuaguguuaguguugaccugcuguguguaggcugcuuucauacacaucaccucugugaccccuaagaugcucacaguuuuguugcugauccugcaaaagauauguagagccucaacauugaaggucagagguggggccccuuguccguggucaccgggcugcacugggcgagccuggaacccggguagccucacucccaaguccacauccuuccucagcacuccuugaacagauaggguaggggcuuaagggcuucgggguagcgcugggagcagccacugcgcggggucagaggucacucacgguauuccuccagccgcauaaggggccggaaguagaugggauagaaggcggcgccgaccauggagaugaagccuccgaauaugagcgcggugcgcagguuccgggccgcugccauggagagaaagggggcagcagagccggcgaaggcccccgcacguuuggaaacucgauucccggccucaaggucgcgacccagcucggaagaggcggagcagagcucgcuuccgggaucggagugcagggaggagccucugagcucggaggcggggccugggcgccucuuaguggggcggggucauccgaggaagggcgcggcauaaggcggggccucaaaccaagacccgccuccucgcccuccggcugccaucguggaggccgagacacugguggcuugugcugacuuguauuuggcuacacuccuuucucgugcccucuuuuugaccucuuacuggccccgggucuggguccuuccuucucugcuccaauuaccaccuucugucuuacucuucuguucccaacaacucuuucuuacccuucccccucauuaaugugacauuuggugacuggugaggcuagaagccucugaaagacugggccucccucuuugaaagcugugugugggcaugagccacaaaggagcaaaucaccugguucgaaugguuugcaagguauuugcaaaauuagucacugagucuucugacccaagacagccuuuccuggaggguguuugagcacaguaagugaucuaacuuugaucccuuguccucuuugcucuccauauugugugugcuggguuauggggggaauuauacagggguuucagaaaguagacagggauucccaaaacuaaucgagggcugcaaacaaaaacuauuaaaaucuaggaacagcacagagucaguggcaggucccuagggcucuggcucuuugccuggggcacagccucugaagacugacaccuguucccucaucccgccaugcuuguggggauugcuuucccccaccucugcaccuguucuccuuuacagagccugagucagaagauaugaucuccucagggggcugggcagcuaagaccaacauuccuugggccuucgcucaaucccuuagaaauagaaaugacaccaguagcgagucugggcugcacagaagguauuuaucuugaccccagcaacauuauuuaguccagagaagaucugcaaucucucagaaaugauguggugaacacaggucuuuuccucuguaguuuuguagucgaaucaagauuccaucuaccucugacucuagcagcauauaaaucagucguucaaucugucagcagauuuauggacuaucuggcuaggccccccgaacagcaggcaaagugcuaagggggacacgagaugaaugagacaugaccucugcacuccaggauccuaccacggaacaaauacaugaaacgauaacuaaucccggaugccgccuguugccgaugacugaugcagucccacgggcaaccgaaguacagggaggaagacaaaugacugugcaguaagauggcugcuccucaggcccccucaggaacuuguuagguaaggagacaaggcugcacagcaaagagggaacgugugauacaugaauuaaacacaggaaggaagauuccccaauaguguacgcuuguuaucuuagcaguagacgauccaucuucaaaugucuuuggggaguagcuccucccccacucuugauagacaaguggauccccuccaguccucacccugcuucucacagucccugacaguuaagcccguccccaagcugaccaagguucuugcauuguggauugguuggccuaggaccugaaccaaugaaguugcaucugccuagccaugugucuuagucaggguuucuauuccugcacaaacaucaugaccaagaagcaaguuguggaggaaaggguuuauucagcuuacacuuccauacugcuguuggggaggaaaugguuuauucagcuuauacuuccauguugcuguucaucaccaaaggaagucaggacuggaacucaagcaggucaggaagcaggagcugaugcagaggccauggagggauguucuuacuggcuugcuuccccuggcuugcucagccugcucucuuauagaacccaaagacuaccagccaaggaauggucccacccacaaggggcccuucccccuugaucacuaauugagcaaaugccccacagcugaaucucagggaggcauuuccucaacugaagcaccuuucucugugauaacuccagcuugugucaaauugacacacaaaaccagccaguacaccaugugacucuaucucugcucuacuggacaacuggguuugaaaaugagagaauggguugcuggagggacugagaaugggaucagaccugcaagagaaaucagauguugauuuugaauuugaaccaggcuuaccccaaaacagcacaguggaugccuaaaaaugaaaguuuuauuuuuugaucacucagggagguggccaguucgggaucugaaccguggccccaaagggagguuguacaacacuuuuaaagaaugggaacacgaagcaagagggaagcuggggugagcugcaguauuauccaauugucuuuugacaugauggguuaaacgagguaguacccauuggaaacugggccuuauccaggcaccuggcuucaagguucuuaauucuuucucuuagacauuaggucuggagcccaagguccuuaauuccuccuccaagacauuuaguccagagcuuagagugauaagagggacaaaggagcaagucagcugcaugugguuaauuagggcacaacagguaauuuguuauguauuuuuuacaacuuaugcauuuugguuuagauaacaguaauuucuauauccuuuaccgguuaacagacaguuaagaaaacauuuggagacgugggauaggaguuuguuccuaguccugggaacauggacuuguaugacccugccagcgagauggagaaguuguccuugagagagcuagacucagacaacugucuccuuacaaguugucccugacaugucuggacucagacaacuguuuacgacagaagcuguucugccguugggaaguccccagcugcccuagggccugggaccuugaauuuagcuucuuccuaugauuaaauggagucugaauaagugccuagacuaaguuucuuuuguuuguucccagugcccuccagauugcugguaugagccaaugaagccccuguucacagaagccagcuuguauugaagucuuguaugugaguguguguguguguguguguguguguguguguguguguguguguguguagaggcaaaaggaaaaccucauuuaucauccucagggaugccaucuaccucuguugagacagagucucucauuggccuggagcucaugauguaggcuagaaugaccagucuguuauccccagauguccuuuugucgcuaccuucccagugcuggguuuauuaagugaaugcuaccacacucaccuuuauuacaugaguccuggggaucagacuugggucuucaugcuugccaggcaagcacuuuauauacucagcuaucucuccccagucucuuggagauuuaucuuuuacaacaggagucacagaugaaauguccaugcaugggacugcucauuucacauuuccuaagcugcgaagcaaggauaacuuuugcacagaccaucagaagccuacauucucuuggugucacacacuggcugagggcugaccucuugugacuccuuauuagucugaaaugacaggauagccaaccaggcccacccacacgcccuugucaaugagaugcaagaugucggaagaacgggccauu

SEQ ID NO: 2465 - RNA, 122600 nt, Mus musculus
ggagguggcccggccgagcgugguacuacggcgggcgcgggccggagggggcggggggaugcgccgcggcggcggcgcgggcgcugggcuggggcuuggccgcgccagagcagcggaucccggugucgccgcggcagcugcgcgggugucgcgcugggucggaagacgccguaccacugcgcucccccacuuuuuuuuuuuuuuuuuuuuuuaaauaaccggaaccaaugaacgcggcggcgagccgagcuucgcgggccgccggugaagggagcgggucagcacccggcgggaguccgcuuccgaggcggccgggccccgggcagcuggcggugagcgaguggccggcggcuccugugagcgcuccucccgccguggcaccgggccgggccucgggccgcccucuccggcggcgcugggcagcaaugcugcucuucggguuguugguggccggcguggcggacggaugcgaucuggugccccggcaccuccgcgggcggcgcgcgucgggaucggccggagcggcggcgucuccuucggcugcggcugcgggcgagcgccaggcgcugcugacaggugaggcccgugcgggcgacgggcaggcuuggcgggacucccggcaggaccccaucccccgagagggcgccuagcgguugccuuggcgccggucgucgcacuucggacgccuuccuaguccaccgacuggcgccucuacugugcuuucuucgcccuuagugggcuccugcgagcuucccagcugagcaaugcagugguuucucuuucgugcugccgaagggaccaguggggucuguaggggacugggcucauuuccccucuucccaaagccgccaaagaaaguaggcggcggcagcagcagcagcaaugcgguauggaguuggccccuguugccuuugcaaaggcggcuggcagcuucuuaccgaucgagagccgggcugagcgcccugucccaggggaagcugcugaagagauucuuugagagccacagcaccuaguggcacuagugguucuguguuaguaugaagaaacgucaaagucugguguguuuuuguggggguacgaggacgcuuuaagggauggaaaguauaugcuguuugagagcaucacugggugacaaagggugcagaaagcgcagcagguaaccagaaacacaccuacaauuuaccaagugcaggauauuugugacguggauuugggcagcauaguucugauggagugcaccaguaccuuuuuuaaacacagaacguucuagcacuuacugaaaacuugcaaauauguuugguaagguuaaguagaaaauuguaugcuuuuacagccuucguugucuuauauaacugaucuggugugguuuaagcagugauguaaagguccugaaaugauuuccuggggcacagugcuggagguagaguaacuuauuuuucuugcugcuguguuuauuuuuaagguagaucucuagguuuucuggaagaacagcaggauuaaagaggaauaagaugauucacuguuaauuuaacugcagugguagcccaacaggcgucugggaguuacuaacagcugcucagcaaaguguucaggagucuuuagaucauagcagcuuuccucugaguucugugacaggcuauuuccuguugcagacagaagaaggaugucgguaagcauugucaggcacuuugagaguuggaggguauagagcauaaugauuagcauacucaagguacucaaaaaacuuaccagauccuggucaguugaaccaggcaagucaucacugguugccuuggauaaaggauuauagaaugaucuuuagggacguaguauguagggagggauauauugggugguuucaugcucaaauaguuauuuucuaacaaaaauauggcaaguguggaagggaacaguguuaaacuaguuaaaaccuacacuagaguguagguugagggcuuauugucuccccuaggaguggaacguuagcuucuaaaugguauaguaguguggguccccccaccucuuuggcagaaauguuugauuacauaaugccuuaacaaaugugauugacagagaggcaagugaucuagaacuuugguguuuauugacucuucaagcaaguauguuuuacugagaacaucaagaaaucagcgcagauggacuucuaauaagcuguaacccuuuuaauuuucucuguaguuauuuauggcacaguugaaaagacgcagugauucuuagugggaaagaucaucacacaaagugaaguugugcugucgugcuuuuuaauaaauuugcugaaauguugaccucggaauuauuucuguuuauaaaagaucucuuuuuuuccccuuauguucaaauauuaauuuuaaaacguuaaacauuuccacuuaaaguuucagauuuuacaacugcucaguaucuaaguugaauaauagaauuuuaauaaguuuaugaaaauacagucagcagggcugguguuuagggaaauguagauugaaaaaugacuugugaaaguagaauguguugaaaaaugcuuugaauuguauggccucuguaaggcccuuucucauuuaauaguuuuuguggguaguucucuuuuauggcuccauuuguuuuauuaaaccugggacauaaauggauggcgauacuucacacuucaggaaguggagccacaggcaaacccuguuacauuccagacaguguuaauggauagaugcagacaugagcauaugagagaacuacauuuuauguggauuuugcaaucugaaaacuugugaaagaacugugagagaauuuuucuccgggguucccugugaaaguggcugucucacuguugacaugucuaauaguuucauaaacugacagcgaccccauucucuguuuuccuucccagauuagcacuuuuaauacuuaaccguuaggagcuucugaggcguuugcuuuuuauuaaaacaguccagaacacaccuuuacauugaagcuuacuuccaagggucuuauguugguguauuuuuagaacaaauuaucuuuaagucuggcuuguucuuaguuuugaacaacaacaacaaaaguauucuugcagagauaggcaaugauaccaucaaaaucaauagauccauugucuuacauguuguaguaauauagaaccaauauuuauaauaucacauaguaaaauauuuaaauuguauaugugcauaugcauguuuauauuuuuaguuaaaaaaguaauccacaugauuaaaaccuaauucagauuaaggauugaaggcuggaguagacagaggauauuuuaaauccguacuuuugaaaaccuuuuuuguuuaauauauacagcaucaauggauugagccagaguggagugguugagcucaucaaaauauugaaauaauuguuucugagaaaucauggaagggcaaaaguaugcaagcuaucucucugccucuucacucucugucucugcauauauauguauguguaugcacagaaagcucagguugggaaaauauguagaauaacaacacuguuuuuuuuuaaacauauacacacacagcuaauuguuucagaauuuuuaaacaaccaacauuagcuuuaaaauacucuauaauuuugaaucaauuacaguaacauucuuuagugcuuauauaaauauuuuaucuuaagauuuuaucacuucaccuauuugguauauuacaggaguauaaaaugaaaaauuuaagguaugucuuuuagauguauuaaaaucuuaacaaaccccacuauucuuaguucaaaguauuauagcauuuugaagggccacuuuauccagacguguuaaaccgcuuaagccguggggcauucacuaauuuaguugggaauuuuucagguuaucuuuggaaaaauacuaauccaagcuuuuaauugucacucacccuacacuccuaagacauauccaguagauacugccuuaauaaugccauuucgagugguuggcuggaucgugcuguacauaugccacguugagucaugccaugcugguguuuacauugugacagcagacuguguuuuccagaaccuucuuuugaugccuuccugcuauuucguuuucuucugcagucuuuggcuauugcuguauuuaccuuguauugucagucacaggacuaaagaaccuguuugcaucuauuugagcuucaucuguucugcauguuuaaccuuaucuguaaguuuguuuagaaacaucccauuucuugcuagucuuuauaaaacuuucaggagugcuacuggucacuguugaugaucucuaagcacagaagaacucagaagugccaauuggaaaugaggguuuaagauuuagcuuucuuugauacaaaaaggauaaacagagauaauugcugauguuguuuggguuaaugcuaaugguuuuagguuaauuuagacuuauaaguaacuguaccaaccauguuggauaugggguagucauuuuaauaugaugugaaugcguucagaaucaugcuugcaguuauguauuuaugcauauaguaauuaaguuauaacaugauuaagugaauguuaaaauagcagcuaauaauaauuaacaagccacuuuugauguucauuaguuuggaccaaguuaggaacuaacuaggagauuauuuuuaauuugcuaaguuuuaucaaccaaacaauuacuaaauacauggaagagauagggaacuaggaauaugaacaaauaaaagaagagcaucccauaaucagccuccaaacgcugacaccauugcacacacuagcaagauuuugcugaaaggacccugauauagcugucucuugugaggcuaugccggggccuagcaaacacagaaguggaugcucacaaucagcuaguggaugggucacacggcccccaauggaggagcuagagaaaguacccaaggagcuaaaggggucugcaacccuauagguggaacaacaauaugaacuaaccaguacccuccggagcucaugucucuagcugcauauguaucagaagaugaccuagucggccaucauuggaaagagaggcccaucggucuugcaaacuuuauaugccucaguacagcaggggaaugccagggccaagaagugggaguggguggguaggggaguggggagagggcaugggggacuuuugggcuagcauugaaaauguaaaugaagaaaauaccuaauuaaaaaaaaguuaaaaaaaaaaagaagaagaagaagaguagaaccauagccugcuuguggggaacucagacuaucacaggcuggggaguaacaguuccauuaacuacuguuacuagguuccguggugugcuaacugcuucccaugaauccauguguuuagaugugagacuaacccugucagaacauuacuuucauagaaguauuuuaugagaaaauggaugccuugugaucucaggcauccugcccaagaucuguauaccuaauguugauuagcauaauaauggagugcaaacuuuucgggaggagagaggcuucuguagacuuugagguagacguagguauguauacuucguguagaggugaaugaaagagccuucaggagugagaaugugagaauaaggaggaagguaauugucuucagagcuaugccuaguauguguguagagguugagcaucuaaaauuggauuucucggccgugugcuaggucauaugggaagccaccagaaaaauuugguaaaaauuucuuggcacauugauuuugcugcuuaauuuagaaaguggaaugaaacauuuauuuuauaauugaaaacacauaaaauacuaaauguguacauacucgggagaaugaaauuuuaauuuuuuagggcaaauccuaagacauuuugaauaacuugagagauuuguuuauaaaguccgagucuucugucaucaagagggugaggaacugugauauuuaagcaugagaaugaccuguguuugagaaggggguucuggguggguggaaguaagcagaccaagguggggaggaggcaguuagcaagcgguacaggaggcgaggaccugagggcuuagguuguacaguggcucucucugaaagcaaguuguagaaaguugguuucuuucuuagguuagacaggagccuggcuguugucuuuuaaucucacuuagaaugacuuaauuaguacaagccuuuaaaaacucccagaagaaacaugacaucuuuuuuuccccuucaaguaugccuauuuaucacuucaaaauuaaguaucuguguguaugauuuagcuuccaugaugauucacaaaauaguuaacaacaaaacaucacagauauacggcuaacugucugaugaaccaaaacccugauagcuaaagauucuguguuuauauacagccuuucaguccauguucccguauucauguuucuucuguauuaaagggugacuguccagauugaguuuaugccauaguuagcauguucucuccuguuuggagaucuccaguguccucugugagcagcagucuucugaggacuggcuuauuauuuguuucaaaaacacccuuugaguuuccugugugagguucaagucugguuuuagauaauggucucuaauaccaaacauaaguagguugguuuugcugucuccaucuugcucucaggaucuguaggauuucuuuugugcucagucuuucuugacacuuucuagucugacuuccaguaaacauuucccuugacugguuccuuuguugcugauuuuaaggaugggucucugcuaaaucacaguucuggaucuuguguuguucaagcugaacauuuccuccucagagaacauuacuaggaaaguucuacugggguagggaaccccaggccaaugauugauuuaacuuuuggcuuuguuucauuuggcccuuuguacaacugcacagccaucauggcuacuauccccagaauacuuuucuuccagcuaggcuuugucaaucauguaguuuuucagagaacuaacuuagauuaaggcgaaagggaguuggaggauguuaauagugaggauugaguguucuuuucuuaaagauagugguaaccaccucuaccuagcccagcuucucccacaggcccagggaaccuccaagccugacaagaaguuuacugggaugggccugccgagugcuguuugcaaguuagcuggucuuuaugugcacugcagaucuugcaugugagcuggucuuuaugugcucugcacaucuuggccucugugcaacuguuuagccuccaguuauuuucacuuucucugccucucugugaucuugaacuucccauuauguaacacuucaaaaacucuuacugaguuaagugcuugguuuuaguuuaaaaaaauacuagcaguguaucucuuauuuacaugauuucugauuauuaagcaaucucauuaaagaaucuucagaguaaggaccgucagcgauuuguguuuguuaagugaguuuuaaugcuugaaguuuguuuccuuccuuucuuugacagggucuuacuaugcagcuguauugagucuguuuucauuaggauagucuuuaaguccagaugcucuccuaagccugcuuccaccucccaaggggcaggggagggggguuccaggcgugugggaugccugugcccgucccuuucauaacguuuucaucugcuauucaaccuccuuaacccuuugcagacccauguuuucuuaccucuacuguuucucuuuccuuuaaaaucacccgaugcugggucccaagaugcucuugauuauuauucucuaccagaaaccaucuugauguuuuccgcuaaagguguguguccucacuccucaucuuggaggucuucugcuuugccacauguauucauuguaucagccuuugcuacuuucuucuuaguucuaauuaaaguuuauauuuugguuuuuaaaauuguagugauaggcgcccuauaauuuuggaauuugcauuugugaauuuacugucugaugugcaucaggccuuagguuugugaggaagggucugaggaagaaccaagggagauuaaaggagaaagccagauggguguuugcauauaauuuuaagcacuauuuaacuacugucaugugguagcugugacuugaggaacuaguuauauaaagaugcuguaguuuuccuuaaaaaauuauuguaggaauaguaaaccugaaacuugucugggaauuuuuuacacacuauaaaacguguuauuuuuguagcuuaucuguuuacauugcuauguauacuagaaguacauuuuagugguaucuguauuuuuuauguucuuuuucagcauuuuucagaacagccaagaugugggaacaacuuaaaacuucaucuguugaugaagaauggauaaagaaaauaugacauacaugcauauauacauagacauagccauuggaagaaaaaaaaguucugcuauuugugaaccuggaaagcauucugcuaaauaaaacaacccagacacagaaagacaaauacuccaugcucucacuugcauggggucuaaaaaugucacccauaguagaauggagguuaguggagugcuugagauuucauaagagacuacaucauagucuuaucucauacuaaaacuaaaggugcagcugugagauaauugguacauugaccagccugauagugaugaguguuucacaguucacacccuuaucaaaccaaaauguacaccuaagguagcuauauuuccuucaguugucaagcgccucacuaaaaaucuuuuuuuuuguuuguuuuuugagacaggguuucucuguguagcccuggcuguccuggaacucaguuuguagaccaggcuggccucaaacucagaaauccgccugccucugccuccugagugcugggaugaaaggugugcaccaccaugccuggcucacuaaaaaucuuaaaaaguguaguauuuaauagaauuauuuuuauuuuguguuguugugcauuuccaccccaguuuuggaagcugggaucuaaccaggaucuugccauugcuaggcaagcucauuaccaaggagcuacacguccagcccccuuuggaguaagaugugcuguaagcaaacacaagccucagagguuuaccaagcaucagguuucagugagaugcuuugccucucaagaucaggaagauacccugcccugaaguuguuggugcuguaccuacuuaaagacugaugauacacugugacaaaggaaugaggacaugccguuuccugaguuaaguagauguucuguucccagaguggaguagagcaugcgaguuggguggauagaagagggcacacaguaugagaggaggaagcugagaagggagacauuggcccaugagaaugcaaaaugugucuguguauggcagauauccagaugacgugacaaucagugcugagccuguggacucuaccccaacauucauauuuagacgcggagcucagauuuuuuggcagcaguuuugcaugccuuaucuaucucauuuaacacucacagaauccuugggagcgucuuucccauaggaaauguuacauagaauggggaucuauuaucuaauuuaaagucuuccagugccaaguaucuuuagguuaaaguagagaguauaauugcaguuaaaucagggaaugaggcuggagaagcaacagaauuagauauucuagguagugugaaaguggaucuuuauuguccacuggccuuugaacuacaucuucauuuuguuaauaaucgaauuuuucugugaaauauucugaaguuuuaaagguuguucucaucuacuauacagauuauaaagcccagugauauaucugcacugugcuguaaaaagucaguguccucagaagaugggaguuucugcuuggguuuguuuuugugaauauuccuaugggauggaauaugguuuuaagacuaauagcacuuacaugggaguguaaguuuguucuccuuuuguagaaugugauuugucuguagaccauagcagguuuuuauuaguuugaaucacugucugauaguggauuauaauuucagguaggggacuuaacuugcugguguguacauuuucauuuauuuagaauauaguuugaaaaacuaaugaguuaacauuauacaaaagugccuaaccuagcaccuggcaaguguaaguacucaguuauugcuaaugccuuccccuuuugccuguagaucagacccagggucauagaaaugugccgagguuugcugaguauuagccuugugcuuucuguucuuuuuaugcaucuaccugugcaguccugaggaguagacaccuggccuugcauacuacuacacaacugcauucccagcccuuucugugacauuaaaaauaaauaacuaugaggugcggauaauagcucaaucuauaaggcacuuuuacuugugagcaggcauuccaucaucaaaacugguggaauucauugcuguggugacaugcacuugcuauccuagcaccaggcgagacuggugaggaucccugggggagcuggccuaccagccuaggcuacuuuguaagcacuaguucauugaaagaggcuaucucagaaaaguagguagacggagucuguggauuaaccucugaccuacaggcuuguacacaugcaucugaacacacgaacacacagaauaacaguaucauugaagacacuugugugacuaaguaaccagaucauuaauguguauuuuuauauguauuuacuaauaaccuugggaugauuuagaaaaaaagaauuggaguuggagauuggucccaagggccuuuccaggcuaaguguguacucaagagcacuuuuaaauguugaguuagugaauccuugggugucagauguauuacaggcuuauggaaguguuaggagcacugauguauucaguuauaaggcucacgggcuccuagaacuuacauuacuguuuaaauugggagcauaauuaauaucuuaaaauaaugagacauaccuguuaagaacaaaagagaauacaugaaauagagaauaguguggcagagaggucauggggcaccugcuaacuuuaggagggugugcuaauuggagaagcugcaaagaaauucauauuaaauuaauaaaaaaaaaucuauuacccccccccccccauguuugugguuguuuccuuccaccucaaguugcaguuguuuccuuccaccucagguugcagggauugaauugaguugacagucuuggcagcaagcaaucucacuggcuggaaagucacauuuuuaguacaauaaauuugcauuuauuuuuuaaauauuuuuggugugugcaugggcgugugugugugugugugugugugugugugugugugugugugugugugcuugcgcaugcuuguacuugucagcucuccagugaggggacuaaacacaagcucuuugcaaaguuuguacucuuaacugcuuacuuaccuucacagcucccugaagaucauauauauuuuguuuuguuucauuuuguuuucuagggacagguucucacuauguaacucuggccauccugcagcucacuauauagaccaggcuggccucacauucacagcgauuucccagaucuggaguacaggauuuaaaggccuacaccacugugcaugguuuaaggccuuguuguuguuuguuuguucuuucaagacaaauucucacuauguaacucugacugucauguaacucuguaaacgagguuggccuuguacucacagauauccaccugccucugcaacuugagugcugggauaaguucaccacuaccaccuauccuaaggucauauuuuuagugauaguaauugaagggaguugagagugaacauuccacauagagguauugauagagauuaguuagagaucccaaggcaagaaagaauuugaauuacuugauuuaaauaucucauucuagguuggagagaugguuuagucaguaaagagcacauguguaaaagcagggcaugaaacaugaguguaauuccagaucuggggagguggagauaggcaggucauuguaguucauggccagcuagacuagcaaguccaugggcucuugcuucagugagaacccuuccucaaaaucuccauaucaaggacacauagcacagccccaacacacacacacacacacacacacagcacagccccaacacacacacacacacacacacacacacacacacacacacacacacacacagcacagccccaacacacacacacacacacacacacagagagagagagagacagagagagagacagagagagacagagagagagagagagacagagagagagagaucgaucugcuuugucugagcauauuuagagggggaagaucagcaugagaucuggcugcugaagagaguggggccagaugguacagaaccuucuagaucuuucccuauuuuuuaacuuuuucagaggauaaugggaaggauugaagcaucuuaaagagggaaaugaaauaauaggacuaauuuuuguugucuauucugcauaauuuuucaggccaugauagaaaauacaaaaaacaaaauuauuuuuaaguguauguuuuuaguauuguuagaucuuuuaaaauuguugauuccuagaacuuuuuuuuauguuauaaaacugaaauagcuguuaauucuguuucuccaacugcuggcaauugccauuuacauuuuuuguuucugugaauuugauuacuuaagguauuugguacaaguagaauccuacaguaucugccaaauuguuacuaacuuacuuguuaguuggcagaauguuuucaagguuuguaacauggauaacagaauuucaaggcagagacuuuguaugcagaccacauucccacccucccucccucccucccucccucccucccucccucccucccuggacacauuuugccugguauaaguaauguuggcaacaugagugcgcugauuucuuuguuucuuucuuucuuuuuuuuaaagacuuauuuaucuauuauaugugaauacacuguagcugucuucagacaccccagaaaagggucucagaucucauuauggaugguugugggccaccaugugguugcggggauuugaacucaggaccuuuggaagagcagucagugcucuuaccugcugagccaucucaccagcccgaguguacugauuucucugacauccugcuucuaguucuguuugcuagauaucuagaagugggauugcugaguauauauggcuuuuacuuuucacugggugcuugccaugucaauccauacgugguagcagcguuuuacaaccugacugggacaggugugcagggcuucacuguuuugcaugauuuaagaucuguuggcugcuguuuggaauacugauaggaagaauggucacagagagguugucuaggcagguggauccucuguccagagggaguggugguagaauguuagagaagagaaacuguacagaauugauuuggcuuguguauggauugggacauugcugggacaggaacagaggaaauaaagaccacuuuuagagugugcugcuuaaaguccccaagacguacguacauggugucauccuccuggcaucccauguuccuagcagaccccggcacauuucuucaugugccucauuagucaggcugggguuauuaccaaagggaaagagauaucuuguuuaggacaaccaugauuucccccacuccccuccacagcugggagaaggggcucacuuuaccagcauauuguugccuccuuuuagaacaaaguggagauucuuugagggaaugacauaauuagcuuuacgagcuuuggaaaaguauugugauuuuuuuuuuuuuuuaaaguaccauagccaucuugaaggguuuuguuguaaagauuauauaaaagagugaagccaucacuaaugcucaguaaacaucauuuuacgugacucuuuccacuccagccauauuagugugugugacagagagagagagagaaagcgagagagagagcuaaacaagcuaaacaaucuaacaaacaagaacucugucuuuaaaaaaaauacuuacuuuauuuuauguguaugaguguuuugucugcaugugugucuguauuauguguuuaugugugccuggugcgcacagaggucagaagagggaguuuaaccugaugaacugcaguuacagaugguugguaccuagaguuagugcugagaaccucugcaagugcccuuaggggcugagacauugcuucaguuccuacaaaaacaauccugggguugugcuugccccuuucucagcucuuuucaucuuucccccauguuuguacuaaacgcagucauuuggcacugcucucucuuguucauuucaucuuucuagaugccacuaguuagaucgaaacuugguguaugagguugaugguggagaaaaaucguugaccugcauaucucgaguaugcuuauggaaaauugggcucucuccuuauuuucuccuuuauucucuugcuuuauguuccuuucaucucagauugcccugucucucaaaguucguucuaaauacucaucauucaguuggugcuuauuuauaaaaaauauucaguguucaguguacugcuuugaaacaugaagauacagcacugggcagcauuugauauggauccuacuuguccauguuuuccuguuguaaagucuuccaaauucuucgcagugagcugugacuccuugccugcucagguaucuauucaagugucuuuagaaaguugucccagaacuuauaaguacuuaacagucugaagguuuguuucuggagucuguuguggcuauugauacauuuaaucuauaucaugauuaaugguuuaucuauuucuuugacacaggguccaguuuuuaaaaacagguagucuggaguguaguaugauuuaauuauuggaaucugcucuuacuuaaucuaucuugagggguacaugaaaguuuuggugugacuuugaggaagaacuuugaggaagagcuguguaacucaucuuuauuugugauugcuagcuucuaauagggaaacguuaugagaucaacuuucaguuuucacuuacauaaacugaguggcuaugacuaauauauuacucauuugucuuaagucaugaacuuggauaaucugcuaccuuuuuauaagagucuaggguaauuacauugaugggauuauuuaagagccuggaauuuuauucaacuuguaguguuauaggcuuuaaaagacauuuuauuaaaugguaguuaaggugcugaggagauggcucagcaguuauaagcacuuaggcucuuacagaguacccaggguuaggcucccagcauccaugucagguugccacgagugccuauaacucuuugaugcccucuggccuccucaggaacauauaagcacccagugcccauaaacuuacccaggaacacacaugcacauaaaaauaaaagacuacaauaacacuuauguaaccuauaaaaagugcaguuaaugugaguuuaggaguuauaagcucacuauuuggcaucaaguauaaaguuacauuuugcuucuuaguuugagaguauucugugugauagcuuuuaaguuuuagaacaguaguagaaagcuaaaaucauagucuuucucaugguuucaucuuuaauauuuugauuauaguugucugauuguauucagaacaaauuggcacuuugcucauuuaugauugccuuuagcugaagcuaagcagcauauugcuuuuuauuuauugacaguuuuuauuuauuuauaauaucaacuauacaagucacagugaauuuuguaaaaagcauauauaugugcuuuacauuaggaucaaccuuacggcccuacagaagccagaacuagaucccugaucuauaaacuuugacgcuuagauuguucgcuauguacugugcuauauuuauuugagaugggaucuugcuggguugucuagguuggccuuagacuccugggcucagaugaucccccugccuguauauccuggguggcugagacuuuagaugaucugccaaucacuguacuacuggcugcugcaauguaguuauuuauuuuugagacagggccucucuguggaguccagaguggcguuuugaaaguggugguuucuuuaccuucuguccccgagcgcugagauagcaauugugcacuaccaagucuguguguauagaugcauuuuaagaucuugcagaaauaagcugguccuuucaauuucauacauaugaauauuuguguuuauauacuuucuuauauaauugucugguagcuuuuguaguacacugaaaguuuggcuuugcauuuuaagucuuuuaaaguugauuuuuuuuuuagguagguagcuggcaguuuugagagauuuaucaucaccuaucuugaauguuaagcuccugaagaccaggauuauuuuucuucauggcauaaaauagauauuaaaguuauccuaggaugucuaauuuauaaugugacaguuugaaaguggcucuauucaggaacuagcagguaagucugcacucagucagucucugaguucuagggaaauagcagcugcuuuugcuuaaaggccaaguuagugugcuuagaguuagucucuuccuaaucauaaugaagaaacucauaacagaguuugaaauuaaauaaccaagauuuuuuggggguaaggagucuucagagugaggauaugcaaacuauagggacucucauuuuuguauuuguuaaaagaaaacaccguuauaaagaauaauuugcacguucuuaauuuguaacuuagaagaguuaauuuucauuuacuaucuuuuguuguuguuucgagacaggguuucucuguauagcccugacugucccagaacccacucuguagaccaggcuggcuucgaacuccagagauccaccugccucugccuccugagugcugggauuaaaugugugagccaccacuguaugguggcucacaccuuuaauaaauaaauacuuuuauuaaauaauauuaaacuuauuaaauacuaaauuuacuuaauaagccuuugacuaucucugcuugggauggcugaugugguagcuguuuacugaacauaaaguauugguuggguuagaauguuuccuguagggaucuuuugucaggagacgugaugcugggcauucugacuuuccuucuuuauucacuaaguaaucugcauugagccccgagcugugcacgaguguuuccuuauuguguugugucccuagcugugcacuccgaguugauucugcucuguuuuacuccuguuggucacuagaucccguuaguccucauucucacauauauucugauauuagugagaauggcuaacaaauacaggguuucauaaauuagaauugucauucccaaggauaugcugaauuuaugcacaguaauuguuucacacaacucauaacuaucugcuuuugcuuaauguauuugcuaaacacaauuuuuggucaaagcaauguugucugaauaccuacagcucaaagcaaugcagucagaguagcuacauuaguagcacauggaaggaagcuucauucuucauucuugaugcaggauugaacuuaagaguucaaagucagucauauucucucucucucucucucucucucucucucucucucucucucucgcucucucucucuuucucucucacaacacacaucucuuacuaccuuuucuuaauucuauuuggugcauuucuucuaguuaauuuuauauagcauuaagaaaucccauguugacuuuuuaaggaucacagaauauauuuucacaaaaucuccuuucuguauacuucccuacaauauaucuuuaauacagucuugguguaguuugggccuugaauucccccucagagacucauguauuaaagcuuugguguccagccugugauguuauuggucacaggugguggaaucucugugggguuagauuggugaggggaagucaggucacugggucacgcaugcucuuuaaggggacugagauucugauuccuucuuuauguuugcugauucaugagguugucaccauugucccacccuguguucccugccaggauauguaugcccuaucacuauaggccccaaagcagcugggcacauugacaccagacuggacccucugagacucugagccaaaacagaccucacucuuacagcgcugacaucucagguauccugagaguaacuuacugcuguguaacuuacugagugugcagcaggagcucaccuuguaacucgacugcucagguagggcuugcgaaccuucuuagaucucugcuugcuguuuuucauaauucuggaaaagcuuaacugacuuuuucaaguaauccuuuucucguugguauucuaaguauuugcuauauuauuuuauauugucucauaguugugggccacaaacauuucccuuuugauacuaauuuguucuuucugcuuggaugauuucuaccaaaauaucucacguuucaaaauauuugaaacuauauuuuucuuuuuuuaauuuuuagcauuauuaaaugacuugugauuucuaugccuugguuaaaacccccuaucuguucaucauguugaauguggauucuaauauuagaaguuuccacuugaucuguugacauuuaaauuguagucauuuuagcaucuggugggauagugcaaacauuugaguuaucucuguguuugguuuuguuguuuguuuuguauguugaaaaugguuuauuuucuugcguuucuuuuauguccccauacuuugggauugaaugauacacuugagaaaguuacguuuguguagaaaugauucugugacaggcugagucagcgugucauuaguuaauggcacgccucuuuguugucacugcuacuguugauggcgcacucaccuguggcuacuugcugugcugaugcuuuguguggcccagagcagauccugcugugucagcgcugcugccuuacucugggcuuccacugugggguggggguggccuucaguuuuagguaaggcucugaauuguccccaguuauucuaucaagacuucacaguguggucgagggucaugaaggaugacuagcuuucauagacuucuuuucuauagaugccuguaauugauuuccuuaauuaacuuuuuauaugaugcauucauuuguuaacuuucuucuguuuuucucuuuguuacuuuauucauucacucacucacuaauucgugauaauaaauuuuuaacacugcaaauccuauugagcuauacuuuacugaucucugauauuauuagcauuaguuuuuuuuuguuguuuguuuugcuuuuuuuacaauuuagugugcuguuuaugcaguuuuauccuuguauucccaacuuugggcauauaaguuauaguuuuuuguguauguauaaauuugacaucuguauuauuaagauauugacauuguuuauaagaauuacaccuaacaauguucauucaaugaagagauguccuuuuuuuuguacuucuguaugaaagaugaaguuucuugggaucuuggcucuggacuacuauuguguugaacauccucgucucaugaaaagacucagucuagucauugugauauuauagugguacacuaauuuguauuuauaguuuuugacuuuuuugaauaaaugcaaauauuugcuuauaacuauuacaucuauacaccuacuguauauacuugcugcuauguuuguaaaaauauguauauuauugaaaguagcuuaugggcugucccuuccuuccuuccuugcuuccuugcuuccuugcuuucuugcuuucuugcuuucuugcuuucuuuuuuuuuuuuuuuugauggggucuuucuguguagcucagacuggccucuaaugucuuacuuaaccucucaagcguuaggauuacagguggguuguauaacagggcaucuugugguauaaauaugucuugaaaauaacuuaaaauuauuuuuuccuaggauuaaguuuuugagauuuuaauucaguauuuuagacuagggguuugaucuuuugauuuucaucauuuaagagcagaaaggggcucuuggguaaagaagaggauuaauaggagagggauuggggaccugaggugggagaaucaagaacaaaguauauauggaaaugucacagugaaacuuacuacuuuauaugccaccuaaacacuuaauaugaauagaugucaacguuugugguuaugauguuuggaguuaugucuuuugguguuguauuuauaccucaaaaauuuccuguguauuuaucagagguacaugucuacuccugcuggucuguucuccuguaggcugacuccugcauccuggcaauaucuuauuguguguuucuuccagguuuagauucuguccucuuuccuggcacuuacucuuguucuuugucuagcccuucaguggcucucugcugccuguuuucuggugguuuaacuaguuucuaggaugggcgcuuuuucacauugcauuuugauugacuuaucaaccuaauaggccaguaaguuuuucaauuauuuuaugauuuagaaauuauguauuauuuuaguuaauggacuuaauuguguugaaugcugaacucucuagacuuuggauuaugauaucuacuuguacccuaaaagccuguuaauauuccguagaguucaugguugauuuuaugauguaagggcauucacugacuuuuucccuuucuggagaggaguggauaacuuuguagaaggauuauguaauccacucaguagaccugagcuauuuuauuaauuuuuuuuuaaucugcugguuuauucacagaauauguauugagggcuuucucuguccugagugacuugcaguggcuuuaauuuagguuugaguacacugacuauauuuaguaguuuuuaaaggaucauguuuaaucuucccuaaaaacaggagaugugaggaaaugggaugcuuaaaccuuuaguuuaguauaaugcucacuaucucauagauagugaugagauaaacccugcguggacucacuccuguuucacaugguaggaacuuccuaguacacuugcccugccuucugucacuauaagaacaguuaagguucagcuuuguggacugauuuaggcaggaucucaaaagcugucugagauugcuuuaguccucaugcucauauccugaucauugucuguaaauacuguggauucuaaccucuguggccacuugggcuucucugcuuuucuuugcuguccucuaguucgggccaucauuaccucuuccuucaggggcucuucuagcagcuuccucuuuguuacagcccagucucucagauccuguaacacuauguagagaucucugugcgccuuccugcuuuaguggcuuguuuuccuaacugcagaauagaaacaccauacucuaaaucacagcauggucuggccuguuuuugcuuuccuugauguguuuugucauguuggcuuccucucugcugcaugaauaugacaaacuuguucguucauuugggccuugacgcuucucaguuucugucucgaguuucccuccuuaacuuuuggcacggcuggcuguuucuugacuuuuuuuucuccccucaggacuuuuuugaugauuucacauaggaacagucuucauucuuguuugcuucaguaaucauagaacugauuuaauuccuuuauaauguuuucaaccagauauuaaguuuuaaugcaucuguguuguguugucuguucucagccaugugaauuggagcuguggaaggagugggcccaagccguucuugaucaugcaguguggagauugugcuacuaucuucuguacucuucugaaaacuuuuuggauaauaaacaucuuauuucacacauuaugugcauaaacuuuuuacuguauuuuauuuuuucucucugaguauccaugaauguuauaguacaaaagaauauuuuuuacccaugcauguuuuuaacugauuuaaaacauaucuuaugguuuugaaaauaaaugauauguuguuucaauuuccauuuuuuaaucagauagucuuucuuucucugaacuuagaaauggaaaguauggcaaacaguaaaacaaauuucucuuaccagaauaaccauuuuaggauuauuuuuaugugcagcauguauuguuuuauguaaauguguuauggugugaaugaaucccuguccccagcuuacacagaggggaccuuagcuucucgggggaggguuaggguugcuccucugggaggggaccaggacacagcauccuccccuacagggaauagguacucuauagaagaugauucugaaggcuaaucagaccccuuugcucuucuguuaugggaggacguaacaaaagagugcccucaccauagguggccccacguguugaggauuuuggccuuuagaauugugaccaguaauuucuguugugaagcaacucaaagguauuucugucauaggaucugaaugaaugaauaugaaauaggaauugucauaguugcucuuuugcaucuugcuuucuaaaaucuagcauaucuugaguuuuuccuuaauuauuaaaugaaauugaagauauaaauuacuuauucauuuuuauuggauagaguccuauuggauaauuuuuucccccaguuuuucuuuuaugauauugcuuugagcaaauguguacuuuuggaguucugggcuuuaaguuuauuuuuaguuuuugagacuuucaaacaggaguacacuguauuuacauaauuuccacccucucaccuccaacaccucuuguuuuccccaacuucaaucucucuggaauuccuaaccuuuccauauugguguuugugugugugacacacacacacacacacacacucucucucucucucucucucucucucucuuccuaguccauuuaacguugcuuuuauguagauguguuuagcacugaccacuuggaauuggcuaaccuaucagagggcugucuuguguauguagacaacucauuuuccuucucugaacaccaguugacuguuguucuucaucuaggauuggggacuuaaggaauuucugucauccugguauuaugucaacuagcaugauucuuuuuuuuuuuuuaaauauuuuuuauuagguaucuuccucauuuacauuuccaaugcuaucccaaaagucccccauacccucacccccacuccccuacccacccacucccacuuuuuggcccuggcguuccccuguacuggggcauauaaaguuugcguguccaaugggccucucuuuccagugauggccaacuaggccaucuuuugauacauaagcagcuagagucaagagcuucgggguacugguuaguucauaauguuguuccaccuauaggguugcagaucccuuuagcuccuuggguauuuucucuagcgccuccauugggggcucugugauccauccaauagcugacugugaguauccacuucuguguuugcuagaacuggcaugauucuuaugcaggucuuuuuuagccacuguaugguugagaucucaugggugcagcaucccugccaugucuaaaaaauacugucuugcaacagcuguccucauccuuucaaggcucucuccacccuuaucugugguguucccuaaaucuuauguguaaagcuguguaguguauaccuugcugggcaccauauagucacuauugccagcaucuugaucaguuuugaaucucuuucacaguuuccaucugcugcagaugaugcugcugagacgaggggugagaguuucacuuagcuguggguagaaggauagguguuuagaguacaguuggaaaguguauugauugagaaaaauggcaguaauagguucuucuuuagguuaggauaggauauauucccagaaguauacuauaagggaaauagauaguaauauuuuaugguuuaauauguacauuuguauauaccuacuuauuacugacuugccuuuucggaugaauuuugguuuugggguauucacugguauuuucuuggaaaaaauugcuauuuguguugaugauuuuaauuuaaaauacuugaauauuuuucauguguauaaguauuuugccugcauauaugccuuuguauuaugagcaugccugguaccugcagaggccagaagaguguuaagucuuuuggaacuugagguacaaacagcucuguggguccugggaaugaaccuggguccucuagaugagcagcuaguacuccugacugcugaaucaucucuccaggaauaugucuuuauuucuuugaucuuugacaucaaugguuugaauaucuuuuuguguaucacuauuuuugcuauugucauuuuaaaacaagaucauacuauauugucccugcuggccugguacuaggcuggucuugaacuuguggcaauccuacucuaagccugauuuacagugcuggaguuacagaugugcacugcugugccuaaucacuccuuugaguguuacuggguggauugccucgugaaauggagggaggaccugggagagaauucuugaguaacacugagagacagucaagacugguucuucucugacauuucuguuaguucacuggcuacuguaacaaugagugcucauuaaaagaguuaagagccuucuucuucccucccuuccccucuccuuccuauuguaugcuuaguaggcacucuacuacuuuagcaacauccucagcccugcccuugaauuucuuaacaacuuggauuucugaaaguuaccuguuccuuaccacaauguaaccaugucaucccuacuuucuuuugucaguucuucuauauggccccucuuuuuugcaaguuaguucauuuuaaauacuuuguauauuuuuucugucauuaauaguuucauggcuuuaaccuuuauuucucuuuuaccauaggaccuagugcucaugugggaaagguugagagggaaauagagaaaggaauaauggaaaauauucaucuuuaauguaacauaaccauccauccauccauccauugauuuuaaguauugaggauugaacuuaggguuaaguacuaccucugagccacacguucagcuuauagcucugcauuucaguuauguaucaacuccuuacuuaagggcuccaguguuucaguuuuuccuugguggaacauaauuccuaccacaguauguacacacacacacacacacauacgcacacauacgcacacacgucuguacugccuauaauuuggugugcaacguuuugcccccucucuggauaugagauuguuucaaugcuuaggaagacuguuacgaaggagugcagugaacugguauauccuaggacauugucugagguacugagaguauacaauaaguuaugugguauguagcaaagcuuuguaauagauucauauucuguaacaaagcuacaguuggaaguagaauuguacaguggaaauauaauaugaaaaagacugacagauuuaaaauggacguuuccuucuacauuuauuuauuugaaggagauaguguuauauuacaucauuuugcuuaacucguagacaggggaaagcauguaaaggucuuggaauauacuucuggguuccuaaguggcucacauaaaucuucaaggcuggauguuuugguaugacacugauaaauucauuauauggacaucaaguggaucuggagcaccauauuuucugaaaaguuucuguuaacaauaggcuuaucaaauugucacccggauuaacaccuggcuaauggauaaacuucccauuaaaucaggaacauuaucucaagcaggauugaaauaaugggauuagaugcuugaauucuucauguccucuggcagagaagaugguggcuguaaaauaccauggaacagaagcuggccuggagagcucucaccucuuuuuuacaaucuggauucugcaaacagucagagacccuuccugucugccaacugaagugaaggacugaagggcacagaauggacuuccuaguaaaauggauuuaugcuacucuaguaggcguauuaaauacaucuauuaauaggauuguugugaauauaggaaacaaauguugaacacugcauucagcacauaguaacuuccucaaagcaugacauagcuuuaugaucauguacaauuauuuaauuuuuaaaagcgcuucaggucuuagcuauaauaaaggauuaaaacuagaaugagacuggaguaugguuaauugcuacuacggcaacugcuuugacaaacuuaaacacuaaggaaacuuaacaauuaaugauacugcuuugcauguuggguaaguacaaauauuugaagagggggccaugcuccauuucaguacuuaacccugcuggcuagccuagaaacacuauuguguagcaacacuagcagauuaaguguccugcaugagcaaaacccaacgcuuuguaugaagugacucauuugguccucccagcagacugaggggaggagucucauguuauaggagagguaucagagucucggagaagcuaagugcaguucacagggcuguuagauacaggcuucacacuaaaugacugucuucugucuguugauuaguaacaccuuugaauuauaaaacuuguuucauuuuagaaaccagugauuucugaaaugugcuguuuccuuucuuaguuaaaguguacauuguauaguaagcaggaauaagcuuacuguuagcauauaugcacagggacagauacucuuaguggguguguugaucuguucacuguugucuuucacaggcuuacaucauaugauauuuaccuuucaaaguguuuuauacagucaucaaaacucagcuuaucuguguuuuucaaagcacauacuugcuaguuagcaccuacaucaagaaguccauuguucuuaguacgguuguucuucuuaaucauuuguccucucuccacggugacccacugucuuuggaguuuacuuguuuuugauuaaguaccaaugcaaccaugagcauauaguuaugccaaauguauuuauuguaaagcuguauauuuuaugcuuuaguaaaugcuaaggugaaagaugacuaucaugccuuggguuguaaaugaauucucauuugauuaauagaauugaguuuuaguguaugauaugugaaacaaaauaugugaguucuuuuucuauguuuuggcuuaguaaugucagaagguaacuuuuguaugaaugguguuuaucacacuaaagagucaaggagcagugaaacuuucuaacaggccgguguuauuugcguuaugagaaugcaaugugugugcauacaugcuuguuuacucauacaguguugguucaucuucaaaaguaccaugguggcugauugaaaguuagguaaacauugccucccaguuacauuuagagaggagauuuuaacaagcugagugccaugaccaguuccucuuauuuggugaaugaggaaguuggggcuguggaucuccucaucugugguuaaauagaagagagcagaacucugacagguaggacagugccuuuucauguuugcuguagagaaaaucugugaggagaauggagacagccaagucaacaaauggcaguuucuuucauacacuuaguuagaaagauugcuuaccauuuuaguacaaggccagaauauuauuucaguuaugccugcuggguacauguucugcaugcuagagcagggggugaagcaaagccgugauuggacacugagugggaaugaugaacagcugggcaagugugcaugcauagccaugggugaugcaugguuccgaagacacugcagggggaggaggagagggagaggauggggagggggagugggagaaugugacuaucagagaccguguguguauguguguguguuuagacgguggucgaugcaaccguauaaagcuucuugacaacccugacaguaaguacagagacgcaugcgaugccuucccuuucucuuagcuagaggguggcaugguuguacuuugcagaaacuuugaguagacucuagggcagguaauaagcauuggcaagaguagaugaggccagagacaguguaggaagaaugcacaggacuuuuuaauuuuuuuuuuaauugauguaaggauacuggggcauugugacaauaauaauuaaaaaaacccauaaauauauaugauuaaaaauguuguagaauauuguaaacaccaaauagauaccuaaaauuuuguuuugccuucuacaguguucuggguuccuuaaaguauagacccgaucuuaauauuuuucuccucccucuuauggucuucuuuuugcuugcuuuguccagacuuucuuuccugcucaguagucuuaaaagucucuguuaguaacuuuucccuuacagaaauauaaaucagcauuccuaguacguucaagggucuggguuugauaccaaacaaggcaaacuaaauaaauuacuauaacuuaaagaauaccacaugugcauuaguuacuuuucuguuccucugauaaaacuuuaaagccaaggaaacuuuaagaguugauuugggcuucucauuccagaagggugagaggaauccauuacacuugaaagcagggaggaaugucagcugaaggaggaggcuggacgcuccuaacuucaaacucaagcaugaagcagagagagagaaaacuagaaaugcaaggagccuuucaacucugaaaguucaccuucaauggcaugcuuucuccagcugggccauaccuccuaaaccucugcaaagagcccacugacucgagaaugcuguucaaacaccuaugacugugggaguuguuucucauucaaaccaccacaguauguaugacuaucauuacaccaaucaauaauuuaaucauuuuaaauguaauuuaauuuuuuaauuuguaauuuaauugguaauuuaaaauaaaauaauuuaauuauauugaccugugucaaaaauuuuauuucaaggaauugguucacgugauaauagagauacaaggacagauaauagaaguacaaggacaaguuggcaaccugggaccuugagccagggauauuguuauuaucgucccuugaggaagaguguauguuccccuuucagagacagcccagagcucuuuuauguagcugggucuugguuuguagauguuuccuucuuucugguuuagaugcaugaggagcccaaacucagaggaagucuuaacucuguuuugauggaguuguauaugccaauagaagcauuuuucucuucagaagaucucuggaccagccagaccauaggcuguauggguaugguauuguuuagacaguggugcuauugcuaauuucacccuggcaguuuugggcuagguaaugggagaaauaguacucuuuuggacacaaauuuagaguacacacaacuugguggcuaucacuacuacagaucuacaaaguauuuugucuccuauuugauauuaaauggcuuucaaaaguucauuucauuaccaugcugccaagcuggcugugucauugugcuggggacuugguaagacaagugaauaucaugagcuuggguccaguguuaugcuccaugugcucauaggugaauuuucuaucagaagcaaugcuguguaaaaagcaagaugguagauaaggcauucuguaaggccuuggaugguacguuugggaaaaugucauaugcacguaaggcaaagcgauaucccuuucucugaugaaaauaguucaauauauuuaaccugccacauuagcaacucccuguuggcaaguuaguggcucuagcuagaccuucugugguugaauaaaaguucacguuccuguacacaugcaucauguucuuuccucccauggccucuugguucauaaggacaucaaguaaugauaggagugguuagggagagagucuuacugauauuuacggaaugggcuuccuuacccucuugauuccuagaauacuuccuuacugauaccacccuuuggugaacauucuuguuggguaccuaucuccacuuuccuccaccccuauucagagaggucugccaacauaccuucuuuagacuuccuuucuagcagcuuccugcuaguuuguccuuccaacucuguggccaucuagcuaaacuauggacauauccugugaguugauacacaugagcaucuuuuagccacucuuccauguaauagaagaaugaaagcauugcucaauguguggauucccuuuuugccacuaaaggaaugucucagaaggacacacuauugguuguucuggugguaugugcauagugucuagagucaucugggaaacagacccagccuuccccuucucuagguagcgcugaguacuugauucacgaggcgauaggugugagcugggagagaaaauaacgcacaggaacggggacugugggcgucagagcuucguggucauaaauuacuuguaccuucagagugcacuuggucacuaccuuguuacucuugucuguuuuuuuuuuuuuuuuguuguuguuguuuuguuuuuuguucuuuguuuuuuuuugacaggguuucucuaguccugucuguccuggcucucacuguguagaucaggcuggccucaaacuuaagagauccaccuaccucugccuccugaauacugggauuaaauguuuguaccaccacucagcuugaucgccaucuugcauaaagcauuuccguuuguuggcaauacugugguauccgcccacuaucaugaguucgguuguuaacaccaguucaugauggaguucagauugugcgggaacgugguaacuguuucucaguuucuaauaaauccaggagcaagcagcaucugcuccucagagggaaagucagcuuucuguggaggacgauagggcuccggucaaaguucccaagggucuguacccuguuuacccacacaggggcuugccaaugccuucagacaguauaucugccaaugccacuucaagcaucuccuggaucauguggcuuaaguugcagaaucugguauggcaguccagcuuuuugcagagcauuuuguuaaaaacaacauuugcgucucaggccaagaaaguuguugcaacuuugaaguaaagauaacuacaaguaucuuucaaguacaaauuugcuugcagguaacaaacuauaccuaguugucuuauuaacagauguuuuaaaaaaagagcauuauuucagaucaguauuugcauaucagguaccaaaggaugacuuaguguguaagcagacacuacaucuguuacaauggacuuuacugaagggcuugauucuauguucugguaauucacaaugacuuugguucacuugauuugaccuuucuggcuauccagaucaaaucauaaauuuuuccuaagugcacuguuguguccaugaccugaauaguccgauuacuguuggcauuuugugucccuuagguaacugguccucauguguuuguuaaguacugcuaacuugguccugcuuuccuaguauccaguuauccucauugcauuuaaggacccacaucagugauagagguucccaugguaauuugugacucagauggcaacucuagcgcucuuuagcuaugaugaaacucuccucacacuuuauuucuuguauuuguggugaaagcugccgagucugggucucuugaguuagguaaacagauuuuaugugaucagccacucugcuagucugacugacccaagccuuugcauaguauaugcucuagcaguucugauccugcaacuucaugugauauaggccucauuuugauuuauauuuagcacuaaccagcuaggcugcuagacccguucaguguacuaacuuagacuuucuaguuaacagcccauaucuauaaauuuggcuuggacaaauuugaacuuuuguuuacacuauccuguacucuuagcaccaauuuccacacauaguucccaguuuucuguucaugcaaacugcaugccucuuccuggguuguacguugaauacuuucuggaacugaaacuuuguaauauucaaaacugguggcagaguaggguuuagucuugagaaucuccuacuucuggcuucuaugucaagaagccauuacagucuucaugaaaagcaaguacauuaguccauuuuucuguuaaguuuaagguucugcugcugcuacuguuucaucucucaugagcacuucauggugauggcuucaugauaguacauuuaagagggaucaugaggugaggcaggaagacagcauggaggggcagaucuugcuuucuuacaaugacuaaggaauaccuggaauuacagaacaguguuaaucccuuccuagagcugaauugccagugauaucuuccacuaggcucugucucuuggaggugccaucaguucucauacugucacacugaggaacagacuuugaacguacaaacccuuugggacuguguucucaucaaagccguagaguucacgucaggugguagguguuugauguacacaacaucacagagugcauaauccccauucuagcucucagaaucucauuacuuccaaaucagugcuucuaaccuaaucacaguauuccgugaggcgagaauucaauuuguuuucuuauaaagcuacuuaggaugacauucuaguugugcuguucagaaauuggcucuguagcuacaguagauaaaguuucuucuagacuuggauauagaaucuuguaggucauuuaugcaauuacuugaauuaggcauaugaagcuuugaguuuuuacuuuuauuuucccacuucauguagcaguaaggagccagccaccagcuaaucuuauacuuguuuguaacaugcucuaagcuaucaaaugcauggucauacagaaccuugguuuaauaauauuucauuaggaauauucaguuauuauauuuuguguauuuguauuggugcacuguacugugugcugucuguucaucuuuaccagugaagauaguguauuguugccuaaaucuaauaagaauagagaacaaauucagaaaauucauuaaaaaauucuucccucuaaaagcauucucaguacucaaaucaacuucuauauaaacaguagaaugacugcaaagaugaaaucauuuaagaagugggcauacgugauugggaaguuuaguuugaaguuuguuggacagauaugaaagcuuggggacuuuugucugaaauugauucuauauuuuuguggcagacuuuguuuucccagagaagccucuguuucguuuuuaaugucuuucagaugauuggaucaggccuacccauacuaccaagauuggauaaggccuauccaugccaccagaucuguauaaaguaaccuuuucagugacauuugugugugugguugacuacuuagguacugugccugaccgaguugguauaugacauuaccaucacagacagcaaguggcucuucaccuaacuucuagaugaaucauuugaaauguauguauauauguccuucauaauagacuugucaguuaauucacuucauuucagacagcagcuccuuuaaauaauaaacaguaaguagauuuuauucaugaaauauguacaccuguauuguuucagaaugaaaccauuuuuucuuuuagaauuuaguuauuuucauaauuagguauauguaccagugucucugugugguuauguguacauaaguaagaugcccacagaggccaaggauggcaucagguccccuggaguggaagcuacaggcaguugugaguugccuaaaauaggagcugggaacugagcugagcuccucugcaagagcaguauguacucucagccaucacccaccuccccaccccucgaaaaugaagcagcucugaagugacgcgcucacagaaugcuauugcccacauuuaggguagaucaucauucaacccaaguccccugaaagcccugccugaggagauuuuaaauucuaacuugguaaugaagauaaacaacuguguuuaucaugauguuucucuuggaaguauaucacugcuaauugcuguaaaaagggaggguugagauucaggauacaugagaccgaauaucuuaaaggaaaggaaaaaaaaaaaaaacccaaccaaacaacagaaacaucaaaggcagagaacagaagaguauagguaagaaaggaaaaguuagaaaaacaaagcugucacuaaaagugcuuuugaaaauaaucuugacagugucagcauacuucauaugcauuuuuaaugacaucuuuuaaaaaaaaagauuuauuuauuuuauguauaugaguacacuguagcuguacagaugguugugagccuucaugugguuguuaggaauugaacucaggaccucugcucacuccagcccuguuugcucuggccccacucgcucuggccccacucacucuggcccaaagauuuauuuauuauuauauguaaguauacuguagcugucuucagacacaccagaagagagugacagaucucauuacagaugguugugagccgccaugugguuccugggauuugaacucaggaccuuccgaagagcagucagugcucuuaaucauugagccaucucaccagucccucuuuaaugaagucuuuuaugcauauuauagauuuauauuuuucuuuuucccaaagaaaaauaauguuuuuaaaaaugguugaucugacauaaccauacaaugguguacauaggagcuguuauauaguuauauuuucaccuuucccaggguaggaaccacugaaucuaggcuccaguauaguaggcaagugcucuaccaugugccuacuuuauuuuaauuaauuaauuaauuaauuaauuaauuuucugacagacccuuuucccccauggacaguugaauuguuagagaaacugggucauaugucguguggacuaauuuugauuuggcugguuuccuuugauacuaugucauuugacugguucuaauugcuucuucuauacugauagcaagauuaacuuggauagaucuaucuuagauuuuuauauaugcaugcuuccucgagguaccaugugcuuccaggccaucauccugagucacuccugucccacgagucacaugguuagcggguccacugacugcuuucugcuucucaguugggucaguguguuuaucugucuuaucccugucuuuaaagucuuaaccuaauggacaugauuuacuaaccauucuccugauccuaaguauugaugauugcugccuauagcugugaaccgaaguuacaaucuguaguuuucaguuuaguuacucugucaauuacuuauuagcuggcugucaagagcuuuaauccaguuuuuaguuuuccuaaaauacaguccuuauggagaaggcagcggaaaagcucguuuuucuccuuccaggacuugguaauugacucgacaacgcugcugaggucuuucccuuucauuuucuuuguguauuauguugaauuugucaacuuuggggaacauuugaugcuuaggacauuuuuuuaaaauuuuguuuucuaucugcaaguacaguugaauuuuguuuauuuuuauuuuuauuuuuauuuucaccuuuggaggaaauauuuucuucugggggacuuuauaguugagacugugucucuuuuucuuuaugguguaguucuaggccccaaggggacuugcaaugugccacagccuuucucuuguccugagcucuagagagcaguguuuccuggagguucccucuccuaccugaauacucuucucucuuccuguacauuuugcuguauuaguuucaugugaugcuuuucuacguuuguuccacaaucauaugcguuuucuacuuuuaaucucuuagugcuaaauuaucaugguauuucacuuggaaauauaucacugccuauugcugguuuaaaaggguuuugaaaucccuauuugauuuucuaauguuaguuuucaguuccuguaauuaacucaguuuugugggguuuuuuugugguuaaauuaaauuugcuaauaaauuuagaguucuauauuuuuguucaugagugaggccauuucuucuuuguuugcuggaaaaguuugccaagguggaauucuuuuucucuugaucauugcuggaacuccugaaugaaauuaucuguccuuaaacaguucccuguggacuuaacgggugaauugucagaaguuuguuaacuugaucuuuuuucuuuuaagagcauaagguaagagaacauccuagauggccaguuuuuuaaugucaucuaugcacguucggaauugaccuuuguuacuuucucagguguaaauuuuuuuuuuaaagcuagucuggcauaaccaugcagugguucacauaagagcuauucuucuggcuaacacuuuacuguagacuagcuuuguucucccccaccucccuguccccacucccccuccccuccugcacucucucucaaaggcacaugcuacuucuaaagaaauagauacuggacuggggacauagcucaguuuguagaguguuugucuagcuugcaggaaccucagagguugaucucagcauugcauaaaaccagaccuuguuaugcgcuccuguguucccacaaguggcuaguggaggcaggaaguucagaaggucaagguuauccucagcuguaaaaucaguggaaagccagccugggguauaugaggucuggcucaaagaaucucuugaaucaaguuacauuuaaaaguaaguuguguaguauacuauuuuauuauugcugcuguugcuuauauuuguaugaauucugaaucaugaaucauucuggaaucuuugagcaagguucuaccuuugggucuaacaguguuucuuucugggccucaguacuuuauuuguaauacaaauaacuacuucauauaguacccaagagaguagauugagaaguaguuuuugaauuauuaacuauauaagugaagguuucaaaauuaaugaggaaggacagaauguuuaagggagauuagagugagacagaacuguugagucuacaucccccagcuuguagaaaauugaggccgaggaaaccagagagccguccaugcuucccuguggcagcgagugcacagaacugagagcucagcccaggcuuucugcuguccagggccucggauggacgugcugcuugccuucuuucucaugaagucguugagaagugcuggcuuguuagcuacccggcuggguguaucuuucucaaaagcuuagacagaacgaguacaugugacaucacaaggacaaaggaaucuuaagacuucaguaguuucuuaaguuaccaauaauuaaaauugcagucaaaguaguuacuggaucuccccccucuuacccacacaaugaaagccuuguuauaguacuugaggauuaaaacucacuuaauauagugaggaauaaagucuuaugugacugcaccaaaugcacuuggaauuuaguugaaauuuuauuugaaaaaugaucacuccaguauaguuuuaguaaaaucuugacuuauuauuguuauggaaaauucuguguuugcuuuuuucuaacuaauucuuugguuuccuacauauauguaccacagauaauuuauuuuuccuucaaauucuucaaguugauaccacuuauggaaagguuucuuauuaauugagcuuuugaaaauauuguacagcgaaggcuuuuuagcuagccagaaauuccucccccauauuacucuauaugaacuuuuuuuucuaaugucauauaagaauuuauuuuuccuuuuuuaacuucugggaaacuuauugcuugugaaauucauaagauuucuaaggcaacuuuaaaaucacaguuuguagaaaaagugguauuuuaaaguaaguucugaaaauugucuuuaguccuauuguuuacacacuccuguaaggugguaaauaacaucaaaugcucuuugugaauaguuugagugaacggucucuguuucaauguuaacuuccaugaggauucaguaugugcuuaacauuugauugaugugaguguuaaggacuagguggacgcaaauuuauguuguguaugcuucugcaguuuuuucugugaaaaucagaguauuuucuuuaaaagacauuauuacaggugucaguacgaaggauaacucgugcuacugaagaggagaccaguucuuuuguaaugaauguucccuuucagguguuauggauauuauuagguacuggacaggcuaacauauuuucucuaaccauguauuauuauuuacaucccucuucagcucaggguaaauaugugugcuaacuuugcauuugaggaugcuaaaaauccccuaagagauuggaugaagaugacauuguaguaaacauugaaauugcaguuuagaagaguucugaugcaugaguugguggucuuugcugugaaauugcacucucccuuugagaaacugauguggaggugacagaaaccgcuguaaaauagcaguuaugugccaaugcugaauggguaguaccgggacagacaggguccguuagggaagucaggaugccuuaaagguagagccaguacuuuuccucuuaaugggcuaacauuauguaucccuagaccaugcuacccuugaacuuuggaucaguuuuugauugcugauaggagaagaacacugcuuuuaauugcuaagggcauaaaucauauuucccagugacaaagcucuuacaguagaugaaagcuaaauguuugaauuaugcuaagagcaguggguguagcaccuauguagcaguagcuaacauuaccuccaaguguaauuacagcacuguucugugaaugacucccuucauucuacaucauuugaaaccauuucauagauauuucugauugaguucugaaggguaagaguaaugcagcaauugacagccuuuuugacaccaugucuucccuggcaaguucuaccuaucuaauauuaccuugcaucuugcccuguucuuauauccugcuggaagagagguauuggcacuguuccuauagucauauuacgguagguagaguuuucuugaauuaucuguuaaaugugaucuguuuuaagaggcccagaaauaaaaguauaugaugguaugaauuuaguaggcuacuauagauuaucauuuaaaauuuaguuuuuacuugugauauuuuuauuugcuaguuuuuuaauaauaaaguuuauacaacuaaaauaaguguuacuuuauguaccuagguacauccuuuuaugaaauuguaagaugcagaggacauggucguuauuuuuaugcuugguuaugaaugaggcuuuuccuuuugggugcagugcuucauauaauggagguggugugccagagugggcauagugagagucugugauacaguaaaauuuaaguuguaauuuuuauuucugucucauuguaguacuggcuuagcuuauauucuuauucuugugaugcuagacaacuuguccccuccuuagucuguuaucauuaaaauccacauccugaaacuauaugaguguucugugcaaaauccaacucagcucgguacacucauauauccacgauucucucauugccaauguguuuuguuaagugcuuagacuugugccauaaacaggcacaaauaggcuccuggucauugauuccuaauccuuccuguauguuucagguaguuuacugaaguuuagugaaauuacucuuaguggcacagaucuugacaacuccuuuauggugguaaagguuaagcucaacgaggccucuaaagagccgagaauaauaaagccaucucacaauguuaugcuuggaggaaaacccaggaaggcagguuauuucugagacuguaaugauagugcaugccaaggagaaugucagacugucccaccuguuugaucuguuuuuuauuaagaaaguaaguguuuaauuaaaaauaauagagccaagguauugagagagaauuagaugaaaaaggaacuaacuguucgcagugccucagguaggcuuuuccccucccaauuguaggguccaaaaaaaaaauuuuuuuuuuuuuuauauccaacccuguguuacaggucuccuaucaguacucgugacugcaugaugugaaagaaaagaaugacaaguuucuuuuaaaaaauucuuugacuuguagcuaaaacauucaauaaagaauucauacuucaaagugugcaacuuggcauguaauaucucuaucuaucuaucuaucuaucuaucuaucuaucuaucuaucuaucuaucuaucuaucgaucuaucuaucggugugaaagaaugggagcuuggcuauaccagggaguugucugucuguccuugcagcaggugagaucucugguuguguaugaguuuaagacacaaucagccacauucggaagcaagguguaaguacguugcacuuagcuggggauaugacuuuacuaagauaccaugaagaagcaagaacaggaaggaggcugagaaacaagaacaggaaggaggcuggggcaguuuguaggggagugaguggccauggguccgucuguugaaaggagagggaagacagcaggaggaacaucuguguaggagauggggauggugcugcaaggggcagucucgguaauguuuugaggggagagcuuccagauuuccugauacuggauaguguuucugugaagaggagugacuuaaguuuuaugccuagcaguuguaaaaggcaguugcugugaccucaaauguuucauuguuuguuuguuuguuuguuuauguguuguggcuuaguuauacuuuguugauuguugcauagaaaaaggaaaaaauuaaaauuaagccaaccaaauguaaaugaaaaucaacuuaaauauguuauguauggugauacaugcggacauaagagaaucucugaguucaaggccaguuugaccuucaaggcaagucccggggcagccaggagugcauagugagauugucgagagagagagagagagagagagagagagagagagagagagagagagagagagagagagagaagagagaagagagaagagagaagagagaaagcaagccagccaacucuuugacccacccuuccuuccuuccuuccuuccuuccuuccuuccuuccuuccuuccuuccuuccuuccuucccccuccuuccuucccaccuucauugguucaauagacaaauacugaauuucauguuugcugugacccaggugguauuccaggugauggaaacuuagcacugagcaaaaccccugaguaguuugcacuuggcuuaguuaauauugagaaacuaguaugggcaauucauaaaacaacaguaucuuaaauuauauuguauaaguauacuuagcaacugguaacuuucaguuaauuguauauguuucauauuuuaauacuacuuuuccagaaaauuacauuaaucucuagaucacuguucuguaggcugauuauggaacaaccuccaaagcuuaaguucaccuguagcagaaggaguaugcucuuauagagucuggaggauaauaccugagugucaugagguuuagauaguggcugagcauccccgccccuccucccuccuuuccuccccuucccuugcacuccuuuucccucuuucccaccucccuuagaguccaggucucaugugauccagucuggccucagacucaacuguguagcugagguugcccuuuaaaauccugcaucgucucccaaguucugggcuuauaggcugcacgacugcacuugacucagaucguuugaccuuguaacuuauaguccugucugccacaaagccuggagggcaggaugagaaugcauagcuacgaagaaaccaugaaauggagagaaacacuucagugaggaaaaaaaugaucucgggguuauugcuaaugaaccaauugggcguaugugagguaucauuuaugaauggcuuucauuuuugccuacuuauuuugaagcaaaaaucaauguuugaauuguaugcuguuuaauaccauguggaaaagauggcaaacguuguuuuagcaaaugaaguuauuucucagaguucccugccaaucuugcuaagcauacuaauucccguguuucugcauggacgcuuuacagugcucaguguccucuggcuucucuuguguugccaaugucuuacacaggcuaguagacaucuggggagggauguuuaaagccagaggcaacauuaaaaguguuugcugggauguuuuuaauuaucaguaaugguuucaguaagcuuuguagcucugaauguuagaacagaaaguguaaauguuuaauaugcgauggcuucgugaaacuuucccucucaaaacaacaaaaauacuguuucuugugugcuggcugacuuccuauagguugcuuaugcaguguuaacauagcuucucagaugcugcugacacaagcucugugaccacauucugcugcuguacacacgcauggcuccucccuccuuacuuaggacaguaggauagcguuguuacagaaguaggagaaggaauuccuguuucguugguugguuuguguuuuucuuuuuuuccugagaccuuaucggugugguaacggacucuguuuuucgauuggaaaacuauguauguuucuauuaccaaacauaaagaauuucuugaaauaauugaucgaaacaaccaaccaaugaaccaaccaguacauaacaaaacuauguugucagacuaacauguuccuccaaagucaaauagcuagcuagcaauaugaacaucuuccuuuccuaaacauuccccaugggaagaaguaugaggcugacacugguugauaagagcaucuggaccagucaaacagaacucuuauguaugcucaucuguguacuucuagucagugguacuuugaaugaaacugcuuccugauuugaaacuugcuuucagagaauauuuuuuuuuuuuggugaaugggaauauaguuuagugguagggcacauacacagaauacaaaggcccuaaguuugagugccaauaucacccaaaacagauaaacaaauggauucaaauaaauaaaucuuuuucugcauaauauucuuuguugguaauauuaagauuuggaaaccugauucucugguuuccugaaucucugaaaaacagcuugggagauggagggaaaggcucuagguuuggacagacugggguugaauuacaacugagcagcuaaccagcuguuugccuuuggagaaugcugugagaaccuugguuuauuccccaugaugcugacacugguugaucagaacaccugaauuagucaaguagaacucauuucaguuacagccacauaguaagugccacacuaauuuugucccuauugugucucuuuguagcagaggucuguuuguuuggguuguggaagaucaaaggcuauuuuggguuacagcuacuuaguuuuguuuugaugauuuuucuuaacagucguauagcagaagaauuggaugacuggagauuuaguauguuucuaccguggcaucaugugggcaccuuaccauucuugauaauaauuaguaucuacaaaguauaaaauuaaugcauauuaguauauauauauaauuuauuucuuacuagagcuuuguaaaauuugguauuauuuccauucuauggcugaugaaauugagaaaaggaggcucaauaauuuuccuacaguuaagugacaaugcgaggaugaauugaguauuuuuuuuucuccuuagaacauccaacuuucaucugcaauacugacacuaauuuaauuuuauaugguuuuaaauccuuguguugacagagacugagacaaugaacuguucuuggauuauaaauggacagucacaaggcucucuuuauuccuuaguguggacuuaggucagguaguguuaccccucacugcucacuguagcaugcguagugucccuuucaguuacugcucugugugugugcgugcguccccucccucgcgcagugcaguaggaucucagggagcgcuuaccucagucagucuaggaagagcaggugcugcaugggucccugcuucuccacaaucuuccucauguugcuuccgucaggaaaaguuucuuguuuugagagagaaguuagaaauugcuucuguguguucaaaauauuguuguucauuuuuuuauaacauccugggaaaccaugagucaauaaguauguacgugcaccuguuugcuuuuuuuuucuuucuuugcaccuagucaaaaauauuuuuccauuuaacagaugcuugagugcuguaagcaaaaacauuauuacauucuuguagcacuuauagcacaaaagaaaauaaauaaagagguaacugucugcaggaagaacuaaagauggcucuaugaagaacuccuuauuugcauacacugaagagacauguugguuaaccaagaauuaaguuauauagaggacugugcuaggaaaugaaucauauucauaauaagucaguguugagguagaggcagcaauuccagcacuuucuggaaaaacagcauuuggguagauguggguaagugagaaguagcuuuguguuuguaguugggugaaugggaauagguggcuauaaaauaaucagauaagacauuuuaauuuuaaaaaaugccauagaguaggaagggaaugaguuuuuaucucauaauucaaucaaaaccauaaaauguugaaaaaauaacuuaccgugaggagcaacugcuuuguuauugcuagggucagggaaaauuaauagguacccuuuauaccauguagugauuguagauucagagcuccaacaggcaguuagaaggggcugcuagcaaagggauuuuacuuuuccuucagcauaacauaucucuguaacuagauagagcugcauguagcuuuuaggccuguuauuuguaaguucugccuucuucaccaucggauagucugacguguuguggagucugggguucuucacuuguguuuugaugcacuguaauguaguacuguaugcacacaucugaugguggggcucucauuccccuuuguuuucugcuguguaaugugcccuaguaaauucuagcuagcguauucuaaaggcucauuguucaccagacaauagaguauauaguaugcugaaacaaauacauaaaacuuuaaaacaauuuuuuuggggaucuauuaauccuacuacauacaggcuaaguguuucaugcuagaugcagggaaaauaagacagugguagacauaggagauugauccugaccucaagaggauauuacaucauucauucugugugaauuugaauccgcuguuuggcauauuagaaagugauacuagggaauugucccugaugauacuaauguuugcuuuaaaagcauuuaaacugaaauauuugacuugauaaagguuuggacuguuuauggcaguaauauguccaauauauuuucuuuucuuucagggguaaugauuaagcaaauccuaaucaugagauucuuaaguaguugccaagaugauaagcugagcucuuggcagggugugaugcugugcaugguuagugggccauggccauuggcugcuggcuaagaguuaccuggcucuguuuccuacucacuucugcaugaaguuuaggagggaaacuaaagacuguguuuacuguuucagccacccugucucuuaguagguuucugagcuauagucucuguguguaucaguagauuauggggacagaauacagcauauaugcucuucaggggcagcguaauuguaguugauacauuucagaagcuuuguauggucuggauuagccaaauggaagagaaaaauaacuuuguuuuuuuaguugacuuuuaggccugaaaugcuagcccugucuguguccucucccugauaagcuucccuugucauuucagugugaucuguuauuuuuacuuuuauuacgaugccugcaguuuaauauuuacuuuguuuguuucugguuuucuugugaugcggaggacagaaccuagggcguugugcuagcuacuaggaagcauaugcuagugaguccauccuuaucccuguagcuuaugcucugugauuuacugccuagacugcuaugauagauagacagucuugggugacaaauacauaggcaacauaucuuaucaagaagauucagauaagcauaugaagacacauuccacauuaugcuugugugaaaugccagugaaaacagugagcuaugucauacccucaguuuggaagaccacgagcgcugacgguaggaaguguugaccaaguguggaacaccagggacucauacccugcuggcaguggacaaugguauaaaugguguuaggaggcaguuuggccauuucuuauaaaacuuaccaguuuucugugaaguccagagauuccacuuguuggaagaguuggauaauuacaaaaaccuacacauagcuuuguucuugauaguaaagcuuagcagccaagaugucuaccagcagagaauggacagauaaacuaggugguucauccagacaaugagauauuauuuagcauaaaaggaaaugaaccaguauaaagaaacaugauucuuuguuccugcgagugugugugugugugugugugugugugugugugugugugugcaaguauguacgugaguuaaugugggugcuguggaggccugagguggaugucagagucuuucagucacucuuacauuuugauacaagguugucaugaacccggagcuuucauguaccacuguguuggcuguccagcaaguccagggucuuccugugucugucugacuaguugggaucauaggugcagccuucugcugggccuagacuuuuauuuuuaaaacaggguacuuaguucuuauuuauguagcauacucauugacugagcugugucacugguuuucuagucaaauggagccuaacuuuaaagguuguguaguaaggaucuaaacuaugauagaagacaaaacuaagaagaucacuauuugccaggaguugggagugaggcaugaacaggcagaacacaggguugggaggcaguccuacuacccucugugauauuuuaaguguggcugcguguuucagugacuuaagcagacccauaaaguguacaacaauaaaagugagcuuuauaaaguaaagccuuugggugguuacaugucacaguguguauguucaucaaugacauguggacaauuguaaaacaaaguugucuggagugaggauuuguacuccaccagauaacugaguucucaacaaguuucuccuuugacacuuuucugugucacuuccacccuaaccauaagccaccuuagugugcagauggaacucggugugggcaggugucucacuugagccaguaguccccucagaacccuaggcuugguguuuuugaucuucacugacgauagcccaggcugucucugcagagucacuuccuguuacggcaccaccuucaguugauagugguuucuuccucuaaacugggcaguaagauuagcuuauuggagaaccaugcuuuguugcaugagccugcccugcacaguguuguugcuuaauguccuugcccugccucccauccacaguccacaagaagcuguggggagaguuugagaagaggggagcagaaaagaccagagcacugcugguugacacccugcuagcggguuuuauuauuuguggguuccagagugcaucuuauuuccuuccugaacuuacuuuuauugucccuuuaaaguaucucuuucauaggucacagcagagacaacuguggacgugucaacucaagcacaucauuuauuaugcaucuuauagugauauuauagguggaguaugggucagaacagucucuguccuugaccucacagaguuucuuuaucguuaccuucgcuacuaaaggagcccugggaaggcugugcuuagcauuuuaaaguugcaguuggauauuuuugcauuguguauuguuuauuuuguucaguaaguaaauaauaauaucugagagugaauagacuucauguuaagccuuagaugaacaugaaacaauugagcaaaguacagaaucaugaaauuuguacugccuguuuagauuuacccucgaccauaaaggggugagaaguugucaguugauacacuuagcuuucuaguccccugaguaauuucuuaaaagacuucuccaaacauuuauauuuaaaagccaauuaauaaguaauucaguaaacaaauaauuuugagcauuucugugagucagauccuguucuagguaguguggagaggacugaucaaaacaaagccugugauuucaugacugcaucucagugugggaguuagugaggagagaaaggcacagugcugcacacugugacagggaauguggagagcauggagccagcagagaacacaggccaggcugguaaccugggaagugcugcacacugugacaggggcuauggagagcauggagccagcagagagcacaggcgaggcuggguagccuggggugaagggaguuggucagccaugguaugucagggagaaagccuagugcuggcagaggaaacugcaaacaugagcuucuuugccagugaagacuuuauguauuauuuuuugcuuuauucagaauagucuuuagaucuuucuacaagcaggucuuuucucugaauguuaacaacgccuauuuagucaagaugaaauaaauaaccacaauuucuuauguauacuuuauaauaugauagacauuucauauuuccauuaucacuguauuuaauguaacuauuugccacauauguucuugccugugugugucuucauggagaacuuugaagaaccaauacaaaugucacuuuuaccuugaagauuuucuuucugugggcauacgcaagguuuucuucuuauuuauauacuacucacagaugucugccauuguaugguuaucaaacuaacuuuuuuaaaaacuuauugugcauguggcuuuugaccuagaaucagucauuugcuagauaaaugauuugcaguuaauauuuagccuugaauauuuauauaccuuuaaaccacuuaagcauuaagccauuuaagccauugaacaugacacccauugaggcagauagugagacuauucaaauuugagguaaaguuaugacacaaaauauuuaccacagagguguggcuauuucccauugcuaaucccauugccaaauaucuaacagaagcaacuuaaggguuuauccauuuuggcuuguguuuucagaggucaugaguuuacuacggaggaacaggccuaguggacuguugaguguguagugauagagacuuaggcaguggaucuaacauagcagugguccaagaagcagcaagcaggacuagagauaagguguggcuaaccuuuuguagcucuuccuagugacacauuucuaccagccaggcccugccuugugcaggcucugugguuucuccaaagcuugccacauaugugggaauaggagucuaaauuuaagcuugugagagcaaaguucacacuuaaaaaguuguguguucaagagaaaugugaauugaagugagauacccuguccagaagauaaguaagguagaaauuguguauguuggagauugggaaugucacucuggaaccuuccuuccccaccggacauagaugcuuuuuggaucugucaguugcuuucucagucaggcaguaucagugguagcaauacuccuuuucuaagacugccgacacauuucuuuauauacuucguacugacucuuggauuugguggcuugaagagcugguuaaaaucccaaauauuauguuaagauagguaugaucuuacuaaucaaguuacccaugagucauuuccucugaaagguacaaacauaggguuagagauaauagauuacauuuauagaauggcuuugguuuucaauaguagaaaauucuaacuaaaggaaauaauuuuaauucacuuaagaugaaauaaguaacuauuuuuacuucaaaacacuuaaaugcuucagacagggcauuugucauugaauacaggaacacaagguggaacuuaaugcuguuguuggcuaagcagggucggucugacucuguugaagcuauuuccauuucuucaaaugucaggugcuaucagugcagagaaaaggagagaguguugaguauauggaagcaaagcaaucuaucgugcugcaccaugaccucugaaaacacaagccaaaauggguaaaccuuuaacacaagcuggggguuccauggccaggaugccuccuaguguugugugcccagcaccaggcagagccuggcuaguacggggguuguuuaaugaaugaauucguuagauaagaaccauguuccagguuaaaaaaauaauaauaaaauaaacuuuguuaaccuaugacauaaaauuuauugcuuucaacuuauaauuaguacaaggaacaaaagauagauaaaacuauugcuuuggacucauaaagauagauuaaacuaugcuuugaacauguugaacuuguaaaauaaaggauaaguaaaaacuacuuaauuacguagugauuuuaauaaaaaauaccucucuucauuguaaaaaaaaaaaaaaaaagaaccauguuccaggucuggagacauguuuuucacuagugcguuuugggagccaaggucuuugaaauucugauggagaagaauuucagcugucauguuugaaacuauuacacuguauucauuacagccauggaucuuauagaguagacugaauuuuaaaauaagucagcuaaugugauuuaaagugaucauucuugcugaauuaaccuaggaaacaaccgagaacgaaauaaaaugagacauuagaguaaagcaauagaguuaagaacucaugacuuaagauuugugagccuaaguccuacuuuaaggaaauaguauucuuaaaaaaaaaaaaaauuguaaacugaugagaacagacacuacacuugaucuuagccagaggcccagaagggguugagacccaggccaugagagagaacccaugccugacacuauuaaugaugcucugcuagacuugcagacaggaaccugcacaucugucauuugagaggcuucucccagcagcugauggaaacagauguagaaagccauagccaaacauuaggcagagcucggggaaucucguggaagaggagaggagggauuaacggagccagagaggucaaggauaccauaagaaaacugcagaaucaacuaccaugggcuuacaggggcucacagagacggaaccaccaaccagacagcaugcaugggaggaccuaggcccucugcauagauguaacaaauaugcaguucauguggguucccuaacagcaggagcagcugcucucugacuuugcugccugcuauuaaauccuuuuccccuaacugagcugccuugucuagucucaauagaacaugaacuuaguccuacuacaacuugcuauggcaaggccaguuaauauccaugggaggccccugauuuucugaagagaaaggcagggggaauggaggaaagggaggugagaggugggacucggaggagaggagggaggggaagcuuuggugaggauguaaauaaaucaaucagugggaaaaauaauacuguuuguuggggaguacauauguguugggaagggcacauaugccauaguguuguacguugucaaggucaagggacaacuuuguggaguugguucuguuccacauuugggggaucaaagucagguuggggauagacuucggggugccagaggacugaaaucaggacagcagacuugcacagcgagugugcuuacucacugaaccaugucaucuacucuaaauuuaggaaacaguauucuguguggaaauguagaucacuguugccauacuauugauugcuccaucuuccacaaaaccucauauacuagaauugucgucauuacagaccuacugugcuugaauuccugugcuuuuguuguggcaguuucccacaacugugccugucagccuugccuucguuccauugauuuuacugugucacuggagugaccucuuaugagucugauugcauuugucccuccuugaaaacccuuauugacuuugcuuaguccuuagguaaaauccaaguucccuagaauggaaaaggaaagguuuagacaacugauaucccugcagucuccugacagugccuuucguuuuuuccuaugcucucucuucuccauacagaggaacccacuuguguguaugucugaugucacagacucucugucugucacugaacguuuucuuucaggcaugcuucucuccccucaaggccaucagcuguagggccuuuaaaauuuucuaaauucacuucaagaaaaguguauugucaacccuauaggcggaacaacauaaugaacuaaccaguaucccggagcucuugacucuagcugcauauguaucaaaagauggccuagucggccaucacuggaaagagaggcccacuggacacgcaaacuuuauaugccccaguacaggguaacgccagggccaaaaagggggaguggguggguaggggaguggggguggguggguaugggggacuuuugguauagcauuggaaauguaaaugagcuaaauaccuaauaaaaaauggaaaaaaaaaaagaaaaguguauugucuuuccuacucuggauuagacucuguccaaguucucauagcauaccauuuuaguacucuguaggccauuguaaacgagagaaauacauuuucaaggccagaaaauucaugaucagggagcuggcugguagguccaagcauucuguuacauugucaugcuggaagaaggaagggcaagagagcaugaggagggaggaaugcaagaagggcaagugagggcagaagaucaaaguuagccuggagcuccucuuagcaggaaccugcuccugagggcgggcucuuaugacccagcacccuguuaggauccuuccccaguacuguucucuggggauuauguuuccagugcaaggcuccuuuggggguggggcgcauauugaaaucaugacaucauguagcuagcuaguguucuuaauaguucuaauauaauaucagaaccugccugucuucuuucucucuagauugugaacuuuaaaaaguacaucauacuuuuuagcuuucgaaugacugcauugucuuuuuaacuucuaaugucaaucguugccuuucacgggcauagaagcaucagaauuaaccaguccuaaaauauuacucagcaaaauucuaguuguuauaaacuugugauaaauggaggaauguagucccugcccuguuuuugugcuuagcugagcagacagauaauaauauacagagcuaccacagauuaguagaguacaguauaaagugauguuuuuagguagaaugaucugagaauaugaaugggaaaaguucagauacauuaacguuucauagccacuuuuugcuuuccuuuccccaacugcuugcccuugcuacaaugucuguggccgucacuaacucaucuuauaaucucucuaggauauguuuaaauguuuuucucuuguucacuguuacuuuuccagugccuaauauggcagguuacacaauagaugacauuuauuuaauugauggacuggacuuuggagaaggaaguauguacuauguaguacuugugaaagauuuuuaugagcaaguuagaccuugaaguagacuuugauguguuucuuuuaaaugaguuaaguuuuuaaaaugcaguacauucaaguaaauaguuacccaucaguaacuaguuaauuucaaucaguccaggaauugauuuugagauuggaucuugcucuauagcacugguuguccuagcauuagcaaugucaccuagaugugugacaauccugccugugccugaguacugagauuauagacauguaugaacaugccugguccaauuuuaucuguauuugcauuuuccagguuauauguuacucuuaauuuuaucuucagacuuuauagucugaguaaguaccuggccuguucgauuccguuuagagaugagugagauaacuaagaccacugacaugugguuuguucacaguuaacuguggacgguuuacaacagggccagauuuuacuauugaugcgauaaccacacuguggcaaugccacagauuauguuaaaccuuaaagucacugcaucuaggaagaccucugcuucuacugauauuauaguuaaacccuguuuuaauggcuuaguaaaaucauagcaguaugucuaccaaucuuucaguguaucagccagcacguaggcugugcggaggaggagugcaggacuguccugcuuggcagauaggcuuuuacuagucacagccucagaagagacccuuuugcccaccgaccuucagccuuugcagaucuucaugugguuuaugcccucuaaauaguguuccauuuuuauuaguuuacuuuauuuuuauaguccuggggcugaaacccagggccucgugcuucccgggcuuucuguagcccgagaucucuaguuuuaacaacuugaauauaaucuucuguuuuucuuguauuggaagggguuuaaccaacaaacagauauuaaagaaaacaugagaaauaagauuugaaaaaagucucuugaaaaaaaucuuguugaucuaaaaauggacacauuugaaaagccagauagacagaagcuuggauuaugauaaauaggaaaccguuuuacacuuuccuuccuuccuuguucugaauguuuccacagcauuucauuugaacuaaaguggguuguacaaaaggaacccuguccauuccauguuaacuuuuucuucuuaauacgagcaaaucucuuuuucuuuagaaauauuggauacaaagagaucuugaaagaugaggaaguguuagaaaaauugaggugucucugccuauugauaauugcauuacuuaguuuuagucagguuuauuauaucuuugauguucaaauguauucugguaagacaaaaguucuuggucuuguucugaagucugauucuuuuuucuuuuucguuccguccagcuauaaucuguguucuagugugacaagguaaccuuguccucugcuuuguuucagaucccuguaugucgcugaguccaccuugcuucacugaagaagacagguuuagcuuggaagcacuucagacaauacacaaacagauggacgacgacaaggacggcgggaucgaaguggacgagagugaugagguggguggggcucucuucuugcccgccuucuccuucagucucuguuuccggauucuuccggaugcaguuugguucucagugccuuuagcuuucuuuuuuaagcugugauuuugcuuauuguauuuacauggcuuuucugacuuccucugcuugcuuuucucaccaccccucuuccuccuuccccuuuccuuuccauaguaauugugacuucacagauugguaguuguggaauuuucuuuuuuugagaugagggugugaaguauaauaacuuaggcuagccuuaaauucucccagguucuaaauccuuaaccauagcugagccuccagacaugcgcaguguccccaugcuuccugguuacacaaacuccucguagucauggcuuucacaagcacaugcccugcucagugucacuucccagcgcuucuauagacaccacugcaaacagcccuguuaacaacgaggaguugauuccugggcucagcugggcaauguuuucguuacuguagggaugggcuuuggucgucuguggcaguuggcauauauugcuaugauguuuuccuauauuuuaugauuucucuuucuguaugucugucauccaggagucugggugggaguuuauuacugccugacagcuggcuuccaagugguagcaucccaggaaguccuuguguaggaguguuuaccgugccucuaguugccagggcuugcuacuaucagauuggcaaaggcaagucauguggauuagcacagucuaugugggaaaagaguauugcuaccucacagugacagucucuaaagauuuauuuauuuauuuauuuauuuauuuauuuauguuuuuuuuuugagacaggguuuuucuguguaauagccccugcuguccaggacucaauuuguagaccagacuggucucaaauucacagagauccaucuacuugccucugccucccaaguucugggauuaaaggugugugccaccauggccagcuuuuauuuauuuuucgaaaccuuaauuuaauuacauaguucccaccccccuuuuuccccucccucuaaacucucccauguaccaucucuuucaaagucaugcccucuuuuucuuuaauuguuguuacauaguauguguguaaugugugugcuaugcauguaugccugaauacauaauaaaacuugguuagucuguauaaugcuacuuguguguguguauguauauguguauauauauguauguauguauguauguauguauguauguuucagggcuauuuugaugaucaauaggugugcuauucccuugggaagacuaucccgaacuuagcuuuccuauaguucuuugucuaggauugagggcucaugggcuuguuagcaugucuauucaucucaucuuuagcuagucauauuggugagacuucauggaugguagcuucugacauuucuaggacacauauuuucacagcaaacugaccauuucuaagguuuuuaucuauggcuuaauccgcucuuucuugagccuuaggugcaggaguuaucuuguuacucacagaugaguauaguccucacuccucaucaaggagacuuugucgcagacagaaaccauuacagaaaacaacaguggaucaaaaugcagaauuguggaguccaguuccaacugauauauuuacaagaugagcucagaauuaaaacaaaaaagacugcuacaccuucaucuagcagccagcaacucaucaaguagaugugggccuuugugagucucagcccauccguggguaauguugaccugcuugaucuuaugugggucuuguacaagcacccauggcuacugcaucacuccuccccguucucuggcucuuaacagucuuucuaacuuucuaugaugguuuuugagccuucaggagaggggcugauaacaguguccuauuuaggggagucugcauuaauugcugcccacuaaagagagauguuucuuuucccagaguugagauuagcacuaaucuaucuuuaaaagcauaaauacuuagaagacaguuugacaauauauccauuuagcaaaacaagaguaguagguucccccuuagagacuguguccuuccuaauguauacucagguuuauagcaccaggcaagaauucacuuguggugcaggccucaaaucuaauaagaaaacacuugguuacauccacaaugcugaugacauuauacaccagugggcacaucuugccuggcagaucaauauuguagcauuuugggucuagcacaguugggcaaaguuaccacuggguaagacauuucucucccagaggccugaauauuagaccaugaaaacuaaguagcaaagaggaaguuugcgggccaguuccagcaugauuuuucuauguccuacauugugaacucuucaguaauagaguccagagauggugggcaaccaagagucaagucaguccuguguugguucccccauaugaccaccugacagauuacuaugaggaauuacaaauuacuuguaaucucaucccuagcgcugagaguuuuaauaacugauaccuucugggaggaucauuguuagcucauucaggguaccccaguucauaaaguccuauguuuaaaaaguagagcuuaggauuuuauuaauaugaaauuuauaggaaauauuguuuucccuuuuugauaaugauauuuaaauauaaaugcagugggcauuuauacuucacugguaccuaaaaccaugucgaaguccaccguucaguacaguagccgcuagcuacauauaguaguugaaauuugaaaaugaggcaugcuauuaacuguaauaauuuguuuaagugugaauauuugagaaaaauaaaguauguacauuugaaaaguggaggcuugggagaaugcucagucugcagaaugcuugcugugcagacaugaagacaugcguccagaugcccagcacagagauaagcugagcaggacgggcacgccugcgaucucagugcugcugcggaaacagaaugauuugggcucuuccuguccagcguguguagcugaauuguugaauuccagauugaguagauauccugucucaaaaaaauagauggagacucccugagcaugguaccugacacuggccuuuggccuucauguacacauuguacaguaacugugcauguauacacaaaauacugguuacguauguaagaugauaaugucuuggacauauuaauaacauuaacuguggugcugaaauuaacuucuuuuuguuuaaugugacuuuuagaaaauuuaaaauuaaacauuuauauccauuuuguuuugacaguacuaguauagggcuuaaaugaaugaguuguuaauucugcaguuuuugggcuaguuuggugucuccaguuuuauaauuguucuuuaaaauaaaguaucucauuaaaaaaguaaauaguuuuguaauaggccucaauuagcuauaauuaggaaauuuugugaguuuaauaagaagccauaguaaaacaaaaauaaaguuucuuguauuugggggauuuaguggcacuuuuuaaaaaaauucagaaguauuuagcauuuuauaaugcuucacugcuuucuuauuuuguauuuuggucauaucagaaaacauugaucaguauaguuuguauucauucauaugauuuugagcuaauacuuuugggccuucugcaugccagauguccaaauagaugcuuggaauaaucgauugggaacaaaccagaugaaaugugugccuuugagcuaacguucugacaaggcuugcgagaggcucauuuaagaaacucagugcuuaaguggaaaaggggauccggacaggaagauuguggggaggcuauauguaugcaguuuaucaucuuuuggugucuaugggucagaaaccguagugcuggagaggaagguguauaauuaauucuuacauugcugccaccaaacuggcagaauccagugaagagaaacaaggcuucucuuggcucaugauuucaaaaguuucauccuguuggaguagggaaaucaugauggaguguauagugcuggccauugugugguggagacucuuuauaucaugggagauaacaaagcagagaaugggacuggaaucaggccguggguauaaccuucaacagacauaacucaauagauggcucucccaccuccuaaugcuuacacaauuucccagaacaguccaccagcccaugagcaagugcucagaacaugaaccugggcaagacauuuuagauucaagcccuaguaguguguuaucugacucuaguucucuuuuacucugcuggugauguaccugcuaguguuacacaauccaaaagucugcugcagggcuugaggggaaacgguaugugagggauagauccacuaagauccuccucauguguucucacauuguucucauguguucuuguuuacuugguguuaggccauuuggcucucuccauagggccuuguaaaauaucacuggcuucccccagagcaaguagaaagagcucuaagcagaagaguugggucccuaugagaaggaccaguaacauagaaguagucacagacuuuuaucuuuuuaaggagucuuuuuuucugaaaguaugagugccugguucccauggaggcaagaacaggguacuaguauuagcaucaagguuggcaguaagcugccaugugggugcuguggacugaacuuagguuucucuucaagagcaucaagugcucuuaacugcugagccuucucucuagcccauuuguauuucaucuuggaaugaugguccauugucuuucuuuuagccugcuugcuggaacuuagauacuguccaggcugacacucaagaaaggagguuaggaaaauagauuggaagauuccuauccuauuggggccaccgugggugcugcuuaacacagcuugucucuuuccugccaacugcaaauguucaguaggaagcuuccccacaugauuauaaagcauugaaguaguacaauuauaucaguuccuucaaaaggccucauuuuaaaaaugauacauaaucaaacuuuucaaagccagcucuuucauaggauauauuuagauuuuuaaggaaugaugugugugacuaaaaguuaucugagaaguaguggggcuguagagauggcucagcaguuaagagcucugacugauuuuccagagguccugaguucaauucccagcaaccacaugguggcucacaaccaucuguaaugggaucugaugcccucuucuggugggucugauuuaaugguguguguguuaauguuaccauguccucaaagaccuuagacguaaggaaugacccacaaaagcaucaguuaagccugaugguccaugaguacugagaaggugagaugccaauggaaauaggaaaaacgcugguaggccaguagaugcuguaccucagguggaugggaagaacacgcaagaguuccuagccucuagaguucuuuaguuuuguucacaucuguucuuuaaaacagaagucuuacugauggcaaauguuaagagagcuuaggacuaaaauuguaaaucacucaguguuccugauagcugggaaaauaaggagcugugggaagcggacaguagcuuugccugcaugcaugucuccaaacuauucuuguuucaccucucucauuauaggaaggaauuucugcauauguacucucagauacaauuuuaaauaucuauauuuuaauaccguguguauauuagauguuaaauagguacauauaaacuauuuacaaguguuaaaaaugggauacaguugaacaucucugucaacugcauuagauugcauaucccucugugagaggucugaacaaguucaugguauaugucgcauagucugcucacauuuuuguaagagcaaccaagucugaaaaucuuuuaaggaagugcagucagaggcacugcuguguuugcagauuucuugagaaucucauguugauagcugugauaccuacaagaaauggcagagcucaguuaucuauauaccaaccuagaaaugcauauguguaaggcugaaaagguagauguuuugauaugggaggauaucacugaacuauauauucuuuuuugaaaaggagcuuuccccauaaauuuguuccaauagcuauuuuagguguaaauucuauaaaguuuuaaauuuaauucauacugagagaauaagugucuuaaucaauaacucugaggagacccuagaaauaacgugugaaaugcuguagguaggauaccuaggaagcuaggugagagggaucuuucaggcuauucugauaucaaugacucacagaaaugugcuaaucaccaaauaguaauccuaucauuuuuguuacuucuuugaucauuuguaauuuaacuggaguucaaauuaugaagaaugauauggguccaaguguguguuuggaaggagguagggaaaaagcuugggcacauguauauguuaucugucuuuacagaggaaagaaggagaaagcucucuguagccaaaucccagggccucacaguagaaaagaaguagauaaaaagggaauuggcccaguggggagaaccuacucuacagaccaaaucauagaaugcucccuagaaaccuggcaguagcuugacacguguucucgagcagugcccagcccugcugagccacaagucuggguggaaccaaauguucgguugugccaagcccuuugauugugcuaucugaugaaaccugagagucauuucaggacacugauaguagcagaggaacuuuauaucuuaacuuggugcugacucagcgucucgguuuuacuugucauuauugcaucccuggagaaacagcccagggcucagucuuccuuguuccugggcagcgcuuuggucaucugcagagugcaugaccucacugcuaugaaggucugacaaaagacccugcuuuccccuuguucugguugauuuugcuuuucaucaaaguccaucuugaaauuuucuaguacuuucuguuaaaaaaaauguggaccuauaaaagagcuagguuuauauauuucuggagaaaauccuugauauuucugaaguagggugguucacaaccuagaugauuaaaaagcauuuuguaaauuacugacucagaucuuagugaaauggucuaguacuuuucuacuuauaccuagacacuuuaauuucaauuguaaaauuccuauccugcuccaguguuguuuaguugaguaccuggccucuugauguguuauugugacagguguagaacucaucuccugaacucccugucuuugagauuccagcucauuugccaacuacuuuugaguuaaugacauuuaaagaacugaugcccuuuuagagucugcccaugcuccaguggauggccccucacccacacacauacugguagcacaggauccaguggcuuuaaaaaaggcugcaugagguuggaagagaaaagugguggaaaaaguauauggaaggaguuagaggggaaggaauugggggugguuauauauagguauguguguguauguguccguccauccgucugucaguauaugaaauucucaaacaauauauuaaaaagagaaagggaaggcgggcguggugguacacaccuuuaaucccagcacucaggaggcagaggcagguggaucucugaguuugaggccagccuggucuacagagugaguuccaggacagccagggcuacacagagaaacccugucuccaaaaaccaaaaaaaaaaaaaaaaaaaaaaaaaaaaggagcagauucucgcagaguauuucuuacugugacuauguauguccuucaaagcaauuacuguaggggaaaagacucucuguaguccuuuuguagaagguagucccugguucuuccucccagccccauguucccagaaauaagacucagacucaaaauauauuuacaaauuuaccuuggccauauagguaggcucuucucugacuagauauaagcuaacauaucccauauauuccagccuauauucuaccauggggcugguucccugugcucaggugccaucccuucagcucaucacaucuucccagcaagucucccuguuuccuucucuccucaaacccuuuccucuccuggauguuccaccucuacuuccugcauaagccauagaccacaugcuauuuaaucgacaggcgaugcaucuguccaauacacaagauguucucucuauggguauauuuguuucuguuucugucauaaccucucccauacaguucugacucauugcagcaggcucuuucuugcagcugcauuagcuacaggcaauuuaagaagcuccuuucguauuuaauaguaaaguucauguagacuaaauuugcccuucuaguuaacuaggaacuuaaacaccauuguauaguuauugcagaacaaugagcuuaaaauggcaaauacaaacucaauaagaguggcuguaagauguguugaagaaacaaguauuucccagaaucguauuuuauggcaucaaagaacaguaaaacauuaaacucaguacauuugccucuuucuaggcaugacaaccuuguuuuaacugggaaaucucuuuugcuauuucuuaaauucuuucaauuuaacucaaaccacauguuaauuauacauuuucauauaaaacaauuuuacauuccuguucuguuaauuuuuaauuuccuucaauaagaauuuccaacucgacagcuacagacuggcaggggcagagaguaggagugaaucucggcugugcaucuggccgugacagucgcagccugucuguacugcugguccuguuccucuccuccuccucugaggaugcucaggaccacagcauggcauugcauuuacguaauucucuucuggagaguuuagcacacuuuugcauauugcuugauuuucuggaagaugucugacugugaguguguacagaacauauuccgugaaugauacagcgauggcuuaguguaacauuaucaucauuagucuuacauuauugcuacuauagaguggcagauaggguuuuuguccaaacuuagauacuuuuaagggugaaagucaguacuguuaauaauuacaccaagauagcagguguaaaugaagucuuccugcagcccagggccauguuauuauauucaccauauggcuaaucauaauucugcuuuaugcuguacuuaacucuuuaguguuuacccccuuccuaaguuguuauaaauugcucuaaguauuacaccaaucuuuguguuauuagaauuuauauaauuacucaaagccuguuaauaugguucaguuuucucuaguuacaugaaagaccuaugcagaaaguuaauuguguguguagaucugucugugcaugugugcaguugcacauacauuugugugagcauaugcuuagaaauuaaaggaacccuugaauauuauuucuuaggaaccauccauuuuguuuuauuuugaauuaaaauaauauuuuguguuacuagagcucaccagcuagguuaggcuagcaccagagaucuauuuuccaguagcaggauuacaguaacaagcuaucauguguggcuuuuguuaaguggcuucuggagaccaaaaucagguacuuggagcaucucuuaccacagaaagguuaaauucuuuuuccccgacuuaauguuguuauucuuaaaaauucuuuagaaacaauauagcugcauaauuuuuucucuagcaaaacacuauucauuaauccuuucauagacuuuauaauuuuguaguuucuuagauuccccaaauuuauuaucuugauuucuaaaaaugucuuuaucauauugaggccugaauggugugugugccuaauguucauguguguauauauuuguauguugauaugcagcaugauuugauacacuuuauaaguauguccuaacacuucauuuaaguacuauuagagagguauagccauuuugauguuuugauuuuuguuuuacucucuuuuuuuuucuuuuucuuggcccuauaagaguuuaacaaaugccuguuauuuugucauucaguuaaacaagauagaccgaauauuuugaagucuuguuuauauguaguacuauguauguauagggcaguaugaaacaugaauauaaauaucagugaguuuaccaucauaugauguuauaacuauguaauaagaggugcauuaagacaaauuauguauuaggaauuugaaugaaccauggaaauggccugugcuuuagagaaaauaauuccugucuguuuagggagugucaggcaaagcuugguauagagccugugcuggaccuugugacauaaauggcuguaguguucacaggcuggaugacaucuaggacauucuguggugguaaggaaagaaugauaugcugaauuuuccuaggcaaagacuagaacugcagagaacuggauguuacucuucauucuuucagucugcagucuucucugcuuucuugcaccuccaguguaugcauucugcgggauguuuguugauggccaguguauguauucugcgggauguuuguugauggucaguguauguauucugcgggauguuuguugauggucaguguaugcauucugcgggauguuuguugauggucaguguauguauucugcgggauguuuguugauggucaguguaugcauucugcgggauguuuguugauggucaguguauguauucugcgggauguuuguugauggucaguguaugcauucugcgggauguuuguugauggucaguguauguauucugcgggauguuuguugauggucaguguaugcauucugugggauguuuguucauggucaguguauguauucugugggauguuuguugauagguuucuuucucuuuuuacuuucuagaaguuucacauaggcccauggauuuaguuaucuuuuccaugauuauuaaauuugguuuucucucuagaacaaugguucucaaccuuccuaaugcugugacccuuuaauacaguucuucauguuguggugaccccuccccacucccaucauaaaguuauuuuuguugcuauuucauaucuguaauuuccuucaucauguuuucucuuuugcuuuuaucuggcuuauauuaguuacauagguacaagaggugauugaagaaaacugaucucuuucuuuaggguauuacaaguuuccuauaaaaaaaaacacaacaauuccucauuacugauuugccauauuugaagagauggucucugguuacuacccugaaccgaaaacacaaguggcaaagacacuagcuauuguacuuuguugcaaauuaaugaaaucuuuuaaagaucaauuuucuuaaaaauacugagagaagaaaauaccuuuuuagcagauacacgucugucuuuaugagaaaaggugccugauuuuugaacauuuaugguauauauauuugugugcacaugcgcauguguguguaugcaugcacacacaccaaucacugcaagucaauggaagucagaacacaguuugcaagagucaguuccuuccuuucaucauguagauuucagggggaacacaguucaaugggauuggugacaguugucuuuucucacugagcugucugucuggcuucauguuucuucaaaucuugaugacauagguucuuuguaaaaaaauguauccuuugaaaguuacauacauacaauauuuugaucuuauaucacuaccacccuccaagacccccaguaccccuuacauuuugaugcacauuuuacauacaacuuagcagagagauuuuacuuuaauuguuucugaauuuugaaaaacaaauacaccuuuauauugguacauggcauaauggcauaaaaaaacauacagaccuguguaccugugaauuugaaauacagaacauuugaccuucacauuauuuuuuuguagaagacagcagugauacaguuauguaaucuuuuauguauaguuggguaguaauuuuucucuaacucugcaaucagaucucauuucccaugcuuuuugauguguuuaaagccugccagugaucugacccugaccagagauguuaggauugccuuauugccagaggccauauagccauuaaaaagaucacagacuugaugugugugcacugucuucccuccguguguuguaaauuguuuguguuccugaagagcagcuuguuuccucucucccuacucuagggcagcucuuuagaacauuucuucucuccaauagcugcaguucccauuuuccuccggaaaccuugccaucugucuucaaccugauguuaguuuucuuucuuuguaaacacacuguacuggcuaguuuugugucaacuugacacaggcuggaguuaucacagagaaaggagcuucagguguggaaaugccuccaugagauccagcuguaagguauuuucucagugaucaagggagaagggccaauuguggguggugccauuacugggcugguagucuugguucuauaagaaagcaagcugaguaaaccaggggaagcaagccaguaaagaacaucccuccauagccucuguaucagcuccugcuuccugaccugcuugaguuccaguccugacuuccuuggugaugaacagcaauguggaaauguaagcugaauaaacccuuuccuccccaacugcuucuuggucaugauauuugugcgggaguagaaaccuugacuaagacacacacaaaauaaagacuuuuuauugaauccaauuuuccguuuuuccguuuuugcucuuugcccccgucuuccuccuuugucuccucucuuccuccuuugaguguaacagagucucuccaggaggguguguguguuauuuguguuauguuagguuuuugccuuuuuuacucaguguagauccuuuucaugaugcuugcucugcaggggccaguucucagcuuucacuuuccaguaucauguccaaaaugccuucaguuuaacuaaaacacauuguuuuucucuugguucucccaacuuuauguuucuuaggcuacuuauuuuuaguuucuuugcugauuucuucauuauuuucuguuuuuacacuucuuugcuuauuuauaucaccucuuggagauuuuccccuggcuucaaggcuuuuaucuacccuguauuuauuuauuggcuuucugaaugugagauuuaugugucuaaauccagcaacauuuccaucaagauauguaaaagucuccaacuuaaguuuuaaaauuguguccugcucuguguuucauuagcucuauuugugaaccuuguguuuuaaaaugcagucuuugucaguuaauugcaguaaccuguagagcgggcccuguguguucagagacaggaucugaucuacuuccacugcugagcucuagagucccaguaccaaagcaaagcaguguuagucccuuggugguguaauuuuccguacugauugcaguccacguauucaugacgugaaacaaacuuagaaauuagaacguaacuuaaacaauaucuuacugauauccucaucuauaaaaacaaauagcuauuguucaauuuacaaaauguaccucaaguuagaaguauaaauucccacuuaagguauccauaguccaaaucuauacuuggaagaaaugguaugauuucuuuaaauaugguuaauauauaucuaaaaucaauuuucguauguuuguaugguauauauuaagugugugugguguaggugggcaugcuuguacaugugcauguagacacacagauugauauuguauaucuuccucugugugaaagauacuuauuuaaucauuuaugcuuauaguuaaaauucuaggaauucaguaaucacacccucgcccaugaccucucacacccaccagaagauguuccaaccuugugcuccaccugucugagcuguguccuugcccccuuccccacuccaggauucugugagcucuaaaggagccuccaggagccagccagcugcuguccacuuuuacucagcuccucuugcccacaguuguaccugagacaccaaguccucaaggaggccuuccuguacagcagugggaugaccucuggauccuuuugcuuaguuuucacucuuuuucuuuuuucuuucuuucuuucuuucuuuuuuuuuuuuuuuucuuguaguccaggacuccaggugucaaauucuguuagugauuaauuucuuucauaguguuuucucuagguaagaguuguagguuggccuuuuuuuuuuuucauguuauaugugcugcucguguguuuucuacauuacguuaugucugaugaacaccuguugucuucuuucucucuucugagaaguaugccugugugagcucugauuuccuguaagacuuucuguuuguaucugguuuuagguuuuugacuaguguggcuccugaguccuguucauuuaagauacgcuuuuaugaaauuugcugucauuuuguuugcuauacucagcugugaaucucaguauuuuucaucaaguauuuugugucuaaaauauuggcuuagaauuuuguuuuaaacuuuuaaaaacuuuaacuguauauaccucuauuuaacaugcuuacuuugugucucagcuuguugaauauguagacuaugucuguaaaauaucuauuugaaauuaugugcaugccaagggggugauguguguauaaaugucuuuguaggggacaaaagagagcaucagauucuguggagcugaagguauagaugguugcaaucugcccagcgugggacugggaacuggcccugucuguacuuaguccacuucuccagccccugucauacuuauuauuaacauuuuaaaaaccacaauucucagcuauuucauguuuugguugaucuugaaugauugaucuuugaaauuuggcaucaccccccccccccccguaugucaguaacuggacuaacugggugccacacauuuuaaauauugucaucuugaguacaggauauuuuaugauuuauaaauguucucaagcuuuuuuauagaacuggguuaaauuacuuggaaaaaauugaguuaaugggugagaagggacucauacuuaguacauuuuaggagggauccguguggcauucauuucagggcuaaucuucucugguaaugaagcaaggccaaucaugguauucuugcuggugaguucuauauuaugagguauuucacucugauugaaauaggcacagugcccuccuugugugagcgucaggguugucuucuccagcauucugagaugaauuucuuuccucccguuuauuccucacuguguauguggaagucaguucauggcacgaagagugaguucugaguuuccaggcucacucucaaacgcaucccuuggucuccaaacucccacuguguuucuuucuuugagagaaauggcuugauuucuuauagcuucuuuuuucuuguaacauguucuauacgggaaucacuuaggacacuuaucccagucccugagcugccaaauuauugauucuggucccucuuggaucacuguccuuggcugcuuuguguucaauuuuuaaaaaaugguguccauauaguuugccugguauuuuuguugcuuuguguaggaggacgcuaaaucuagacucuuguaacuucaucuauacuggaaaugaacaguuugacuuaaccaauuuuaacaaguagaacauggagauuuaaauauguaaccuuuccugaaauagucacguuacuucugaguaauuugacauaguauugaugcugugcuaauuggauauaacauugacucacauuauugcaaagguauugguuugcauacauuccaggguggcaaaaagagucaaguuaguaacucaguaguuaaagaauuuggaaacuuggagccaaagccugaugguagaguuugaugaacgccuaaugccaaugacuuugguauauuucuaguugucauggaaccuauuuaugguagccuuaauacagcagcaccuccaucccuucacuucugggaacauuuuacaagacuucccaaaggaugucugaaacagcagauaguaguggacccuauauguaguguguuuuccugaacaugcagcccuauuacaauauuaauuuguagauugggcaggguaaggaauuaacaacucauagauuucauuaguaucauacaaguuuuccuccucaaggugaaaguuuuauucccuuuucacuaagggacauugugacuucuuuugacauaucugaauauucacauccuagucagaagaagagcaugacugugagcucucauuaugguacccagaccagugcacaguuuacaucuuauauauaguuaaggaaacuauagaaagcacaacuugagaaaggaggaccaaccugaauaguaacaguuucucaacaugccacagguauucuucagcuaagaaaccuacuguuuuaaaauagguaagaagcuaggcgugguggcacaugccuuuaaucccagcacucgggaggcagaggcaggcggauuucugaguucucgaggccagccuggucuacagagugaguuccaggacagccagggcuauacagagaaacccugucucgacaaaaccaaaaaaaaaaaaaaaaaaaaaaagguaagaaauucacuuaacagugaauaaacucaccauaaaguagaaacaucugacuuaugucacuguuauggguucucuguuaaaaucuuucugccucugucucuguugcuuuaucuacauagggaaguuuuuugguuuugucuuuuugaaauaacauaguuuuaaucagucuucugucuauauauuuggacuaauuugguguuuuucuaaugccauugcguaguaccacuuuuuaaauuaaugggcagacuaaaggaauccuagauauuuugcauuguaaucauaauagugaggaggcaucauugauguagcucacaccauccugaugauuucaguguuggguuucucacuggcagugguggugcgagccuuuacuccaagcacucaggagggagaaucaggcuuugaguuugaggccuacagaguaaauucuagggcuacccaguauucaacacuucccccacaaacaaacaaacauccucaaggguuuuuuuuuuuuuuuguaaauuauugauugaauuaucuaucucuucuuuauugacuggccuauuggaucaguauuauaaauaaugguuaaggucuaaccuaccuuuacuggaguugacaguaauuaugaggccuguugggcugagcucuucugagaauggauuugaggaagucauucuggugcauuuauuaccgguaggcuguggcuugucagauggguuuugauuuuugguagcucaguguggugaauugaugccguagcagcagggaguuaguugcaacuaacuggguggaauagaguuauguauguguuaauguauaaacugcccaagugauuuuccaguuuuuaucaacauugaguuuaaauaucugaacuuaggaacugaaaacuuuuucacauuuuaaauaauuuaccauuugcuauaagguauuagugagaacauaguccaaguguguucuuuuguauuuuuuaauuuauuuacugacugacugaaugacuggcuggcugggauggggcacgagugccacagcacaccgguggaagucauaggacaacuuagaggaguugguucucucuuucuguggcucuggguguugcacucacucagaucuucaggcuugguggcgugugcuugugucucaucuuuaaagugagaauguggcugaagagguagcucaucaggcaaaggcauuaccaccaagcuucauggaacccgaaugguggaaggagaaacuccuuucugcucuauccugaaauuccacauccaugaacaugcaauuaauuuuauuuguguauuaaaaauauuaauaacaaauuaauaaaauaaaagagugggcacaggaguggcaguuuuccuguuguguguucuuccuucuaagauccuacacuaagcuaucuccauguuacccuuaaguuggugauaaggacccaucugcuguagugacucacucacuaggccuugagaucgcaugauauuuugacgacaugugugcuuugggaaagucucucugcuuccaucgucagggaagaggcucuaguuuucuuccacauuuuagucuggcauguuuuguuuuagaauaucuuaaguggaacuccguaauaucgggaaguaggagacagaagagaaguuaagugacagugguacucagacuuugaauguaugucagauuccagaguuuugaguguggugauaagucgugucucuugaguauugaggcuuauuggggguccagauuuuauauaccagagaguagaauaaaaccugcgcaguccaggaauugaaaguaggaagucacugaggcggcucugggccaccugugcguccaucuaaccucuuccucucugaguuaccucugcugcuguccucacuuguucucugcguguuuauuggcgucagcuggucacuuagcaccugguucauggcgacugcuccugcuaugguacuuuuaaaaccagaguauuuaccuccuugaagauccagagucauagcuaaagcauggacuuccaugauuuuaauugcaggguuuugguguguguguguguguguguguguguguguguguguguguguguguguguguguguguguguguguaaaaacccuaucauucuuguauaguugcaguucuccuuuaggugagcuaucugcccucugauccaguagcuguguaagugggugauagagucggggaggaugaugggauauaggcauggggcuuuauuaagauaguaguucuuaggggaaagggcugaaacgaaacagaauaaauguccaauaauaguuuuagugauaugcauuagcuuuuauuacagaagagucacaaaagcaacaguacaaaaaacgugauagauauuacaggugcaaaaacugaaauguguuuagugguacuagaauagcuuauuuaguauggcuaucccugugacucccuuugaaaagcauauauaguaagcacuuauucacagagcaguccugguuaguacugucagcuuacgauuucuuggaggagguuugugugugauuagacauguccaccaaggauguuauuuacuuaauugaauuucaaauuuugcuuucagauuucucaacucauguauuuuaguaaguuaaaugaguugucuuuugcuuaucuuuuuaguuauuuaugaauuuucaaaauuucucuaguuggccuuuuuuuuccccaccaaauuaauagcuuagagaaaucugagcgagcaggcacaauuuuguguuuuauaggauagagaggagagcuuaauggagccagaugugccuuugaguuuguuguugcaaaguuuuauuauccuguggucauguuugcuuaaagcaaaaguauuuuuagauaauucuaggaaaaguauaauuccaucuauuuggauuuuaccuagcuuucuuaaaaaugguuauuuuauuguugggggagguuuuggggcaucccaaacaacucuaggggaaguauccuacucuugguacuaggguuauuguuuaagaacccauaguuuuuggaggaacuuuuuauccuguguaggggcgcucccucucacauggaaagcacacacauggaguuuauagaacaguaggcuuccacauuacuguuucaaagcuuccuaguguuagucuccuucuccccggcucugccuuccugccuucgccucuuugcacuuaggccuuccucuccauucuucuccccuuugccuccaugucaccaguguucuguuacccacacucccucuugauuuguuaagcacacacuucauauauagccaucaacuuauucuguaauuucucagauauuagcuaaguaucacaucucauccacauggauggaaacuagcucauuucuaaagccacagaacuguccuuuucagugacuagugcucacacagugaggaggauuuccugggacauucuuuuugauguguaucccauaaauggaacaguugcuauuuguuccagcugacuggacuguuuccaaagcuggcuuccucuuugcucagucucucaucaugcuuuucagucucgauuuucuauucagcccuuggaucucuuccaagaagagcagguucuaagcaucucagguacagugaucccacauccccuaaguauucuacuagauccuaaagauagcaguuuggaagaguaggaagggugggcgggaauagccagacaagcccuuuuaacuauaccuuuacaaaaaguuuugaagcuuagaaaaguaaaugauuugcuuaauauuauuauauagcuguuaagucguuuauucuugucaaaccagaauguugucaugucugagaugcugcugauuguuaauauauaaaaaaauaagaacuuugcuuuuuggguuaaagacacuugggacugugacuuucugcauucugaauuucugaaacagucuaugaucuucuuuugaaacuaaguaauagucaagacagauaaaauaaaauaacaaaacagaagaagaaggaggagaagaggaggagaaauguugaguuagaaagcacaaugauuuaaaauauuguauauuuagaguaguacuuuuauuuggagaaaguuugaggagguaaaugauuuacaggcuauaaaaaauaaaauuuuuaaauuuauugaacaguggaaaagaaauauuaaagaucugguuaaguuuuaacagagcuuaauuuugcugcuuuaucucuaaauauuuuaagguaugcuuaauaaggguaugcauagguuuauaaaauaugcuaguauuacauuguagccuacuuugaguaauagcuuagaugguagaaaaauacuaugguaaaagugauugagauuaguguuaguuuuguuggaaauaccucaucacugauugugugucaaaauguaauauugugacaguagcugaacugugugcuugacuguagcuugugacauugguuggugucucaaugcuuguccauugucuuaaucuugggcauguuacuuagccucccucgccuuggcuucuguacuggcuaguuuugugucaacuugacacagcuggaguuaucacagagaaaggagcuucaguugaggaaaugccuccaugagauccagcugugggguguuuucucaauuagugauaaagggggaaaggccccuugugggugggaccaucucugggcugguagucuuggguucuauaagagagcaggcugagcaagccaggggaagcaagccaggggaagcaagccaguaaagaacaucccuccauggccucugcaucggcuccugcuuccugcccugcuugaguuccaguccugacuuccuuggugaugaacagcaguauggaaguguaagcugaauaaacccuuuccuccgcaacuugcuucuuggucaugauguuugugcaggaauagaaacccugacuaagacagcuucccauuugugaaauaucaguagugccuuccucacaggaccaucaccaaguucagacucuauggcuuucuaaaucuuuguguguguggauguguauucacaugcaguguaaauaaauguagacucauaucuauuaagugauaaacuuugaauaaaaaccucacugccucuguuuucaugauuagaagacauuuuguaaaauguguuuagcaagcaugagaaaauggcuuaaaauaccaacaguguauuagugucuggaaaaaagacaccacauaacacucuuguucuuaguuuaucaggcccaaaggaucuuacuuauguuuaacuuaauguuuucucuuucauaguuuaucagagaagauaugaaauauaaagaugcuacgaauaaacauagucaccugcacagagaagauaagcacauaacuguugaggauuuguggaaacaguggaaaacaucagaagguaaaacugugcagugcucuggagccuuggcuugucugcuucugcccugcuuggcauuggcagcccuacuaauugcauauaauuauagagaagaucauguuucugugagaauauuuauauuuaaaaaaaaaaaaaagacuuucuuagaggcuggguguguggugcugcauuccuagcaguugggaggcagagacaggugcaguuuuuguaauuucaaggccagccuggucuacagagugaguccaggacauccagggcuauuacacagagaaacccugucuaaaaaacaaaacaaaauaaaaaacaaaaaaaaaguacccaaggagcuaaagggaucugcaacccuauagguggaacaacauuaugaacuaaccaguaccccagagcucuugacucuggcugcauauguaucaaaagauggccuagucggccaucacuggaaagagaggcccauuggacacgcaaacuuuauaugucccaguacaggggaacgccagggccaaaaaaaaaaaaaaugggaauggguggguagggaagugggggggggguauggggggacuuuuggcauagcauuggaaauuuaauugaggaaaauauguaauaaaaauauuuaaaaaaucuaaaaaaaaaaaccaacaaaaauaaguaaacaaaaaccccuaacucuuagaugcauuaaguuacaggcuauuuuuauauacuuugauaucguauacuagacuaaauagaaauguuuguuugagcuuauugcguaagcuuuuaaaugguauucagauguuuuaucaaguaaaaagaggaaacucagguuuucuuuucaguuguggaugucuaaagucuucaggagcccaggaauuuuaagcuuuuccugaagcccucugugaacccugcuaaugcuguaaucucucucguaugccuuguauaaucuuguccaguugaagacauccaguugaaacccccuaugcaugcuguuuuuccaauguauacacaucuucaacaaaguauaauucauaaguuaggcauaguaagagauuguuaggaauaauaaauaacaaaguagaguaauuauagcaaugaauuauaaguaaaaguucugugauauguuacucuuuagcuaucauuagagcagauagcauauacuguuuggauucucuggacaauucauguucuuaccagaaaagcacgagauuuuugcucuuccuuucccuucuccccuucccuucucccccucucuccacauggccauggcuccccucuacuucucuacacuucucccauucucugccuuucuacaauaaaugccuuaaaaccaaaaaaaaaaaaaaaaagcacaagauuuuauuaaacuacuuaggacacucauuugacaaugaguuguucauauuccuggaauuuuccgucagugcuuuucucacugaaauggacuguuagcugaaaccacaaaaacugacacuguaguugaaagacuccugaacuagcaggauaaaauuuaguaauuuguauuuuauuuccuuucuguuucuaaguuguguauuuauuuuguggacaauaauuuuguacagcacaagaaaaaccucaugccccaaagccuuggcacagaaaccaaugccagggacuuacuacaauuuaagccguuuccgaaguucauucaguuuauucugcuuuucaguauccguuaaccaaauuaucccuuuuuuacaaaucucaaacaguuguuaugggauauauuuuuuccuagaacuuugaauaacaaaacuaaggaacugagcagacuuuuauaaaaagauaaauaaauuacuaguuuacuagauuaucaguggugacaucuggaaauggcagcagggaagccaggagugcgauuaugaagagccguuuggggaucuucugaaggaagagaugucucacucagauggagucuguauggccacuugucacaucuggaauauuuuuuuucuuggacaaaauucuuuuuaagacaaaaaggaggugucaaaaauuaccucuaucguuucuuauuuauuuuacuuauguugauuguuguaaaugcauagccuugguuucucaaaaggacaaccuuucguagccuuucuguagagaucuacauuguuucugaguaaucaccuugaaugaacuauggcaaaggaauguguuugugggagcuuuauuguccccaucacagcuguguccuauaucaucuauucuucaccuaguagaauaguuuacuuauaauauaaaucugaaguguucaacaccuuaaaguggcucacagaaaaagaaaaaaagaaaaacccaacacagaccuucacaaagcacuuuaagccaugccucagugauggucacuucuuuuaccuuuuggccugucuucuucacuuccauccaaauuagauuggccucuuccuguuucauagugugcagggacagauguccuuuuggcuggcuuccuucucuuucuuuaaucuuuaucaaaggccagucuuccauuggagccuacuuccuuuucuguuccucguuuuucugacacucaugauccuucaugucuuguucccaugccacacuguguccaaaguauuaaagauagcuucuucaucacauccgcuccucacacgguaaagcugaggaggaagagacuccucuguugacucguaaaucuccacaggagaggaccuguccuugcuucccaccucgugacuguguucugagcagaucuuuuauaauccaggagaauauuucuagcuguuuccuuauacuuuaaggcuuucccaagguaaacagucccuucuuuuucucuuaagcuuucgcaccuguccuuaucuauuuuauauugcaacaaagcagugauuugauguuaaauugcuuggccaacuuuucuaaccugaguuuguuuucugaguaguuggcaucccacuucucuuucuuagggguaaaggccugagagaaaugguugccaaauuccugcuagcacagaugcccagagggaaggagaaaggaaaaagcugugcggaggauucaggcaauaaaaccucaauuaaaaguuuacacagauggggucgagucucucaacucacaguuauuaaagggccacauaaggcugggaauggccacuagagcaucacugaaacuucagaguucugcuuuggucgcuuguaucaucuuucuuuuaagauuucuguuagaaagcaaguagucuuuugaaaaguuuugagaacuacugaaaguaaauauuagaaugaauguaaaaauacuaaguucaguauugaugaguugaauauguaaaacagaaguguguguguguggcagauacacacggacauuccuucucugccucucaguuuuagguauccaguggcuagaucaguggugcuuuucagcaugauacucaaaaacugugugaugaaugaugaaugucugaaaauacaaugcucgcugaaaacaccauguucuguauccauuuccucagauauuuaggccaugcugucuacauuuaugaaaaacucacacuugcaaaauuaugaacuuaaaaugacaguuuguggggcaagugggcugugcucccagacagaagaaccgguaagguugaaugagcucagauccuguagcucagauuugagaacagugcaaguggggccaaugccugccuaacucuaccugcucugguacauguaaccaugacacuccacugggaggaccaugacagucagucaguugggaaaauaccuaaaguucuuccucaugcaaauagagcauuccuagcaucuuagagugaaccaaugggaaggaucuaccccuggaucccaccccauccucaauguuuuuaaagucccaauccacauggaauaaagugcacacguuauuucacugaaaaucgucggagaguggcuguuuuacugagcuauaacaccuuggggaaggguucucucuucugaaucauuugucacuggaccuuggaccagccuggcaggccagguucaugcuccugcugcuccugccccuaccacugccuacuguugacauuggugcugccaugguaaugggaaagagcugggaccccagcuaccugccccacaaaggcuuuccuucugagagcuguaacaccuuggccauuucugacugggccagagacccauggaaccuauuccucguguucugcggaggaggacaacuguuaauggaaaacaaaagcgggugaaaucaaugacucaaaaucugugcagccucauaaccugaucacuggcagugcuggcacucauaaaaagaaauuugauauuacuaaccauuaaaugcuacccugggcauaggaauguacacuacaaguaauaaacggaugcaacuuaaugaacccagcuaccauguuagguuggguugagguugccuuaaaugagagaggaaaacaaagcacaaagaugagcucugagagaggccugugcauggcaucugcagccacucgagcugagaggaagaaggggaggagucacaguuuuauguguugguggggauacauacacacacacacacacacucucucucucucuauacacacacacacacacacacacacacacacacacacacacacguauauauauugcuauuugguacuaaaugcuaaguuguuugaaaguaccauaauauauugacacagucucuaauuaccaguuauuuauaagauaauucauguugcacagguuauucuguauuuugugccacacaggcaaagcacuggguccuggagauuaaagcugagguagacauuggaccaggcuauacuagacaaagcacugauuagaagugagaaaguaaguaugugcugauagcaugagaugauguguccacaguacagugaaggcuggaguauggagcuggcucacauaacuccguaugugauuagcucaugacuaagaguauuuacagaaggugguauuuagaauaguucaugaagauugacuaguaggucuuagaaaggaagguagauuaugugagaagagugguugaaagaucaagauacauuauguacacauaugaaauugucaaagaaugaaaaaaauaaaauaaaagcuaaaacuaaaaggaaaauuuuaaauuacaauaugaauuaaauuauaccuuaauacuugcugaaauuggaaguagacauggcaugcuucugaaaguauauggaccuccaaguugcucacagggcuguagagauggcuuggugguuaagagugcuagcuggggcuggugagauggcucagugguuaagagcaccgauugcucuuccaaagguccugaguucaaaucccagcaaccacaugguggcucacaaccaucuguaacaaaaaucugaugaccucuucuggagugucugaagacagcuacaguguacacacauauaauaaauaaauaaaucuuuaaaaaauguauuuaaaaaaaaaaagagugcuagcugcccuuccagaggauacagauuagauucccaguaccuacauggcaguucacaaccaugugguacuccaguuguaggggacccaauaccuucuauucucugaaaauacuccagauacacauuugaugcauauacauucaugcagcagaacaccuauuuauaguggcugacuuauagaaugugacuguuguauaauauaaaugaaauguuuucugauggguucuuagcaagugcugucucuauaguacuucuauauaaacgaaaacauucagccaugcuuaaagauuuuuaaauuaauugaguagauauguaaaaauuuagaaaaguuuaacuuaaagcaauuuaaagaaccuuuaauucagagauuggagagauuugggcauuuaguaauugccauucucuaguauaaauaaaaaaaaaggauauuggguguuuuauuucuguuuaugacagcauuuguuuuguaaacauugcauuaaaguaagaaaauuccuggccaugggccuugaauuccuuaaaaguaaggcacauuauaagucguuacuccucaugcauccuuuuuaugcugagguuugucuuuugggugugucaguguggguggauuucuaaauacugauaaaagucuugccuuuuugagugugcacuaugguuuuacauagagacugaguuggaaaacggagauggacugagugcauccuguuuggcguuacugucagagcuacucaaaacauaaaacuuggagacccaguagcaguuugugcuauccagcaacagaauacuguugucuauuuacaguaagcauggaagucacuggcaggauccaaggaagugucaagcguuuucucugaggaguuuuaauggcauuuuuuuuuucaaauacacagaugaaaagcuaaauagcaacauaagaagucuuaguuauauacuaucuaaguggugguauuauaggagaauaauuuauucucaggaauuaauauuauggaaggcauuuuuuuuuguuuuuagaaauaagaaaguuggguauauacaguuuaacacacauauuuauauucuuugaauaagcacaguuuauaauccaggcacguaguuucuuuuaguguaugugauaggccacugaauauuuauuucugugauuuaguuuugugguaaguuacguaagggugaauacugccgacuacauguagaagacuguucauaaucagaggaaaggugcuuagagcagugcugagccgcaaacaaucucaguagguaucugucucugugaggcagcugucaccaugcugugcuaacaaccuggguaagguucugcucuuacaccugagccagggagccugaaacuugcugucuaaagaaagcuguuggcuugugugugcucucaguagcaaagaaagauauccuuggaggauggcguuauaguuacgagcagcgguguuuacuguguauguaggcuaugacaguucagguagcauauuugucaucaccacuaaauauuaaacauuacugaguccucuaugaauggcuuggaauagacuuuguaaaagcuugaaguuuuguucaccguacucuagcaaggagauuauuaccuguguguggauaaaaugugaaucugagugaagaauggaauauuauggauucuagaaauguuuacaggaggacuuggaaacguuugcccugugcuuacagaguauuccgaggguuuugcuugugugguuuugcuuguuugcuugcuugcuuauuucuuugauugaacauacugagcugguucaugcaauaagaaccuuucguaagugcuuauuaggagcauggccuggucugagacuaagauacucagaugaagaaugccuuuuuucuugaccuacccaugaucuguuaguggaggaagaucugcuaacagcuacuuaugggcuguucuacaaccagcugccugcugagaguguauaaaaggaacugggguagauagguagggagaggcgugccagcagaggugaaguaagggaaggaggaucgcauuccacgacauucacccugccaucaguauucugcuggauuaauaguucugaggauauuaauaauuaauacagcacauuuaaagaaagaugguucuuaauaagcugcuuaucuaauacugcucaacaggccaaguuuuaguauuuuugauccugugugcaaugcuguuaguuuuagaagcuguuuucaguaaaaaccaucaauauaaguucggguuuucauugugcccgaaagcaccuuacacaaggaaggcugguuccuccugguggaaucuaguuuuagaagugauagucgccaucaucuguguguacacuaacaaaagguauucaagcauuaguagucagagcugcuucucuguaaaggaaggugauguaaagauauugcuggcucacucugucaaccaucauuucugggggucaauguggguuuugaaagaaaaguagugcaucuauuucauacucaguucccacaccagguaaacacgugguauaugcuggguauagugaucccgaaaucacaggaucacaaguuccagguuuguguugugaccugagaguuuaucuuaaaaacaaacaaacaagcaaaaaaacaaacaacagaaaauccuauacuucauguuaaauguaucauuuauucuuuuauaguuauaacuuuuuuaucauaaauuccugaauucagaguacucucaaugagugguuucugauuucugaaucaccauuuagaagaaaugcuagauaaaauaagguaaauuauaccacacacacacacacacacacacacacacacacacacacacagagagagagagagagagagagagagagagagagagaaagagagagaaagagguuaucuagcuuuuucauuuauuuccagucuuaaagguugaguuuuauuuuaguaaucauuccuuuuucuuugcuucaucaugacuuuuacaauguuaaaauaauggaccauuagauacuuuaucaaguuuuuucaauuagauauuuacugugauuacugguuuaguuugaaauuaagagucuagauaagucugacaaaaugaagaguuccuucauugaaaggaauagaaagaaauuuaguguuuacuuccacugucaacuccuuuucauuuuaugcaguaaguuuucuuaagagcauaaaacaaauguuuucucauugcuuuuaugugcucaacauaauagacuuaacacuuaacaaaaauguguaguaguuaaaaguuaggaacugaacaagccuucugacaugucuccaaucaaagcuacacagauggccaaggcuggaagaucacaaguuccaggccucucugggcuacagacuaaguucaguuuaccaaggcccugucuuaaaaguaaaaagcagcuggauauauagccuagagguaaagcgccuggcaucaugggaugccaugccuugguaauuccuagaaccauuguguguggaauguggcauaggcauugacagcucauugaaagagagggagugagagaccacuuggggaauacuggcaggaaggcaaggucugaugaggaaaugagcaguggccuucugaaggacacaggcaaaucagaaaggguggugggcuggaaagaugauggcuuagcccuuaaaggauaaagcuuauacuaaagggcagaaaggacagugccauugauaucuagacgggggauguuuucaggaaguggguagcuggcuguguaaaucugcaggauagucuaucauauugcaaaguccuuguuaaguaagagucugcaugaaaaauaacugaccuuucggucuuaaaaauaagcaugaaaguacuucagcaugggguucauguauaucauguaugagcugugacuuauauguagcuguuguuaagggucuuauguauauuuugcacauguucuuaacuguguuucauuuugauuuucuggcucagugauaucauucaucauuuauucucuuuacacagcaugaaucuuuguaaagaauucuuuuugccuuuggcacaacucuguccuauaaugagagauagagaaagacaaaaaagugguuaguuauaguuagauguagagaaaugugguauaaaaaaauccagcccaaaaacuuagauuuggcaagaagcaaaucauuaaccuucaagaaauuaauuuacauguugauaagaugaguggacacacacguuugugccugcaaacacacaaaggaggauuaaguaaauugguuauucaaauuuuaaaaggaagagaauuuugacaugaaugauucuugaugguacaauaacuagggaaauaaauuugccuaacaauacaaauauuauauaguuguauaauuuguagaugcgagacaccuacagagucgucaagaaucacagugcuagaagaauugguaguggggauugcuguauaaauaauacauacugauuucaguuucacaggauggaaaguauucugaaaacagauuaugugauagaagcacaaaauauaaauggaccuaaccccacuauuuaaggccacacauguacaaaaaggcaaagguagaauuuacuguguuauauguauuuugucauaauaaaaaacagucaaagagugugagauaaguaggaaacaguagcuagcagccuguaagagaucguccauaugaaaagaaauugaaugguagcugcaguuggguaguaugaucaagcaacgaguuuuaaguagauaugacuguacuuaaaagacacaaaggaaguacuuaacaauuauaagaaauuuuagagcagccugugccuuuugaauagccauguaugagagguugucuuguugugucuucauauuuaacagcagcaucuauuucuuucaggaauaauuguguuaauguguugauaagauuugaguuugauaaaagugaauuuaagcuuagagaggcaagaaaccuacuggaaauacaguuuuccauuggagugcagaggaugugagugacuuuagaccugcucaccauuuuugaacccaucucugaacucauugcucauggagaauuagaacaacaauucuucuugagcaaugacuuuaacuuuuuggaagggauugagguaggaggggaaagggggaguggaggguaaagaggagaggcccaagaaauucuuuaccauagaaacuggccuauauguuuguuuaguuucucaguuauauaguguucgcauauaaaaugcuaacaacauucuuuuccauguuuaccaauaccaaauauuuuguggcagaauuugacaauagggcugcucuagcuuucccacaguuaaauaaucaucgguuucuguguguuguacuggcuguguucccacugaucuagagccugugaccuuacaaagggaagcguaucacacuugcagugugagauagugugaagacuugucugcuuugguaguugucuaaauuauucuaguuuguuuucagugagcaugcuuaauugcaugaauccgaccaugauauuagacugcauucucuauuagaagugaaauuggaaacuuugaaagaggauaggauaaguuagucuccuuuaaggcuaggucuagauucuuugaauaauuuuuacaguuggccccuaaauguaaucucucuagcuucuaauaaaccguauguaccauguuaaaugcuggaggcuuauuuuaucacaaaacuaagugccaguuccugcgcaugccuuguugauuggcuugaaauugcaguauaguauauuucauuccucccucccucucuuccuuccucccuucccucuccuccccccuuccuccuuucuuugauggaagaacuuuauuuuaaaaucugaguaauuuauuuuaguaagucuaccuccccucuccuccucccaccuuccuccuugcccuguuccuuucucuuuuuuuuucuccuuuucuuuuucucuuuuuacacauggacacucaaaauaaccucaaguaauggauacuuuuuguuaaagaagcuugaugaucaacaauucccuugauugcaagggacaaaagucauaauuauuucauucuguuacagauaauuuauuuaguucuuucugugagacaugcguuauuccagacauuggggauagaguauucccuaaaguacauauccuacccucauaaaaucaacaaauucaggaagaaaaugaauauguuugaauuuccacgugugaaaagauauauucacaaucauguaacuacuagcacaguugaauuaugugauuaaacuauuaaacaggguaacaagauaggcagugaucagggaaggcaagggcuauuuaaauaguauaguucacgaccaacuaucccaagaguaguauuugguuguagaccuguuugcugacagugagccaaggguggauacggugaaguauauucugggaggcuuagaggucauacaguuuaagguccccaaggcuggcauggguuuacauacucaaggaaaccguguagcucggauguaauaaaggacagcauaagucagaugcacaucuccugccucccuuuaggcuuucuuagggccaaguacaggucuagaccuaaguauauuguaaugauaucuccauuuaggaguuuugaguuucucucucucucucucucucucucucucucucucucucucucucucucuguguguguguguguguguguguguguguaguaccaaugaacauggaagcucaagauugauggugggaaucuuucucucuuggucuuucgccuuauucuuugaggccuggucucugaauuaaaccuaaggcuaguccauaucucuagucuugcuacccggcuugcucuggggauucucugucucagccuucugggaauuaaauuacaggcagcuggccacacuuaucuggcaauucucuggguucugagaucuuaacucugauucuuuugguuacaaggcagugcuuuaaugcugagccaacuucccagcucugucugggaguuuggacaaaguauuuuugccauuguuuuuggaaagauuauuauaguuguggugcaguuauggagucaagagcaaaaagaacaaaaaaagaaaaagacaaaagugaaaaaagaaaaaggggcuucuguugagggucugggaguaaacgagcagaggugacagguggcacacuggucaguuacuuucuaauuugaaagaauagucagcaguauuuacuaugggauugaauucaggacacugguacagaacaagaauaagaauaaaguuuuuguguuucuauaauguuagaauuuggaggauuguaaugaugaggaaaaaugucaauaagcuugugcguaggcaaugaaaagaaaaaugcugacugagcuuuuuaaaugaugggaugagguggaggacagaaggcaaugaggucaaggaacaguaagauuugagagagaauacugagaaguguccaaagagaaagaaaaccaagaggaugugagggucugcagaccucagaaagaggaguuggagcaacggacagcaggcuucaugguuggacugauacagaggcuauucgugcucuucauagccgcaggugcauggggccgaaugaaaggaaaugggugauguaaacuggaagugaagacaguaaauaguguugacuuucugaaggaggacuagagacuggggcucugaugucagaaggaagacacgcguuaaagaagguuauuuugcggggcucugcgaggcagcaggguugucucacaacagucuguaacugcagcuccaagggguccugggcccuucuggccucuguaaacauucccacucacauccacgguuauacaaccgugaauaaaaaacguuuuuuaaaaguuacuuguauuuuaaaggaugggaggcuuccaguguguccauguauuaauagaaugauccaguucagcaguaauugauauggaggaagacugaaccaccguaauugaaaagcagcccucacugaguuggaaagugcagguauauaauuagacugcucaugcugggcucacugccuugucuauugggauuuuaucugcugauuucuagaggcuuauucuauggaucuuagucucugugggcuugcauuuucaaggauggugcaucuuccaugcuugugcuaguuagaaaaaugccaggaagucacaccugacccaucccugggguguucugguuacuucuuccugccuucauucccagaugaucagaagcuguugaaguggaauacuagcagcgcccagcccuacaaccagauuagcacaagcagcucgacugagaagagcagaccagggcugaucaaaaugcaggauggaugcaggguggggccuggcacugugggccacaugguaaaacaaucugaccgucuugugacuucaaacuaaguuuucugggaccuugaaacaaacaaaugaauacugaaauaguauaguaaaucucaauuuuauugaaaugagcuauauuagccuugaaaauugaaaacaaaaagaaaaaacccuuaccuguuaaagcauaguuuuccaagguacugccugguacuuuacacuguaacaggucagaacuggcugggaucacugggcacaucuaaaugaugauaaacuuacacuuuuaggagaggguuuuccuuuguagcuagacuggccucacgauagccuccugcaucagcugagugcugaaauuagaggcaggugcuccuuuccacagcaucacggcagaaggaaaacaguucauacucuagucauuaccaagacuuugguuuugguauguuauaucuucacuuacauguggauuagaucuggacacuggugacuuuccccagugaggcuucucugggauagacagugggcacuguagucagugaaugcaccugaaauguauaaagacuccaaagagcugucuaggagacgaucacuucaugaauuuuccaaagguaaggucuugcugccagccaucacuucuaggagaagcaguacuuuuaugucccacucuguuauaaaagaguaguucacuuagguuuuuuguuuguuuguuuguuuguuuuuuaaaauaugggcucuccacuuucuuuuugaucuaguguaggaucuaguuagcauuuuuuaagaaccaauuugauaccauugcgaauagucacuuuuuauguuaauaagaaggaaggaucagcauucucuggugacaguugagcagugucuucauuaggguuuuacugcggugaacagaccaagaccacgaccaacagaacgugaccaaggcaacuuauaaggacagcauuaauuggggcuggcuuacaggcucagagugucaguccauuaucaucaaggcaagaagcauggcagcauccaggcagauguggggcuggaggagcugagaguucuauaucuucuucauccaaaggcagucagagaagacuggcuuccaggcagcucgggcaagggucuuaaagcccgugcccacagagacacacuuccuccaacauguccacaccuacuccgaucaagccacaccuuuaaauagugccucuuucugggccaagcacauucaaaccgcagcauugcaguucuuacacuaguaccuuuuuuauuuugcaaauaaauuuguuaguuaugauuuagaauucaauuauaguucguugacaguucuguuuacaaguaauuccuagauaauaaaguauuuugcuugcaugggccaucaaauauagaaugaauaguuuauaacuaaauaggacuuugaauuauauuucauaaaauuauauugauucaucucuaacauuuucaaaagagauagcagguugcuuucuucauugguacaucuggaaaccugagagggaggaaagagagagagggaggggagagaaagagagagacagacagagacagacagagagagacagacucagacagagagagacagagacagaccaagagagagacuaaaaaugucuagauauagucacaagaagccuaagagauacaguauauauuugggaaucaguaaucagcuaauuagaacagugaaaauaauaugaaauaaacagaaagagauuguugucagcucaacccagaaaauugaaagcaaauaugagauguuuuaguaauuuaaccacauguaaucucuaugcuucuaaaaagacuucuaaaauuacagauaauucccuacugcaaagucaugaaucagcuuuucuuugaacuguaguuguuaaaauuaucucaguuguuuauaguugcuguuauuuuuauauaaauacuagaaaccuauaguaaaagauuuccaguguuauguauuuucaucguauauuuucucacuuacucuuaaugaaugcuaauauagacuugcuauaaguuugagaacuuuuaccuuuuuguugcgaauuaaagccuccccccccuuuccugagcagacaagaucaaucucucaaaguaagugagagcccugacuugacuugcuauauucagaucuccaugugacucaggugaauaacucaaucacuggguuccccguguucccauuuguacaguguaauuaguagcguucuacucauagccaguccacacacaccuaggcagcugugcugagcauuagugaggagaguacuuaggagcuaauggcccuguguuugucauugucauugucaugguuaauauuuccuauucuggcuggauguguugucauaugccuuuaaucucagcacuucagaagcuggggaaggcagaccucugugcauugcaggccagccuagucuacauagggaguuccagacuagccaaauaaacaaaacuaaaaacaauuugccuacucucuucaagaauaucacaagcaguaaaauuaauagaauuuuuauauaauauaaacauuuuguuuuaaacuuugauuucacagcuaaagcaaaucaaauuuagagauguugucagaacuagaacaaagacuuuccaugcacuguuuguccagagaaccccacugucaauuucucuuuucacauuuguccuaauaauggccuuuauagcugaaaaaugcaggauugggcaugcuagcccauguaggucugcagucuucagccuggaacaaguccuuuauauccuauacccuacucacuggcugguuaucuuuaaaaaugcuaucuuguagcuuuuuuguccuuaaauugggauuuauuuauuacauuugcaugaucagguuaugaguuguggauggauugucauggaaaugauuuuuucauuacauucuuuuuuguuuuuguuguuguugucgucugugucaguuuguuuuaaugucagugguuuuaccuuggucauguauggaagauaguguucacuauguuuuuauaaguggauuuucaucuuucuguuagaauuuuucuguuuuguuuuguuuuguuuguuuguuuguuuguuuguuuguuuuguuuuugacacaggguuucauguggucuaggccugcaucaaacuggcugugugguucaaccacucucaguuuuuugcagugcugggaauugcucagaccuuuaugcaugcuaaguaacuaacugagcuaugccuccagccccuguuaugauaauucuugugagcuguaacuugaaaacuguguaauaaaauaucauauuccucauaccauauucacccacuuguuuuacugucuuuuguauuuguguuguuguuguuuuuuauuaaguauuauacugaugauugccagauggcaauuucucggucugucauuuuuguguuuauuaguuggcauuguacuggaagagauuuaaacagcgugcacuauuagcaucuugccaugugagaauggugggugcuaacagacaagacuuggaaguagccccggggaaagauccacucagcauccuacugagucucccaaguuucgucuucuguaugaguugauuugauuaccaucagagccaacuuuucucuuguauucucuggguuuucauuuguuacucucagccuucuacccccccaugcuggcuuuaguaaaccuuaugaccaccuuggcucuugaaugcuucuuuuugacccaaggagguauuauggaugcauuguguuauuucucagugccagacuuagaaacuaguagcaagaaugcuacuaggauauuauucugagauauuuuucaacugucaagcuuaaaacauuacaguuuguauuuguuucuuuauuaaaaaaccaugauuucacacugauaauuucacacaccuccaauuccaguccuacauuguugaguugguuggacuuacacucucacuguguguguguaucucugugucucccuuuaccgacagcaagcugaaucgaaucggcuguuaucuccagcguguuugcuuacuguuuauagccccuuuccugaccacaucagacugcugcugccacacuccagacccugccuaguguggacuucugcaaggcugcuagcccgaugccacaccagccaggcgcuggucaguaguaacuuugggacuuggcuacuucugagcaauagaaagauuauugagauguggagagaacuuggagggaaccuuaaagggcaguguucagcaucuuugggugagugaguccuucagugcggauuuacuuuuacugaggcucuuuauucacagagcgcccuucuuauguaacucacucuuuagcccuugacaaaggcccucuguaaauaagccuguuuaguaacuuaauauuauccauugugccacuacucagaauugaggggauuuuuccuaaaaguuguuuugccacaauagcauuaaaccauggcuguauauaccuaacaaaacuuaagucagaaaacauuccauauuaaguaaauguagcuaaugauaauuaugaaccaguagauuuuaaaauacuaaauguacuaggaaaaaauugauucaguugaagaucaggcagaaguuuuuagaguaaaauuaacuugggaguaaaauuaacuagugguaaaauaaucaauuuuacuguuccugcuccuuaacuuacuggcucuuaaagguguucuuuaauugagccuuuuuuucugggguaagggaguguuugacucccucaaaaaugaauguauuuuauuauaucauguucuacaauagucuuagucuugauaaugcuuguauucuagcauuuuauuuuauccagcacccaauauuaauuucuaugugccugguaaauauuugcuauauguagaaauaccaaguugacuauauuaaauuuuuuaagcagacuuaauucauuuuguuuuucuuguauaaagccccuaugugguaaccagagcuggcuccuggggcgucugaacauagauucugcugggggcuucccaagacggucagugcauuucgaaugaagagacuuggugaacaugguaucuuuccagagguugggacucaaguagcuguagucuuagagaugacaucaaagguggccuuagcaaaguugcccaggguggcauuguggcccccagcugaugugugguagucagcaauaccagcuaucagcagcaacuucuugggcacgggagcagagacaauggcagcgacugugguggcagggagaagacacaccaacacacaaccacaguggccgucaccucgcguggaacagugaggaauugccacuuuuguucccccagucucugcgcacagggacgguggaaagcuuggccaagaugauggacccuugaauggcagugacuaccuucuuggggcacuuaacacucagaccagcaugaccauuguaauccccaugucuuaggguuuuuauugcucugaagagacaccaugaccacagcagccuuuaaaaagggaacauuauauuuggggcuggcuuacaggugaagguuugguucacuaucauucugucgggaagcauggcugcacacaggcaaacacugugcugaugaaguagcugagaguucuucaucccaguccaacaacagggcaacagaagagugacaguggacccugagcugagcaucugaaacuucaaagcccacccccagauacacuuccuccaauaaggccacaacuccuaauagugccauucccuauggcccaugggggccauuuucacucaaaccgccacaccucaguagugacaaaagucuuuaaccuggucugcuggucugccccaaccuaauccuuuggggacauuaccuggaaaaagucagcgaucucacguuucuuagugggcuggaagaucaaaugaucucccccagggacuuggucuguauguccuugaccagcuuggugauggagaugcacucacucacagccuccuccuaggcccgggcccucccacccaccacaccagcuccaccugcuguuucuguuuucuugaagaagcuauauuuuaaaaaauaacuuuaaguuuuaaaagaaaaguggcagaaaauaaaaccaaagauucuaaagauauuacuuagauauauauauauauauuuguuuaauauguuuuagaaaauagcauguucaucacuuuacaaaacacagccacacuuuagaagaaauuuacuuuaucuagaaaugccacucaauuacucagcgcugaccucuuccuguccuccuaguuuaacagaaucgguugucauguauucacguacuggcaacuccucauuauuuaaguacuucacagugguugacauauugaaauuauuuggguaaaggaaacagcacccaucuuuaaagagacugauuugguaugaaauugucuuuaaagaaaaaaagauagucaucaugucagugucuauggaggccagaagagggcugcaaauccccagaagcuggcgugaauggcagcuguuagccaccugauaugggugcugggaacugaacccugcucagcugcaagaggagcaaguugcugaaugugaagccaucuugccauagccucaauucaguauuaaaagaagaaaucuggauacagaggggaaaugcauaaacaauuuagccacucucuucauaggaucauaaauuuguucugugacacacacagagauguuuaagaaaacuugauuaaacauuucuuucucuuguagucauugaguguauugcuguuuugaguuuuuuuuuuuuaaagaaaacauuucuaaacuucucuugcaugguauuuuaguuccuauauuugugaugauaaaauaaaaccaguuguuuauguucauaugacauauuuaaaugaauaauuucuauacuuuuucugaauucuuuaugccuuuauugcucuucaccauuuuuuauggacauaaccacugguaauauacuuaauuuuacauaauuuuaaaaucucaguuuagacggcccggcuuaguuuuaaauuuugaauauccagacauuugcuaacaucauguugaguucuaaaaauucugcaaaguucuuacaugauacaaggcaaggaauacacgaggguagguauuagcacaacuacuaauaccugaccuucccaaguucagggcauggcuuuagcuguccaaauauagcaugaugcagggguuuagaccaugucagagacaugucuugcugauugacgugcaacuaugaacucacauucuggcccuguucuaaagauaaaccuuucucuggcagcugguugucauggugucagucacaagugacgaguguacauaguccauggaaccaacugagaagagaugagcaggccugcagcuucuucaccucuauacaaggaguugcuuucucucauguuuaguaaaguuuaaaaaaugguuaaagauucauuagcagagcccugccuuuuuacagcuuagguuauuugaaguuuccugugagaaguuacaucugccaguguaaugagaacuccugaggcuuuguaacuugaaagucuuucauuugaaauugaauuuaauucuaauaaauucuguauugguacauuguuuuagaauauauuuguaaacaugcuacuguuucaaacauuggccaucaugucuuuagacuuuuauaaaaaugucagaacagcgagcacugaacauuuuauaauggacaauguuaaauaacauugugauuuuuccucccuugugucuauaccaaccuguugguauuuuauaggguuguuuucaugcuauaauugaagauaguguaguuaguuuuacagaacugacccacuguccuagcuaaucacggcagaagugcacuugucuacaguaacucuucugccaguuguuucuugacacugagaacauaagccuguaacuguuuaugcaacaacagcuaauagcuaggcagaguuauauauccacucuggucaagcucugcugcagccaacagugaacuuggcuguaguuugagauuuucucagaaugaaaaaagguacgggaaggaggaagaucacgacagucaauaguuugagcuuugacacccacagcaauuuugguuccauaugcacuaccuacuuggaguaugaauuggggaauuacuaaacugucugauccauagcuuccugauguauaaggcaaaagucacaauaauaucauuuuugauauaauauauauguauauaguuuuaauauaucauacuaauauccauaguauugaugaauuucaugagaauucaacaugggaaguauguuaccauagaaaucuuuuagcauaguuaauuggaaauugucacuguaucuuuacauacacaaaugcuuuaugauuagaaguuauuuuucuauuacuguuuggaugaauuuaugaacaucuuuaagauuuggagggcuaauauuaacuaaaauuuuaucuuaaauuuuaaaugagacuuuagaaacuuuuuuauuuucaggccuguaauuuaauguaaguucuaaggcuagugacugcauuggcuuuguaaaauuuauaggauuuauaagauugauuuuuauggaugccaggaacaagugauuuguauaguauauucucuuacaguuugaauuucacacugauuuguaaguaucagguauacuuaagucggggaauggaacaaaagcacaauaugcucuucacuccugacagcugacauguguaaauuagugcuuucauuauguucuaggccucugggaucuuuucuacaaccaaggauucuccagugcgccuuugaaaugagauacccugagaguaguauugcuuauuuuuuauuacaacuccaggaccacaaguagacaauucagaacagaacugauucuuuucaaaggaagaauuguuacaucuucaucgaauacuuaaaaugauaauuuuacaguggaauauaauaguaucucguguaguauggacgcccacgauauaguaaggcacgacauucuagcagguaguuagcaaaauaagacagcuuagaugucgugcuauuuugucgaaccaguagguagguaagaauucaggggcagagaucccugccagcuagggcguuugauccagcuguagcccagcugugugcugcuguguccugagcguggcccauggcauucuuagaaggcuguuucucggggcugagguggccucucuguugaaggcuguguccaccccuuccuaucucuuaacucucauucucgcaccccaugcuuuccaaaagcuuucacuucuuagaccuaguuuuccucuuuuucaaguucuguuccaaaauaguuacauugugguagggcuggcgaguagaguguaggcggggcugaugcaacacagcgucuuucuuuguucaaccgaggaacuacauuuacuguugcagaaauugccuuguuagcaaaaaaccccaaaagcuuugaaucuccagcugcugucuuucuacuguauccuguacccuccgcuaccucuccuggagcucugguucuguucaccaucccuuuccuaccacccaguacugcagaggcagagguaggugcauuucugcaguaugaggccaagccugagcuucauagcaagcuccaggacagagacacugcuucaacaaaacgaagcacggaagcccugaacuauucgcucuuugaaauauuauccucagguuguuagagggccucucccaacuuacaggcauaucuucuaucacgaaaaguuagcauaacucuccugcgcuuuuauguuacuacuuccaacguuaguguagccccuguguaucccggacaucucuagaacugcaaguccacuuaggcagcugcuuacaguagacuacuuguugguaacauuuuauacuuguaugcuauuagcacuaaauuucuaagagaaaauaucucaaguguuagugugguguuuugaaucaaaagcuaccuauaguacaauggguuuggaccagaguucauauucuaguuaucaguugauagacauguguaaucaaauguaugaucucuuggccaggugucucuuuauagaaucuagagauagcagcuacauuucucaguagcuaaaggguacaugucgaaauggauguguaaguguguauuuagaaaaaaaaaccuccuuaauuagcuggaugacaauaauaaguccugggcagaugagaugccucaacaggggaaggggauugcugccaacucugaguuugacuuuugaaaccugcagguagaaggagauaacugacucuugaaaauuguccuuuuaccuccacacuuacaacauacaugugcacauuuauuugcacauaucuauacacauaaauacguacacacacacaaaauaaaugcaaaccacuuuaauaaaaauuaaguuccucuucucuuaguguucaucaucagagggcagguugugaggacagucacaucacauguauauugguuugucucacgguugauccauguauagaugaugacgaauacaaaggagaccaaugcaauauugaacugggcauugggagaauguuuagaggaaggaguucuuaguuugagucagagagaguaaggacaaggcaggcaaauggaaaagagagggaaagccagucucagcugaagaguguuaggguccacaaggacacagggcaucuuuaagaagcugcagaucgugcagugucugccauucuaaaaacagcuugcucugaaaccuacuguggccauuuacuaauuuguuuauaccuaauuaagaguucuaccuugagaaaauuguaggcucagcaugggaauaaauguacugcuuucagagcugcuacaguguccacaugaaauaacauucauaaaucugguauguaguacauaguuaauguuagcaacaguuuuuauugguguccuagccauuuuuagaauucgaucuucccugucagcauucuguaaugaaauguuccgggcugguuguucaguuuacagugcuuuagacaacagcccuuuuuuguuauaacggaaucagaaagacagaauuuuaaaguagcucaguuuauuacucuguuuauucaaaaacuuagccugaguuaaagagcuacgguggcucugugacucagguacaccucuuggcaacggucucuuuccauucccaagugugcugaaaaucaccgaaaugucagccuauagcaauuggcacaguuuugagcaaaaauacuugguaagcaauuccaaagucagugacagguaggcagagggauggggcggcuucaggucgcucuuugucacuggggaucuccuaugcaaacaagccuagguugaacaguacucacucuuuaagucucaucuacuucaguaguuaaguggcacccagcaaacugugcaugagugcucaguaaggaacuuauacauccuuuaguggaaaagcagauguuaaaagaauuccuucucuucuagaugauugaaauuaauuaaauucuguggggaaaaaaguucuuaugaagaacugaauuuagcuaagaaaggaagauucaacaaaaauacagaagaugauaggauucaaaccgguuucauaucaggucuuugaggacggauaaaaaggagccaccguagggguugaaagaccagcagaguauuuggagcagagggagcuaauacaaaacuucucauguccugguaaugagaagaaaagcuguuugcaaggaacccagacaucaaguggaaagccaauucuuucccucaaguaacucugucuuaugauaggaugguauuguuuuaaagaugcauucaaaagagaauugguuuuacaaacaaagcuauuuuagaccagcacagcuguccacucaggucgaguaguauuaggacuggacaguuucgugcgcuuuuuugcauuucuuccuuugaaucuggucuccuuggaaacuugauguguuggguugcuuagacugguuuuuuugcuauugaaaaauccaaaggcagagagaaucuuauccuguuuuccuggcugagaguuuugugugggugugugcacugcagcugugcuguggguuucuuggcauucagacagggcaguucuccauguaaugcaucgcagaaggaagaagccuucguguaacaaggcuacuuugacuggauuagguucagcggaaggccccuagggcugggcugcuggcugguagccucacuuguuugucucuguggcuccagcaggcucagcccauauacaggugugaggguagagaugugucagaaagagaacauaagagcuuugucucaguauaaaauugccacuuagcaauacaguuuuuaaagguuuuuauuaguuaauuauacuuugcuuguuuuuucuuuaaagaucauugaaaagggcagugugaaaacauugcaugcaaaugugcauuuagcauuuucuauaauuuaugagaaugcucuuuuccuagagccuuugugcacagauggaucugcagcacugcaccuaccacuuccuccuugucuucagccccguuugcccucugcugugguuuuccccagucgucacauuaaguguagacagcaugcagcucuccauuucucaagccuuccguuggaacagcuuacccuuuacacaagcaagccgagaaaagccuccaacuuaauucuuauggucucuucuuguuuauccuuuugcucgugguuguugcucucaaagugcuauagaguaagcuucuaucuuugugugccuguguucagauccagucuuuccuaauguggucccucucugacuuucugccucuuccuaaaauacaauacaauacagaccaaacacagcucagcaagauuacaucagaucuucagaauucuauggcuuuuauuguaggcuuuaguugauguagucaagccagaggacuuaccuaauucauucucauucacauccucucucucucucucucucucucucucucucucucucucucucucucacacacacacacauacacacacacacacacacacacacacacacacacacacucauuuacccccucccauuuuuuaaugacuagcaugauuuaaauguuuccuucccccaucuuucuucauuucuaaguugccccccccccugaaucuuugcccagggcaccuagguuucacagggguaaacaaguuccccaucuguucucugcuguaugcuguagugcuuacaguggccugacucucacggggugguucucugauuagaugcauuaaugggcuagguaaagugccaaucaagucuauaucuaguaagguguuacacccauggaaauggguuguuucauccuuuaaaaacucuguauuaaugcuuauuuuagaauuaguuuuacugcagucugucuaauuguuuuaugucuuuuuuucuguuuuagauuguacacauuugggaaaacaggggugggccucacuauuuucagcuuaccauaggaugcuagaugcuauuuuacuaccacuuauuacaucuaauugaaaacuuaaucucccauauguagauguguucagaucuuaguuuugaaagcagugugcuuuaaacuauaccuucuuuucuguguuacaguucacaauuggacacuugaggauacccugcagugguuaauagaauuuguugaacugccacaauaugagaagaauuuuagggauaauaaugugaagggaacaacacuccccaggucaguggucacccagagggcguugagaaaugagauguagaugcaaccuuucaauucuaaaucugaaagauacugcuggggcugaugggagaaaccaaauacuauaaauauaucuguuugaagcacuuuaucuuuuucuuauuuuauuguguauguauucuuuguguauacacguauuguauguaugugugcgugcguguuuguggcguuagagugcagaugacagugcauguguguagaggucagagaaccaucuuuccugaaccuuuuaccuugcuuuguuaucagugugugcacgcagcaacuuagcaggcccccaaguuaccgaguauucucucaccuccuccuucuaaccugcccaggcagugcgcauugagugaaucccucuccccucaaccuacccaaaaaggcuucuuaccuucaaugugguuuucaguguacauuguucaucugaaacaguugaacacugaguguggugagagccuuucagcugcugcuagguaaaagcuccucaaguaagaacuguuuuuaacaucuauuaaaaauauuuaguaagucucuuaguaauuuuacuuuuaugugugugugugugugugugugugaaaugauagugaaaugcugacauuaguuauuaguuaauuauuauaaaauacuuucaguuucauaaacuuugcaauuuuaguaaguuauaauagaaaauaacuucagaagacaguagcucaucaauauagcaguacaauuauuacccugcagaaggcuuucaguaucacagaugagcuuucaacaaugauaaucaguaugugaacugguaaauauguugcuuguguauugaaauuuauauacuggaaauaccuuguuuacugcauauuauuuuuucuauauacaggauagcaguucaugaaacuucauuuaugauuucccaguugaaaaucagcgaccgaagucacagacagaaacuccaacucaaagcccuggaugugguucuguuugggccucugacacguuaguauuucucucauucagcaauacagagugcagugugccucauuccuguugcagauagcagacaauagagaggaacaggcaaccaaaaagaaccauuugcuagccaugaaggaaauguggcuuguaggaugagcuuuucugccauagaaauaggaauuuucaaacuaguuucuaauaugaaaagcuaugaaacuguggcggaccugagaaccucucagaagcagaaaucuaaacagacccccccccccccccgagacuguaguugucugcaguauggaccacugaugaaaguaauuuauuacaauccgcauacuugaggaaaugcuuuauugugagugacugauucuccagcuugugccuagugacaaugaccuggccuaacugaaggaaauggaagaagcaaguuaugggaucccuucucucugggggguuuucuuucaguagcaggagaucaaucacaacaaggaaagccuguuauagccauaugugguuuucuuugccuuucugcaggucuuguauauuagauagaucaaauaagcauacugauuguuugaagaguugugauuuuauaaagcuagaauuuguaacugguggaaggagauauuuaguuuuguuugcuuuggaagucugcuuuucuguauauuuacauuguauuacacucaaaaauuaauuuaaguaucugcuuuuuuuucuuuuuguaggcccaccucauaacuggaugaaggauuuuauucucacaauuuccauaguaauugguguuggggguuguugguuugcuuauacacaaaauaagacaucaaaggaacauguugcaaaaaugaugaaagacuuagagagucugcagacugcagagcagagucucauggacuuacaagagagguaaccgaggcaucucacugcauauggacgugguggcuaacgcugggagguggggcuaggaggaucaggccaaggccauuguuggccguguagcuagugagaucaggaucagcuucuacuacuaaaaacuucucucaaaauccagaauaauacaaaauucauuaccaaaaccaguccuagcucugaugucacauaaguaaauaugcuugugaaauguuacaugaauaugcauguaaacauuuagguuagguuaguguucauauuaggaauacauguuuauuucauuuuguauuuuugaagaauuaaaauuugggaauaaauguguagaagaucauaggaagcaaaucagauauagguagaauguaguugaaccuuacuuuuaaauagauuuaaauguuuauaagguuuuuuuuaaagucuuuuuugcagagacuguuuuuugugauccuugugagcccaagauaacaaaaaaauggauaaauaauagguugccugguauuuacccuaauuugagauuaauagaaauacuauaaauucauaauauacuauaaauuuaaaaaguauaauauuguuugaaacaguuauuuuucauugaaauguaauuuuggauacuuaagugauacauuuuaaaaaauguauuguucucuaagacuugaaaaggcacaggaagaaaacagaacuguugcuguagaaaagcaaaaucuggaacggaaaaugauggaugaaaucaacuaugccaaggaggaggccugucggcugcgggagcugagggagggcgcagagugugagcugagcaggcgccaguaugcagagcaggaacuggagcagguaccguccuagugggaguggcccagcugcuacucccaggggccaccagcccuuuuucuuuuguuccauuugcuguauccaugaugucaugucugcuguuccucggcuaauaaacaaauaauuuuuuaguauucaucaaauucauauuuuaaaaauaacaaaaggguagccggaaggugaaguugccagcuugcugcugcuucuaugcagcauuaugauccugcguccugcuagguuuguuggcuugaguucaugggagguguuuacuuagaucuguacuaaguuucuguuucuaaugucacuguguaagauaaaggacuucuacugugggcuucuuuaaagccacaggcugcaggugugaaggauucuauuagucaucccuuuccaaccuguuagauggcuuuacaacacagucuguugaagucuucaaagguaucugcaaagauguccuuccuaaugucuguuuccuccacucagcugcucgaaguaggauggaguagacauucagacaguucacagugcugcagagaagggaggauuguagaaggauuucauggcaugcguguguaucaauuuccugucccugcagaggcgaauuacuauaagcuugguggcauaaguaaauauagauucauuaucacucugaagugcgccugcagggccuuguccuucugcagucuguguuuccuuucaucuaucaucccauaaguugccuggaauucuugucugauggcccuuccuucgucuucagaacacacucucuaacgccaucucacuuucugacuuacccauuuauugauggagaaacuaagaaaucggauaggauugggaaacuuguucagaauuaguuguaaagcagggaaaagacccuaaguucucugccucacuguguacuguuuauguacugccugucaguuuauugccaagucaaagaucagaauuauaugaugaguuuuaauuguaccucugggcacaugcauuuauugagcaccacuguuucuucuaagguguccuuuuggagaaucugucugacugaacucuggucucuucuguugcugcugacuacaucucucucgaaauaacauuuuaaaucucuuucccuuuacuuaacauuaagcuugggucugguuaauuuuugagugugauuuuuuucuuaucuauuugcaagguuuuuuaauauaaaguuuacuaaacuuuuuaagaagcaauuaaaauugcccuuuagauguauuuuguaguuaugcccaucucacuggcaaaccuuucuguccagaauguaggaaagaguugagaaguuaacaauaaaggccugucuaaaguuaacgccuccaagaacuagguaugcccuaguucauacucccggccugacgguuggcuuguuccaggacuaugaacagcuugcuagcucauccucuaacuuuccuauaaggaggaaguaacccagaggaacuaguaguacuuuuugucuuauuagcauauguuaauuacccugcacugugguuucauugcuucauucucaucauacaguauuaauguguuucaucccgucccuccccaguuacccucuucuguucucuccugcccuuuccucccucacccauuccuccuacuuucuuauuuuccaccugauuauuuggcugucccaaugaguuugauucaguuccuuuauggaguccuugaggagggaguauuuacagaagcaugggcuugucuguccuucccugagcgaaccuuaacugccguaagaacaggguugacaggugacugccucuccuuuuaucucugguucugccauagagugcuuugcaugccuuuguagacccuagggucaccggaaugugauguuccgguugugccaguauaaacacaauccucaugucaucccgaggcagucaaggguggcuuacaggagaacagugggucuuuaggaagaacucagcccaacaugauuguauugguaagaaacgccaccuugaguagucagugugcagaaacccuugugucugcacuaggggaccugcucugagcacuaccccuuauagaaugcuaagagacauaaccacuucugugcguuacacacuguuauucaacagaggcaagcuuuuguguguuuaauuucaaaucuucgauuuccucuacugcuguucaaagcaucauuuacugaggaaguaagugauuaaccugggaaauuaacuuacguuaucuauacaguacccuacauugcauauaguugaaauauaccccccccaguggagauaacuucaaaaaugaucaauaugguauuauuuucuuuaaaugaagacuuuuggguaacuaacaucacuuuauauuuuuauaucaaugguuuugcuccuaaaauuguuauauuauuaauauaagucucaggcagugaucuucaaaaguaugaauuuuacuggaagcuucaugggcuuccagccaaucaaauccgucaaaccaggucuggaagcuagguuugagguaugugggcuguuucuuucugacauguuucuacuguuguuuucaauguuccagagggauauaguuuuuaaaccuuaaauucauuuguaaaugcuauuaacuaauuagacuuugaccauucucauggauaacaacauaauucaaacagaguuaagauuucgaucaaauaacaaaguuauaaauaacagcugcugaacaguugcuaguaugggaugaacauaaauuucacauuauuuaauaguuaauuuaagcauugcucagccucaguuuaugccccaauacaaaguuucugugcaaaauaaucuaacuauuuuaagagaauuugauggaaaauguuuaggguuguagagaguagcaugagugaaauguguugagauucuguguauauguaguauccugaacauuuaaaucacacugaauuuuuaguuucaaagucuugggagagaaaaggcuugcuguagucugcuugugguguucuguagggcugugugucacagggccugguuucacacucuuucuucaagagauaucagcaaggacaccacauugucccauguacauuacacaaugaaucacacuaggugagugucaccuaagaaguugcuucuauugaaaaagccuuuuuuuuaaaaugucucaaguugcaacccuuuuuuuuuuguuuuguuuuguuuuguuuuguuuuguuuuguuuuuuguuuauacacuauguguccuguugugauuucuuuuuaacuuuggaguuuuaaaauauuuuucuacacugcccaacagcuguucuauuucuugaucaaaaguuuguguaguccuauucuuaguuuacucuggcaaacagaaagguuuauuuaaaucaauuggauuuguucagaucaaacaucccucugcacuuuaguuuagaaauggagggaguuucaguuagcucaguuagcuuugugggcguagucaugggccgggcaccaggaucaguguccaccgugcccccguggccugguggggagguuuucauuaugcaugccagucccaccauccugcccagauuguaaguaagcucuuccaagaacugagucucucuuccuucuuugucacuuucuuacuggggcuucgcuucauauauuuuuuuuuccuuagcauuuaucacacuuaacacaucagcaccuuauuuccuuuauuuaauuggcuggcccuuaaauaguaugugggaaaaauacuucauccuuacagggaaagcaaugcauaguuucucacagggaaaaucaaauauauucuuggccagaauugacuuucuuaaaauuugcacauaguuuuuucacacuuagugucuguuugcuuacaggagcagugggugaucuagacaggguggaacaggcuguagugggagacgcgcaggaaagaacagacagggcaucaggaaggagaccuugaaaguccgcuugguuuauguggguauugcuucauauccuagggaaccaaaaaaugcgcugugcggaaagugucaucaguaauuuauauauuuccuaauuuguuuucuuuugugucugauuugucuuagcuugacagcuauaaaauaaaaaaccauuuccacaguuuaugugugugugggcucaugugccccuucacuaaucuguagguucagcuuugcucaguaaucuaaugauguacuucaaggcagcacuaguuuugaaauaaaucauuuagauuuagggacuuuaaaaggguuuuguaaaguccauaauugaauuguuuguuguuguuguuguuuuguuuuggcaccaauguuuauuucagucucuucuuccuuuuguguuuucuuucucucauccuuccagguccgcauggcucuaaaaaaggccgaaaaggaguuugaacugagaagcagcuggucugucccugacgcacuacagaaauggcuucagcuaacacacgaaguugaaguacaguacuacaauauuaagaggcaaaaugcugagaugcagcuagccaucgcuaaggacgagguagucucuuauuucaugaucaauuacuuggaauucaaagaccucaguaaaagcccuucuugaagauucuguuuuuaaaauuagaguuugucaucuaaguugacucuugcaauuauuggauuuaaaguaaaauuacuuucucuagagaagugcguauauagcuuucaaaauuaccguagaguccuugagcaguugugacuuuugccacuauuguaaacguuuuauacggagcuucucuccuccaggucgcugccuccuaucuccugcagguuaguaguuacuagaaauucauguuugcuguucauuaaauugugugacauaagagucuuaaucugaauucuggaaaaaugcauagucgacucacuaacaccucaucgcaguaggauuuguaaugucuuucuguugguuuuaauagaagacucuggucuugggcggcuacagaaaucugagaaacaguucucuggagcaaagcuuuaagugucucugacuuaggacagcaugcuuucucucucaucuguuuuccgauuuugaaaacaugucuguaucuuggcugauaauuuucuacugguuuuaugauuaauagagucaaaaccaggaucaacuucgcugguuauagaaguagucauuuuccugaaccuagcuuuauucuuuaccuuuugggucuaggcagaaaaaauuaaaaagaagagaagcacagucuuugggacccugcacguugcacacagcuccucccuggacgaaguagaccacaagauucuggaagccaagugagaaugcugugcugucugucugucugucuaugcucagcugugugcauguacuauguagauauguguauuuaaucagugaagcauguguaaugacauaauugauacugauucggagauuggauaauuucuuccucucaucagucagguucugcggucucguccuguuguuuuaauuuuacugucauauugaaggcuucaguccgauaaguaauucacccguugacuuuucaggaaagcccucucugagcugaccacgugcuugcgagaacggcuuuuucgcuggcagcagauugagaagaucuguggcuuucagauagcucacaacucugggcuccccagucucaccuccucucuguacucugaccacagcuggguggugaugccuagagucuccauuccacccuacccuauugcuggaggaguugaugaccucgaugaagacacacccccaaucgugccacaguuuccaggugaguguucaguaaagaguucaagcgcugcuuugguuuuuuuuguuuuuuuuuuguuuuuaacuuauuuuuuauuagguauuuucuucauuuacauuucuuuuuuuuuaauuuauuuuuuuauuacauauuuuccucaauuacauuuccaaugcuaucucaaaagucccccauacccuccucccccacuuuccuacccacucauucccauuguuuuuggcccuggcguuccccuguacuggggcauauaaaguuugcaaguccaaugggccucucuuuccagugauggccgacuaggccaucuuuugauacauaugcagcuagagucaagagcuccgggguacugguuaguucauaauguuguuccaccuauaggguugcagaucccuuuagguuugguuuuuaaaguagguacgugacacgaccuuuuaggagugauggacuuugaaacuuaaggggaaaaauacauucuucuuugcuacuuuuuaacauauuuuucucuuuuccccauacauucucacauauauucuuuguauguguguuauauauucugucuuagaaaucuaccugaucaagaaguauggauacuuaauuuauauaacuuaucacauuuauauuucaacagucgucauauuaacucaugguagggcuuugcuuuuaagcauuacuuaccauuaaguuaaacugagagagucacaucagaaaggggaguacagcuuuaugacugcugaugguuauaucagugacaugcugaacucugagggaaaacugcaggagaaggaaguguugggagcuggguuuggaugcuggcucugcuguagucagugcuugacucuucugucagcuuaugguuugucccauucccaaggcuuuucuuucuuucuuuccuuuuuuuuuuuuuuuuuuugguaauauuuuuguuuugcuuuucagugcauucuuuuauuaauaguguugcccuguucugcuuaacucauggagaacuaagucuuucugucuucagcaaaauucaacugugcuuguuuaugaaaacuuagaugugaucuguauauguguauguaucaaacauauaugcaugcacguaagaugugcuaguuguuuuaagaugagccuugcuguguagcucaggcuagccuccugccuuagccuucugaguauuaggacuguacuuguacgccagcguaauguuuuucuagaaugugaguccuucggaagggagcuuuuguauuaauauuuguuauuaauauuuguguguuaauauugcguaguguugcgugcucugcuuuuguguguguuaauauugcguaguguugcgugcucugcuuuuguguuuuacuuuguagagaacaaucuugguaagauaaaauuugaaugcuugaacuccugacuuucugcaguuacagauguuuucaguuuacagguuuuuauauuagaaauuauucuuuacccuuauuaccgcuugccuggucuauuuuuccaauacuuaggacuucuuuuuuuuaucaugucaauagaaugaagcucugaagaguggagaacuaacucuguuagcuuaguucuugguugacugacaucucaaacuauuagauuuugaugacagucaagccaucuuaucugagaauuuccaguuuggccuuuucuguucaauguugcagcuuuccugagacuguuagaacaguucugauuauacaagagaguugugaucaaauccagcucuuaaucugacagauaacucccggucagugggaccgcuuuugucuuuucccuggcuuugagucuguuacuggcauaguggggugaggaggcaguaacucucccagggagagcauuggcuuguaaguuuggggaacacuggaagcaggagaccucauuugucuccuugucuggacuaugagcuggugaugguugaguugcgucuguauucaagcuggcuugcaauuugaauuugucuauuugcuuauuggcuuauauaugugcucuuauauaacacugaaaucauaagugcauauuuauuugaaaacuaagccuuuuaaaaauaguuuuucuuuaaaauauguaauuguugagaaucauaauugugcuugaggaagaucaauuucuuuaguuaaaucuuuuucuugccuuuuuagaagcacuuuugggaguuuggaaauggcaaaacuuuauuuuuauuuacuuuuuuuugauccauuaaaagaagauacacuaaaugugaauaauuggcauauguuuuaaauaacugugguaauauacauagacauuuauacuuguaagugugaaaaaguacaagagcugguuugaaauguuauaggaaguuuuagaaauuaaucugaucgcucauagaauuggagagcugugccuccaccuaguggccacguagggugcuccauuuugcuuuguaaguccugaacuuuauaaaacaaaggcuguuagccugaaguguacuaugguaggaugaaggugcuucauuuaaggaucucuuuauuggcuauguguuccuuaugcuugaaacaaugcccaguaagcacacuuauugaagguaaaucgcaaaggaagagagucuaauacacauaauaagacugucuguaguuuuacaugaagaaaccccagaaacuguuaguugaugaauagaggauggaauuacuccuccuuccccagguuuuaaguaucugcuaaauccuuucagaguagaauguaguaguaauguauuccaaacuucucauaaagcccuuugaacauucuuaaggucacugaagccugugcccauccacuacaaaaguaaacagguugucuuacuuguuuuucugaaaugaaccauaucaucucucuuucccucuucuaaaguugugcuuuucuaaagcccauuagaacaugcuuccucuacauauguaauaucuaauauauaccauugcugcauacuuacaccaccuacauaaguaucaucaaauuauagauaucauuuuucaacuucuuugcucaaaaugugcuucagagcuuuucugugcuuauccaaguuagauuuacugugauuguuuaacaugagacaaccgaagcuuguuuauauacuuaguaacaugggcucucuccuuucccacugagauuccuuguauauuuuucuuuuaaaaacaauaguagaaacacaaauuguuauguuauacauuaugcacagcucuaagaauuucucuggacccuuugaaugauuuuugaucauuaggcaaggaucucauggccaaauugccuucaaagggguuuuguuuguuugcauacucaguguuuaugaguccugcuucugucuccucacucacacuuggcaugauuaguucuguagccuggaugaauacgaaacaauacugcacuguuccuaaacucacuucaucaauaguuuggggauauguaaugcaaaugugcagccugcuucccucaucuguuuuauccugaggcucuuacaagguuuguugucccacucugcuucccucugucuucccuauccccuucuaucacacucucaccacuuaggggcuuaacauaaugugauuuagaaacucuucauuugguguuagucuugucugcuguguucugauaugugggcugucacucauagccaucauuuuguuacauuugcauucauuauuuagaaauaauuaccugcuuaucauucuguuucacuuucuuuccuuuuuuguucuuuuuugaaaauauagcauugauuaguauuuuguuaagcaaauuagaagaaaauauccuuauugacacuuuuacugaaaaguaacaguuuaacuagauaacgguguagauuaauuucauucuguauacucuccaaaguguuuucaaguuccuggugagaaauuuauccucagucaaauuagugugguuucucuuuagguaaucucuaauuucugauuaguaggagaauuauuucauuucuugcuuugugguuucuucauaauguaauuggcaagacaaaaggucagagcagacaggaaaggucaaaacucuugauugauugagugucagcuggauccuagaaauaaacucauucacugugaugaugauuggauggguuggcuagagcugaguccuggggaagagagcauuggugugcagccugaggccugcugcugucugagcccauuuaaugaaggcgugcuccuuuccuggugcuguggcacaggaaggaugccgcaugcaugacgagcuagcuugagaagguuguucuugggcugcuuuaguguaggaaaagaaacagaggaccauucuuuuguuccaccugcaugggucuuagauaggcaguagacacagggagaccuaagacacaggcuuccugaggaccuguguucaggaagcaagcuuugguuucagcugagagacuguguagucuucauuuaaaccuucuuaaaggucagauagguugugauacgucaagacuauccauugauacuuuauacaguguuuuuccuccugauccaguaugaguguucauaaacauuuaucauuucuucuaagugugugauagagacuuuaaaucuaaggguuauuuugaauagcaguuuaaguucuuuuuaauaguguuagauuuuuuuuauagcaaaacuacauugguguucauuuauuuuaguuuuacuucuguuaccauuuuaauacauuuguaauaauuuuuccauugguuguagagaagggcauuuguugauguaguugcuugaauaaacauuaaaccgauauuuuacaucaguucucguguauacguuugggagaagacaguuaagggacauugguggcuaugagcauuuucauugguuuguauuuuucagggaccguggcuaaaccugcaggaucuuuagccagaagcaguaguuuaugccgcucucgucgcagcaucgugccauccuccccacagucucagcgagcucagcuuccugcucaugcuccucuggcagcccacccucggcacccucaccauccgcagcauccccagcacucguugccuuccccagauccagacauccugucugugucaaguugcccugcucuguaucggaacgaagaggaggaggaggcuaucuacuucacugcugagaaacaaugguauuggcguuuaucgucauaagugcggagugugggucugaguggggcugaggggggacauggagcguagaguggcaggagugccacaguguauuuugugcaugccacagacucagugucuucacaugacaccuguuuguggaccccaguucuguauaucugacgugcaucuggccugaguggguuuucugcucagaguauuagaggcuaaaaucaaggugcuggcccagcugauucuuaugugagaucuggaguccccuuugugguagaauucaguucuuugugcuuauaucacugaggucuuauuucuguaccacucuaagcauaaggucgguuuguuuucaguuucuaaaggcaguuucguuugcccagggcuuaagaaaauguugagaagcuaauggagggaaugauaaaaucagaugaacuucaugacuaauuccuuugccaccaugagucuagcagcaugcaguuccuucugugaggugucagugcaccgugcggccacggcugucgggagcgcacaucucagugcugcugguaacagacggacucuguugcuuucugauuuugccacauguuaguaguguggacggcagucugcguggcuccugccacauggcucuugugacauuaacaucagaucacuuuucccauaaucaucucacugccuagugagaguuauuuuuuaauuagcagacagucuuuggggccuguucucaaggaaacaauugacguuugcaucucauugcaaguauggguuuaaugcaccuucccacagggagcuaauuaugauuagcauguuauuuaugugucuuuguaguaugaccacagccagcagcaggauggcuuuaccucuaaguuguuuuccugugguuucuggaagaugguaggggacaccagagcugcccuggcccacagaaucuuuccaucauggaaaguuaguuaaguucucauuucacauagcuugucaaaacuucgcagcagguuauaaauacgagaggaaucugacuucagggaacgccucggcugcucuccuaguaauugcuucuacuguuaagcggaccuuucuguccauacuccauucauagacacucacaagccgucaccagaguugucugucuuuuuucuuuaaacacauaucuucuuguaaaacuuacauguauuuagcuacagguugcuacagagaaaaucaugcaaauguuguguaugauuuccaaaggauacaggcuguagaaagaaugcacauuuaaaaagacagaagccaggggcuggggagacagcucagcaguggggagcacuggcagagcuuugauuuuagugcaguguucauaguuccucauccuuuuccucagaaaguuauauuucaucaagcucauaacuaaacauuaaaggaagugauuaaaauuccaucuuuucaaacauauacuggcaguuuugugguucagaaagaaaaguaguauugaaggagagcaaaagucaaaaaggcuuaagaaaauucaaaacucaaacauuuucaucucccugaaaguuaaagaaggcauagcuuaauuacuuugcuugauuguuauaaauuauccuaagucuggagaguggcucagacaauacagugccugcgugagcaugaacagaguuuggaucccuggaaccaguguaagagcuguguauaaccacgagucuuaaauccagcggcagaaggacuggacacacauagaucucuagcucauuagccagucagccuacaugaauucucgaguucuagauuuguuuagagacccugucucuaaaauagcauggauagcugucaaggaagauuggccugcucuugcacacacacagauagccacacaaauacauacacccacaguacacacacacacacacacacacacacacacacacacucgagguggggagaugacaggcuauauuaaaggaaagcuuuucaagucuuacauauauuuauacauauauaaucucuuuuuuauacuaaauaacgaacggaaguugauuugguagaauauuugcuguuacguuaauaacacguagcucuaaaguaucaccuuugucugugucauucagggaagugccagacacagcuucagaaugugacuccuuaaacucuuccagugggagaaaaccgucucccccuucaagccuugagauguaccaaacauugucuucccgaaaaaucucaagagacgagcuuucccuggaggacucuuccaggggggagucacccgugacagcagaugucucccggggcuccccugagugugugggucugacggagaccaagagcaugaucuucagcccugcaagcagaguguacaauggcauccuggagaaauccugcagcaugcaccagcucuccagcggcaucccggugccucauccccgacacacaucgugcuccucagccggcaaugauagcaagccaguucaggaagccucgaauguuuccagaguaagcagcaucccacaugaccucugucauaauggugagaaaagcaaaaagccauccaaaaucaaaagccuuuucaagaagaagucuaagugacucggcugacgugauggaauuccauucaaguggcaucuguaaacuguuaucucccacccuccacuccguuuuuauuuuacuuuuaggaauguaacuccacuggggcuuuccagacuugaugccauaguggaaauguccguaagggcagcugucuacugucugcuuauaucuaacugacuacgcaaucaauucaucaagucagauaccaccaccggagccaucggcaggaggcaguuuacaguucuuuccgccuauuuauuucugcauugauguuagugauguacacacagcauucugucgaaagccgccauggacuuacaagcuuuaauggacuguaagccagcaugggcuugcaaaauuuucuuguuuaccagaauaucuucuuaucuuuccacagagcuguuuccaucauggacuaaauaacuuaaaagaaguaaaacugauugcacuacuguuuuccagacuggaaaaaaaaaucucugcaaguaaaacuguauagaguuuauaaacugacuguggauagggaauuguuuucacuuuuagauaaaauggauuuuuaaguagaaacuaggguuucuaauugacuugauuucugaaaaugaaaacccacacuuuuauuaugggacgcuuccucaaaugcauuuauuauuauaaaguuucaaguccugcuguaaagaccauguuguuuuguuuuccccagggcuuucacugugauuuacugcacugcaggcuguaugauaaaauauaaauaauguaaaggcagaaggcucuugauuccuuauccaaguggaagaguaaaacuugaucgaaggacuuaaaacauucacaugcuuaaacugcggucuggggcguggggacccaggcacuuguuuacagacuuugaauaaaugcaaagaauuuaugguuugugaaaaauuuguacuguggaaaagauaauaaauuggagacauuauugugugggguugugcugauuuuuguugauaacacuccacugaaaacacuguuuucuggagagccauguaagcugucuugcugcugaauugcaguauaagaaauagcgauguuuuggaacuaaguugucaacaaauuucuuuguuuuauauuguuugucauauuuuuauguaguuugaaaucuuuaaauguucucauaucaagauuaacaaauauaaauugcuggugcauuuagauuguguugaaugaguuuguaaaguuuggaacugguuagcugcugggcaggucagagagaagccugagaguagccucgcauaggacagcagugcacauuucguuuccaccuucucagcucuuaagaccucaggcagaacuaucuggaaauacaggaagaugggugguugggugaacacggauauguuaacuagaauuuuuuuuuggugcuggcuaucugggaaugcugauggauaaguaagaaguccccuugagauuugcauaaaaggagugcuuuauuaaggauccaaaucucaaagccuccugugaguugugauuauuuacuuccauugcucugguuguuauaaucgucagggucucacugggcucgaugacuaccaaucagcuccuaagaucagaagcugacugucugacauaaagaugcuuugcaagauagcgugaaacauggaguucagagaccacucuagaguucuacuggaaggaaagcaauuuugcauaaagaauuagaaaguguccaggaaaccccccagacuaaaggggauguuuugucuuugucacagcuggaccagaggcguucucuuugggaauugcaacagaaauaagcgcuuuuuaguuugauggacagaaaggucaaagcuaccagaguguggagugcauacagaaggcuuggcugcgagauugcuuauagcuaggguugguagggcguccugggucagagccagguagaaacuagcggagguugggcugagagaguagggguggguuuaggaaaggaguguauuguguauaccugauuacacauuuauaaacagguccaauggagggauauguacuguuguauggugugauauuuauuugcauuaguaacaguauuuggaaaagaacagaaauccagaggaaagaaacuaguuuuggaaagccaucaucauuuugguaucacaucacaugcgaagcguugggcauuucuguaaguuuuacauauauugccuuccucuacucuuuaaaaacugaugcucuccuauuucucccuaacuauaagaugagaaagauuccugguagugaagugcaaaaaagaaaacagcagcauggcagucaaaucacgcuauuaaaauuacuuuuacuau

SEQ ID NO: 2466 - RNA, 799 nt, Mus musculus
uuggauucuuuuuuuuuuuuuuuugaguagcaaauaguuuauuaaguucaugguuucaacuguaguaauaaauucacuugaagaggagacaguaaucaauaaauacuuauuaaucaucagaagaucucuggccauuugggcugucacgcagaaauccgaagucacugaaaggccaaaucuuaaagaagauauguccucuuauuaguccauaugguauagguccauaauaccuggaaucgguagaauucuguaaguuaucaccuucuaaccaaacaugaccuguuggcacauaacuacggcucuuaaauacaucagaugggcuagugcugaggauuuugucuccuuccaaaccaauuacucuuuuacagauauuugauuuuggaucacuugggcuuuuugcaauuacaaugucaccucuuuggaugccauaaaaaugucggcuaagauuuucugcaaagacaauaucugaauuuugaauuguggguuccauugaugguccagaacacauuacaacaccaccaacguauucaaaagcacaaugagcuaugcagccauacugaaugguauagccagcaagucgaaaagccuuucccagaacaccacgaagcauacuuugauguugacucugcuaccaccagccauaagucuguucuacaauuuguucaacuuuaugguagguuuccaggaaaccccagaucugacggaggucucaaagcgugcgugggucauccauggcuuccgauuccugcggccccaaacaccaacagaaguuccucggccaggacucagaaggaccugu

SEQ ID NO: 2467 - RNA, 1698 nt, Mus musculus
aaguccuuccaauauggggucaauaguccuaauauaggguuagauagugagaaggguagaugcagaaagggugggcagaagggggcagggugcagauggcagaaguuccagggcucagugcuugugaguacccuuguagguacccuuguacuggaagcccacucuccucaucagcucaucugccucuguggggccacggcugccauauacauaggggaagggcuggggcuuuucucguucaaucuugugcagcaguggugugaagauacgccagccuucccugaguucaucaguacggacaaagugcaucuggcacccacagaagacauccaggaugaggcguucauaggcaccagggagcuucacauucuuguauuuguugccauaaguuagguccagcuccgacuccucaggguuaaagaacaugccaggcuucuuggucaucaucguuguguauacugccucauugggcugcauacggaugaccagcucauuacgcuugcacuucugguggaagaugucgccugguauaucucggaauugcagucucacuucagcuuugcguucauucagggcuuugccacagcgcaguaugaaggguaccccaucccaccguucauucuucacauagaggacagcugcagcaaagguggcaguuguggacccacgggguacuguggggucaucuaaguauccauuggcagcuucuccuucuccauugggguuccccacauacuggccaaggaucacauugucaguuuccaccucugagauacguuucaacacuuugaccuucucauuacggacaucaucugaaucugugguagcaggcuuuuccauggccaccagacacaacaucugcaggagguggcucugcauaacaucccugaugaucccaaauucaucaaaauagcccccacgacccucaguaccaaagggcucuuuaaaugugaggaucacacaagcaauguugucuccauuccagauagggccaaagauccuguuagcaaaccucagcaccaugagguucuggaccaucucuuuguccagguaguggucaaugcgguagaucuggucuucacggaaaagagaggagaugugguuagacaauugauuggagcucugcaggucucucccgaaggguuucuccacuaugaugcgguuaaagccugucugacucaugcaggucucuugaauguucuuggugacugcuucauagacuguggggggcaaggccagguagaauagaugguuggccugcauccccuggugcagggcauuaauguagcuguugaggugcuuauaggaggcuggaucaucauacuggccaacuacauaggaguuacgcgugaagaacuccuccagcuugggucuuucuucuggaguggccuuaaagaagggcucacucugcuuuuggaugucauccacugugaguugugagcgggcauagcccacaaugaagguuucuuuggguagaagaccaucccggaacagccaccagauggugggauagaucuucuucuuggccaggucacccgaugcacccaugaugauaaauauguguguaucagcuugguggaaggcaucauuuugguacaacucuucccucaggaucccacacacuuggguccggcuuagggucaccugcucugccaugauguuuuccuaguuuaguugccacugccaaacacguucaca

SEQ ID NO: 2468 - RNA, 788 nt, Mus musculus
acugugaggggaaggggacagagguggguaagagggaaacaugaccugguauuggguagggaaaaaggauugaagcccugagggccagcagaagaauagaaacaggcaaccucaggaguuaggagguuggggggacccuccagaaugcaccagagaccugggagaugaaagacugucaggauucaaauggagagacuccagauuaaaugccuuacaauggggagagggaacuuguagaguccaccuccagcagaacgucagggaaucaagugagggaugggguugccaucccacagucaaaauucugacccauaauuguuccuguaugaaugaacugcagggauggaaauggagaggaggcugaggaaaaggagauucaaugacagacccaaagugggauccagcucaaggggaggucccaaagccugacaauauuacugaggcuauggagcgaucacaaaaagggacuuaucaugacugcccucagaaaaacccaacaaggaaaugaaagagucagaugcagauauuugcacccaaucaauggagucaaacaccccugugguugaauuagggaaaagcuggaagaagcugaggaggagggcaacccuguaggagaccagcagucucaauuaaucuggaccuccaagaucucugaaacacuggaucaccaaccagacagcauacaccagcugacacgagggcccccaacacacauacaguagaggaaugccggguguguucugucagagaaggugcaccuaacccucaagagacuggaggccccaggg

SEQ ID NO: 2469 - RNA, 60010 nt, Mus musculus
caggggcggggcuuccgugcggugggcgggguccuggcggguccaggcugagcggguaggggcucgcgggggccgagcuccugcauucaauccacccggcagcccucgagcugcaccgucuaccccgacccgggacgccgcggccggggcgaggagggcagagggacgcggcgauggcucuguggggacucccgggguccgcugugcuugcugcuucaguguucgugggaggcgcugugaguucgccgcugguggccgccggugagugcuuugguccuggucgggacgccuggugaguugggucugcgcacggaagggagccaggggcucgacgagucggucgagcccacaaccccgccgcgcccugaguugcgcgcgcccugcugugcuaccggaucuggcucugaacaucugggugucccgggguggcccgggcagggugcggcgcgcagcgcggcuccaguccuuccccacccgccugccggggucccgccuucccuccccgccgcuucuaaaaaacggcgggaccccaacucggauucuucaggaugucgcuuuccugggaugccuucucccuagccguggaccccuuucuacuguccugguccucagaggccucaccaggcgaauaucuugacacccgggauaggguucugcuuuccagccuccuuccucgcuuuauuuucuucuuuccuuuucauuauguuaaagccuugaaagugccagucuuugcaggugguuauggauucuuuuaguaagucgggaauuucucacuccuucccauacaugcuggauaaauuaggccgggaaagaggaaagacaucuauaauguauacugcuuuuucuuuguaucaaauccugucaucacaaaaggaaccucuguggucgggguggaagccaccaagccgagacgcugagugcugucuucaacuacaagccaucagcgggaguuucuaacugaaaucuaagaggucuaccuuuuacuuaaggacgccuuugccuugugcuccuguuuuuauaaggcacacaccagggauucuuaauaauuguuucccccucuuaauugccaccucgcugcaguacuuaaaaaaaaaaaguuaagccuuccuggccguuugggguuaccacaggcugauucuuacgucagcaggcucugccaagcuugccuucagggguggcuccucuucaggcccaaauaauaagcagcuggaaggcuuccaacggugacugucuucucuauaaaauauacgugcugcucuucuuuuuggagaauguucuagucacucggagcuuuggagccugcuucucauuuguccuuuacuuuuucaugggcaucagaacgagcuagcaagggaacaggauagauagacgaugugucuccuggguauuuauuagcagauccgcauuuccuucagccaucuacccaggggaaagggaagcuggugacucguucuauuggaugggagauuuucccgugcauccugggcuucuuucccgagacuuguaacuacaacauaguuucaacguagauuggagacugcagguaguaagugguaucacuuguugcagaguuuggaacaauaacagaaaagaugaaccugggagcaagauuguuacaguuuaguaagugaggcauguaaccagccaucaucaggagaaauccauuccuagaguggguuuuuguuuugcuggguuucugaacaacauccgggugucaggccugcaaugugacugaagaaaguucuacggaguggugcuauuaguaaccuuuuaugagugaaaguuagugcuuaaaaagaaugaaguaccuaagguggagaggauagaacuuccaguuuguuggcuggcuuagggccuguaucaagagaugagccuggaacaucuggcagcugaucucuuuggacuccaaguccagaaguaggaagaaggagauggcaucugauagagacagccugccgugugcuuuagcugggugcuucauguguauuuuaaaacuuauuccucaugacccaagauguguuuauucucuguagaucaacugaggccugucauuacauaggcacuguaucaguaagcauugguuggguggggugggagguagggggaagggagaggggggugggggguggggggauaaauacagccuguuugguuuuaaauucaucaucuuucuacugucccccaugcuucccagagaaaauagaggauaggucagccucagcaaccugacuuaaauuguaagguaguuaguucuaagaugcccaaacaucacaucaggaguauguagucaucugagccauacaguggagaaccgacagagagcuucucagaggguggguggcagucucuaucacuuccuuuuuuuuuuuuuuuuucuuugagacagguuuucucuguguaucccuggcaguccuggaacucacucuguagaccagauuggccucgaacucagaaauccgccuggcucugucucccaagugcugggacuaaaggcaugcgccaccacugccagggcuucacuuccuuuacuguaagccaucuagacaguggcauuagaagcuacuuugcaaguaacagagcugcuuuuccagguccugccuuauuuauguccuugaguucucuggugacuuguccuccuuggucuccguuucuuaccucuccugucacugggcacagcccuugaguagagagaugggaaaacaguuccaggguuggagcugugagggaugcacagucccugggcucugugggcauccagccagccucagauuccucauuuagauguugaagauauguuugauuaaacucuggguucucuuuuggcuggacagcugcuuagcugaauguccacauaguucauagacauugggugcaguguuuuggaaaaaaaaaaauacuguuuagagcuuuggacuucaugcuuacuccaaauucaaagaggaaaugaaaaauaucaccaguggcugacauuucuuuaucuccucugugcauuuuuuucuaauccuucagaaaagaaugagggaauuuugggaagacuuggauuugaaugugagaagccacaguccaggugauucaaacagcgaacuuugauuuuuuuuuuuuuuuuuuacuuuaaaaaaaauaauguggcuuugauguuuuagucuuauugcauacuggaccauuuuaauuauagcauuuagaaggaugcacauuaaaaauacuguuauugaaaacaauuuggucuaaguuugaaggccuaaaaucaaaaguuggcaucaugaugacacaguggcgucugggcuuuggguguucaguggcaggacacucacccugccugccugcuuccucucauguucaggagugccuggcuucaguccccagcacuaccaaaagccaauaaaccaaccaaccaaccaaccaaccaacaaacaaaugaauaaaaagaaaaaguaaagaaaaagaaacaaaagcaaauugucauuaguuaaaacagucucuuaagaguuguccaguaauccuugugguuguguuuaggaacugguaaagauuuuaaaauucucuuauuuacauguaugcaauuuugucuuuaucccaggguuaugcuauguaucauuuauaugccacauuuaauuaggacuaauacuauacaaucugaauguacguaaaaugucguccacagcaaggaguuuggggcugcuaagccaagagaguaaaaagaaggcuaagcaugguggcgcauccuuucaaucccaguacugaggaggcagaaucaggcuuaucucugugaauuugaagccagcuuggucuauaggguuuguccucagaucacuuccucuguguaaucccacccgacugauccuguguuaaaggcugggaauguggacccucugagaagcgggaaguuacagggaguuaccugggccucugucccaucuguuacacuguuacacucuguccuaucuguucaguucuaaagugcauugcaaacuauucuuuuuccucuuuggaaagaaaauucuuuucauucuaaaauguuucugaagagucacagcgguaugacucugcagcggucuagguaguuuugcaaagucccuccugccguuugcgugggaggagggaguuagccuuugaucucuuaccuggaggcacuugccucaguuugcauuccauucuggucucucuuccugcacccugaccucggguaguauccuaaugcaguguaguuuuauuggcccgggucccuuuuaccuuagucauaggcuggcucucuccugaagcacugggaaggugucuuagaguuccaucccguagcuucacuguguuuuugccacaccaugccuccuuuccggaaggcuguagcugucauugauuguuuuaaaaugagauuuaaauuucuccauuguuucccugaacaccucuguccacaaggcuuggugucauaguugacugccuguguagaagauggguucuuggaaaagcagcuuagaggucggugcaguucacauugugaggccguugauaacuuccgguuuguacucuuaccacagugguuugaagcacucacugcccgcucuuaguauuuuuccccugaaaauaaaaagguagcugcuaauguuuuaggcaaaagcuauguguugguaccuuguuuuaauguuaucaucuuugguucuuguaagaugggcuauuuauuuuuuuuacuauccuuuaucagguugguuuucuuugcuucucucuaguauccagagcauuuguacagugcuguaauccuuucuggacauuucacaaaugcaaaaugcucugaaaaaaaugaggauuuuuuuuauuuuaaauacauacauacacauacucucucacacauacacacacacacuauauauauauguauauauacacauauauauacacacauauauacacacacauacuuauacauauacacauacacacacacacacacacacauauauauauauaugcauauauauauauauauauauauauauauauauacauauacauauauauagagagagagggagagagagagagcgagcgcugguaacacagggccugccccagugggagguguucaaguucgaguuugcucucgcauagguugaauaccccugugccuugcugcggccacccagcacguuugacuucugagugugacagugcaaguugaacucggccaccuuucugcaaucgggcaucugccucugggguuucaguuaaggacucaugaccgugcguuucccuucccugacucaucuguucauguuuucucacaucccuugggagccaauaaguagcccauacaaauaucuaaaaugucccauggagaaauagcagggauccugcagagaggacuucuucucuccagagaaggcgcaguagcuaagagugcuuugccugaguuugauucccagcacccacacagcaacuuauaacccuguaacuaacuccagaugcgggcaugugaugcccuuuugugucuuccgugggcccaggcaugagcauaguacauauacauacauacaaccaggcaaagcacucacacgcuuaaacauaaaaaugcaucuuaaaaucuuacagagauuugaaaagugacucagggccaguagagacuuuaaaaaaaauaaccucucugcugcagagcacuucaggaggaggaaggccaccuggauauucuaagcaggaucuaauaaagacacuuggaugcagcugggcuucugcaucuguuugguagcucuaugggugagugcucuauguaauggaacccuaauggguaaguagagagguucggcugggucucuucucugccagcuagugacacggcucucuuugugagagaaagaaauucaaucugcugaggaacauuucggagauacccccaggcaaccugaguucuuggggccagucaucuuaucuccaggcucccuggccagccuccuugaacucaggagagccaguuuccauugcugccugcaauaccccaaggccuccagcuuacugucuuuccuccuuuggcacugucugggaucccaaaaaagagacaauuccccagccuggguucuguuuccugugcuaguugccaguccuccccaggagcccucuccaggcucucccccgccccuuacuugguuugcaaacuccuggcuauaacagcauuucaggcacuaauaaaagugccuguuguccagagaaaacaagucuuuaaaccacuccucuuaccuguauuauggagaaaauagagccaagcugcuucaugugguuauugucacgaugaugugagccaacgcaugggcacgcuuggcacuguguuugcggcauagguauguuaaaaaggcuugcuucauuauuuguccauagccaggcauuaacaguucacauaaaaaaaaaaaaaaagaugaaacaaaguuccuaaccauuccaaaacuggucuuaacccuagcacugggaagcugagaugggggggauugcuguuaguucaaggcccagccuggguugcagagugaguuuuaaguuaacccucuacauuaugaaaauuuuuaaagcagaacaagagggagcuucaaggaaguaggauagagagggaaccaggaccaaugggcuugacuguguggcuucucgugggagguggagacaaagccacugguugucacaguauuacaaggaaagagaaggaagcgaggaaaccuuuaccuuuauaaagauagacagcccuguuucguuuuggaagaacuuugggggacucaucgaugcagccagccagccuguaguuguagugcguuuccuuacgacuugauguagugaucacgccauaugcuuugguuagugaaggucuaauuggucacugggcuccucuuuccucgcagggacuuauuugaaugaaacgaaguuucaugacaggaaagcagagccuguguauuacaggcuggcggggcggggguggugguucuagugacguccucagagucuauuuaguggagaggaaauggguacgacuaagauuuaagacuguuucuuuguacccugugggaccuccuguccuguuggcauguccuugcauugacauggacgcacagcugucccugcuccuagcagguuuccucuguccauaccuguuccugguguucacgcuucaagaaggucuguuuccccagcucucagaugugggauguaccugaccucagaagaaugauaacuaucauagcagugacuuuuguucuuagugacaugccuuuagagauggucaucuuguuacuagucccuuuguuaugcauauggggaaacugaacccaaaaggacacgguggccugcaggagucaugggcagcccauccuuagcagccauuagggugacaucauguguggaucuuguucacugcccagguuugacuuucagaccuggaauagaauagguuuuuaaaaugugaauggagaguccagaauaucucccucucccaccuguguguauaugugaguguguguguguguguguguguguguguguguguguguguguguacaggccagaggaaggcauuggauccccuggaccuggaguuacaugcaguaugagcuggcuaauguggguccuggggacugaccucggguucaguuaggcaucuuuccggccccccuuauucuuucuauuaggguagaaaguuacucuuuggaacauucagucucagaucuuagcaccgagucuccucugccuuccucuggauugaugauagacugcugucuaucagccucugugggauuuguuuacaucugaagguggcaaaacuagacaugaagagaggaugccggcaaccaggagaucggagaaaaccgagacagugagaggacguaguagugaacguuuucagcguaaagauuuuaaaacuccaaaucuauucaugagucucuuuccaaaggcacagucacuuguauucugccagccaaugccagucaguuguguguguaucauauuuucaaugucccaacacaugaaguauuuaaaaccaucuauuucgugagcaucuucgucuccuuucuauugcuauaacggaaugcuugccacuggguacuagacgugcauuugccucuugguuuggcagacugagaagucaugggugugcugacaucugcggggcauccggagaggaccuccauugcaucacaacgggguagaggacauccuguggcaagccuaagugugcaugccauggcucucucuuucucugcuucauuaccucaucgaaucccaauuaccucucaaaggccccaucucuauacgccacaaacauggaucucggaauuaagucucaacacagucaaauauagcaauagacuccucugauugauggagagaggaugccucuauacgccacaaacauggaucucggaauuaagucucaacacagucaaauauagcaauagacuccucugauugauggagagaggaugccagccacaaggagaccagggggaaaguaaguauuaacauagcacccgacaacacacaaggcacagaagaugaagugaugugaacaggguauguggagccucauggaguugucuuagcaccucaguaagaaaagagaggcacagggccagaguaucuagccugcggcuggggugggggguguguggagaauugagaauccaggccagguggggcaaauaaaaacauucuggagcaaauaaggcuuaaauuuccacugcacagcuauaggcauuagcuggguaaaaggaaccagccguugcggaagagugauugaugugugugacgguuuggaugugguguguccucaaagggcuuacaugcucacaucuaaggccuuaggaggcuggaaacuucauggaugccggguuuaguacugauuagcuuuagauaaagccauuaggguggcagccucaugguuaaauccuuauagcaucaucgauuaagagaccagaggagagacauacagagucugugucaaugucuuugugucucugugugugugucucacuuguguacaugguuccuauuucuaugugaaucccgaacaacacuuagacucugccagcaaaaagaccaccauuagaugggguaucuggagauucuagaaguaugaacuaaguaaacuucuucuuuaaagugaccuggccuacuugugguauuggcagcugaaaugggcuaauacagcagcaggcuaagcuguggccagugcuucucaaacuugggugucuaucuggaggcuggucacggcccagguggcuggcuccucccuggaccagcuaagacaacauacagugggcuugagaugagaauggagaguuugcaucucugucaacauuuccuguugauguugacuaagaaucggaagagagccggggaguguuggggagggaagaugugggcuuauccgucuuccuuuguguucccacucauugucuuaggcuagccuauccugccuuguaucugugcuuccagcugagaucaaggcuaauacuugaggaaaccuuuccugugacuucuccuagacugccauucugggaugaccugcgugcaggucacgcgcccuguaucucucccacgguauuuggcccucaguuauaagcauuugcuuccccgguauucuuccuauuaacuagaacucuuuguggcagccgcgucgaugagauguguuaaguauuugaucgcuugagcagauuuaacuuuugcagucacugggaggagcaggucacugcggucugcucuguggcauggagggaacugagacuuacgagaagcgagcuuucuugcucaucacagaggaggggaagccaaagcuggguggauguuccugauccccaaaggucccuuguguagugugaaaugauguguacacgcugguaccagucgaaggaaagauuuauauuuaauuugucaguuucccauucuugcuccaucuacuuaaagagaaaaccaagguaucuuagcaagugaaaguagguuuuugauguuagucaaaaauaguucauuaaccaaagacgucucugaauauugccuaccccaccccuucuuagagacugggucuuacuauguagcuuuugcuggccuugaacuaauucugaagucuagucaggcuuuaacuuuacauucccaaggcaggaaggaugggucacauguuaagagcacuugcugcuucugcagaggacccugguccagauccuagcacucacacuguaguucacaguugucucgaucucccguuccagggaaucuccuggcuuccacaggauuaggcaugcaaaugauguacauguauacaggcaagugaaacucauacacauacaaaaaaccuguaaauuuguaguucuccugccccagccuuguaagugcuggagucacaggcgugccaucugugguaaguaaaugaacaugcaauuggauucagaaauguuuucuuuaucuuggcauagugguguucacuuuuaaucuccauacuucuaggcuagccuguuuuacauagugaccucuaggucagccagggauacacacagacacacacacacagacacacagacacacagacacacacagacacacagacauacacacagacgaauaagaaaauuuaauuaaaaaaaaagucaggaccuggaagcacaacuucaauuucauuuuauuuauuuccucucuucuauagucuuuuuuuuuuuuuuuuuuugguuuuucgagacaggguuucucuguguagcccuggcuguccuggaacucacucuguagaccaggcuggccucaaacucagaaauccgccugggauaacuuuucuuagccagcugguuaaauuagucugguggaaacuuuacagagaaccuguauaugucacaugccacacggagccggagaggaagagcuccuuucagcucugaagacuugcccagacaccuccucugugcaugcauacaaccguacuguggcuuuccgagauuccucugagggguggacauuugaagcgcucccuggacauucugucucauaguguaaguggggggaggggagggagggcucauuuuccacugccauggcccuccagagcuggaagucuagccacagucaugugaauugucggcuuuacagaaagcagcagcugugauuucuuggcguuggccagguggcagguggcuagccacagacguuacauaguaucauuuuccuuugcaugucuguggucuaugcuaacauggcuugaaccuuugcauugcuucaauacggaucagccaccaggacaaaagccaaggccuuggacagugccuaaaguagcgagauugagcagggcaguugggcuucacaggagaaauauuucacggcuguauuugccaagaaggugccuaauaguugcuucagcuaaaacuugcagaucauuuugcacacccagcacgcaguuaauuaaaacgugggcuggucuuauuugagauacugccggguagcuacuggguccauguaaugagugaacaccuaauuuaguuuuuguucuaugaaacuuaugauggagaaguguagauaagccaugaauggaaguccuuguggcgucauggaaaaaggguuuugguguaaucagaaccacugacuaaggguugugugggaucacaggagacuucucuuuugaagugaaggacaaaaagagcuccauagccugaaacugggcauugaagugauccacaagggaacuguucauaccaaucccauggaacagccuggacgauggcauuggagcuaggagcaaaccagccauugcagcucccguggggcagagcuucuaagcgcgggaagcuucacaggggagacugagguguggcuccucagcucuugaaggacuuuauugugccgggucaggaagcucaggcugggcaguggaggguagaggaccaagaggagucccggggaauugcccugugagggaagagugucuggugucauuaggacuggaguuuauagcagguucugaacagucagugaagagcugggauguuuuuccugcaucuuuguaggguagagguaggaaggagagcucaagggagccccagugcaaaaugaugcuuguuuuagcuuuuuauaugucuccgagucaucugugggaucaaggaacuaaugccaucccuuguaagggagucuauauaauauagucaauuugugugacacgcaaauaggaaggcugcguuuaaggaauucggggaaugagaaugaugaagucaguacugugggcggaguccuggccacaggagagucaaggaacaacuaugguacccgcuugucuccuguucgucacuccuccaaaauccuccaaaccagcucgcguacaggauuuauuuuuggaagcccauuugcauuucucagcccugcuguucuucaagaacgaaucauuugcgucuccuucuggguuggagugcugucaccuuuagggcaguguccauaaauaaaacaaaagucagcaugggggugaauuuaagccccaauuggccaacggcuccaucucugucacuuccugcagaccuguuucccugcuccuugaugccuuguacugucacugcacagaucugggagaagggcaaugugagaacgaucuagcauacguuugaugucuauguacuaugucaacaguccuuacacagacacuccauguuugggauggaaugggagaggacuuaaggagggagggacagaaugacaggaggauugguuuuauccacgcugagacuggguuguaccuagagauuuuauugaguaggguucuugccauugaucagugugguuggucuguaucuucuaucucuggugcagaugucuuuuaaaacccucugaauuuacuaaccuauagggaguguagauggaugagucuuucuugugcaugaagagccccuucgaccacacuugagauuucauuagugacuguaaguaaggcauggagcuggugaugggagguaccagccaugccauggaaaggcuggaacuucuguccuuuccuugauuucugggguucaguggacgucagccaacaauugagccagucaggcuucuuaaaagcucuguaccagggcauggaaggggcuucuaggggugagcucagggcugggcuggcaguugggcuuggaggggguguggaagcuguccuucuuugccuucuuuuccauuuggcuguccugguuuauuacauccuucacaauaaacuuguggucauagaagacagauuuuugaguucuguaagacacuucaguaaauuauuggaaugaaggggacauuguagaaacacugacauuuguagccaagagucaucuucgagacuggucuuugaagagaauaacucuuuuuuuuuuugagauaggguuucucuguguagcccugaguaaccuggaacucacucuguagaccagaacucagaaaucugccugccucugccucccaagugcuggaauuaaaggcuugugccaccacuguccgaagggaauaacucuuaacucgugggucuacacugacuccaggcugauagggucagaguuuaauugacccuaggacauccaguggguguuaagaaagugaaauaguaggaucucucugggaagccauuggaaccaacauuaaaacacgccuggaaucaccucuggaaucacaccuguauucuacuuagagaaaagcacaaagacauuuauaaaauacauaccaggaaaguggaaggcgucaggccauugccccacuguucagauucuugcaccugcuuuauuguacacaggaguggaagguacaccauuugguuucuuugaccuuugauuccugugcuguggcucaaaggucucauagcauggucucugccuauagaaauauuuggggugucacuguggacgguagcuuugggcaguccccauagugagggauucuaguccuauauucugguuuaccucugcagaaugaauacgaccguuagguuggaccaugugaaaaaaugcaauauucaacuguuuccaccuaugguagcaacagguuuauguuugaacugaucguaauaaagacuccuuacugauuuccucauuuguugugaaaagacuccagcucuucugauuaucacuaacaucuuuuucuuuagacaauguaaggaaauagagaagaaaacgaaaaacgaugucaauguucuacuaguuggaagggaauuuaguuaaugcuaaauugagcaagugcugucuaacaccuuaccuuuuuuuucuaugaauaaauuacuguuuuuauuuuuuauauuuaaaauuuuuauuuauuauacguguguguuuguauccaugugcauguacuuagguguucacaugucacaggcauggaggucagaggacagcuuuucuuccccucuguuaaaguuucuuugugcauuuuuauuaaccacagcaggaagaacuauggagaaucgcacucugugggauuuuacugaaugcccaaauccuucacucuagcgcagacccucagggcacggugccuacugccucaccucugccacuugcuagaugugcaaccuggggcaaauuaucuguaaaacgggguuuaaaauaaucucuacuucccuggauuauugucaaggcugacaauaaauguguuaauagcuacauuauagauaaucuaugguagaguaaugguacagacacuuaucaauaugugacaauuauaguauuuuuuucuuuguauaaguuguugcauauuuauuuauuuuuuaaaauguuggcuuuguagcucaggcugcccuggaacucauaauccuccuaucuccguuucuguguucugauauuauaguccugcgcuagauuuuccgagaucccaucugggcaucaugguaaugacuuucauacuauuucccuucaucugggguuuuccugaugggccuauuucaucuuuccagaauucuuuuucccauuugaucuuugguuuuccucuuggccccccuuuccuuggcuuucuccagaggcugugagaggauuucacaucaggugacuucagugggcucagaaccuugagguuuccuggcuguuccccuucaguucccgguucccagguucucagaaaccagccagacccacgugccuggcuugugggaacacugccugacugaaccugugacuaauccgaaugcccucuguuuagaacuuuuguaguuuucgguugaaucauuuuccccuuccuguuccuggaaggaagagaagccuccuggacugugugugaauaugaugugagaaaugugggugucugccugccguggcucugccgugcgugcuguggcucugugcaucgucacucugugcucuguggcucugugcuccgugucucugugcucuguagcucugggcuucauggcucugccuuguguccuguggcucugugcaucguugcucugugcuccguggcucugugcuccguggcucugccuuguaucccguggcucugugcuccgugguucugugcucugcggcucugccuuguguccuguggcucugugcuuuguggcuuugccuuguguccuguggcucugugcucuguggcucugcuuuguguccuguggcucugugcucaguggcucagccuuguguccugcggcgcugugcucaguggcucugugcucuguggcuuugccuuguguccuguggcucugugcuuuguggcuuugccuuguguccuguggcucugugcuuuguggcuuugccuuguguccuguggcucugugcaccguugcucugugcuccauggcucugacuggccaccaugguucauggcucugcacugcuaauuaugaaucuacuuugccugcagaaugcauggcgaugcccauggcugcuguguccucacauggagggagggcucauguucucuguaccucacauaguguccuuucuaauuccugggguucauugucuuucugugugucuggcuuuauauguugguaacugcugcuaauggucacauuacuaacacugagcacacacugggauauaaagucaaauuaaucucauagaauacucaggaacauuucaacccuuguccacauuguaggguugagaaaacugagguccaaauauuuuuaucaacuugcccugggcucucauagccuggagccagucugaacauugugaaaacaagagagauuugguuuuugcuuccccucuugccuugcuggggagcaccuuuggcucagaaucucugucccuccuguggcgauccuggguucaagucucuacccagccauccauccccaagaggaaggccacaguguugcuucuuuauuggcucccuuucuaagacaauuuaauacuagcaucuauuggcugguauccguuggcaggauaagugauaagacauguacuuaauaucugcaagucccugggcccuuugccuacuacaacagagcaaaacaaacaaacaccaaccagacaaacaaacagccaaaaaaaaaaaagcccccgcaaaauaauaacucugggcuaggaagauuguuccgucugcaaagugcucacuaaauaagcucaggaaccugaguguggaucucgagugcccaccuacauaaacagccaggggacacauaacuguggucccauugugagugugugugugugugugugugugugaagguggagacagaucccccaggguaggcuggcuggccauuucuagccaagucaaugagcuucaguucagagagauccugucccagauaagguggagggcaauuggagaagccaccugauauugaucucuagcuuccacuggcacagcguacacggucaauaauaacaucuaucucagaguuacgggcauuaaagaagauuaaugcaaguaaaaauaccgaaguugucgcugaaguugaguuacucucagcaggugauggcagagaaucugagcaccccagaagcuuagagcauggugcucccagccccuagaacuucccugggguuagaaucucccucuucccacugaugggugcuggaccggcucccuugugaagcuuuuacccugcucccgacccuuacuucccugugugucuagauucugcuguauucugugcuugcuggaaagauuuggcugaccucccagcccuggcggugaugacguuguacacagaagccagagaugcagcuccccaaggcuugcuugguccucuauaucaguuccccuccaucagucucaggggagucacugauuuuguucaggaauacccagugcuucccuccugaggaaacaggccaucugggccugucuucugcuuccugucugagcauuuucuucuggcucgcacuacuuggccuuccuuccguagcuuaaguaauuuccagcauagucucgccuggugucuugagaggaauaggaccggaccuguuaggaucgcagccuucugaacagugggcagucaccaguggugagguuacauaagcuuggauuuagugucccuggaggaaccuggcgaguugcggagagcuggagucccgugaccauucagcugaaggccaaaagcuggugucggaauguacugcuauuuguagcccuccuuugcauccuguagacuggaacucuccguugguguagaugagcgcagagcauccuuuguacugcugucuuucaggguuuuugguuauucagcuuuggacacaaccugcucauuugugucuuuggggauggaugguauuuggcaaacggaaccuaauuacaccaggcccaaauaaguucuaaacaaaacuaccugucaaguuagagcggagguggguacuccuugggugacccuggagcccuucucaaggaauggcucugcugucacaggcuguauguugcugguauucaggguguccccauugugucccagaagcugugacuguucaggguguccucauggugucccagaaagcugugacucucuacauggcacucagaagcauugacuuaaguugagggauuccuuugauuucugugucucauuuguguuugggucucuauggggugggcugguguggcgaguggauggggaaggggauggaaugucccuuucugucauugccacagugaugcauggcagacugugauuuauuuacgagaugaggcuauaggucaucauuccagcugacuccuggccacuauggagacuuagauccaauuucaaauguggaggcguauucagcagcacuguguuaauugggugggaacauucauaucuuacagacuguguuucuagcuaaugugaaugauguuguugcucuucugccuuuucugcccuucccucuuuucuucccuccuaaaagaguuuuaaacaccaggccguuaccaucaaggguccaagucaugucuguagcaaccaucgcguaagaucccagugcaguaguuugugacuuaggugaacacauaaacggacgugggacucgugccaguagauuaagccagggccuccauuuccuugguccugguaaugguuguggagaaguguauuaggguugagcuucugaacgaccuuuuguuuuuccacaguuaauaucagagguuuuuaugaugcugaguuuuuuguuuuuguuuuuguuuuuuuuuaaaggaaugcugucaguacagaaccauuuccucauagcuaaugucucauuaauaugaucuucacauugaaggaagaugcacacaugcauggauaauacauaguggggucacuuggagggaggcaccugucagucacuggggagauacuggguggcaugugcugaccucagcuacaucuucgggucaguugguauagguuaguccaccuauuuuguuuuucuuuuuuuuaauguuuaauuuaauuuuauuuuuuuauguguauaguaguguccugcuugcaugcaugcauuuagacuauguguguccagugcucauggagggcagagagggcauuggaucuccugguacuggagcuacaguuguugucagcugccaugugguugugggcaacaaaacuuuggaaaaagcagcagguauucuuacagagccaccucucuggccccaaaccaccuauuuuuuuucuuuuuuuuuuuugaaagauaugugucagaaauuaacucgccacucuuccuaggcauguauguaauuuacgauuugaaguguucagauagguucauggaaaaauucucccuacacuuguuuucccaccucccagcccuguccuagaagacagagggggcuaccuaaccaaggcuaaagagucaguaugcccuccuguguacagcauugaaaacagauaaaggggaaugggcagauggguaggcauggggagggaaggagagcaggagaacaggaagaaagagaggugccccccccaccccccgccccugcccugaggccguuccaccauugauugaccuuuggcaugacuucacugaugugcccugccucuuggggugccucugagacucuuuaccuucucugucuuagaggcauggucgauugcuuccugcccugggugccagagcagaagugugguaagucgaccaugucccauuuucaggccuggugugaucugccucugccugacuccugaaugcuagccauuguuugaaguaggcuggaagauugccaaggaggccagaacuuuagccagugaccucuccagaugcccaggauccuggaguuaaucccuuccugaggaguagcuaggggcagggucaacagcuguugucuuuggucagccuuucugucuccuuaagggauuuguuuggucaaaggguucuccaguguuagagacagguagggacuuucuuagacucuaaaaauuucccuccaucuuaguuuaaauagaaaccagggaugguaaauauuuagauuacuuaaaaaaaaaacuuaaaauauuaacgucacugcaguuuggguccuuugaucacggagcuaccuggguuugcacugcuucugcuuuguucccagcuucccuucugggcagagcauuuguucccuuuuguccagccaggucacuuguccuacguaggucuacuaugaagugcuccuccuaccugcguucuuggugcaucccuucucaaaccccgugguacuucucaaaggcugcagagagacugacugggcuuaaagcaucacuucugagucacgaccgcaaguugcucugcacuucccauuacaagugaagguugccuuagugaugcuaggcuccaggggcguagguguuaaguuggugggucagauccugacauugcugggucccacaugguuuaccgaggagccaauggaggcuuccauugaugccaaagugaccucugcugccaagucagacuguggugcuuaugaauuccauaagcucuaaggaauuuagacacagucagguuagguaggcuauaugcacuggggugggauucuguuacccaggcgggaggauucuguagguagggagguagguagguaggcaucucagccacacugugcagagggugggacuccaacugcuacuuagcugugcagaagccgauccaccacauuuaagcacaaugaugcucuaacucauguuguucucuagggcccacaggggcucucucauucucucagcccuuuuuauauuuacugguuucuaagcuucuugaauuugagugaaggcuauauauauaucucagccuuggccccaagagcaaggcacggucauagagucucuguggcuuuaucugucuucauagccacucagaaauauuuuuggggggagggggguggggugggaugggagucacuucauuuugcaggauuugcuuugagucccugucauaguguagguaacugaccuugacuguacuuuaacuauaaaguacaccacagagagggugggggcuuggggaugggguugggggcguguccuacuaguucgcagcucuuucagcuauagguagugaccccagaaggggugccacacucucucaauuucaugaaugccaugaaaauuaugauaauagucaaguaaauguacaguggacaaaaauuaauuuaaaauaaaaugcgcaguugaccugaggaguuucuggcagagcucgucccugguggauuuggaaggcuucucugcagcccugguucuaaacccaccacaaacacuuccucucauacaugcugcugccccgugaugcugagggauguugcuggaaacaucggggcucaggcuggaggcugugguauguuacagaucgcugcccuucuccuauaaauacggaguguuccgcucugcagaagcacagagggguaauuauggaaguggcauuccucagcguguaaggauucacuuagugucugggauagagaguuagaauucuuuguuuuaagaauugcuguuugagucgcugacuugguuaaaaaaaaaaaaaaaaacccaaaaaaaugaauuuugccuugaauuugguacacaaauuccaacaacuucugaaaugacuaaauguacuucagucauuugguacucuauagucaugcuaauuggaauuaucaguagugauaauuauaaaaaucaaaguagcuagcaaauucuggaaaguguugaaaauguccuuugucgacucagauauucagcugagauuuaauucuucauauaagaguaaaugaggacauucaucuuauuaguaugcaaauuugcuuuccucuucaccaaaugguaagaugguaucaaggaauuguuuuaaaauaaaauauauuauguuacaaaguagguguuugacuuguauacuccuuuuuauauaucuacauacuuaggguuuucuuuuuuuuuuuuuuuuuuuuuuuccgagacaggguuucucuguguagcccuggcuguccuggaacucacucuguagaccaggcuagccucgaacucagaaaucugccugccucugccucccaagugcugguacuaauggugugcgccaccaccuucagagagaugaaugacuggccaccucagccauuuaaccucucucgacuuuacguaguuauucuucagacacugugauuggaguguuaguugauagugcguugggguggggucuccuucccauccucuguugauggcugugccagaaacccacacuucucaaugcaucccagugcggggggugggggugggguggggauguaaacuggaggugguauuggagcuacugaugggcugcuuccucauugccgugauuggccacagcuauguugggacuggucccaggggucacuucucuggccucucugguuucugcucucuucccuauuaucuuugaaguccucuggcuacgccugaugcccucuacggaugccauuucuaccccauuuugucucagcuucccugacugguuggaaauacaaauauaauuugucauuuuagguugacuccagucauccuccacuucccaaucuccacacugcuucauccuuuuugccuucacaucuucuuuugucaucugcucagcaggcuguaggccaaacacagggacacagugagcccucagaguacugugaauuaacuacagccggccaggccuagggagagaacuccaaacaauacugauacaagcuggucuuuguugggcaguauuuguuugcggaaggggucaccuuugccgucagggcugagaagggccuaauugcucuagggaacuauagauucucaacgugaggcgguggcuuauucuuggagacacagcaaggcuguguggagcccagacuauggcuuacauaaggugggccaugacuugggaguugggagaguggagacuggcaacagaguugcaguccuauacuuggaaaacugcuucuuauaugacauaaugauaguaguuuucaaaacacacucaugggcuggagagauggcucagugguuaagagcacugacugcucuucuaaagguccugaguucaauuccuagcaaccacaugguggcuuacaaccaucuguaauggaauccgauacccucuucuggugugucugaagacagcuacaguauacucauauaaauuauaaauaaauaaauaaauaaacaaacaaaucuuaaagaucuuucucucccucucccccuccccucccccucucccucucccccccucucacauuuucugcuguccuaauuguaacccaaguuuggugagccuuuucucuaaacugaguugugagauaauaucggagcgagcaggauaacauucagcauuugagcagaaaaauggccuggugagguaucguuuaaaguauuagaccugagacugcugccuuuggauggaacucccucugagccuucuguugaugcagacacugaggguagcaggaagcccgcgggaacaggugggcucugacugguccaggccuggcaccgccacuuccucaguagccgugugaucuugggaucuucccucgccuuccugugccucaaucuauaaguugaggaucguaaccuucugugugauguuaauaaacuggacuuacugugcaguggcauucggugcuuaguauggugcuggcacagaauugccgauauugaagugguaguuguuuuagguaagaauagugguaaauggucaggcuuucugcaccccuguaggccucucaccaucaacuguccccuuucuugcuuuucccuuuucaccccaauugcuugacaucuucuugggccuugcagccuguacuguauacccuuaguggaucagaauacauggauauacauacacaauauguauguauguauguauguauguauguauguauguauguaucuacacacacacagucacguauauauguauguauguauguauguauguauguauauauauccauguggugagugcccuuguucauacucuuuaugaguuuuucccaauccuuggcuccccugcugagcccucucucucuucaagucccucugccccaccuccauuccuaauauauacuguugcuucuuaagcaguagaaaacuagaggaugucauacaccuguuuccuuggcuccuuucaccaacuucaggaugccucgggaagaaauagcucuuguaguuuaaguguuugaucauguuuuccacguggaaacugucucaagcgcaacacuccauauuuuccccccuuuccuuucauauauuaggagauacuacugugguuugaguaggucacugacacuccugauuuggaaaggugggccucauggcauuggaguugagcccuugugaguggguggaaggcuaaccugugccacuucuugcucagggagauccauuagguauggucgagcauugguuaauauugcugugaggcagggcugccccuggugcuugcuacaccugcacuccuucccucggcuucccaccacagucugccagcagcaguucuugggcuuguugcuuccagaaccucgagucaaaguaaccuauucuuuuucuacaaauaacccaauuuuaaccauugugcuguagugacacauucgaggaacugauacuuugucuuuuuuuucuguugagagagagaaaaacuccagagggaaguuucuucccuucaccucagaacugucuuucggaaagagccaagccugcucagcccuccgguccuuaccuggguggcgaccugcugucugcagccaccagaguuucccugugccuuguuggguuuuccuuuauuccaucuuuccucaguugauuuuaguuuuagguuuuauuuuauuuauguuuaugguucuuuauauuuuaguuucuccagacaggguuucccugugugggccuugcuguccuggaacuugcucuguagaccaggcuggccucgaauucagagauucacccgcuucugccuucugcaauugggauccaaggcguacgucaucaugccugacuuacucggaguuuuuaaaaagaaaauaccaagaauuggaguagaauucagcaggagggaguuaaaagauuucacaucagcugggugugguggugcacgccuuuaaucccagcacuuggaaggcagaggcaggcggauuucugaguucaaggccagccaggucuacaaagugaguuccaggacagccagggcuacacagagaaacucugucucgaaaaacgaaaaagaaaaaaaaaagauuucacauugaucccugaaagguuucucuuguguuuagggaagugugaucugcccaugguccucuuggaucuccuccuaaccuuuucuuuaugugguucccucccucccucccucccucccucccucccucccucccucccucccuuccucccucccucccucccuccccugucuuucaucccucuccuccuuucucugcaagaaugcuuaauauguucuuccacucaccaaauuaauugcacaacacccuguuaucaggauuuauuuaucucauauagucggugcauuggauucuccauauaucagccacucccaccccuccccgcccuucugcuuucucuuucuagggcucugaccacagcagucccucuguagcuuugcucuuugugguuuuaguuacccaugaucagcuguguuccauaaauaugaaauggaaaguuacagaaacgaaacaugcauacccaucuagcugcgcauccuacugccgagcgcugcgaaacccugcuccugucugcuugggacgugagucgucccuuuguccagaguguccaugcugcuugcuaccaaccugcuaguaacuaccucagccaucagacugagacacagagagagacagaaagagagagagagacagaaagagagagagagacagagacagagccugggccaggugaccuacagugacacacuuccucuaagaaagccacacuuucuaauccuaagccuuucaaacaguuccagucgcuagugaccaagcuuucaaauauaugaguguauggggcggggaggggguggugguggugcggggguacauucucauucaaacacacuaccacuagggacuucugugcagcuauuauucccaauuuuaaaguuacacugcaucaucacagguaugugcauauaguagauacggggcuggguacuccugguguuuuuagacauccauugggggguguuuuagaguaaauccccugcagauaaguggggacugcacauuuuagacauuucauauaagugacgcuauaugauguuuguccuguguuuggcugacuuagugugacauccuugagacucauccaugccaucauuuagcgacacuucucuucuuuucuggagccgagcaguagcccguuauauaugcacacugcagucucuuuaucccuauggcuaucgugcggcacuuaaauuaauuccuuacuagggcuuuugugacugcugcacagauagagagauccucgaaguccuuacucuuuuggauauaaacacaccuguaagauuuuuggaucaaaugacaguucuaguucacuuuuuuuuuucuuuuuuuuuuuuuuuuuuuuugagacaggguuucucugcauagcccuggcuguccugggacucacuggcauguguccucugcugcaaccaccacccaucuuuuuauuuuauauuuugagguccucuguaguguuucccaucuccuuccugcuuuaguuugugcguuggugggaauacucaauggccacugaacuucucugauaaugcuccuuuucucuguuguguaaguguuaguagaguuaaucucuuagugacuucacgggcucgaacuucugcuugcuaggcuauugcuacauaaaagauuaccucaaaguucagugucgcucaucuggacagcucaucuuugcuccacucagcaucccagcaucuccugguucuaggaucuacuuccaagccaguuuguuuacagguuggcaaguugaugccugcugcuggucucuuuacauaaacagguugggcuuccuuauagcauguggcccggugccaagagcaaaugccuaaagaugcaggaaguaggaagugaguugcuuaaggccuggggucuagaucccaacccccgacgaguuguguuguucugacaaaucacaggcgagauuuuuauucuucuuauuuauuuauuauuuauaugaguacacuguagcugucuucagacauacaccagaagaguguaucagaucccauuacagaugguugugagccaccauugguugcugggaauugaacucaggaccuuuggaagagcagucagugcccuuaacugcugaaccauuguuuccagccccacaggugagauuuuuuuuaaggagagaagaggauggcuccccuuguucaugauuuugucauccaaaaucuaguggcuguuuucaaaccaucaaggguacacucaguacuuugcuuguuuuaaggcagccucucucuggccuugggcugucuccucugucucugucuugugugugcugggaugacagguguguaccaccaugcccugucucagcuacagucacucugauggcauuuuauggaugaggacaccaagcauugaacauuuacauuuugcucacuaaugaugagagagcuccuaaguggcugagcuguuccagccagcaggcagcccgagcuuuuaaguucagugcuuuaguacaucucgagaauugccuggcucgcaaauguaaauucccaccaccugcaacuuuuccauugcacugcaguugagauuaagugaaugaugcuaguuaaugaauuaagugaauuaagugauucuuguuugcaaaccacacaacucuguacaugcaggcuaggugcuggccgaguggacagcgaagacacacucucaaccacccgggucugagcugcuguugacaccacuucugagcccacugcucauuccugcuccccacugcuaauugaucuuuaccuucugccugaaacaggcaaugacucugagggaagcuauuugaucuucagccaucccuguggcauaaagcauguggucgaagaaggaaggaaggaaggaaggaaggaaggaaggaaggaaggaaggaaggaaggaagggaggaaggaaggaaggagggaaggaggcaggcaggcuuacucagaacuaaaaaguuaaacaaauguuucagacuuuguacauuaucuauguguuauagacacauaugugguuuuuauacacauaucugcauuauuuagugauaggaauacauuguaagaaauacuucaucagauaacagugcacuuauguaaacuuuggugguacaaccuauugucauuuacaugacacucuauugaccccaggcuacgaaaccucuacaacauauuaccccaacagguccuguacacaguugucacuccgugguguuuguguguuuguguaucuacuuauaaaagagaacaguaaaaaaaaugcagugggaauuuuaaaauuucauuauuauaaucuaugaggucucuguuauuuaugcaaugccuuguuugaaaagucacgugcagugagaaguaugugugugugugucuggcuguauagaugcauguauguguguauucuugaaugagaaauaaaaaaaccaugcuaucucaaauucuagagcuugccugauaaagucauuuaauggagccuuucgcagacugaugaaagcaguaguuuccuuuacuuaaagaccauggguauuuccauguaagaagagaagcagcccuuugucucaugggcuccaguuaugcuuacuuggauacuguuggcugcugcuauggccugugaucguuccauacuaggugugguacagucacaccccagucauccuuucuuagcaacguuguugagaaagcauagagcuaagcaucgcugucgcuggcuuucugauuuuggguuuucuuuugcaggguaggugacuugcaggguaggugacucucuacauaagcagcuuccuuuuuaucagagaaaucagagccaagacaucaaacccaaaugcuguauuuuccucuacuuuucaaccaccugaccuucuccuuucauuugcuccuaauuuuucuguggcauuaucuagucagagagagcaggggcggaggcuccauucuguaacuggcagcauacugaauucccuuuaucuuuuaggcaccccaacucagguaaaaaucgaucuuggcuuuaaugcagaaaaagguuucaagacaagucggggugaagcagagccggaguuuauuagagaaauguuucagcagauuuuaaaacuagagagaugcuaagggagaaagaaacauacaggagaguacaggugugggcuucucacagucuccauuugucuuuucaauagauacauauaccauuugcgugguuuugaaacuauucacuugcacaagagguucuucagccagagaaggggcguuuacaagauuauaauuacugagguaaaacuguauaucaucagauacuagaaaguaggagggcuuguuguacaaagccuugcuuaagauccccagaaaauaggaggggaauggaacuaggcucauauaccuuuaggccucaauucugguuauuguaauuccaaaauaaaauaaaauuauccaucaucuauucauuccucugccuaucuaucgucuguccacccacuuaucuaaccauccacucacccauccauccauccauccacacauuuagcuaucugcucauccaucuauccacuuacccauccuucuauccaccccuccacacacaucaaccauccacacaucuauccaugcacucauccaucuauccaucauccaaacauccacccacccacccauucauccauccacuuauccauccauccacucauacaaccauccacucaccuauccacccucucauccauccauccauuuaucuguccacgcauccaauuuguaugccugcagccuacacagcauuguuaguugugcugcaguucuugcuucucaucucaggagggguuucagucagccuuuggagugaggggcuccuuucuucuccacggucucauuguuuuccccaucuauccuaccccacagguuuucucugcagucuguauucucccuuuccuguccacuuguugugguggugugcucaggcuuucucugacuuacuuuucugaggccauaugacuauuauacugucugccuuuucaggccgccucugggauaaguucaugugauagagaucuaaaagcaaacuucuuuguucuaaaccacacccucgccacagcuucccuuuucuuguggacugguccccagugcucuugucucucggugcacgugaauuucuugcaugugaccugcucugggugccugaugcuaguguucccucuucuccucucagcucccagcaguggcucaccacacagcaggcacacaguaucugguauuuagaucaaugaaugaacaaauacacacagccuuccaguuuuucauuuggaccuuggaccagaaaucugaggccaucccuggucuuuccucucuuugugcugucaucaucuuaguucacuaaaucuuucuggaacauaagccacacaaggacaagauguuugucugucugccuugguguggugcacuugcgucucuggcauuggacaggcaagagaacgaucauuugugacugcaaaaauacacucauguguguuuggcccgcagcaacugguuucaucuucauagaaagaugugcagauauugugacuugucagaaugaugcuaaaagguggaguuggacuucuaccucaugucucccggguccucacacacagcuacuauguagugugcuguaaugccccccuuaacucuugcauguguauucugugcagucuaaaacccugugccuccuaauccucucuuaagagaucucauaguucaggaggugacuuagacugugucagcucgagccuaugcucgcacccuuuaucccccucuaucgggauccccagaccuguguacagcucguagccuuugaagcacaaaacuuugauguaauggaaauauucccagagcuuugucgccaucaccuaacagagccgugugugucccucucuguagacaacacugguagccacacguuacacucccgagcagagaccacuccaucgucacccaccaacaacccugggaauggacacccggaauacaucgcguacgugcucgucccuguguucuucgucaugggucuccuugguguccucaucugucacuuacuuaagaagaaaggcuaccgguguacaacagaggcggaacaggaagucgaagaggaaaagguggaaaagauagguaaguaaccucugcuuuaaaaggaaauggcuugaggaguggguucuaaguggaaaaaacaaaacuucauauauaauccauuucuuuaugaggaaaacuauuuucugcaguaaucagaguuugaaaccuugccugcauuuauugaaugcuugcugaggguuuacuucagagccugguagcccgggacuguuauuuguaugguauauauuuauuucuaauuguauugacagugaauuuaaugaggguaccuucucuccacuuugaaggguuaaugugaaauuuugagacaagguguuuuggugauuggcacuuacucauaagccuaauccuugcuguuacuuauugaaucaagauucuaauaagaacgguagggacgugaaacgggucucaucggguuugcuguguuaaguaucacuggaggaguucucauugaaguccaugugacugaacuguauauuauuaaugaauagauguuugucauaguucgguagagcugcagcaagaacuggugcuuccaugugagugucagggcgcucaucuuucccucugcacauauguugauagcuugugguggggucaccuccauccacagcaugucuuccucacugauauuccuauccaguccugccugagggagguuuccugaugggucccaggacuggcagcucacucuucauccagcucagccccucugugccaucuuugcagggaggugacauuuggaguaggucacccauggagccuaccggcagggaagguuucucagugguggcuugccagcuugcuggacuguugguuuuuccacccccacugaccuuugaggcuggggaacaugggugaacaggaugagucacgcucagcgaaugagcaaaccggccuugaguguuugucaacagagcagggccucccccgcuguuccuucuaacccacgaagcaggcuggcucaggcuggcucaggcaucagcccccacugugacuguccaaacaucuauaggucauaggggagaagccucccuuggggugcagaggacacuccugcagguacaugggugugcuguugucccagucuguacaaugucucaauccagucucagcugguccugcuaaauaaauuauacagaucgguuuccaaauggaggcuugccccucuuucuccgccugacuuggcugucacgugcuggguccccaaaguaaacugagucuguaaacaaauaaccagugcccaaauuuagcuaccuuguuucaaaggaaaagagaguuuuauaaacauggaugaauacuuaguacuuacuuguucaguugaaaccauuaaucaguaggccaguuguauacagcaugucugagauucgauaaaaccuuuucgugauccuucuucuuguuucuccagaggguugaagguaauaaggaaagauaggagaacgugggggcagagauacaugcacuccuguagugucaugcaaagcaaggggaugcuggacaguccugcgccuuuucuguuuaauuuauaaaugcguguucagcccaggaauucaaaaacguguggcaucgggaagguggggcugaaggauuaaagcuagacucuuugcacugugugagggugcuuaaacuuucuggaagguauucggcgaggccuuaggcucucagauaaaugucuaguugacuuguugcaggugauggaucguaacgccgcucuguccucuuucucucuuagaguugaaugacaguauaaaugagaacagugacacggucggccagauuguccaguacauuaugaaaaaugaagguaaggauaucuucgugcuuuggggcaucucaguguuauuuaaaaaucuccuuagagucagaauuugaauggcuucgcagggcuuuuaccugaacucuguaacuccucagcuuuuagcacugucacaacaggagagguugccuuggugguguuugguggcuucagcacagcaaagggccaggaaggucgauagcuucuaggcuguguaucacgugacuuuauaaagccucagcuuccuccuauggagugagaguuacauuacacaacuguguaggguagcacaagcgaugugcugggagucauaaggacucacaucuuagcugguucuuguguuucacauuuaaggacaugaguuugaacugggaagaaauugaggcauccugguaagaacuggggagugacggccagggcccacgugccuguaacaccagccaaugggugaacugcagguucagugagagagccugucuccaaauaggaggagagugauugaggaagaugcccacauggaccucugcccucugugugcacgcauaugaauauucucucacgcaucacacacacacacacacacacacuuacuuuugccaguuuaaccgcuuggccauuuggaaggggggaguuggguagcauccguguccuuucuaagagcuacaccagugucagcguauuccagaacuuccucggcaccccacucugaaagauagcugcuucucucccuguuccuuccuccccaaaccaccugcaaaggugcuuugcuuucugccucuauguuuguaucuucuaggcuauccaguauuaaauguggauagagcuuaagcauuagggcuuaaguaucuuuuuuuuuuuuauauauaguuucuuuuuugagauagggucucaugugguccagccuggcuuugaacucgguauauagccaaggaugguccugaaccucugguccaccuccccuuaucuccuaaauguugggauuauaggcaugcgccacuaugcucagccuaugaaauguauuuuaaggcaacuuuuuaagagaaggauccaauuguuacuaaaugaauuagggucuuuguucuggaggcugaggguugucuuaauaggaugauguuuucuguugcuauaacugaguaccccaagcuugacgagcuauaaagaacagaaguuuauuuagcucaugguucuagaggcugacaagucgacguguggggccagcaucugcuuggcaccuggagagggccuucacugcuacguucugagcuggaaacgugacgagacagagcagucaugucagaaagaaucugcuuuuaugaaaaaaaccacucucucaguaauccacgaaucuaagaauccaugagcaggccagugacccagucaccccaaggcgacuccaaaugccaacagaaugacuuuggggaguaauguuucugacacgugagugaauuuuaggacacacccaaaccagaacagaaacuugguucuucgugcuuuaucaggucugugguacuccuuaccccaucugcugaagugcuacaguguccacuucuguuggcagaugccaccgucccaucaccagccucucucugggaccuugguccccacaccgcucagcgagagcauccaccuggccccagacugagagcugcaccuguuucccagcugugcuuuguguccuuagaaccagcuuuaugagaaacugguguucuacucagcuuggaagugaaggaagggagacgccaagggcuuuagguccacgcgcuucaagccuucugucuaguucuaaacauuguccugcuuucagcuuugcaaugauauuucucucuuucaguuuugauaguuugcaaaaaaaaaaugaaugaauaaauaaacuuaguagaaugguuuuuagauaagaacaaaaagacaagaacacuugggcgugggccuguuuuucagagauuucccaucagggcaugggauuggcaguacugaaucccagcacacuaguuacaaccuagaguguuuucagguugacucugaggcuaaaauucgccacuguaugcaacaagcaccucguuaccccaccuuguauuccauaguucgcgcaaccucaaacuugauuucaauuuagacuucacuguuauuuucccaaacuggcacucuauauuuacaaauuauaacugcacucugaacuuuuuaaaaggaauuaaaaaggaauaagaugaagcacacgcucucuauuaacaucuuccuaggcucucuguuaacccacaacauuuaguuuuaaucauuuguguuauugacauacaagcagucuccugcauuguguuuuuaacuugccagauggguaauuuaauuugucagauguagucaugauuuuuuuuaaugaagugaacauugagguuuauuagaauuuuaauauagauuuaagccagaagggggacaacagaaucagacugaaggacaggacagugguacacacuuagaaugacaagcuggcuucccaaggugacguucuugcuuuggguugaaguaugugccuuuccuuuucuaaaucaauuuuagcuuaggucgcuguccuuugggguuuggagacaguagcugaucugcugggcaggcacguuuuguggcggugugcugucucacugaguauuucugaaagauguauucccgugggggcugggaaucagaggaccucucugcaagagcagcaugcgcucuaaccacugagccaucucucuagcccgugcugugcuuccaauauaggaugugugcagauuuccaacccaagcaguucuucacgucugacgccagcuccaugcgugucuaauucacuucugacucugccagggaguuaguguggucuaccgcaggcaaagggcucagcuucacaaggcuggccggcuuugccuggccccucuguuccucuaacgugcacacugagaaucugagaaucccccagucccuuccucggguuugcuagaauggcucccagaaggccgggauaugcuauuacauucagugcuuuguuaaaggggaacaccuagaggcggggagccaggcauuggguuagugccagaguuguuauccucuaaucacacugggcgggccuuucugauuacuggcuccgcccugacucaccuuguuauccuagacugaguuuuaccaaguggcucauuaugaaugacaaaagacacuccuaucugacuccggaaguuucacuagggaaauucuucggguuuuucagagcucuuuuacacacccacacacuuuucuucuuaauccggagaccuggaacuaccccagugcuaucccgaguuuaccuuucucuacagagccaaacugaggaguguuuguguggucaguggggguuuccuagcauuguguaggaguuuggagagcaucaaggauaguaaauaauuucucauuuuacuuaacgggcacucgucauaauauauagggaauuguuuucucagguaaguuuauacaguuuucuuuugaaugcuuaucacuauaaaagucuguuacagccagcaugaccucauucccuuuguuguuguuuccucucuggucacauuugguaaacuauggggacguacacacuggccauuuccuguguauuuuacagaaaucgcaugugagacuauacuucuuuauuaguucaucuucuguuaauucauaauggaauauacagagcuagugcuuuuuaaaagcagaguaguuugcuguagcucacaguuuggaggauggagguccaagaucagguagccucauugauuuggacucuggagugaggguccaccugguugggucacaucuuaguggauaacaacaugucgggagcaugggggaaaggcaaagaacacauggugaccaggaagccagagagaguggcucucuccuuguggaggcuaagacucaaaugcagggacuccugcguacgcucugcugcugagcuauagccccaguccucucacuuuuauaccaacccuuuccugggaaugaaggcugagagagaguaucccaagagcugucugacuucugaggccguguuccaguaaccucaucaccuucccuggauucagaagguuggaccauuucucauagcuccuccucccaugaggccaguuugcugccauccaguaccagacuugagggagaguggcaucaaaagggugccaagccaagcauagcgaugacagcacggacagaagugguaauggggguuuuaacacaggaaucuuuggggcaccaaagcacauggaaaucaaagcaacauaccaaccuauuaucugaaagaaaauucuuuuccugaauccccaauaucagucaaacaugaaagugacauguaucacaagauuaugaagugugucagagucaaugugucauuuuuuguuguaugggggggauauuauagaucuaauucagggcuuuuuuuuuuuuuccccuuaaauaacaaaaacauuugguuuuauaauaaaaacucauguuuggcaguucauuuggacacccucaccauugugaagggcaaaaaaaaaaaaaaagguaguuuuuuaaggaaagcgaugacauguguaaauauuucuuagaaauacugcccccacccccuuggauuccuaaaagcugcauuguggugcugugauccccaagguagcggagacuggagaucaugggggagcccaaaacaaaauaagacaaaucaaaaugacaacaaacucacucucuuuuauauguaaggcaacagauaggccauaggccauaaguggaucuaagucuuugguauuguauuuucaugggaggauggguaggggaaaaagugggagaggcaaaaaggaagucaggcugugaagcacacagcacgugggcccuugccucucaacucucccagcagcagaguuagaacucugaguuaaauguccuucucaggggaugucaugugauguaaacugcuacaagcuaccuaucauuggcucacgugguaaaucaguaauccuuuuauucuuucuucucuggagaauuuauugugguuagucaugggaugggaacggugcuuuaaaaaugaauggaaaagguuaggaguugguaauagcauuuggccuugacaauuaaauagccaaaagaaacuugacuuucacugcagccuuugacuggcuacucugagaagucaggacguagggugugggugugggugugggugugggugugggugugggugugggucaagccuaagaagcuuggguucuguguguugacagcucacauccacaagguuuuaaaacaugaacacuguaauucuaaguuaagcccgccuaugucagauaaauuuggaguguuugucccaacuuaggggcuucugcaguccuagaucagaguaacagcauuggccaccugggaaguaaaccuucuccgaccuuccucaucugggccucuggggacugaggaggagcgcggugucucacggacagcuuuucuaacauggcucugauugcucacuuaguucuuuuucuuucucagcgaaugcagauaucuugaaagcuaugguagcugauaacagcgugggcgauauugaaaggugagugccucucucccaguggauggagacaguuuucauuugcuuguucagauugauucccuugguacuguguccagccggagcuggccucuagccuuggguacuauuggcauuuggggucaggcaagucuucgcugagaguaauggcuagcacaagauggacuauugagcagagucccucaucucugcucacuggaugacagagcacuuccucuccuucaaagugugacaaccuaaaaugucucccuccgcacacugacaguguucccaggaggacaucccucugugacccaggcucacaggaauuggguccaggacccacuagguguugagggcaagagcuggagauuagaagauaaagaagacagaagcugggaccaggaggagcucuuguguaagccgauggcuuauggcaagcaaguuuauuaagaagcacaacaucuuaaauacagcuuuuauggggaaaaugggauccagucaguguaaagcuaucauacaacgggugaugucaacaggaagccagucaaacaguguugcacaaggggaacacaggaugccucaagugcuccacagacagagcacacaguggccacagaacugagacccaugggugaguugaguugucacgaugaagucaguuccuccaaggcccuuguccuaggccuuuacuggcucugcccagcuuauucccgguuugagacaaccuuuuaucagggccucagagaaagucuugggucagucugagucucaguaacacugguugggaauucuugugguagacaguaggguuggagaaggcaagcuauggcucggagucaaagagcagguucagagcuugagaguggucguguccugccuccagugugcaggugacugcugguugaugcacaaguuaacugagccugcugaguuccagauccuuaucugcaaaccacugugcuaacuucauucaauuauuaccaggacuauagagcgcuuccaguccugugagaccuuuaugaacaacaguaacuaaaugauaaccuggucgguuuggauuaccugcuaccaucuguuuuuguguuacugguuauagguugugguuguugggcgccagauuccccuguaauuaguuacagauaacuauaugucuagacaguccucaauuucuguaacuaggaacguugacuggguaaaugguucagugcuggauagaacaggacagucacagaucuuugcucuggaagguuucagccacugcagcauagagaugagugcgggaggccuucggagaggcacagguacgaauuuuggggguucuggggaccagaagaagguuaaaaaggaggaagcgaugccugugccagguguucugcuggugcugaugggaacagguucuguagagaggccaccuuggaaugguuugguggcuggagaauaugcaaaaugugacaggauguucaguugggauggagugccaugcugagcaagaucaucugcguugucugugguccccaccaaggucaccuagcacuccuuguugcgaaugugucugucagaugggcccuguuguaugugcacauuagaggggucgugcugaacacugagccacgugcucacguucuggagaugcagcuuaggccacgaagacugauguuucuuaccuuugcccauagauacuugcuguccaguacuuauuggcucuccguagccugaacucgguugacugugggccugcuauugggcuguguaaucacugauaccugcugagugaauguaguugaugagcucaguuucuaauacuugaugucaagcuaauguucuaccgggacgguccuacuguguguuuguauuucaucagcuuuaaggacauugcuaaagagcacgugagaacuuuacaguuguuguuacuguuuugacuccucaguucuagcauggccuggacugcuuuugaagugugcuaguccacuggaugccagcaguccagaggcugguuucugccagccaucuguguggccuuggcgcucuugcugcacaucucagguccuagguauugauuucaggugccacagagggcuggcuccuggucaguccagcccuguguuguuuggaucccuccuuuucuagcacaggauugguaugugcuuucugaaaguaacugacaugguguauuuacaauuuugcuuuauaugucuuagcuggucuggccaaaugucuucuagguuacccgacuggucaccacugucucugaagcucuguguuggcuauggccaugcauggaggugggcggggguaggggguggggugaggguggcagggggagggacuguacaauuugacuuucuagguuuggauuucaaaaccacuuaggugcuauuuauacuggguaagauguuucgcuucuuugagacucaauguccucauuuuuauggugaggaaauuaaugcauauaccccaaagauccaucagggucuauuauauuaacacguagggcauucuuaggaggcgauuagcugcucuucgguugucagccacaucagcaucuauuucaaguaccaccuucuaugucuuaaccuagaguuuuuucuuugauguaguagucagauuggaucuaguguucuagccuuuccaugguacacucaggguggcuugcauggcguuccaggcggacucuuggcuccgugugagaagucagugugauggugugagaagucagugugauggugugagaagucagugugauggugugagaagucagugugauggugugagaagucagugugauggugugagaagucagugugauggugugagaagucagugugauggugugagaagucagugugauggugugagaagucagugugauggugugagaagucagugugauggugugagaagucagugugauggugugagaagucagugugauggugugagaagucagugugauggugugagaagucagugugauggugugagaagucagugugauggugugggagucuuggaaaagagugaugggaagucagauugcguggccuccuuggaaacaguggcucauuccccagcccgacugcuaucacuguuggaaugagcaacuguugcauggucccgagagcugagugcaguugcucagggccaggucacaaaguucauuuguacaacugaagggugugucccugcaucucagggaacaccugccuucacugggguuucuccuaaguagccauuuuuuaccuugucuccuucuccuuuucuucucuaccuuagcccugucacuccuagcacgccagggagcccaccugugaguccugggccccugucaccaggggccaccccagggaagcaugucuguggucaucaucugcacacagugggaggugucguugaacgggaugugugccagcgaugcaggcacaagcgauggcacuucauaaaacccaccaacaagaccaaagagggacggccacggcgacaaggcgaggucaccguccucucugugggcagguaaggagggguccuggugcugcuugugugggaccuaguugcugugguuacaggauuauccuuagguuuuuauugggggaagggucaaguucucaugacucuggcuucuuccauauguccagguuuggauccugaauguuucugacagaccagacagcucuugauagcucauagagaacaaguauuaauuaagaugaggaguuaauuaauuaaucucuguaaauagauggagcccagacucucaacuguguccagaacauauguuucuauuucucuugugagaaucuaaaacagaugaucaggugaguguauggcuuuuccacacggcuauccagagccagaggccccgccauccacuccugacucugcggguuuguaaacagagagagcuguggcagauacugugaagggguuuuuagugaaagcaaccuugggugguaugugucauuugacucccaugccacuggcucuggcugaucacaaaguuccaggccaucaggaacugucaugcugucaugcauuagauagagaaguacagaugcgacccagaacguuccagucucugccacuuaagauccacgccagaggcagugacugcuuucuuugcggucaccucugcuguccccugggucccucaguccccgggcauccuuuccuugugacccaaaugugauuuaaagauccugcuguuggauggacaucuuagugagacuugacauggucagguuugcaggggacucuccuguggucugagggucuuauacaggaagugcauugcaucgguugugacacacugggaaaggucacccgugcaggaaucagacugaguacgugcugggcuuaaaugaggccaaaccucuaggaaauguugcugggacucauuacaucuaccucgauccggucguggugccacuacuuacagacuguucugucacucuaucuccgcucccccccaccccccacccaaggugagaagggccaucacagucacuucccagggcuucugugagaaccaaaaauggugacucagguaaggguuuuaggguaguuucgggcucaugagcacccaaggaacacugucaguuuuucaaaguucuuauuguaauuuuaauuuuguugagucuuguucuguguggcgguggccaucaggaccaggccgaggacuguuuggcacucacggcagagccguacaacccaugaccagacuuuuaucaagaggcagagucaugggaauucacgaacgcagugaaugagaaccgaaggcaugcggacaaagcacgcacuguuuccccuugaaaaaugugcugaaaauucucagcucagcuccaguaugcguuuuuuucagggcucaguguccaccccccugugagacgcuggggaugauggguaauucacuggggcugcuuuucagaagguuugcuucagacucuuccagguugacaggauagucucugcuucccagacuccuccucuuuguggcuugugaccucguuuugggcaaggccgccacuauaaaaaugugguuacuggaaagcucugggggcuugaugacagacaccauucuagaaagauagagcugacugccuuaucuuuucucacacuccuuaaugaaauucucuucuguaauuuauuuaacuguuuuucuucaaucucgagugaaaguuaaucuaaauuuggcuuuggagagcagaaacaacuuacgguagugaagucaccgcugggcuccccugcccagcaggcgcguauuggcucaaggugguuaugcgguggccaucuugguaauguucgucugcauuguaaugggcucuuccuguggccuagcguucugugguuaauggucgcgcuaccauuggaaaccacaacucugaggccacagagcaauucagccuaaguguuuucugacccacuuuguguguuccauaaacuauuagagacgucacacaggaccugcaggggaaugcgccccucuuguccgguagcgauucagcugcuguucucccuuuagucugagcuugguugguuuccuccaggcgauuuuuuuuuucccccuaaacuuacaguuccugcuuggaacuggaaaagcgacgucccgucaugucccuuuucuguccucagguucagagucacgaaaguggagcacaagucaaaucagaaggagcgcagaaguuugaugucugucaguggcauugagagugucaacggggaugugccugcgacgccugugaagagggagcggagugacacggaguagcuggugagcuguaguuugggggacuuuggggcaggaggguggccggguggguuggagagcccucugaggacgcuggccacacagaaaaugagagggccucccugaaacuguuggcauggcagggcacuaagucucaggauuuugugaauacuugucugcccggagccccuugugaagaggguuggagcauuacagagugguggcgacugugagacaggaaucgggcuucugggagaagcaucaccucaaaugucuagugugucacugcaacagcuuuguccucaaaaaagaguaaaauccagaauuuuaggauauacaauaaauaagccuuuaaagguuggaagcuuaguacauucucuaucuaaagggagaaaaaauaaauaagcaaaaaccagauuggaaugggaguacaagacugucucagcauuugggagucugaggcaggaggauuaugacuuugagacugaccagugaaacucugggucaaacaacacaacacaacacaacacaacacaagacaagauaucggguggcaaaggauaucuauucuuacuuaccuuguuuaaguagacugugucugagaaagacugggucaagcaagccucuguuuugaguuggaaaacaauucuucauuuaucauguaccguuaguugggauacuacucugcagcccucaguaggaacauuacguugagauaccccagggacaauauuguucuuugcaccagcucuccuggagcacucucaagacaaggugacagcuucuuuguuuagauguuuuaaaaguucagcucagcuacuucccccggaaugacuuccuuuuggcuuagcuuucuucugacuccuuccuuucuggcuugaggaguguuuguugucuuuaugcuugcuacacguaaaagagcaagacccggacuucagcaugggggcaggggugggguccaagcauauaaaggaagugaggucaggcauggacggaggacugggccgagcugagccuauauccuggaucuggcugccaggugcaguuucucuguuugccgcucuuaacaaggaggcuugggccagucguggcagccuuuuaugucucauuggcacauggagacgacacuaccugccuuggggggacaaggaaguuucucugaaguuucagugaagcccagggccuggcaugcagcacacgcugggcccgcugggcagugcugcugguauccugagguaauucacacucggugggugaggcugaguggaggaugcgaaggucauuguccuugaaacuucuguaauagcuugcagguucaaagggcuaaagacacucuggaagucaccucgaggagguguguguuccuuaacucuaaagcauggggguacuggccccucuuuagagacugguuccugcagguuuguguugggggagaucuggcuccuucuaauuuuagacgcuaaauaggggcuuuuuuugguuucuuguuuuguguguguuuguucguuugucuuuugaggcaaggguuucucaacugucauucaugcuggccuggaaaugacucuguggccugggcuggccuugaacuuacaacugucuuaucucggcauccugaguacuaggauuacuggugugggcugucuuaccugguuuaggugauuucuuuaaagaggaaaagcaaggcaaaaaaguuuggcuucucaacugagaggaaccugaggaaagagggugaaugaguggcuccggacagcagcuaguguuaccuugggauucuagcuuucuggacacagagcugacacuaccauugccaugguuauaaacauuuccuaacgagggucacaccaucaucccagacgaggaaucugccacauggguggauaggguaucagucagugguugcaucacuggacagaagccucaagacuuguacccacaucucugaguuacaagauagaaggcuaggccugaccccguuaggcuaugguguaggaagccuaggcccuggcugguggacaccucuauugaccauucuagaguuuugucuguagcuuucagucaacuaggcaccuuacauauaaacuaauugcaaguaagcguucagguuguauacuagucacaugucacaugauuaguagccacccaggcuagagucugccuuacugggugggcacugcagacauaggacaucccaucauccagagaagcaguccugagcagagacagcagcaccuuugguguuagguguggacugcugcgugaccuugaccuggcacagcugauuaaagucacccucugggaagagaugcaccugcuguugaagucuaagguaaugaaacccagccagaaguauggggccauccugacaugugacuccaccugggcagcacugacugcugaagaagacacggacgaguggaaggcaggaaggaacugcaaggcgauggucuugccacacucugcccugguuacggugaucuagaaaguuaggauugcucagguggcuuuccuggcccaaauucuaucuguaucugauucaggaauuugacagaaaucaccugaaguccugacuauguguaacugcuuugcaauuuaauagucucugcaaagcacucuggcaccugcuaggauuacauaacuggguucuauuagaggcacaucagggugagcucacuuggaaauaaauaguucuuaacugcccuuaccuucuuuuuugggaaguaaauauuagauucaauguaagcgccaagguagugucuagggugaaguuggcuuucaauggaggauaauuauacuguguguauugucugaaucaguaagacucaccuaguggccucaagaaggaaacauauucucugagacuccaauugacuguaguuaaucuugaaacaaaaacaacaacaagaaagaauuauuauggaaauuuaaaaauucgaaagcggacagaauaauaauuaagugacuauaaucuguggaauaguugaguaucuugcuuugcagcugaaguucuuuagcuuggaguuuaaacaguguguuuggaauuaugagaaaauaggaguuuacaguggaacccagggagccuggcuucaguugacacagaugucaaccugcuucaggaaggacgggucuuagguuaagucuucaccgaauuauguggagaauggaccaagaaaaagaaggaaccuuuaaaauauugcacauuugaaaagguuuucuuaugauucuuaggaaaauuugcuugggacaguugauuugacuugacuuucaaccaagaaaaccuggaagauuucaucugggcugaaaucucuggcccaguagugaaucagaagauuugccauaaaauguagcaacaguugggugugguggcacacgccuuuauucccuguacucaggagaugagaggcagauagaucugugagucggugaccagccugcucuacacaguguguucuaagccugccagggcuacacagcugaaaccccaucucagagaaagggaaauacauacuuuauagaaagcaguaaaaagcugauuuguuuuuaugucguugaauuaaaucuuugaauuuguuuuuguuuuucccuuaaagguguuuuguucaaauuggguuuuccaagcugcuuaauuuacuguagauucucuuacauguuggauuauuggguucuucucccuguuccugacuccuuugcucccucccccucuuuuucucucccuuucucucugucucugucucugucucugucucugugucugucugucugucucuuucuuucuuucuuccucucaacagaaucuaugcuugcuaaagucaguuuacuauauccauagacucugcacuuuuagauucauccacuauccaacugaaacucuuucuggaaguccucugucuguccugacugcauguguccaccuguccucccaugccaccauccccuaaacaaugcaguucagugacgauuugcauagcauuuacuuguauuugguauuauaaguaaucuagacgcgacuuagaauuuacaugcggaaaugugcacgugaugugcaaauauucugucuuccgauacagaggccuggacacccacaguuuuugcugugcacagagguccuuagcugacccuuauagcugcugagggacaaucggguguucuagauagaacacaucagagggagcaggauuuuucuuucccucucuccuucccucuucuaaaaacaagaugcguuuguguucucccucucuggcuaucccucccugccccuguggcuugaacuccuuuuguagcucauucugacuuacauucugccugguuuauuuuggcaaugccaucaaaaugguuccuuuuuuuuuuuuuuuccuccccagaaaauguguuuugauuuucucuuagaagaauaagcuuuuguucuucaaaguuaaauaaauggaauugcuuucagucuccagaugccacagccuugucgccguugucacuggucucuggcuuuuuguaaaaaaccgaugcagcucgaguucuccagcguguguuucugagcuguguccucuguuuccccccacuuucugauugccucugauugaaaacaccgacuuggaaaccuuucaugccaguaaaaauuggacugagguguuuguguuuuauuuugauuucuuugcucuugaguuguugcaguuuuuuaauacauucuauauauuaucuacuauauauauacauacauacacauaucuaccauauauaugugcauauauaccuaccauauaucuauguauuuauaugcauauauacauauauauucucucuauguguguguguauauauauguauauauauguguauauauauacauauguauauguauauauauacacauauauauacauauauauguauauauauauauauauauauauacacacacacacacacacacacacacacacacauacauuuauuuaugugguagauuccagcuucacuguguguauguccgugugucuguucuuucuucauuccauccccagcccuaggcaggguucugggacccaagcugugggagacaugacauuuauuucaguacauacguaauauuuucccucauucuguaggugugacuucacuuuugcccccguggcuauauggaagcuugaguguuguguaagcucauuugcugcucuugcuguugggagugugauucuugggguccccgccucgucuguguuauggaguuuugcuccuauauuuuuucuaguaguuuuacaguuagaauuuuaaaaugaaagcaagucaauauuaggcauuucuauuuuaauuuguauuaaguuuuauucucugagaacgucacauguguguaauacauucugauuacucucaccccacucucucucuccccuuuccucacauagacauuucuguuuagucuaaauucuuuuauugaaaauacucuauuuugguuauuuccuuuuggugauuaaaagcuugauuuuaaacuguauccauuuacuuuaaauuauaucacuugacuacugauuauuauaagcaaacugcuuaagccuaaccccuccccuccccucccuuccccuccccccuccccccuccccuccccuccccucccccccuuuuauuuccuuuccuuuuuuuuccacagggauaugcugugcacccuuggcuggccugguacuuacuaugaaaucuaagcuguguuugauuucccagugauccuccugccucagccucccaagaacugggauuucgggugugcgucacucucguagcccaggcuagccuugaacuugcuguguaucuauggccagucuucuccauucauaucugcugcuuccgugcccugggugcugggauuacagacguccccuaaucucuuaggaaaugaagugguuguuagcuuagccgacaggaguauguguaguccuuaagucaguccuuggcacaguuaguguuucuaacuauucacugccaucagaacuaguccugccguucuccguggccuuuguuaguuauuaggcuauuucuugagugcugugguuuucacaucgugcaccccaauuccacucaccucccgauccccuccuuugcccuugcaacuuccuccuaaagaaaaauaaaacaaaccaaaaauaucucauuguggaaagauuugccaguaaagaaguguggagaagagaguauauuuugagacacucugugacacaugaccgcuucuccucugcuuaagaacgaaacacuuggacucuuaggucacccagauggagacaauccuugacaaaucccucaggaauuugagccauuuuugccuguguugaggaagccuuagaaaucaccaugccuuguagggacucaaaaccaaggacgggaugggaagguuuugcugacucaagcucuuuugacugcaaagcucugggcugugcacugcagccugugugcuuugggaugagucugcuuucccgaacaugcuuagcccaucacaggcaugcauuccugaccuugagcuggccucucagugagggaggccagcuccuccuucccuucagcuugguugccaaguauuuaguagaauacuuggggucuucuccugaacuugccacgcccuuaccuuacauucuuggcuuggcugguuggcuggcuuacuugcuuucuaucucucucucucucucucucuuucuaucucuaucucucucucucucucucucucucucucucucucucucuaucucuaucucuaucucuaucucuaucucuaucucuaucucuaucucuauuucuaucucuaucucucuuucuauuccagaguaaaagaugauggugggaaauauaggggcauuggauaaacauuuauaaaaggaaacuccuugggugagaccaccuguuugguuuccaggguagagcugugccuugugugacgucgggcaugcugugugggagguucagccaugaucuugugagaggaggaggaggaggaggaggaggaagaagaggaggaggaggaggaggcagugucuguucaggccccacuguguggagaagacuuagggacuagugagaaaggccaaaguccagugaaggucugaguuaccagggugcucugggcaguugugggaaacacuaacauccccauuuuauagauggggagccaggguuaggacuuacuuuuccaggcuuuuagggugggaagaaauccacacuccagagcucagaugcucggugacuguggaaugugagagaauguugcucuccuugaaaaggaaaaaaacagaaacaugccuauggccucauaguaguggucauuucaaacccccuggcuuucuccaaagggugguaucuaaaaggaucagcaauuguaacaaugguucaacccagacauaguauucuauuucaaaagauucuauugagccccuuuuuggugccaggcacugugcuaggcugggccauggggagcagcaguguguaagacuaaacuuuuuagcccuggcagcccuuugauaagacauagaaaaaaaggagccguaauaucucugcucuguucaucauagacugcagcauuggaggcucagggaccuuggguaccuaaagacagaccuugggaagcccaagggaagcagaaaacaaaaugcuuuaggagauuuuuuuuucuuuuaauuaugguaucgauagguguaaccaguacuuucauuuucaucauuuguaccacgauacuuugacaucuaugcacaugaaguagccaaaguaaaaugcaccgccuguuuucucggacagguuaugcaguacauauagacuccaccggagcucuggaaugaauucugaucucauuagcugguaucuuagacacauggcagugcugcugcugccaccucggccucucuguuugucaaagaggcaugucacaguguuccuugguauggaauaacugaggguuauucuaaucugaaaaucugagauccagaaugucccagagucaaaaccuuuuugggcaacaauauaagacucaaauaaaugguuuuuguuuuuuaagagcaguccagguuucacgugcucacaacguaguacaaaaccugaaaacucagcaggacuggagagauggcucagcagguaaaggugcaugcugccaagcuuaguggccugauuccccaugacuccacagaguggaagggaguacugaugacugcaaguuagccucugaccuccucgagcucauccuaucacaguguaccuucaagccugcccacagugggaaaaacaaacaaacaaacaaacaacaaauaaaacaaccccccgcccaaaaccaaaacaacaacaaagcucagaaauuagaaauauaugaucccaacaacuacuuuccauaagaaacacucugcuuguauuauaucagaugagcucuauuuaaaugguuucauauguauauauaugaguuauuuuuuuuucuuguuucccuugaggcucagagaggcuagguuaguagacccucaucccauccucagguagaugcugacugaaggcagucagcugcccuccagcuccuuagacacauggcugugcuguucgucaccagaagaagaaggugaugccaugcagucguguuauucugcacuagcucagaggagacugaagucagaggagagcagagacucaggacugugcaguccucauuucucuagguccggagccacacuagaugucaguggcagaaauuucucccaagucucccuuuccgaagggagggcugcagaauuugaaguguccaguucucagcacuuggguaacccaguguugcugacaacguguguugcuacuggugcauaacccaguugaggggcaaccugaagacucccagagcaaggaaaacaucagaaacuccagcucuguuaaggcaugauuucucuggguguuauucagaaaagaagugaagagaauuugcaaaaacuauucacuaaugucuguuaggguuuuguuuguuucuuuaaguauuuugauuuugaguagaaacaucucuaagggcuuuaaccccccccccccccaaugauccaccuauaaauacuugcucaugauugguauuuagaagguuuuaauuauuuaaaccccucaucaaaauaggagagcuguguguuauugaaaauacagugaucagcaaauaugaaaaaugcccaauuuagacugggcaugguugugcaugacacaggaggcagauggagucuaauaucuuugauuucaaggccagccuuguuuacauugugaguuccugccaagacugaaacccuuucuguguguguauggggggugggaggugggcaggagagagagcagcgucagagugagagagacagagauaaacagacagagaaacagcccaacauuauuaauaaugaaauuuaaagugcuucagucuuauauuucuuuuaauaacgauggauauaaaugagagccugacaguaaguucacauccaaauggagccuucugagacuaaacaggacacuggguaaguuuuuguuucaguuuguguuuuuuguauagacauuuuuguuuguuuguuuguuuuguuuuuguuuuuguauagacucuuacuuuacagcccagauuggccuugaacuuguagcaaucuuccugccucugagucccuagugcugggauuaucaguaugucucaccaugucuggcugcaagccaguugaccuggccacuaguucagaggguggagagagauggaggccgucacccagggugucucauggauagagaucuuugugcugauacucuagaaauggcagaaacuuaaaggcagccucugauccaagauucucaguuacagauaacaugaggagggaauauauaagacaguguuagaaccuguuccuuucagcuuccuuaauguccagccacuggagcgaagguuaaguuuucuucaauggggauuuaauucacugagaucuuugacaauggcauuaucaacuaucuugcaguuaagauaauugaauauaaguuacaacuuucagagaagugccgaccuuuucucuugcuucagaugacucuagugacuuaaguccauucuucccagcagucuuguuuuaugagggaagcaguggggauucugugcaccaaagccuugcuuaaucucucccaguuugggcauccauuugucuaaaccuguaucacaucucccccacacagagaggcagcuucugaagcagggggcuuuucuucagauggacacccgaaggaggccacccucuacccucugcccguucuuguugggcucuuguggcuucugugccgaccccugaagcucugaucuuuguuagccgguguagaagguucuuuuagcccugguuugaagugguaaagaaauaccgauucagaguggguuuacuugucaauaaggauccagucccuuucccauaaaauaagggauggaauuuaggauuguuaaaacauaccaaaugcacccuuggcuuccagagacugaaccaccaaccaaagagcaagcgugggcuggaccuacuacccacccacccccgcccccauaucuaguagaugugggcagguccgcuaacaacuggacuggaggcugucccugacucuguugccugccuguggaucccaguccccuaacugggcugccuugucuggccucugugggaaaaggugugccuaaucuugcagugacuugaugugccaggauggguugauacccagggcaaccuccccuuucucagaggaggggugugggggagauacccagaggagaugggggcuucgaucaggaugugaagugaagaaauaaauaaauuaaugggggaaaaaucauaccaaaugcacuccacacuuuuuagguaccuccuuccauccacagaaaguaggccacaguuggacauuggcugaccuuuugacauccugugguguuguucacacaacucauaauugagagcagcgcaacugaguugcccuaaaacaagacaaaacacacuaucuugauguuuaaggaaguuuacgauucuguguugagcccucuauagcuguccuugggugcggcuucugggcccuaggccgaucauaucugugagugugugcuaucauuuucccucucuaaauuguuguuaugaugagacaggugagacggguguuuacccggaagcucauugccaccuugcgucaagcagagaccagaugggaggggcuucuguguagguaggugccuucucuuggcugcauaguuccugagguccugaagcagcaguuuggauuuuccacauccuugugcagagauaacagcgcacggggcaguuuuuaagaucagcuuuagaaguggcuguuuagagccgaggacugaugcucaccuuccugcuggaggcuuugacugcuggguaccaugagaaacacugaguaucagucaguguagggcaaacuucauugcccugcuggggaugccagaggacagccaccuucagcgccaggacuaaggaucuaggucugaaucuagaccuuugaucuuacacucuuguuggcacacccugagccuguaguucccaccccuggagguuagugggaucuucugggaugcugucaagggauaaauucuggguuggaaugaucuauuuucuuuccuucuuuguuuguuuguucugagacaaggucucuguggucccagucguccuugauuuuuguggcaguccuccugccucagcuucuugacuccugaaauugcaaguauggauuaccaugcccuuucacucugaugagauguuguauuccaggccugaccucauuguccuggacuuugugacuuucaggauacaaaaagucacuuaaagaacagccauaaaacaguccaauacauacuuucuagguaauguccuaaaauucuuaacauaguuuuuuaaaacucuuuuggguguguguauguguagcauuuuuacauuucucuacaaggucuccuuguggccuuuuucugugcuagaauguuaacugucuacugaguccuuccugaaagcgacacucacuggcuguccccagguacaaacccacgugucagcuccacagagacaccacuuguuucauuagaacuaaaagcuugacucuugacguuuuaggggacagcauuucauuuccaugugguccuucauccaauucauccucuuuggaaaaaucaggcuccuccccuuccaucauaagucacuaugaauaucagggaugucgagaaauaugaacugaugaccuuggagccuggagaggcugcucaguggugaagaacacuggcugcucuccaagaggaccuggguucaguucucaguguggcuccuguccauccuuaacuucaguuccagcggaucuaaugcccucccuggccuccauggggaccagcuaggcauugugugcacaaacauauauuuaggcaaacucacauacuuauacaauaaaaauaccuuuaaaauaguagauaaucuuagagagcaugucuuaaaggguaaauuuuuguuuucccucccucucccucuccuuccuccuuuucucccuucuucucuccccagcacauaugugaguuacuggggauugaacccagggcuuugucuaugcuaagcaaaugcucucucuuugagcacccccccuuuuuuccccuuuuucccccuuuuacuggguuucauuaagcuuccuaguuuggucuugaauucacugugcagcccacacaggcuuugagcuuaggauuccccuuccucagccucuagcuaagauuauaagucugugucccccagaccuggcuugugaauaguauguucuuaaacuaagaugugguggcuaacguuuguuagucuucuguaucucugcaagcugcccucuucucucuuacguucagcauuuaucggcaaacacguguggcagaugagagugcuuugcuccuucauaaagguuugcuccuuagugucgguuucuaacacagcaugcaucuuucaguauacaaugacaucuugagaguuucaggagcauaaaaggguaugaaagcugugaaugacaggagauacuugggacauagaaagcuguuuuauaaguaugacugaggccaucacucuguggcaugugacauggcagcauggaagcagggcuuaacauccuuauucccuggagaucgaaccagggaucacaggcagagugaguaucugcugccgugggaguaucugcugccgugggaguaucugcugccgugggaguaucugcugccgugagggcuucugugaagagcugcaacccuuuaauacaguuccugauacugagugacaccccaaccauaaagugauuuuguugcuucuucauaacuguaauuucgaugcuauuaugaauccuaauguaaauaucuauguuuuucuaaaggucuuuuugggguugugacccagagguugagaacugcugcucuaguguuucuuggugacaaggaggagguccuuagguguucuuagacugaauucuagccggaugguguaaugagggcagggaugagcggguggguccacuggggucuggagggauugcagcuuuccugugucauuaacucaggcagaugagcacgugguaugucuccuuuugucacagcuuuccucuuuuuuguuguuuuucucuuguagcagcugcuggcuuucuugaagaguucuaagagacuccgaacuugcgagauaaugaagucgccuagggaauauuuuuauauguuuuauacaguuucuaucaugaagucaaugggcaugcggaucaaacccaaaagggcauauuuuugcuacgcuggacacagaauucagcuugcuuugaaagaagcuuugggcuuaaaaggugugaugaaaguuuuaguuccguuucuaaaagggaaagagcucuuccuuuuagacaaccguccccaggugcacauuccuggcuguccauacccaggcagcuacucccuuggaaucauggcauuaugaacaaacagaggagccauuuccagccugagcuuguguuggcaugcugacaucuguuccugaaccccagauuccauguugacuuuggcccuaagaucuuaauacacacaguugggcuguuacagaagacucuugccugcaaaaggucccuggaaaacaucuagugcuuagaaaaugauccgcuaggacgucaugggauccaauggaaccacaggcgcccugcacuaaagauuccuggaccaacaagaauucagcacugacuccugcucccgucagccugcccccugucauucucuggucacuuagaagacacagagacuaugacuguuguuauggacuuaaucuaaacagcuggcuuuuagucugauugaguaaaagggaaaaugguuuaaaggcaaccaaaggccaaaacaaaacacuccucuuaugcaaacacgcccuugagacuuccgcuguuuuacucaggauccugcuguagcugaugcuuaguaaaggcuuccuaggaagaucgcaaguugaaggcuccccguguuauagaguguucaggggauagccugggugacugagccagauccugucuuccaacaaaaaaagugaagagagggcugggcuaucacucagugguagagcaugugcucuaccagucuuaggggcuucuugccugguagggcucucucuuggccuuguuuuauaaaacgccucaaaguacauaggucugggauggggaggguggcggggcggcaagcuuuaugcccuacuuccauuggugugaugcauuaacuacugggugugguuuugggguuuuuuguuuguuuguuucuuuuuuguuuuuugcuuuuaauuuggcuguacaaaaauaaaauagaaaaaaguggggugggguuuuaaaaaaauauaccccagggcauuuucuguuaaaaaaauuucugcuucuggacacaaacuaacuuuuuuuuuucaaacauuuuaugcgugugguagaugcaguuugaugugaacccacacuggcagcuagugacuugguauguguguugugucuacuaagcagagaugccaguguggaugccagguucacugugguccaggaagcagagugagugcucaugggaguaauguuugugcagcuaagccaguauuuuuacuuaaacaaacaaacaaaaaaaguauacauuuugcaaaaaaaaaaaaaaaaugacguccuuuaaauggugaugggcuaauauguaauauucuucaguuuuaauuauuuuuuaauuuuauucaauguagagcacuuucuauagcaauaaaaaaaaacaaaacaaaaaaaaauaagcaaagauauuuaagauuguauuuauauacccagaguacauuuuaaacauuuucuaauacuugagcagaugggugacuggcuuccagagaugccaaaaauuaaacauucaauacauucaacacauaagcuuuguccugguuugcacagccuggugagaauccugaggguucccagcauaguuggcguuuagggucccuccuccucccuccucccucagaaguucugaggauccucgacaaggucacuguccacgacacuaaugauggaucgcuucuugguguaaaggaaagagucacucgguugccaucuugauguaaaacauuuuguaaaggaaaauuuuuugguuuccagugucaaauguauuuuuaacugucugguuuguacuuuuuaugaauuuuguacuaccaaagcagaguuaaaaauaaaagcauuaaaccagugugcuugaaugagcgacaucuuacaggaccagcuucuuaagucuucgauuguugaguaaucguuaggcuggucugauuggauuuccccuuuuauagcaccucuaccuccucccccgcccccgccccauggaugauuugggacauagagaaauaaauauaguguggaguuuaugggu

SEQ ID NO: 2470 - RNA, 1071 nt, Mus musculus
agaagaaagcuaagccaaaaggaagucauuccgggggaaguagcugagcugaacuuuuaaaacaucuaaacaaagaagcugucaccuugucuugagagugcuccaggagagcuggugcaaagaacaauauugucccugggguaucucaacguaauguuccuacugagggcugcagaguaguaucccaacuaacgguacaugauaaaugaagaauuguuuuccaacucaaaacagaggcuugcuugacccagucuuucucagacacagucuacuuaaacaagguaaguaagaauagauauccuuugccacccgauaucuugucuuguguuguguuguguuguguuguguuguuugacccagaguuucacuggucagucucaaagucauaauccuccugccucagacucccaaaugcugagacagucuuguacucccauuccaaucugguuuuugcuuauuuauuuuuucucccuuuagauagagaauguacuaagcuuccaaccuuuaaaggcuuauuuauuguauauccuaaaauucuggauuuuacucuuuuuugaggacaaagcuguugcagugacacacuagacauuugaggugaugcuucucccagaagcccgauuccugucucacagucgccaccacucuguaaugcuccaacccucuucacaaggggcuccgggcagacaaguauucacaaaauccugagacuuagugcccugccaugccaacaguuucagggaggcccucucauuuucuguguggccagcguccucagagggcucuccaacccacccggccacccuccugccccaaagucccccaaacuacagcucaccagcuacuccgugucacuccgcucccucuucacaggcgucgcaggcacauccccguugacacucucaaugccacugacagacaucaaacuucugcgcuccuucugauuugacuugugcuccacuuucgugacucugaaccugaggacagaaaagggacaugacgggacgucgcuuuuccaguuccaagcaggaacuguaaguuuagggggaaaaaaaaaaucgccuggaggaaacc

SEQ ID NO: 2471 - RNA, 1071 nt, Mus musculus
gguuuccuccaggcgauuuuuuuuuucccccuaaacuuacaguuccugcuuggaacuggaaaagcgacgucccgucaugucccuuuucuguccucagguucagagucacgaaaguggagcacaagucaaaucagaaggagcgcagaaguuugaugucugucaguggcauugagagugucaacggggaugugccugcgacgccugugaagagggagcggagugacacggaguagcuggugagcuguaguuugggggacuuuggggcaggaggguggccggguggguuggagagcccucugaggacgcuggccacacagaaaaugagagggccucccugaaacuguuggcauggcagggcacuaagucucaggauuuugugaauacuugucugcccggagccccuugugaagaggguuggagcauuacagagugguggcgacugugagacaggaaucgggcuucugggagaagcaucaccucaaaugucuagugugucacugcaacagcuuuguccucaaaaaagaguaaaauccagaauuuuaggauauacaauaaauaagccuuuaaagguuggaagcuuaguacauucucuaucuaaagggagaaaaaauaaauaagcaaaaaccagauuggaaugggaguacaagacugucucagcauuugggagucugaggcaggaggauuaugacuuugagacugaccagugaaacucugggucaaacaacacaacacaacacaacacaacacaagacaagauaucggguggcaaaggauaucuauucuuacuuaccuuguuuaaguagacugugucugagaaagacugggucaagcaagccucuguuuugaguuggaaaacaauucuucauuuaucauguaccguuaguugggauacuacucugcagcccucaguaggaacauuacguugagauaccccagggacaauauuguucuuugcaccagcucuccuggagcacucucaagacaaggugacagcuucuuuguuuagauguuuuaaaaguucagcucagcuacuucccccggaaugacuuccuuuuggcuuagcuuucuucu

SEQ ID NO: 2472 - RNA, 1230 nt, Mus musculus
ugggaguuccucuacgugugaaaguaccaacuugugagugagacaugaguacaaucaacaauggaaaugccuacuguguuguuucccuggaauaugcauggaauggucacauggcugggucacuuuguucugguuucagcuacuaaacauagcacaguaagucacagguaaguggagucugcaucugacacauccugccgauuguuuauguggucacuucacaacaucugagaaaaacagcuacuugcuucuaagauucgguaccuuguuuucuuucuuucuuuuguucuuauuuaguuuuuauucauaaucauaaacuuaacucugcgauccagcuagacuugaaggggaaggagggaaacccaaagaaccucagugagagcagagaggacagggcacugcgaggagauggggugggguggugggggcgcucuccugagcuacagaagaaaugguuugguggguaaaaugcccgcaagucaaaagaaauuagaguuguucauggucagaaauggcaaucuucuuauggucuugccauuccuggacccagagcgcuccauggcuuccacaauguucaugccuucuuuccccuucccaaagaccacaugcuugccauccagccauucauucuuggcaguggagauaaaacacugggaaccguuuguguugguccagcauucagcauggacaaggugccaggaccuguaugcuucaggaugaaguucucauccucaaauuucucucuguagauggaccugccaccagugccauuauggcgugugaagucaccacccuggcccaugaauccuggaauaauucugugaaagggggaacccuuauagccaaucuuuucucuccuuucgugcucagagcauggaaguuuucugcugucuuuggagcucugucugcaaacagcucgaaggagaugcggcccaagggcuugucaucggccaugauguugaagaacacacacggugggguugaccauggcugcagcaagcagcaaaaagugacaguggggucugcaaagcccuuguuuucuuucaagaaaucauuugaugcacaucaaacuuugagugacuuaauacuccacagaacccuuucucuucccaagcugacuccuuaauccgcuacucccuucucauggcaacuuggaacaauuucuacaucccuacagagggaaaggacucaucacccacacagggacuguucucucucucauggucucug

SEQ ID NO: 2473 - RNA, 73821 nt, Mus musculus
cuccgacgucaucgccgcgcgccgccgcccgcgcuucugcuacuucgcgggagaaguuguuggcgccaauggaucccgagccccgauaacgaauuaccccagccacgggccugcccaccugcuccuguucggucguggggcugcgauggugagccgcccgggaggccgugcagcuacagaggcuuugcaggcgggggugugaacggggcgccgccgcggugcgggauggggaggacgaugcagagggcuccgaggggcccggcuuagggugcggggcgcaccagggacgcagcugcagggagguggcugcuacgcggcaauuucacauccccacccccccgacucuugggggaagggaggaaggaagaagaaaguugauuuggacggggcguuaaaaguuacuuucguguacagccuugucccaaaucaucucuguuggagugcuuccuaaagucccgacuucaagcuuugcguggaagaaugucacacuuggcuuucgcagggagaaguuugcucgggccuucagcuugaaucagcuuccuggaagcgagugucagcugugacacaaggaaguuuauuuguuuauuuuguuuagaauaauuuauaggaguugagcggauccugguuuaccaggaauaaaaacacggcgaguacagacggauguucuguauuugacagcugucaucucuuaucaccuguuacgauaaguaguuuuuuuuuuuuuuaaaccucaguuccaacuucaauaauucaauguaguggacauucaaauaguuugaaagugaaauuguuugaaagucccuggcauaggagacagauacaaguuggaaauaauuuuuaauuuacuggaccacugaagauguucagcuaaucuacaagauauuuaacaaucacacuuacacacacuuuuauuauucuuaagcuugucagaacaccagcaugcaggggagaaaaguguuacaccaaacuggaaaaaguuucagcucucuguuuuuuauucuuuggggaaaaaagauagugaugguagccacccagagucggccuuuuuauuuucgggauaauaugugaguuugcuuuaaauaccgucuagaaauucaucugaaguguuguuuuggaaaauauuuauucuuauuuuaguuauguguaucuguguuuguauaugcacacauaguuuguguaugcacacauauguuugaaggcccaugguagccagaagagugugucagauccuccagaggugguguuacaggugguuuugagcugcuuucuguggguguuaguucuggaagucagggucucugcaaagaacaauaugcacucuuaaccacugaaccauuuguucagcccccaaguccaauacauucuuauuugacuuguaacguguauguugugucugaguauauuucugugacuaugcaugccugaugccaucagaggccagaagaggguguugaacccuuuggaauuggaguugaacucauguccucugaaagagcagcaaguacucuaacuccugagacaucucuucagucauaccucuccaguucauugguggugcaugacuuuaaucacagcaccugggaggcagaggcagguggaucucuauaaguuugaggccagccagcucuacagagugaguuccgguacagccaaggcuacacagagaaauccuguuuugaauaaauuacguguacaaguguuuugucugcaugcguguaugugcagugcaugcagcccuggucccaagaaggucagaagagggcauuggguccccugguacuggcgucauacaugggugugaaccaucacgugggugguggaaacugaagccagguccuuugcaagagcagcaagugcucccaaucacuggacacaucucaagccucccaaguucuucgugguuguuguuguuguuuuguuuuuuugagacagggucucucucuauguaguccaggcuguucuagagcuuacuauguagagcaggcuggccuugaacuaacaagagaugcuucugccucugccuccugagugcugggauuaaagucccaugccuucaugcucagcuccaaguuuauuguuuugaaggaagauuuggguaauagugccaugugucaggucuugaaauuacaguguaauuauagauuaggcuggugugaacucaugauccucuugccuuaacucacaguccaguuuuuuaacaguaaagauaccuuuguuguuguuguuuuucgagacaggguuucucuguguagcccuggcuguccuggaacucacuuuguagaccaggcuggccucaaacucagaaaucugccugccucugccuccuaagugcuaggaaauaaagguguacgccaccaugcccggcuaaagauaccuuuuaaacaguuugucauacaacuagaaggugguuaaacuggaaggagagccuaggcauuucugacuacuaugcuauucugccucccgaaaaugaucagcguugcauuuuggaauuuagguguguugguauugugggaaguugagauuuuuuuguuuuugauuuuguuuuguuuuucgagacaggguuucucuguguagcccuggcuguccuggaacucacuuuguagaccaugcuggccuugaacucagaaauccgccucccaagugcugggauuaaaggugugugccaccacgcccggcuaaagacuuuaauaguuaauaguuauauuaacaugcuaauaugccuuauaauuaucuggaccuguacaaguagauuaacucaagugacuccugucucagacuuccaagugcugugauuacuggugugauccacuggacuuuauucuugguuucugcuugcaaaaaggaugggaugaauaauaacuacuaccuugauaacuuaacauuaaaaauuauauuuauuuacuuuuuucuuuuuuuuuuuaaaagauuuauuuuuucauuuauuauauguaaguacacuguaccuguccucagacacuccagaagagggagucagaucucguuaccgaugguugugagccaccaugugguugcugggauuugaacuccugaccuucggaagagcaguuggguacucuuacccacugagccaucucaccagcccauuuauuuacuuuuuaaaaaaugugugugugugucauagcauaguuguagaggauccagguuuaguuuccagcacccacccacaugacagcuuauagcagccugguccucuuaauuaaaagauauacuuauuaguuuaugcauguaaguguuugcuugcaugcuugcaugugcaccauguauugugcuuggugccugaggaagccagaagaggguguuggauuuccugaaacuggaguuacagguugcuaugagcugccaugugggugcugggaacugaaccuggguccucuauaagggcagcaagugcuauuaacuguucagccuucuuuaauggaauauuugcagaauuaagacaauuuuaagggccagagagaugguucaguugguauagugccugcccuacaagcaugaaggcuugaguuuggguccccagcacucaaaaugcaggugugguuguaugcauuuguaaccccaguguugagggaggaagggagcuagguggaucccuggugcucaugacugccagccuccgcgaaugaaucacccgccugcugcagguucaaugagaggaacaguguaugcacagcuuugauucuggagcuuggcauguaguaggcauuauauaguuguuccagcugcaauaaucuguuuuucagaaaggauccuagacagggucuuacuguguaucugagugaucuggaacugcuauguaaaccaugcuggccuugaacuaacagauccuucugccucugcuucuguggccucugaugggaucaaagguaugcaccaccauguccagccuguccuuuuuauuuggugagaacuuuuguagguguuugcaucaguucuuaagggcauaagaagcuggucaugcucuuagccagugcuugugcagcagaggcagaaggaucaggaguuaaagaccaaucucuguuacguaguucccguucagccugcaguucaugagacccuaucucagaaaauuaggagaaaaaaaaggggguaggggcauagaugcuucugacaguagguggcuaacagcugccuguaacuccagcucccagggauucaaggcaccugguccuugagggcacuuguacucauguccacauacacauauaaaauacauacauccguacauauguauuuggggugggauagguggcucagcuguuaagagcucuuguugcucuuguagaggaccuggguuugguucccagcagccacauggaggcucacaaccaucucuagcuccagucugaggaggauucaaaguccccugagcuucaggggcaccaggcguguacaugguaugcaugcauauacacaggcaaagcagccauccacauaaacagauaaagcaaauauuuaaaaaaauuauauauuauauugguguucaauuuaguccucuagcaguuaacacaaaaagaagccuagcagaaccccagaauaaaguucaguuuaacgaguguuuauugaacaccugugcauaguuauaggacagagguucuuaacuucugcaugggccacuguucccuuugagaaguguggugagagguaugcaaaauuucugaguggcagaaaugcauauaggcacauggaccauuuuaggggcuuuuccucucuucugaagcucaucuggagacagagacuaacuuugcucugggaauuguugaacuugagucuccagcuuuuugucuuugacagaggugucagagaauucaauagucuauuaaaaaaaaagccgaagccagucaugguggcacauaccuuuaaucuugacacucaggcaggcugaucucugugaguucaaggcuagucuggucuacaaagagccagggcucuguuguuacacagaguaacccugucuccaaaaaacaaauaaaacaaaauaaacaaaagaggccagauagcccucaugcaaaauaauaaagaauaaacuuggauguuuacauuucauaccugauagaaaacagggaugaauaaagaauaaacuuguaccuauauauuucauaccugguaggccaaauucuaguacgaaugggaaaggcugaggcaggaggaucucugaguucaaggccagggugguccuuagagugaauuccaggacaaacagagcuauacagagaaauccuguuuugaaaaaccaaaaccuaaagaaaagaaauauaguuuugcauuuuagugguuuacaaaguagaagcuuguuaaauauuugaguagucuuugugaaguauguugaugauaauuuuucuugugaauuuggugggucauuuagaauguuaaacaauauuuguauuucuuugcucauuuuaaaauagagaaguaagaccaauguguauugccgugucagcugcucugcagagcaucaaaggcaaaugacagugacauaguuugugcccucucuccuuucacaucuaccacaucugcugguugagcuccuaacaagugcagaacaguaaugagagcugcuucugucugcuucagagcaacgugcaucaguguuuauacuccaggguuucugaagccgaaguucaucuaaugcugcauuucuucuggguuugugaggguauaguaaaaaguuuuguuuuucaucucuacuuaugcuaguagauuugaaaccaacuuggaaaugucuuaguacagauuaaaaauuagaaaacguacccaucuucuuuucaguaccugacaaaaucugguaauuuaguuugaucuguguuuaucaaaauuauacuuggguugccugauuugcaacacuaauuucuagucaagucaucuugcagaauuguuaauacaccguagagaugggaccugccucucucugucucugucccugccuuucucucuguugagauggcuuugccaaguagucgaggguggucucaugcucuugccucacacuccccagggcugggguugaagggaugguuagcuguuucccccuuauguuuaggucagucuucaauuuaaauauugguuuuuauuuacguguauuugugcgugucugagugaaugucguaagugugaguuaccuuggaggcuacaguuacaggugauugaauauaaaccccugacagaaaugcuggggauaacucagguccuggaagaguagaaagugcugucacuauaagguauuccuccagaacuaacuuucagucagucaguaugcuuauuuauuuauuuuuggguuuuuugagacaggguuuuucuguuuagcucuggccacgcugucuaggaacucugagauuugucuucccugccuccugagugccaggauuuaaggccuguaccaccacugcuggcccacucuucaguuuuaaaacuuuugcuagagaauggcuucuuggcauucucaguuucuuaguaggguuaacaacuuguagacuuguucugugaauuaagcacauugacuuuguuuauuuauuguccuaugaggcagagucucauaugucccaggcuguuguggaacugagagugaccuugaacuugaguuccaucugcugccuguaccuuccaagugcugggccuauaggaauguaucgcucugcccagccacaauuuauuuauguaaccaggcacaccgauuuacugacuuauuuuauuaauuuauugugugugcauacaugccugccacaguacauguguggaggucagaggcaacuuggaaauugaacuuaggguaucaggguuggugacaagcacuuuuacccacugugucaucacacuagcucuccugccccucgccccuccucccaccucuucagugcuagcgaguggaccuaagccuuauggauuauagacaaauauuuucuccugaguuacaucccacaccuguauuuggaguuuugugugugugcuucauuuugaauacuucuggggaaaauaccacucaucaggcuuaugcaagcugaaaacuuucugaugugccgguauagacuguguaaacuuucugaugugccgguauagacuguguaaacuuucugaugugccgguauagacuguguaaacuuucugaagugccgguauagacuguguaaacuuucugaagugccgguauagacuguguuucuuucugaugugccgguauagacuguguaaacuuucugaugugccgguauagacuguguuucuuuggcacacacacacauauguuuuggaacauuuuacugauuauuuuggagcauuuuauuugucagucucugcaaggguagaugccgcagggacagagaacugcucuguaguaucuggcauauguuacauuuuccaugaauauuugaugugugaaugaacuuuguaaucccaauaaaaauaucaauaagguaagaguuacugucauuuucccgaguagcaguucucaacuugguggucacacccccuuggggguuguugaacaacccuuucacagaaaucaccaaagaccgcuggaaaacagcuauuuacauuacaauucauaacaguagcaaaauuacaguuaugaaguaguaacaugguuaggaagggugagaacuacuacucuaggggcuggagagauggcucaaugguuaagggcacuugcugcucuggcagaggaccuggguucaguucccagagcccacauagaggcucauaaccuucccauaacuccauuuccaggagacccgaagccucuucugaucacuauaggcgccaggcacguauaugacaugcacacauacaugcaggcuaaacacucauucucaucaaauaaauaaauuuauuaaaaauauuuuuguucaugacuuuguauuuaaauuauuaaaagauuucaugauuggguguggugacaguacucaaaaggcagaggcagagcauccugagucuacauagccaauuccagaccagucagggcuauaugugaaaccuuggauuauuuuaguuuuuuuuuuuuuuuuuuuuuuuuuuuucaggaugguaagguagccauuagaaacaugguccuuuacuguauuauaucauaggucuguuuuugguuugaacuuaaguuaugugaucacauagauaguugaaauuugauauuuuuggauuagaaaucauuugugaaauguuaaucuccagaugaaugaggacaacaaucccaguauguuagcuguggucaaugucagaaaucugaaauaaaugguaccaucagugucagacacuaguugccccacucuagccagugugaaaagagagacugcagggcgugguggcacacgccuuuaaucccagcacucgggaggcagaggcagguggauuucugaguucgaggccagccuggucuacaaagugaguuccaggacagccagggcuacacagagaaacccugucuugaaacccccccuccccucccaaaaaaaagccuaaaagaaaagaaagagaccuuaguguuuuaaaccugauuagauaauuauuuccauguuguacucaguuuuuucuuucuuucuuucuuuuuuuuuuuuuuuuuuuaauuuuguaauuuuggaucagggaccugaaacugucuaugaugaguguuuaagagacucuauuguauucucugaauuaucccagccuugucaccuggugaugguaguguaccccuuuagucccagcacuugggagguggaucucugaguuugagaccagccuggucuauagagugaggucuaggacagccagggcuacacagagaauccccacaaauagacagacauuuuuuuuuuuuuuuuuauuguuaagaagagccugugaggaagugucaggaagagauauagaggccugguuucucuucccagcugggcuuuauuuuucucugcucagcuuguguucucuaaggacagacagagagcagacagauggaggcucugugggaauggaggggcuuuuguuuuguuuauguucuucucuuuccugugucuuuucuucugagcacugagcacugauccuggucuguccaaggcgcugagaaguauuuagugguggccugagugaaagggaaucuggagggaccauagagcaguuuucuucccgggacauacaguugugucucgugucccguguagucgucucacuccaccuuuguaaagaccacacuuggcuagcucaugguguccuccucagggaggugcuugaggcagugcuaaacuuagcuaaaacaaucauguuugcuguguguagugacaguuuugauuucuaaaaaaaguaauuuguguggcuaaaagccaauuuugaaggagaggaaguggccuacuaaaagugaaaguuguuuuugucuuuuguagccacaauaugguaaugugacacaagucaggcgucuaauauagaagugaauuuuaauaauuuaguucagaguaauacacagugcuaauuuaauaucucucuguguauccacccaugucuguguguguguguccgugugucugucuguccagaggaagaccccuggcauccugcuguuuuucuucacccuauuuuuuuuuugagauagggccuuucacugaacuucgagcuagccagccccaguccucuugucuaugcucccaucucagugcugggcuuacacaugugugcacucaugcuuggaucuuuguguggguuuggggauuugaacuuaggcccucauguuugcauagcaugcacucuuacagcugagaugucucuccaccgccugcuuacauuuucuuaaaacaaaaaacagcaagaacagucauagcaaaaaucccaaucaaggguuuccugggggaguauguaugcuugucuagcccuuucuggccugguacuuauuauuuuaaauuucuuuauuacauguaaguacacuguagcugucuucagacacuucagaagagggcgucagaucuuguuacagaugauuguaagccaccaugugguugcugagauuugaauucaggaccuugagaagagcagucggugcucuuaacugcugacccaucucaccagcccugccugguaguuguuucauagcccugacuggcuuugaacuugauaguccugcuuucagcuucccagugcugcaauugcauacgugugccaccaugccuagugaaguuuguuuuaguacucauaauauuuauuucguucaguaauuuauauguccucuugcauuuuuuuuucuguuuguucuuguuuuugauuuuguuuuucggaaauagggucucacuacauagucuuguuuuaccugauagaccaggcuggccuugaacuuacagagaucugucugcuccagguacaaggauuaaggauaugcaccaccaccaaaaaguuuuuuuuccuuuuuuaaacuuauuuuuauuuuauguguguggauguuuuuguuuggaugugugucuguaacaugcgacuacaaugcccuuaaaaggccaagagaaaguauuggacucucuggacccagacgguuguuagccaccaugugacugcugagaugugaacuuagguccuuuggaagagcagccagugcucuuuagcacuaaaccaucucuauuccauuuaauaaauuuuuaguuuaaaaaguauugggccaucccugguggugcaagcuguaacuguagccacagagaggcuaaggcaggaaggccacaaggucaggcccugcuuagauuacagaaugcuuucaaggcuagccugggcauuuuaaugaaccuugucucaaagauaagaaaugggccaggaauggagcuuagugguagaguacuuguuuagugugggcaagaccucagguucaagcucccagggcuguaauaaguugaaaauuuauaauuccuacuagaaaaacaugauuugaacgagugcucagguaacaauguuaagcuguauuuggucaagggguagagauuagcaucaaaguguaguucugcucgggauggccaagacugguuuggguugcuuagcuguccguuagaugagagcuucaucacucuaaagucaacuggacguuuacugaugagauucauaagcuuugaguguucagauacuugccguauuuacuuguuucccuaacacaucuaaaagaccacagucacuucuggauccuacauagcugcaagaaccuuugggggauuccugccauuccaggcauguguguccuuccuguuccaggcaccucuccaggaaacugaccuggcaucauuccuaagaugcuguagaacaccuguucugagcguugccuucuaacccuuucuagucuguuuggcucauucuuugaccaaauguucuacaguuuucuaggcccacccuugaauuucucucucuuauuauuauuauuauuauauuuuauuauuuauuuauauuauauuauuauuauauuauuuuuuauuauguacuuugguguuuugacugcauguaugucuaugugaggguguuggaacaggaguuaaagacaguuguaagcugucaugugggugcugggaauugaaucuggguccucuggaagaacagcuagugcucuuaaccacugagcuaucucuccagcccuagauuuauuauuuuuauauuauguauaugugugcaucucuguagguaugugcuugugaguucaugugccuguugaggccagaagaggacaucagauccccuagagcuagaguuacaggugguugugagucacccugcguaagugcugggaguugaauucaggucuucugcaagagcagcacacacuuuaaccucuagcaccuucauccuuggauuucugucuggccaggacaaaauuguagacugcugcuuccuagcugcccagcacugugugagcuuucccucucaccgaaaggcggagugagucaggguuuguucccgugucucugucacugucuuagauggcagccucuguaauguggugaggacagugauucuccuaggauacagaaugacccaguggagcuuuaguuugauggcugcugugaagaaggucgugggccuuccauguugguccuuuucacuagguuuacccagcaucuggcuuaguucugcauuuuccauuucuguggcuguugccuaucugucucauguagauguaauuagccuugaauugcuuugauagcugacuuugaacucaugauccucccuuggcugccuucagagugcuggggguugcccuugugcaucuccaugcuuaguuucauccuccuuucucuccuucccuuccuucuuccccuucccccuuuccgucuccccucucccuccucccucucuucaucccucccuccucccucucuucaucccucccuccucccucccuuccuuuugagacaagagcugucuaugauguccugacuggucuggaacucacuauguugcacuugaauuuacauucuagccgauuacuuuggcugggauuaaguguuccacaccugccccacuuccuccucucuuuccuuccuuccuuucuuuugagacaaggucucuguuauguagcucuggcuguccuagaacucacuguguagaccaggcugguucuaaagugauuaaaggugucagccaccuuuccauuucuuuuuuuuuuuuuucugguuuuuugagacaggguuucuguguguagucuuggcuguccuggaacucacucuguagaccaggcuggccucgaacucagaaaucugccugccucugccucccgagugcugggauuaaaggcgugcgccaccaccgcccagcuacuuucuguuuuuaagacagggacuuaacucugugguaguuggcuggcaucgaacuuauauuucuuuugccucagccuucaaagugagauuacagguaagcaucaccgugccugggaaaucugucuuuauggauguuugagcaucauauuaauccacuuagaagaaggucuugucauugucaaaauuguaaaagaaaauguaaaaaauaacuucuuuuucucggguuggcuugauuaauuaucgagaaaagguacuugcuaccaagccuguugacuccugagacccauguuauggaaggagagaagugacuccugaaaguuguccuuggaccuccaccgauguguccccacguacauacauagucacgcauacagaagaaguaagugaaaaaagaguuagccccuuucuaacuccccauucagcagaacuccacgggcagcugagugagcgagggccuuggcccuuuauuuggcauaucacuuggcuuguuccgcauuucaucaaggcguugaacaccugcaauacuagacaggaaguguuacucacucgggagaguaaggugacaccgcgcucuaggagccaggcugcucaccuugcauguuaugcuuaaggccucacagucucgcaguggaggcagucagcccuacccagggugugaaacguuugcaaguguagaguuagugcaugucugcuaagauagaugagggugcugugguuucucuaccuuugggucuggggauugaggaguaggguggagagagagaaaaggaccgagcaguaaguacagggcagacuuuccugcacgcgcacgacugcccugccaguugauucauucucaauauuuuguuuucuuuagucugugguguaaaaaacaaguugaaaaccaggacccuaauuaucguaacuuuguuuuguuucuuuuuuugugcauauaugugcauguauguauagguguggaagucaggacaacgugugggcguucuccuuucccuguguaggcuucagggcuagaacagagguccuugggcugacagcaguugucuuuacccuccaagcugucuugcuugcuuccuaaauauuagcuuaggguuuugcugguucuguggagucgcuggcaucaucucuguccuucccuuuuucuucccuuuguauuucuaagaaauccccacuguuugagugaagaaucaccauaccauuuuaaagggcgaaacugguuagaaacugucauuuccuacagaagcaauaaagcagucagccucaagcccaguucuuggcaaauuauacauaugacugggacuuuuuuauugcccuauucuucaacacuugacacagaugucucuuuaggagucuuauagccaagggcuauagacuuguuuuauucacuuucuuuaaaaauuuauuauuauuauuauuauuguguguguguauaugagauauuuaugugggagcacauaugccacauauuuguggagguuggaggacaaccugcagagucacuucuuuguccccaccuuuccuugggcuccagagacugagcucugcuuucccuugcuggaccaucauauuggcuuccucuuuacgaauuuauuuguuuguuuauuuuugagacagaggcucuuguaucccagacuagucuggaacuugcuguguaaggcuggucuugaacuccugauguuccagcuucuaccccuugauuacaggcacaugccaccaacauggcagcaauccuuuguaaacuuagauuuaguuaauaaauuagaaccuuuuauauagugggagagcuggaaaggaagauuugagauccuauaucuuugcuuauaaaugguuuauaaaaugggauauuucagugaugugacuggauaauaucucaaaaugaagugaaguuuuuugcugagccaaaaugauaagagauacauguuuaaacuuuauaaaggguagguauaaugaaaugcauuucacuuaucagaaaacagauugagauacugaugaauuguucaaggucacacaaguagaauggaccuaggcuuuuugauucuaagguuuguuccuuucuacaguuguuucuucauaacuaaauuagagaaagauaggguuggguguguggugcacaccuauaaccccagcacugggggugagggcagaaacaggugaucucuuacgaaguggaggccagucgggccuauauagugaguuccuguauagccgggguacauagggagagcuugucugaaaaccaaauaaaaauaaaacaaaaagggaagggacagacaauagguauguaaauaauaaggaaacugagugcuuuuaauguucaguuauauuguaaaguuuuuguauaauuaacucaaauucuguaguuuaacccagggucgaguaaugagagagcauauuacaauaggcacuagucuuucuuuuuagaguuugagaagcauuauguagagaaaaaucuuucaacauucuuaguuuuucagaaugcucuggguuguauaaguccuguggcuguggguggugcugaauggaguccuuucacccgccugggaugaugggauggguugugcgucugcagucacugccugcuuccugucuguuagaacccugcugucauuuucaaacaaccauuuuaaaaaugguuuauauauauauauauacuuuguguguguguauaccugugugaguuugugcacaccacaugcaugcaggcgccuacagaggccagagggcaucuuacccucuggugucagauggugguuguaagucauuuaacccaggucccuugcaagagcaguaugugcuguaaccacucagccaucugucucuucagacccuuuauuauuuauuuauuuuuuauuuuugagacagguuuucucuguguagcccuggcuguccuggaacucacuguagacaaggcuggccuugaacucagagauucacccacuucugccucaaaagcacuaggauuaaaggugugcgcugccgggcaugguggcgcacgccuuuaaucccagcacucaggaggcagagguaggcggguuucugaguucgaggccagccuugucuacagagugacagccagggcuacacagagaaacccugucccgaccccccccuccccaaaaaagaaggguaaaggugugugccaccaccaccaggcaaagauuuugaccuuuuucucguuauauucugaggauuauuauuaccuuacauuagaaaaauuauuuuugauucagguaauuuuaucagauggcuuuauuuauaaaaagggugcugcugacuauauaugaccuugcuuuggagagauggcuugggugagaccaacugaauaagguuguccuauuagugacugaaauuagaauguuacauauuuaauauuuacauguuuccucuuuuguguuuaggacauucggaaauucuuugggguuauaucaaguggaaaaaagccuguaaacgagacaguaaagaaugagaagacaaaagcuucggagggaacugucaaaggaaaaaagggagucaaggaggccaaggucgguuugugugugagcuguccagcgagcucugcuccuauccuuggaaguguggacugcuguaaucagagacucaguucgggacaccgaggaggagggauguaacaggcuaaucuguguagcaaacccuguuguccccuccccaagcuccuuuuuuaguuguuaaacuuugcauuuuggucuggagaguuggcucagcgacuaagagcgcaggguguuuuuccauauggcccagguuugauuucuaguacaugguggcucacagccauuuguaacuccaaguaacagagucugaagucuucgucuggccuccaugggcaucaggaauacacauggggcacagacuuguaugcaggcaaaauaccuacaugcauuaaaaacaacaguaacaacagcaaacagaaccaaacuaacaaaaccuucccuuuuuaaggucaaaauuugacaucuguggugacaaagcauauucuggaaagaugaagagagugaggcagaacauaacaacaacaacaacaaaaaaacaaacaacaacaaaaaaccccaaaaaaccaaaacaaagcagauuugcucauagggacauaagaaccuauccucagguagauacuguuagacucaggaugaggccucgcaggaaagagucagucucugucuuuuggacccaaugaaggucagcuaugcuacuguagaauguagaaaaugacuacaaugguguauaugaauuaaaacuguugcauuguauuuaaauuguaagagguuuaugauuccguaagcuaauuuauaaguauuaugugcuauaugugcauauguuuaucuuccacaauugauuguaauuuuuauuuuaaaaguuauguauuuuaaagaaguuauaaggaagagcuggguggugguggcacuugcccuuaaucccagcaccggaggcagagauagguggaucuccaaguuuaagaccagccuggucuacaguucuaggacagcaagggcuacacagagaaacccugucugaaaaaaacaaaccaaacaagcaacaacaaaagaguacaaagaagaauguucuuuuaaauucuguauacauaucuggugcucuucauuucucacugaagaacugaguuuucuucugauacuauuuuugcaacuugaagacuuuucuuuaaauuuuuuguaguauaguuugcuuccgacagaagcuguaaguguauauaagagucaauuuugcauucaucuuaaagggcauuuuugcugagugugaaauuuugaguugccagucuucuguuuugacucuuuaaggauguuccugugcuuugcccaguugaacuugccuuguagcugaguugaccuugagcuugaccccugguccucaggcuucaacuuccugagcagaggcuacgggauuacaggugugagcuagcacaccuggucacucuuaaauuacacauacauagauucuuaguagugccucagugaucaucuuuuacucuucaguuucauugacucuucuucauugccagcuuucuuuuaagaguaucuuuauuuuaauuguuuuauuuauuuuaguucuggaauuuccauuguguuuuucauaguuuuucuguucuguguauauuuauaguagugacuuuaaaguucccauaucuggaacauaugaggauuagucucuaaguaccuuugcucuugagucuguaggucguauuuuaauucuggauaccccaacaaaaauacuauggauccaguggcuuaaacagcagacacuuacuuucuuugaguucuggggcccgugugucugugaucaggguucucuggcugguguaguuuuuagugagagcucuugauuuucagauggcugucuuuccuguguccucacucuugggugaggugcucagaaggagagaacgaggaucgagccuucugcucugucagaucaggaccuuacccuaccucuuuacuuacuuuuuuggagugagucucacuauguagcccagacuggccuggaacuggcuuuggagagcaggcuggccuugaacucacaguuaucuaccuuccucugccgugaguauuaggauuaaggauucgagcuccaauauagggcucuggagcagguaaacacccauucuauaacauuuauccaugaccacuuaaagagcucuuucuauuucaguuacaccuucuuccuaguguauucauucuuccaccaaguauaaagacuggaucguuuaaauuucaucuaagucaauuauaaauaagguuugaagguaugauucauuuuuagguaaauucuuguaguuguugggaaauuguaaauaauaguggucagacacagaguagauauuuccaucuugagaaggaaggacuaauggcucuaaugcaagcccaggaccuagcaaaggaaaugccauuauauuuucagguacaguaguaguaaccuggcuuuauagucucuugcagaccugcugggguucugcuccuguaagccuaggcaguaaucuuggcccugugauccuuuagugcuuuuugccuuugaggcuucaggugaaggcugucuggucuuuugaaaccaagauggugcuccuacccuuugagaguaaagagucaguccgaugcugucuuaggaauaaccuuucgacccaucuauggauuguaagaagucaggcagauuucuuuguauuuaucuucugaaguugaaauuggcaguguuucugcuuguauugaugucuucagugauagcucagcuauacucuugaugcuuccuucagaauacgcuggcucguuuuuacaauguggacagucuuaagaaauuuccaaaucaucaaguuaugguugcuuuuugguuaguaguacuuuaauucaccuuucuuucguuuaccaacuuuaccauagucagaacccagccuguaccuucagcauucugauucaggaucgcucuaggucagcacugaauuuucuuguuuuucuuagaacacuagaacacauccacauuguuuuaucuguguguauauguauauaguaccacuuguaugccuggugccugcagaggcuagaagaggacuuuggauccuguacuggcugguuuuguguuaacuugacacaggcuggaguuaucacagagaaaggagcuucaguugaggaaaaaaaaugccuccacgagauccagcuguaaggcauuuucucaguuagugaucaaggggggagguucuuguggguggugccaucccugggcugguagucuugguucuauaagagagcaagcugagcaagccaggagaagcaagccaguaaagaacaucccuccuuggcuuuugcaucagcuccugcuuccugaccugccugaguuccuguccugacuuccuuggugaugaacagcaguauggaaguguaaggugaauaaacccuuuccuccccaacuugcuucuuggucaugauguuugugcaggaauagaaacccuaagacagaucccuuggaacuguuauaaacuggaguuauagaugauuaugagccaccaugugggugcugggaguugaaccagguccuauguaagagcaauaguguucuaaauugcugaaccaucucucguccauaucuaaguucauuucgucucccuuucucuaucucauuuuuagagagcuagacagggucuaguucuggcuggcuggcuggcuuagaacccccuuugaaggccauucaggcauccagcucacagagauugccugcuuguguuuuguaggugccggaaucaaaagcaugugccuucagguccagacacaaccaaguucuuuguuguuguuguuuuuuguuuguuuguuuuuacuuuuguuuuuuaagacuggguuucucuguguagcccuuacuguccuggaacucacucuauuucaggcugcuugucucugcuuccugaguguugggauuaaaggucugcgccagcauugccuggcuccaucccaugucucuacugugguuuucaaaagccuauuacaguuuccaucagaaagcacaguggguugguuggccuuuaacuuuaauuuuuuuuucccguacauuuuaguauggugaauguugaagaccaaguguagggccuugugugagucaggcaagguccuccugucacugagcuagacuccucauucauggaucggcacgcuguugauggagauggacauguuuucugagacgaggguuugcccuguggcucuguucuuuuccaugguccccccuaaacccaugccacucaucacagcuccuucauggcucucugggcuuuuccuagcaucaaaucccuccagucucuacucagucccugguuuuuagguaaauuuuuaauagcaguauuccauuuuuuagaacuaaaaaucuggcuaggcuuuccagugaaacagaucaaugguaugaacauaacucuagauucauuacuaagauuagguucagaggguugaagaagcugacaagguuugcaguuuguaaguuggagaccuaggagagcgagcggauggcagaguugcuguccaggccugaggaucagaauagcugagcacauggaucugucuaaucuaggagacuggaggccacagaggugauggucccauuccaguccaaagacauggaagaagcugaugcacucgauagaggucaggcaggaagaauucugucucauuccaggaaagcuggcuuuucuuuuuagggcuucagcugauuugauaaggcucaacuacuuugggaagggacaucuuuuuucacuugacacaaacuuaggagugaugcuugaccagaucucuggauccuuuaugauucguugucuugacguaaccacacaagucauuuuucuugcuugguuauauuguauuggauucuguuauauuccuacaaggaauguugguucuuuuggcuuagcauguaguuaacuugaucaaacucaggcuugaaauucuugcuaccuguuagaugggcagcagguaaaaaucuugguuuaguucuuuuaguuuagcuuuuuaaagcuuuuacccucuuaaguccuuguagcuauauuauaaaaaacaguacacgagaaagcaggagaugugggcagaaccuauaggagggaucugagacuuugugucuagaugucugucucggaucuuuacaguuacuguauuugucuuuaguucacuuucuggaucuacuacuuuguugcaucugucaucuguaaauuguaaugguucauuugccuuguuuuuuuuuuuuuuuuuuuugaagcuaaauaauuguuucuguguuuuugaaauuauaucuuuuuuuuuuuuuuaagauuuauuuauuuauuauauguaaguacacuguagcugucuucagacacaccagaagagggagucagaucuuguuacagaugguugugagccaccaugugguugcugggauuugaacucuggaccuuuggaagagcagucgggugcucuuacccacugagccaucucaccagcccuugaaauuauaucuuaauggacagaaauauguagauauuuucaucuaagugaucauuuuuucucugucuauuuuuugauacauuuuuggaaauaugaguauguuagaaaugugauauuuauaaauauauuuaaccuuuuuggccugcuuucaaauuuucagcaugcaugugcuauugaugggcugucagcuuagaucuuauuucuguuguuuuuuuuuuuuuuuuuauguugcauuuuuaggaaacaccuguccuguguauuauccacuaucacaaaauaccuugagauaaucuacuuauaaagagaaagguuauuuugacuccgaguuuuggagguuucuacucugugaccuguugccucacuguugugggccucuugagguagcagcacauuauggugggagcaugugguaugguagagugguccucaugaccaagagacagaagagaaagaagggauugggccucuuucucccuuuuuccauuggacucuaccuccaaagguucaaccaccucuacugagagguagcugcacccuggagaccaaggcaugcauucagggacaugcaggcucuaauaaaccucuugacccugcaauggcugacauccuuuuccucuucguuauauguggguucguuuugaguguguagcugauaauaauguucuguaagucuccuuuccugauacaguucagcaagagcauuccugacguuuuggguuagaugagugcuguguugcgugauguuaguaguacccuuauguacucuagguguuauuaaaaccucugcuucccacuuugauaaacaaugccucuagaaaucaacagaugucucauggggcagaauugcuucaagcccaagucuaaugagaaggccaggcuuacguuguauaggcuuccucuguucuaauucuaucugcugucuccaggucaauaacuccgguaaagaggacgccuccaaaccaaagcagcacagcaagaagaagaggaucaucaaugacucagguaacuuuucugaggacucuaaaggcuucagaauuguucauuucccuuguaacuguauuuuccaagcugauggcugagacacacaaaacucauuacuguggagagagcucugguggguaguccuuggaacaguugucagcgcaaagcuacaauaccuaaauauuuuaauguacugaagguuugcuuaugagggauaagaguauguagcaggucucagauuuacugugagcucaucugucugucugucugucucuaucuaucuaucuaucguauguauguauguauguauguauguauguauguauguauguaugugaucagauucagggccuuacauaugcuaagcaaguguucugccucugaucuguauucucggccccuauuguaaacuauauucucaucaaaaaauuuuuuuuucaagcugagguuuuuagaaguugaauuugaaaaaaaaaaguagcuuacaaugcugcuauuaaaguaaauguugguuacauuugauuaaugacuugguguguuugugguuaugucuaccaugcaaugcgaggucagaggacagcuucaggagucuguucucucucgucacugugcuccugguggacugaacuuagauuaucagccuuggugguaucuuuauuugcugaaccaucuugcuggccccaaagcaaauaauuaaaauugauuuuucuauuuugaaggauuuucuuuaaauauagcuuugagaaggggaacaguacucuuuaugcccaugucucucucuugcucucauucauucauucauucauucauucauucauuuugcaaugccagagguugaacugaggcucucugccuggucggcaggagcucuaccacugagcuauccucccuagcccuguuuguauuauuauuauuauuauuauuauuauuauuauuuuugguuuuucucuguauagcccuggcuguccuggaccucacuuuguagaccaggauggccucgaacucagaaacccgccugccucugccuccaguguaaggcggucagaagucagugaggugguagcagucugucugcuagaggguauuuauuugugugaguaugugugugguccaggggaugaacacacuugcacaugcuaugcaaacauccuaccccugaacuacauccauagcucucuuaaaggucacuaagguugcuucuacuggcuuugaacuuacuuguaucccaaacaagccugaacuaucagucucccuggccacuaccaccaugcuugguuucuuggcuuugaagaugggagaagaggcuaagauguauugguggcagccaguaggcagauggaaaugacaaagaaaugaauucuucccuagggaacccugcugauguccccaugagaccugugucagccauuguucagaacuguuaaagauaauguauuuauguuagacuuuuuuuucuuuuguaagugcgugggugugcaccacuuuguguguguggaggacagguggucauuugggggaguugacuuucuccuacuacgugguucccggggacugcacuuagguuaucaggcuuagcaacagggaccucuaccaacugaaccgugucuccgcccacauguguaguugugaagccaguugguuuguggcuauuguuauaauaacaauaugauaugaaucuaaccaugaguuuauuacuggugacacgcuucagacaugaguuuauuauucaagacacgcuucuugggggauugcuuugaaugacuacuuuaaaaauacacugauauuucuuuucacgguuuaauuuuucucuuguagacucagagucagaggagacaguacagguaaaaaaugcuaaaaagaaaucagaaaaauugucacugucuuauaaaccugguaaagucucucagaaggauccugucaccuacgucucugagacagguaagguaucgaaugcguucccgucguccuuuuugaaugguuucugucagaggagggacaccaucaucucugaaaugucuugugugguaaaggucuacuuacugcugagggccaguacuucaugcaugcuggcaaacacucuaucacuuagcuauaguccuauccuugggggauaguuuguuuauucuuuucagagcugaggacugacccuugagucuuugcacuugcugggcaagugcucuaccacugaguuauaggcuacugugagccuuucuguggaugcuggguaucaaauccuuguccuggaagagcugcugcugcuguuccuccuccuccucgucuccuccuccucuucuucuucuucuuucuucuuucuucuuucuucuucuucuucuucuuucuucuuucuucuuucuucuuucuucuuucuucuuucuuccuucuuccuucuuccuucuuccuucuuccuuccuucuucuuccuucuucuuccuucuucuuccuucuucuuccuucuucuuccuucuucuucuuccuucuuccuucuuucuucuuucuucuuucuucuuucuucuuucuucuuucuucuuucuucuuucuucuuucuucuuucuucuuucuucuuccuucuuccuucuuccuucuuccuucuuccuucuuccuucuuccuucuucuuucuucuuccuucuucuucuucuucuucuucuucuucuuucuuuucuucuucuucuucuuucuucuuucuucuucuucuuucuuuucuucuucuucuuucuuuucuucuucuucuuucuuuucuucuucuucuuucuucuuucuucuucuucuuucuucuucuucuucuucuucuucuucuucuucuucuucuucuucuuuuuucuucuucuucuucuuucuucuucuucuuuucuuucuucucaggguuuuuguguguaguccuuguuguccuggaacuugcucuguagacuagacuagccuggaacugccucugucccccacauggugggaucaaagauguuuaacuugcucuguagacuagacuagccuugaacugccucuguccuccacauggugggaucaaagauguugauguaaccaccacccaggaguagcuaguccucuuaacuguugagucaucucuccagcccuugagcuaauuuuuggaaacauuuaauagacugauguauuucuuacauuggggauagauuaguguuuuuaaugcuuuuguacuguugcuaugcuuagauacauuguacaauauuuaagagguuccuuuaacauggcuaccuuugugacaguuugguuccaugggaggguuaagggaaacaguuuaguaacugggcugugugaccgaagguggugugaugaagcuuuccagcacccuggaaaugucauugcagauagaguggccuuuaacuguggaccaggcugucuuuaucuugggauuuagguacaccaaggcucacuuaaggcucugauuacagauucucuagucacuaggauaguuuuuaguguagucuucugaagagacgccaguaucucaugugagacuuuuaugaccacugacagucuccucucccuccuccacuagacacuccucauccguuauagucuccucuccccuucuucuguuuucuuuuuuuuuuuuuuuuuuuuuaauauagcccuggcuggccuugaacucacagguauccuccuaccucagccuccaagugcugggauuacaggagugugcuccugcaucugacucuuugcuuguuccauuccgcccauggcacguguauguaaaaggagcauuguccuugucuuagcuaaaaauuuggggggacaguguacccauugugguaguuacauuucuguugcagugauacaguacuaacaauuuaagggagaaaggguuuauuuuaguuccuaguuuggggugacaccaugaggaaguuguggcaacaggaacuugcagauauuggucacguuguagucacagucaggaaccagagaggaaugacugucugugccuuccucacuuucuccucacuguccacucuaagaucauagccccagauuagucuugcccauagugggucuuccaccccacucagucuguggaagacacuugucacaguggcacacucaaaggccugucuugacaccguggguuucuaggucucaucagggugacagauuaguuaucguacucuacuaugauguuuaguauuauauuuucccaugugauuuuaaaaucuuauuuuuuauuccauuuuaugugcuuugccuucuuguguguuuuugcaccauguaugagccuggugccagaagagggugucagaucccuugggacuccuggaguuucagacgguugugagcucccauguggaggcugggauugaaccuggguucucuguaagagcaguauagcucuuaauugcugagcuaucucucuccagccccauaaaauugaaauguagaaaguagugauguuguauguugaagacagacuaucauguagcguagucuguggguuuccuauguagccgugggugaucuugauucugauccucugcuuuccgcuuucccgugcugagauugcaggcgugcagcacuguguccuguucacuugguuuuggguugaaaccauugcugcugggcauggugccacaagccuugaauucaagcacgugggaaguaagaggcagguggaucucugugagacuacauagugacggugaugguuuguauaugcuuggcccaggguguggcaucauuaggaggugugcccuuguuggaguaggaugucauuguggguaugggcuuuaagacuauuguccuagcugccugggagccagccaucucauagcagccuuuagauaaagagacagaacucucagcuccuccggcaccaugccugccuggacacugccaugcuccugccuugaugauaauggaccgaaccucuuaaccuguaaaccagcccgaauuaaauguugucuaagaagugcuguggucauggugucugcucacagcagugaaacccucacuaagacagugaguuccaggccaguuagggcuauagugaugcccugucugaaaaagaacaaaacuaaaaacagaacaaauccccaaaauuugauuuguuuugacgauuuuguuuuagaugcuaggaaugaaaccuagggcuuugagcaugcuagacuagcacucugucucugaguuacagaacccagucuuuucuuuccaaaaaaaaaaaaaaagauuuauuuauuuguuuuauguauaugaguacacuauagcuguacagaugguugugagccuucaugugguuguugggaauugaauuuaggaccucugcuuauuccagucaccccuauuugcucagucccuguuugcucuggccugaagauuuauuuauuauuaaaaauaaguauacaccagaagagggcaucagaucucauuacugguggcugugagcugggauuugaacucaggaccuuuggaagagcagucagugcucuuaccugcuaagccaucuugccagccccaguacucagucucuaucuuaaaauguggcuauuuuaagauuguauuuauggccuacauuuuacuucuguuuuguaguacuuuaaaaaauaauugaaaagauugauuuuauuuuuaauuaugaauguuuguggucuguucgggagggaguauguucaugugaaugcagguacccacagaugccagaaggcauuggauucuuuggagcuagauuacaggcaguugugagcugcuuuuuugugcuugcugggaaccaaacucagguccucugcaagguccuaugugcucuugaacuuugugucaucuuugcaucucuugagcuccguggaauacucucuaaaggugagaagggcugaaggaaccgugugcgugacaagcauuucugucuauguuagugagcauccaggcuuggguucagcuuuuaggacauaguucagcaucacuuugacuaaaucuguccuacauaguauuugucaacauuuuuaaaaaugaguuuaauuacauuaauuucccaauguacagaaaaaggaaaaaaaugcauagcgcuaaccauugacuaauagaacuuucucaguggaccacacccuagaugcuugugugcugcacaggcuuacuuuuagcuuuuaauggaacgaugggccucgaguuagagugcugaaggcuaccguacucaguuucaccagcagcugcuguuugauucaagaaauuaggguuuuucuuugucuacuuuuuuuaaugcuaacuuuacagcuauucuggaggcagugcugugggagcuguacuucacugugcugaguguuaauugagggaaaguggcgguguuacacuuccuagggugcucuauuagguccauaaacaaaacuugaaaaacauuguucuuugcuuuuauguaugagguaacaaguauaauauucuauuugagaacuucuuauagaugcugccaaugaaguauggaaugguuguagcagggaaugucucuuaaguaagagaacuuuccauuguauuuauuugauuuuaguuauugagaaucaauacuaauuugcguauuaggauucuacauaaaagaaucuuuaaguuuagagauuuugagcuuggcugaaguauuuagguuaacacauuucuauauuaccccagggccuguucuguuuccucccuguguacaggaauuaccuuggaggggauauggcucuccuggcaucagaaaucuuuguauauuuaagcaugcauguauuuauuuggguauauauuuaugcagccugcuuuuccauuauuuagugucguaacuugcuugugccucuucuccccacacacgaaugugugcgcaguguugggugugauuuccaagcauacacaaagagagaaaccuuuucauggacuuguuuccacucgaggacuuauugcucauuuauuaaugagacuccuggcuucucgaucaguuuuguuuuugugcuuauuugcagagacugugucacucacucagcacacccaggaacggaggaggagugcucaccgcuuuucuuuucauuuaaguucaaguaguuuuuagcccuaacaacugaaccuuccucugcccuuccaaaccaagaugacagugagggauuugauucgagaagcguugagaggcacuccaggcaugcacuaaggcuaugcacgccagcuacccuacuuagauuucacucguugcuaagucacuuauuuuuaaucuuucuaaugaaaucucccuguuaauuggauuuuaguguguuccagagcaaaggcaagagaaucguagcaucagcagucagauccaucugcagaggccaaacucugagcagcaggagcuccagaauuagauuuguuuuuccugcuugccuuguaaauggauuugauugcagaccuucacguuauucccuucucucucaucguuauccuucuaaacagauguguguggcuaacucagcguggcagagccaucuccucucccaggcaauucuucuacuccggguggaaaaugcuaguuuacuuggucguuguuagcacacuugagauuauguuguccauaaauaaaaauaaaugguguuuuuauaaggagacaaguauccuggagggaaauuuuaaguguggaguugucuaugauuuccaaguaguugucagaaaucugacuuagaucuguuuaucaggcuuucauuacagcuuuugggaaggagaaagcagcuugccucuggcuucuaacagacagaaacaaaucagcuucacuagagaacaucugcagaggcaugcuucaccucuguucaggaccgcagaagguguauuuuaccugaggacgguccgagcaaaaccuguuaacugauagugucuuugcaggaagcagguuacacuguuagauucuuuuuggccuagaacucacuggaauuucuccugcguuagauaucuaggugcuggagucacggggcugaaucgccagucccaucuuaggcuuuagacaaggcagaacauaacaguguggagugugugguagcugggaaacaaaaagggggaggaggcuuuaagaggcuggggauaaaauguaucccauaugauaugcauauauguauguauguauguaugggugcaugcgucuaagugaguauuggagguuagaucacauguggaagucagggucucgggauggaaugcagucaucaggauuggcagcaaacagcuuguaccacugaggcaccucccuggcugcuggaugguuuuccuuucuuucuuuuuuuuggauauaaaauguaauaaaaccaacaguuugagguuccaaaugaaugauuagauaauuauuagaugucaaccuuuauuauguguguagccagcgucugagcuuccuaaccaccucugugaacuacccuagucagcaucuuguccggagcuauaauggccuccugagcuccccgccuuugccuuuccucucugcagugucuucuccagaggacaagacuuaaccaacaugugauguuccgcuacacgggcuucugugcuaccacaugaguuucuuucuaucaccuaggaaguccauagaauuuaacucuuaaccugcaacuacacugccuucagccugggaggacauucacuguaagggagcacggugacuggugcuugcagcucacauuaucugacuguucuugccaggucuucauuucauggcucugugcagauguugcuuaucuaagagauguucccuagucagguaucuuaggucacacuagaaaucucagcauuaggguuguugaggcaggagguuugaguuggaggucagcucuggauauguaggaaggucaaggccagccagaacaacauagauuuaaaaaccaaaggauugagaagcccgaugguggugcaugcuuuuaaucccagcauugggaggcagaggcaggggcagaggggcagagagagagagagaggcagagagagagagagagagagagagagggagagagagagagagagagagagagagagagagagagagagaggcagagagacagaggcagagagagagagagagguagaggcagaggcagggcgaucucugauuuuaaggcuagccuggucuacauggugaguuccaagacagccaaggcauacacagagaaacccuaucuagaaaaaccaaaccaaaacuagaaaccaaaggcuuguagcgaagggggcgaguacuugccugguacacaggccugagcuugagcuccuaacaacaggcuuucugaugauugcuuugaccaaaaggacagccuuccguuuuucagacauauucuuuuucuuucuuuucuuuuuuucccuuguguugggcagugaaccuagagucuccuaugugugcuaugcaggugcucuucuacugaguucucucucuccucauucacuuuuuggggauggggagauuggacuuaaggccucuuguauccuuaaucacuccuuacccuucucuuacuucacguuuucuucaugcagcucaaaaauaaaugcguguguauauuuguuuguguacacacauaugaauguauaaaauuaauguauuuguuuuuuuuuuuuuuauggagacugcguucugugagaucagggaaugcuguagcccuuaguuguauccucagugccugguagauaguggauguguugcagccagccauaggccuggcccuuguaaaugucagagugccuguuagauucagaagauaggaggacgaaaaaaaacucaaggucuuaguauuuuuuaaaaagcugguagaaaugauuagcuuauauaauuaagaccuaugcuuuaucaaaaauacuuuucauuuaagaugaagaugaugacuuuguauguaaaaaggcagccuccaaaucaaaagagaauggaguaucuacaaauaguuaccuuggaacaucaaacgugaaaaaaaaugaagaaaacguuaagacuaagaacaagccguuaucuccaauaaaacucacaccaacgucagugcucgacuauuuuggaacugaaaguguccagagaucugggaagaagauggugacaagcaaaaggaaagaaguaaguguucggcaugcccaggcacgccggugugcaccgaugcuucagcgcuugggagacugaggcuaaaagagcgguagugugaggccaaccugugcuacauaauggaauugauagccauucauggauacuaauaaggaaagcuugggauuaauaaagcaaacaugcuuuauuaauaaugagauuuuuuucugugauauagauaaauauccucauuuuggaagauaugggaauuagaauauauguauauauauguauauguauauuuuauacucaaaagcaggaaaauauuuaaacuauaagaaaaagucaugguucguagaauuuaaauggaauuuucaaaauguaaacuuauuuuacuguugaccucagauguacacaacuguauuuugaaaugggauggaccuguuauuuuaucagaguguaccuaugcugauccgcucuaguuugacugaugcuggauuuguucuucccuggccauuuaggaaauggaccuauagauacaguauaguaaaggaaauggacuuauagauacaguauaguaaaggaaauggaccuauagauacaguauaguaaaggugugaguguaagcugguuauaguguguccugguuccuuggcacaggacugugccacguuuacauugauuugccaaugucuuagacuacuuugacaaccaaagcacuaaccuauauauacggugcgugugcacauguaugugcacacuucuuuugaacauuucaauagaacaaaaugagaguuaucugucuguagaguaucuagucuuuaugagauuggauguaccagaacagccacaaacgacuuugggucgacuuugggcuuguauggauugugaccuaucucucaguaauguguuuaguuaguguugccagaaaaacaaaccaaccaaaacuuuaauuuuagccagauuucugcuuaucuugcuugauuuucuuuggaauacagucuucucaaaacacagaggauuccagauuaaaugaugaggccaucgccaagcagcugcagcuggaugaagaugcagagguacugccauuccacuuaguuaucacuguuggcuugauggucugacuuuggacuucuguuagccaggcaaacagucaagaugguuuuaauccuuuucucuuuuuaaauaaguucugccugccucccugucuugucucuguaucugccugucucuguguauguguguccauccacccauccauccauccauccaucacuccaagacaggaccagaacucacuguauaggccagguuggccuugaacucacaauuuugccuuaguuuucugaguguugggauuauaguggugcacagccaugauuagcucaaaaugagccucaucaggaguaugguguaaaauaaauuaaaauaaaguauaugagaauauaaguuucuguaaaauauaaaugaugagacuaacagauaauuauuuauguaaacauuuugaaguucugugaauaggaggcucuguaguguauuugaaagaacuucauuuucuccugucuucuuuuugcuuucauucugagcauauacacucuuucccuggcccuuuacuguauacacugaugucuuagaaaucugccuuugguucaggauucucucuugagcuguaaacccauaucugacagggauuuauugaucacuuaccgaguuccuagcauggcuguugguaguaggugauuaugguuuaaagagaaaaccaagaaagaaaacaagaugcugggaagcgacagacgugcagaaugcaaguagaguucuggggcagguagggagcgcguggugucggagagugacgcacaggcagccacugcugaagacucagauccacacugagcccaggaucgcaaggguaagcaucugagaaaguaugcgcaggagaucaguauggccacacagaugaaugagaaggcaguuaggggauuuggaggaguagccaucagcaggucuuguaggucacaaugagucuuugguaccuaggaaaaggacauugauuggucaggacuucagauuuagccucugugagauggacucaauuggaguccuuaguaaaguggcaugacuugguggguccuggaaguauacuggcuucuguaguguacacaggauaacuugaagucuuucccuguaguugggcaugagcagacuggcguggagauuguuaagguguggcaaguggcaaauguuagcucgcgucagguuggaagugagaggugaccucagcagcuggaugaacaguggugcuguuacgaagaucagaacacaggaugcagagccuguugguacaaagaaguuaguucuguucuggcggcuacaggguggugccggcagguccagucuagaggagagagaaccuggucccucuggggucucucuggagcugagcaggauggcaagugucgaugucccaaaagaaacacaccaagccaggagucuuguggaagcaggaacucaacuuuauggcaucagccucucgcuuauauaaguucgaaacauagggaggggaauuuuugguggggcaaggaggaauggugacagaggguauggcgugacugacagggccaauggcaaaguucuaccucagcaagagugaggcagaggcagggccaaacaggucuugcugaaucauccugaugcggaagugacugagacaggucucaaaacuagagccaggcuuaggcuuucccacaaggccgcagaaacucgaaccggguucggguuuguccucaagggccaaaccagggcaaaaaugaggcccaacaggauggcucagugauuaaagcugcucggcauggaagccuguccuccugaguuugauuucugguaucaauguacaggguagaagaaagguuguucucugugcuccaccugaacacccauucacacacacacacacacacacacacacacacacacacacacacacacacacacacacacacacagguuguucucugugcuccaccugaacacccauucacacacacacacacacacacacacacacacacacacacacacacacacacacacagagacacacacacacacuaauuaaaaagaguucuguuuugauaguggcagaugucugauagaggaagugguggaggaacaaggaaacaagucuggcacucagcugcaggauguauuugcaagugauuagcauuugugugggacuuaauacuuguauaccuguaugacaccuugaggagaaaacaaaagaaaaacauuguuaggauugcucuuuaacauuggagaugaaggggcuggagagauggcucagagguuaagagcacugacugcucuuccgaagguccugaguuucaaucccaacaaucacaugguaaugagaucugacgcccucuucuggugugucugaagacagcuacaguguacuuauguauaauaauaaauaaaucuuugggcuggagcaggcagggacugagcgaacgggggccaacuggagcaagcagagguccuaaauucaauucccaacaaccaugugaaggcucacaguuaucuguacagcuacagcauacucauauacauaaaauaaauaaaucuuuaaaaaacaacaacaacaaaaaaaauggagauaaagaggcucuggcagaggggacuaagggagcuguggguggggugggaagacugggugagccugguguuugcagacgcugaauaugauggaguucaccgggagggcucaucuuggagcgucuucauguuagggcuuuguggaccccuucccuguccccagacacucaggacuguauuguuuauugacauugugauacaaugccuucuccauggagccugacccuagagaacauuggcugacuaugucucagugcuuguucuagugcccuggacagaccaugugugguucuucauuuuauuagcuggacacuucacacuugguguuuuacaaauauuccuuagcuggcuguggugguacacaccuuuaaucccagcagagggagaaagaucuccaaaagagcuugaggccagccuggucuacaaagcaaaucccagaccagccaauacuauauagugagaccugucucaaaacagcaacaaaacccgaaacaaauaccugccuuguuuuugguuguacugcauuaucugaucucuacccagggguccugaugacucaugcaagguaggaugaguggccuaggccaacugugaaguccuugucaggaaccuaacgugcuguuaucuuugcccagcuguggaggauuagcuacuucugugcagagaaccacaggguaucacaguccccuguuuuccuguuucugucacauucuuuuagacucuuuggguaaauuaauuuaaugaaagauuuaggguguuaaucauugauagucuuuccuaauuaucuccuaagaaucccauccccaguucuaccuuuuuucauucaugguaacuauauguucacuaucucaucccgaagccaguauauccaaugccacaugaugucacugacaguaaauaaacaucgugauaagaugcagggcucuuuaucacaugccauaaccccaguccuaaguuucguucgauucauugcccuccccuucccuccucuccccucccaucuccuccugguguacacagaagguucuagaccguccaggacuacauaaugagacaaugccuuccacagcaguggcugggaggaggauaagccagguguaguggugcacaccuuuaaucucagcccuuuagagcagagguagguggaucucagugaguuugaggacagccuggucuacauccugccuucuaagccagccagugcuguguaguaagacccuaucuuuuaaaaaucaaaacagaacugggugggcuaggcuggagaggugacucagaugacuugucaaaccagaguuuguuugcuagcaccuauuuauaacuccaguucuggggcaucugaugcccucagcuggucuguauacccacauauagaugcaaauauacacaugagguuuuuuucuuagaacaaauaaaccauaauaaaacauauaaugaagagaucuguuauacuaagagcauuaagagaaaaugugaccucagauuuuauaaagaaauagcacgugaggauaugcaacuaucuccauuggcugguaagauggcucagcagguggaaggugccugagggcuggaguuuaauccuugggggcucaaaaggagaaaaacaucucuuacaaguugucuucuggccuccucacuugugccaugcaugcauacccacauacacaagaaauaaacaaauuugaaauaugcuaacuuuauuauggugcagaucuagaaguggagucaguaauguaaguugauacuugacugucaguguauagugggaagaugucauuguuauuuucaggaauuuuuucuguuuuuuucuaaacauaugaaccacacauuuaaaaacuuuuggguacaaaaagccaaaagcaucuuacuguguuaugcuuuuuacagcuggagaggcaguugcaugaagaugaagaauuugcaagaacacuggccuuauuggaugaagaacccaagaucaaaaagguagcauuauggggggggguguuuguguguguguacacguguguacacaugcaguccagagguagaugucaggucuuguccuccaccucaguugaccuuggagcuucccauuucuucuaagauggcuggccagggagugagccuccaggauccuccuguguccuucccagcauugcauucccaguuacaggaaugcacugccaugcuuggcuuucucauagguucucaugaagugaaaguaugugggaugacuuuauccauugagucuugccacuagguacacuguuuuaauuuauacuauguguguauguauguguguguaugcaaauucauuuacaguguaauucuuucuuaaagguuucaagaaauaaagcagaacuugcccuacaaaacacaguggguuuuaccuuuauuucuuaucaaaagggauuuuaaaauaagauuuacuuauuuuaguuauaugagcacacuguagcugucuuaaaacacaucagaauaggcaucggaucccauuauugaugguugugagccacugugugguugcugggaauugaacuggggaccucuggaagaguaauccgugcucuuaaccgcugagccgucucuccagcccgcaaaagguauuuuuauauuuuugguugugagccuagccuuuaacggcugagccaucucuccagcccaaaagguauuuuuauguauuauuucagaauaaugauugucagcuccuacggaaugcagauuuaauaacuaaacgcucuucucaggaagcggggccuccguguggcacuuuauuuucucuugagaccgugcucucuuaggcuuuguuuuuugaggugaucuuugcuggguugguuuuggguagccugauacuguguagccaggauggguuugaaacuuggcaguccuccuggcucagccuucggauacuaguacugagaucaggauaucagcugcuacucuucucuuuuacuuuucuacugggcuuuaauuuguuaucauuuuuuuucugcuuuguuuguuuguuuguuuguuucuauuaguaguuugggaguugagauaaaagaaacucuaacaagacuuccauuucuggguuaggagacugggugggaugagguguuuuauugaauuauugcuauaaucguucaucuguuuccuuaucaguaaaaugaaguaauaaaacauucccuuugcuggggguaguuuuuguggauaaauggauggcaguuuauugugguaucuugcugguuuggaagaugacucuuaaauuuaaaauuuuaauucguuuuaacagcacauuuuauaguaauagcuuuccuauuacuuaacauucggacacguuuuaaacuuguuuuaggcccgaaaggauucugaagagggagaagaaucauuuucaucuguccaagaugauuuaagcaaagcagaaaagcagaaaagcccuaauaaagguaaugguggcagaggaauguaagagagcgcuggcuugucuuuguagaagagaauacucgcuaacuuugcuaaacccuucuuugcacuauuuguuucguggacauucagcgagcuguuugagccccuuuagguaaaggugccccuaggcucagauguacuucugcuaacuccaagaccgucaacaguuagaucaugucguagugagaagugcaugcuguggagaaugucacugcugaugcccgauaucucaagaagucgcugaguccaugaauauggaacccacagacacggcaggcugauuuacagucacauuccuguaaaaucagaccucaaaauuacccaucucucugcugauugcauguuucuuuugcaccauuauaaaguugaaaacuuuuuuaaauugguuauuuacauuucaaaugugucucccaccugcaaaccccccaucucaucccccuuccccuuugccucuaagauaaaguugaaaacuuuuuguuuuuguuuuuguuuuuuuuuuuuguuuuuuugagacaggguuucucuuauaguccuggcuguccuggaacucacuuuguagaccaggcuggccuugaacucagaaauccgccugccucugccucccaagugcugggauuaaaggcgugggccaccacgacaggcuaguugaaaacuuuuaacaguccuaaaucaaggauuaccugcacuuugaaagcuagauacuagaggagaaugcucuucugcguuuaguguuauguaaaguguauuaggguacacuuuguuaaugucugaguauguggauuuuauugugugaagacaaagaagcaaauguuuuaagcuuuucguguuagagguagugucacagaguuguccucuggauuguccagaccaucggaagcucuucagauuaucuuggauauccuguucugcaaugguccugacauugcaccauuuacugauacagucaccccuugccuuuucuuacccuuuucuguuuaucugcuauaccagggauuaaaucuagggucuugcacauacuacuuaagugaucuguuucagagcuauauucucagcucuccuuuuucuuuuucuuuugagauaggguucuagugaguuacacaggcuggccuuaaaucauccuguacuuuacacuuaaaacugcagucuuucugccacugcccucugaguaguuggaauacagaccuguguccuagaugccccucauuaucuaugaaacaugaauuucaugacccauguggguccccaugacuguggacacuuaagcucuuuaugugcaaggguagaauuuacauauaauuuauagacagcaucucuuccaguguacuuuaagccauuauuagauuacuuucauacaguauaaugguauguaagcaguuacugugcugauugucuagagaauagucaucaggauaaacgaacaugguuuguauauacauaguuaaaguauuuccuguuccuggcuggcugaguggagccugcagacgugggagacuaauggaugauguaauucuagaaguaaaucugcauauguagcacuucuuagccuugaugacucaggguuugagucccacugcuuugcagaguucugugcagcauaucccaggcaguaaguuuugucucuauacauuuuauagcagcauaucuguggaggggaaucuuggacuuuucacaccgccugggauuggucucaggcuuugcguauugguaggcaguacuguacuauugggcuacauccauaucuuuccgugcuguuuacaauaauaugucaaaugaauaguuugcauuuauaaugacaauucucaguuugaacugauuacaaaaauauauauuaugugucuauauaaguuuaaaaaauaaggaugcuauauaagcuaaaguaguaaauguuuugaaauaaugugauacuauauaguacuaaaaaaaucacaaagaugaagaaaauguugaugcuggcugucaugaaacccaaauaacaauccugguuuccccuuuguaaaagccgagcuuuucucaacugcaagaaagaccuacaguccugcuaagcauggcaaggggagggcuucagaagaugcuaagcagccuugcaaaucagcucaccggaaggaagccuguuccucacccaaggccagugccaaacuggcgcuuaugaaagcaaaagaagaaaguucuuacaacgaaacagagcugcuggcugcaagaagaaaagaaagcgccacugaacccaaaggagagaaaacaacuccuaagaaaacgaaaguuucuccaacuaagagagagguagggacuuugugaaauguauguaauucaggaacaaauggcaguucagguggauuguucaucauguuccuacguuguuauaaaaaaauaauuugaagcugggggguguagcucagugguugggugcuuggcuaauauacuugacuccuuguuugaucccuagaagacaugagaucauguaaaucucuuaaagaauagucauacaggaaaugagccaauauguacugcuauuguaugagaaacuaugcucauauucauaaauuauauuccauaaucuucacaauaaccuuugagacauuugcucuuauaauuuguuguaaagacgaagaaacaggcugaaagaauuuaaguagcuuuuccaagauuaccuaccuguaaucuuggucaucagaaccacaaagggacuuuucuuugucuuuagauauauauaagaagauaauggugauuuuuaaccuccaguucugaaacacuuuagauuuagaaggagaaacgagcacuccuagugccucuuaggcacuuaguaucaaaggcagagcuagacaugagcucucugaagacaaaauagcacugugagcguugggacagcuuagagccggcuuuugaguauaccgauagugcugaacagauaagggauccuagucugguuauuucuugauguguguguagaaaggagguagggauauguauuugguaccaaugaaauggcucaguggguagggugcuacacccgaguuuuaucccugggcccuucuugguggaaggagagaacuggcuccuacagauuguucucugaccuccacacaugcagucacacauacaaacacacucugaauuuucuuugucuucagauauauuuaagaagauaauggucuuuuugaaccuucauuuuggaagcaguuuagaucuguaagaagaaaccacuauuccaucaugccccuuaggcauuuagcauuaaggccagacuaaugucuauuuuaacugcuuaucaccauugugagguguguguguguguguguguguguguguguguguguguguguguguacacauagaacugaacugaaguggugaagauuuugaaaugcuuuuguuuucagcaaauucucauaaauaugcuugaagcaucaguuaacuuuuuggccuuaaauuuuucuucacuaaauguuuaucugguggaguuuuuucuucaggcacacuaaguacauggggaaguuugcagaggaugaauauuuugggggaaggaggaaacaaaaauuuaaagagugauacuguuauuuuuauggugguuuucauaguuggacuagaaauaauguagaacuuguacuuaaauaguuuggggagggcaucagaguuuaguagauucaauugaucuuagucaaauaauucuggcguaguaauugaguaugcugccguuauagccagauguggugcauaccuguaaucucagcacuugggaagcugaugaagaaagguggauaguucaaggccaacuucuacuacguagugagacagcccuuguugcagaacaaacaaggagcaggcaggcguguagacaguucaaaguuguuuuuaguuuuagccuuucacaaaauagaacuacuguuaaaaaugaauaacauucccaguugguuuauaggacccuguuuugaaucuuaugacuuuuugggggcuggagagauggcucagcggguaagagcccugacugcucuucugaagguccugaguucaaaucccagcaaccacaugguggcucacaaccacccguaaugagaucugacgcucucuucuggagugucugaagacagcuacaguguacuuacauauaauaaauaaauaaaucuuuuaaaaauauauggcuuuccauacaugaucuagacagcuauaauuugauaggccccccuauaauuuaaguggaccuuugaaugggugagagccauuguuaaguaggauuggggccagauaugaugguauaugccauuaaucauaacacucaggagacagacauagguagauuucugaguucaaggccagcuuggucuacauagugaguuucaggcaagccagggcuacacacuggguucuuguuucaacagcagcagcagcagcagcagcagcagcagccugaggcuuggauucuaggaucagcuguaauaguuuaacucauaaucggcuuaacuaucuuuuugguuuugucacuuauuuauacaaaguaauauuuuguguacuucaggagauuuggacuuacucaucaguuaaagcaauaugaaauaggaauuggaaaaauaaugacacaguguuguaguuccuuagugcacauguguaagacacacccacuagcucuggaucagaaaccuugagguggauauaauauaauagaucuguaauauauauaaauaaaauuaucuguauuuuuuugagguacauuuuaauuuuacauggcuuuuuuuccccuucugcccaaagucuguaagcccagaagacucugaaaagaagcgcacuaauuaucaagcuuaucgaagcuacuugaaccgagaaggucccaaagcucugggcuccaaagaaauacccaagguaagggugaggaagggugugccucgcacaccaugaggacucugccucaggguucuggugagcauucacugcuagggcagcaaggagcuagugagccgguauuaacagaaggugucagcugcugucuuaugaguuagacguuuguauucacauugugaguccugggauggacacuagggcguuuuccuuuagacaauaaguagcuugauaagagaugugcuuuuccacgaacuggugagguucuugugguacucagagcuuaaggacagcauuuuaagugcauucauauuugacaguaauuuuguuauaugcugugagagaaaaguccaaggugcucuuagagaauaugguagagaaacguacacauaugcauguguguguguucuuguuacaugcauaccugguauccucagaggcacucacuguuccugcaacuggauuuucagaugguugugagccgcugugugcguguagauguugaacucggguccucuacaaaaaucuuuuuaaaaaauugacuuauuucaagagaguauuuugucuacgugugucuguguuccauguacaugccuggugcacgcugaggccauaagagacggucagaacuccuggaacuagaguuguugacaguugcgagccaccauguggguguugggcauuaagcccauguucucuggaagagcacuuaagcauagagccauauucuaagcccugaagagaaugugugugugcacaugaaagauugaucgauuuuuaucucaugcgcaugggaguuuugucugcaccgugugcgccaugugcuugcagugcccacagaagcagagggagcauugacuccuggaacugaagucacggaggguggugguccaccacgcgggugcugcggauccacccgggcccucagccucugcuccucucauugcuccagcccccagggacaugguuuauaaagaaacaggaaaaagaucuaggacuuguugauaauuggaagugagaaguguagcugaauggguauuggaaauggucuggugauggcacacacaucuggguaaauaaaggcagaacauuuuggauguuggccgaguugugauuuagauaugugagcaucuaugugggaaugcucaguagacaaguggcugaguggcauuggcugcaugugaaccuuggcaauauuaguguguugcuaguguggagggagagcugucaucuaagaaacucuggcuggcaagaggagggccuucccuaucucagcuucuuuaugaaauggagggugaaauccaugaggaagucugaugggcggcaccagagaagcgcaggugagaaaggggauucuuguuuguuuguuuguuuguuuuagauuauauuaaaggcagguguauuggggagcugcgaguucauuggucccaaggauugaggccagggagucaccacagggagagagggaggugggggaagagaaaggaagggcgcccacucaugcaagcacagagaaagaagagaggcaagaaagaguguucuuaggacaaccggaagguauagccugucaugucauggaagcugcaacagagaagacucagaauugucuauaguaaaaugacuaacggcccuacugagcucggcaagagcagugaguagaacagagacacagcuaaagcagcgacuggagggagcagggcugucucugacucugcugccagauuuugggaccuuuuucuucauacuggguugccggguccugccuuaauauaaggcuaauaauauuaguuauauuauauguuaauauaauauaauauaauauugucuacuacagcuugauaaggcguguuggguugauaucugugagaggccugccauuuucugaagauaaaaggagggggaggagauggccugggaaguggaacacucagucgguugggcuuugaaaugcaggggcuucuuuuuuuuuuguuuuuuuugagacaggguuucucuguguagcccuggcuguccuggaacucacucuguagaccacgcuggccucgaacucagaaauccgccugccuuugccucccaagugcugggauuaaaggcgugcgccaccaccgcccggcauguaggagcuucuugauggggaguuucccagggugauuuggagccuguuguagagaggacuuaaaguucauuucacuccaagaaacggagagauggagaccugcucuuaguucccugcacaacccuucucccauccuuucugagagaauaguaaccauuuccuuccuuccuucuucccagcaagguucuuucugcggaggggaggggacugcuuaggccgaugcuggggcauguguagaguccugguuagcuucuuuucaagacuucccaucuuuaccaaucucaguuuguuuagagcaguaaggagcauggcacacuguguacuccuuauggaaucaguuugcuuggaugucugauuuagcugauuuauuauaaaaacuuuaaggaucuguaacuauggagaguuguaguacagacuuaggaagagagacgccuggucagcucuuagauuagcugucaucuuuccgcgggugggcgggugaugccuuccuaucuuuauguuuccagcaguucucagcguuacucucagggaauggggagcucacacuugauaagcuuucuagagccaaagcugcccuuuagcagcagcaggcguuucagugggcaauugcaucaagguaugaaagcuaauugcugguuuaaguauggaaaguggagacuagcacaagcggguaauuuuaacguuugcgaacgguauguuucucuuuguucuuuugguagcugugagauguuagcguguaaggcauucaucaggauuugcaccgggguucacugaggcucugcugugauucccuagccagguuucacgcugggguuauuuaugauguugggagagaaaagucaguuuguugcagcuuggcugccaaauauuucuuuggaaagcuaccauauaauuucuucucugcuugaacacugugguuuuguagggagcugaaaauugcuuggaaggccugacguuugugaucacaggagugcuggaguccauugaacgagacgaagccaagucucuaauugaacguuauggggggaaaguaacaggaaacgugagcaagaaaaccaacuaccucgucaugggccgcgacagugggcaguccaagagugacaagguggguucugcuaccucuucucacagugcugccugucugcagcggcaugcgcauuguggcuguuugugguaaugccccuggcugcauuucagggaacuaagacuuguccugcagauuugucuucucugcguaccauaugcuguguugucugcugggacugacuacaagauuuugguuauucaguuggaaacauaguugcuguuuacuugacuuucuuuauauauucuaauuuaaaacuuaaaaaaaauuuaaacauacauaguuucauuuuuuguuuuuguuuuuuuuuuuguuuuuguuuuuaguuugaaguuuucugauacaagccacucuagaucccaucuuaauuuuucauuauuggaagugugugaggaagaagcagaggucagugggaaaguaacacgauaccugacugauggguuuaacuugcccuaagaagacaguagucacuaggauguuucagcagcucaggagcuuaacccagagagucccagccaccaauucugucagccuuauaggcaucaaaccuguugccucgugcuugcgaaguagcugccugcugggcaggaaagagagagcaguggccauuguagccgggccuggucuuacaggcucugucccagcaacacucuaggaugccaccucacugguugacacggcuucugaucgggugggccugcuguaagucagugucacugggagauggacacacuggaguccuguuagccgggggugguggaaaugacugcugcaugagucggacgugagaggggugggaauggcuggacuuugguucucccggcuuuguuccuucccagggagcaaagguaaaggggagcccaagagcggugaugccgucccacacugcccugcacucacucacucgugcugccugguuacggcagcucacagcuagugcucuugagaaguaugccucaggugcauugucuugauugaugaccgugggugaugucgccucagggcugaugguccuggugcuauaagaaacuugagaggaaagccuguaagcaguuguccuucauggccucuucaucagucucugccugagguuccuguccuguuugaguuccugccuuucucccuuuucucagugauaugcugugcugugaaacuuugagcaaguuccuuacguugcuuuugguuaugugucuucucauaguaguaggaauuguaacugaaauaccacuuuuuuuuuuaaagauuuauuuauuuauuuaucugaguacaccaucgcugacacaucagacgagggcaucgaauuccacuacaaauggcugugagccaccaugugguugcugggaacugaacucuagaccucugaaagagcacucagugcucuuaaccgcugagccaucucuccaacccuaaaauaccauucuuaaggagcuuguuuaucugucugccugucuugucuaucaucuaucugugauaaauauugaacccagacccuuauaugugcuagaaaggugcucuaccacuaaaauacaucuuuaauccuucauuucuugagguaaaaaggaucuugccacauugcuuaagcuggucuuaaacucuuggauccuccugcccguuuccuucguccuguaauuauaggaauauaguaucaugacugaccuucuccucucuuccuccuaucuacauucuuguuuaaguuguagcuucauaguucaagugugccauaaagucuguauuuccccaccuuucaaucauuucgugugugugugugugugugugugugugugugcgcgugugugcacucgcacucgcucauuuguguucaaacaauaggcagaggaggaugcuauuuuucuuuuucuguuacucuccaccuuaugccuuugggauggucuuacugaaccugggacaagguugguauccagaagcaaccucugucuccacuuugcauagagcugcaguuaaaaucacauacacagucacacccagcuuuuuuuuuuugauguaggcgccagggauuugaacucagguucuuucacuugugugcccagcacacuuagccacugagccacaucuguagucccauuucuuucuuuuuaaugguaauuuuaaagcuguauguaaagaauuugcaaauaaacguuuauguagagagugacaucucauaggaguguuuguauaguuagaauagucauucugaggcuuaacgucacauuguacucaguacuuucauuaucaguuauauauucucuuauguuuauucaccccccuuuuuguuuuuguuuuguuuuuuuguuuuuuguuuuugagucagggucucucuguguagucuggcuguccuggaacucacucuguagauguugaacucaggaaucuaccugccuccaccucucaagugcugggacuuaaaggccuuugccaccacuaucagcuucaauuauaucuuuaauguacuuuaccacacaccucaaacugaaaagucagcagcagcgugaaaacuaggaaaacuagcuuuaaucacagcuucuuucauaauccauauauccauuacuggauuucaucuuuacagauaacuuucuagugauuuuuuuauuuuucuuuuaaauuccaguguugggacucagcagguaagagcacuuguugcucuuggagagaaccuggguucaauuccuagcucccacauggcacuuacaacuguuuauaauucuaguuucaggggaucugaagcccuguuggaguaccaggcacagucacgguacauacacacagacauacacaugaacaaaacacuuaaccauguaaagcaauaaaauaaaucuuaaaaauaauuaaaaaucaauuacagcauuauuuaguuuauaguguguuucuccaucuaccaguagaccuuaaaaugauuuuuccacuacagaaagaaauguuuugauuacaguucugaugaguuguguuuuaaucaacaggcagcagcucugggaacaaaaauccucgaugaagacggccuguuggaucugauucgaacuaugccaggcaagagauccaaguaugagauggcugcugaggcugagguggguaaggcaaacuggucuauugaaguuggaguguagagccuccugucucaugaagacgggugguagccaaugcugccggguagaugggcagccuccccacccgcaacacauuuccuucugaccugggagccugucuuuaguaugucuuuacccucuggggaggagggagggaggggguagugaauagugugcuguauaugacauacucguuauacuugccuuccuuuuuuuuuuuaaagcguaaaagaauuuauuagcuuggcugguauggaacuugauguauaccaaccugguuggccuccaccucauagagauccauaaaggugccuuuaaucccugggauacugggauuaaaggcaugcgccaccacaccuggccacaauuuaaaacacuuuuggguuucucucuguguguguguguguguguuugggggcaggaguacgugcacaugaaugcaguacccacacaugccagaagagggcaucaguuccugggagcuagaauuacaggcaguugugagucaucugacauggguucugggaacugaacccugccaggccugucucugaucuucugccagaaaaagaaguguucuuuuauuuauuuauuuuuuuuaacuuuuuccaauuuuuuauuagguauuuucuucauuuacauuucaaaugcuaucccgaaaguucccuauacccuccccccacccuguuccccuaccuacccacucguacuucuuggcccugguguucccuuguacuguggcauauaaaguuugcagcaccuaggggccucucuucccaaugauggcugacuaggccaucuucugcuacauaugcagcuagagacacgagcucuggggguacugguuaguucguauuguaguuccaccuauaggguuguagaccccuucagcuccuuggguacuuucucuagcuccuccauuggggggccuguguucuauccaauagcugacugugagcauccacuucuguguuugccaggcacuggcauagccucacgagagacagcuauaucaggguccuuucagcaaaaucuugcuggcauaugcaauagugucuggguuugguggcugauuaugggauggauccccgggcgggguagucucuggacacuccauccuuuugucucagcuccaaacuuugucucuguaacuccuuucauggguguuuuguuuuccaauucuaagaaggggugagguauuuacacuucggucuuccuucuucuugauuuucuuguguuuugcagauuguaucuggguauucuaaguuucugggcuaauauccacuuaucagugaguacauaucaugugaguucuuuugugauuggguuaccucacucaguaugacacccuccagauacauccauuugccuaggaauuucauaaauucauuguuuuuaauagcugaguaguacuccauuguguaaauguaccacauuuucuguauccauuccucuguugagggacaucuggguucuuuccagcuucuggcuauuauaaauaaggcugcuaugaacauaguggagcauguguucuuauuaccaguuggaacaucuucuggauauaugcccaggagagguauugcgggauccuccgguaguacuauguccaauuuucugaggaaccgccagacugauuuccagagugguuguacaagcuuucaaucccaccaacaauggaggaguguuccucuuucuccacauccucaccagcaucugcugucaccugaauuuugaucuuagccauucugacuggugugagguggaaucucaggguuguuuugcuuugcauuucccugaugauugaggauguugaacauuuucauucgauauuccucaguugagaauucuuuguuuagcucugagccccauuuuuuaaugggguuauuugauuuucuggaguccaucuucuugaguucuuuauauauauuggauauuaguccccuaucugauuuaggauugauugguaaagauccuuucccaaucuguugguggucuuuuugucuuauugacggugucuuuugccuugcagaaguuuugcaacuuuaugaggucccuuuuaucgauucucgaucuuacagcacaagucauugcuguucuauucaggaauuuuuccccuacgcccauaucuucgagguuuuuccccacuuucuccucuauaaguuucacugucccugguuuuauauggaguuccuuaauccacuuagauuugaccuuaguacaaggagauaagaauggaucaauuugcauucuucuacaugauaaccgccaguugugccagcaccauuuguugaaaaugcugucuuuuccccacuggaugguuuuagcucccuugucaaagaucaagugaccauagguauguggguucauuucugggucuucaauucuauuccauuggccuaccugucuguugcuauaccaguaccaugcaguuuuuaaucaaaauugcucuguaguacagcuuuaggccaggcauggugauuccaccagagauucuuuuaucauugagaauaguuuuugcuauccuagguuuuuuguuauuccagaugaauuugcaaauugcccuuucuaauucguugaagaauugaguuggaauuuugauggggauuguauugaaucuguagauugcuuuugucaaggauagccauuuuuacuauauugauccugucaauccaugagcaugggagaucuuuucaucuucugagaucuuugauuucuuucuucagagacuugaaguucuuaucaaacagaucuuucacuuccuuaguuagagucaccccaagguauuuuauauuauauuguguauuuauauauuauauuauauugugacuauuuauauauuauauaaauauuuauauauauaagguauuuauauauuauauuauauugugacuauugugaaggguguugucucccuaauuucuuucucagccuguuuauccuuuguguagagaaaggccauugauuuguuugaguuaauuuuauauccagcuacuucagugaagcuguuuaucagguuuaggaguucucugguggaauuuuuaggaucacuuauauauacuaucauaucaucugcaaauaaugauauuuugacuucuuccuuuccaauuuguaucugaaggaaguguuuuuacugcugggcuuuagcaucuuuagugaaaacuuuauuaggaguuuuucaauuaacagaaaccaaucuguauaagaaagggaaaagaaaagaaaaggaaagagaagaagaaaguguuggcuugcauagcuaggcugugggcaggaugggcuuagucuaccaaguuggcaggacuucugaacucuuccauugucuguguuuguaucuaccagugcugucacauuuauuccacugucugccugcaugccaagauucuugucccuagagugucaccaaugugacuagauuguccacccagauuauuccaguagaaaaguccuaggaaugaagugugcucuguaaccaugguugagcuguaacaagugcagugugauacaguguguuuucgccucacggcacauugguuccuguuguccuuugucugcuccaggguccuauuggcuugcacugcuucagccuccuccagccuacggugguucuguuuccucaguuucuucugcuuagcuguuuguagacugucauagcaucgugugauguuucucacaguuagguuguguuacccaguuugggaagaacacgauauuguguccugcucagugugucucacacacgauaaugauauaccuugaucaguugguugagaucgugucugcgggucuccgugagugagaagacuuucugcucuguagcuuauagcuuugcugaguggauaguuaccuuauaucuccagaaaccuccgcccuaacuagguaguuauaauaaguucuagcauugcuggaaggcguuuaacuguuuuagaaauuaagauauuauuuccauuuuuuuaaacucgcuuuuuaaaaaauguaauucauaccugugcagugaucauuaguauuuaauuaaaaaauuacauuuauuuagggggcuaaagaaguggcucagcaguuaagagcauuggcuccucuuucagggaacccagguucaauuugcagcacucacauggcaacugagugacacugucugugacuccagcuccagggacccuacucauacauggaggcagaacagcaauguacauacaauuuaaaaaauuacauuuauuuauuauugacuacauguauuuaugucuggguacaugugaaggucagaggacaucuuccuugaguugguucuguccuuucacagugaggguuuugaggauugaaguuaggucaguaggcuugguggcaagugccuuuacccagugagccaucuuguugacccaguuacugcaucucauuccagacucugucauuaccuccaaaaagaaauccuauacuuaaugauagucgcuugucauacccucugccugguggccacuaugcucuguucuaaggauuuaccuauuuuggacauuuuguauaaguaaaauuuucugguuuuagcccuuuuauuuucuguaaugguuucuaggcgaaccaaguuguauauauuaguauccauuccuuuuuauaguuaaauaauauuccauuggguggaucucagucauuuuuuguuuaugcugaguuccccaguggauguuugggcucuucuuuuauggcuguaaugcgcaugugcaccauguaacacagcacugcugugacguuguauaugugcguuuuagaggagacguugguuuuacguagucaagaagcuuuaaagcaaguuguuuaccucaugauccugucuuuauuuuaaaaaugaugacuguauuggcuuucugggcguguuguuaauguuugugaaguuuggaaaauggugacugcagacacugauagcccauugugacagcagcccagucacuuggcugugucaguuugccucuggggaguguguggcaggacaggaaucuucuguguuucaucaggccuuuuugauuuccccugcagaugaagaaagaaaaguccaaauuggagcgaacaccccaaaaaaaugaucaaggaaaaagaaaaauuaguccagccaagaaggagucagagucuaaaaagugcaagcugacucuccuaaagaacaguccuaugaaggcagugaagaaggaggcaagcacgugcccaaggggccuggaugucaaggagacacauggcaaccgcaguagcaacaaagaggaaugucugcucuggguggauaaguacaagcccgccucacucaagaacauaaucggacagcagggugaccagagcugugccaacaaauuacuacguuggcucagaaacuggcacaagaguucuccugaagagaaaaaacauggugauuucacaacuuuagucauuuucugugugucugucaacauauguagugcucaguuguauucauggccaaaggcucaugcaugguucauuugccugucaucaaguauuuaucgaggcuuguugagugcccaagugcucuaggcccugguggugcuucugugaacaaagcaggcccuucaggggcccccagagaguggggagauuaugagccagcuguuaaaaugcaugugccaagugcuuuuguaggguaaguacagggagcuagcucuggggaugcugguguguagucaaggaagagggugugagcgcucagcccuggagcgaccuuggaguccagguagcagacagcugggcuaagggagaugggugugguauugggcuggaggaacaaccagugccagugucugaaggccugugagagagagaaugcccagggcccuuaaggaaacuggaagaagcugagguaagcacuggcacagugaccuacagccucauuacauugccauuugcuuuuggucugcacucuccucucugcuuugcaaagcucucgggcaguucauaaaugguuccuucugaucuggagugucugaaauauggugcauguuaaugcucuggaacuucucuucccuagcagcaaaguuuggcaaacuugccagcaaagaugauggcuccaguuucaaggcagcucugcugucuggcccuccagguguuggcaaaaccacuacagcuucucuugugugucaggugggugcccugucauagugcagugaucagcucgugugugugugugugugugugugugcgugugugugugucuguguuaaucuacaguguauauuuuucuaaagucaaacuuuagaauuuucuuuggcuuuagugguguuugucacuucuuuuuuuuuuuuuuuuuaaugcuauuauucuggcugggugugguagugcaugccuauaaucccagcauugaggaagcaggugaaucucgagguuaauucaaggccagccuagucuacauaguaaguuccaggacacaagucuuuuuaaaaaaaaucuaaagaaaauuaaagaaaaaaaaaacaaaccccaccuuaaaccuguuauugaauuggcuauuauaaaaacauccauuuucccuuauagguggaggauguguuacuaggcgcucaggagaugccguggcugcaggugguacagagcccugugcaccgugcccugcagcagugccacuucauauaguuagucugccuccuguguccuggcacccuccuugccucccccucuuacugucuagggccacgguacuggcugguuuuguguaaacuugacauaagccagaccuuagaaggaaggagccucagguaaggaaauaccucugugaaauccagcuguaaggcguuuucucaauuagugaucagugggggagggcccagcccauuguggguugggccaucccugggcugaugguccuggguucuauaagaaaggcuuagcaggacagacagcagacccucuauggccucuggaucagcuccugaauccaggauucugcucuguaugugucccuguccugacuuccuucagugauccacagugauauggaaguguaagccaaauaaacccguuccuccccaacuugcuuuucagucaugguguuucaucaaagcaauagaaacccuaacuaagacagccauuauuaaguaaggguuauuugaauacacccacuaugauacaggcagguggucugauacccuggcaugagccaccauacauagcuuaccagcugugguuuuaaaaccaaacuccucuguguauguguuguuuuaagaaucucuaaugcuguggggaauuagauuuguggccuuuugguaucauacuuaauuuuuuacucauguuuaaugugacuuuuggaaccucuguguuccuuaaucagcugcugcccaggaucauuugcacuguuauaauaaugauuuuuaauauuuugacuaggaauugggcuacaguuauguggaacuaaaugcaagugauacucggaguaagaacaguuugaaagcaguuguugcugaauccuugaacaacaccagcaucaaaggcuuuuauacaaguaugugcccuuuuugaacuguggcuauagaugugguuuaagaaaaacaagucacuucaguguucuguaaugagcacuccugugugguaaguauccugaggcaucaagauaggaaaggccuuuggcauaacucuucuggggcauuaguucugcucugugaucucagagguuuuugagacugggauagaaaugugugcauauacaguuuucauuuugugugugauguuggacaguuccaggugagucuuguaaaggagaacggggagagugaagugcaccguucacugaggccgaaagccugugugugugugugugugggggggggggggagcugauuguguacucugcaguaaaaggaugacuugauucagagagccuugaagaaugaaagggcccauuuauagcaagaaggugugaucacuguggaagguuguguuguaacuaguggucccaaaaggcugaguucauggggaaaugaagauguaucagguaaggauccacaugccuguggagagugccauagaacugcgguacuuuuauguuagaaguuaguuuuugaaagaaauugcucagaagaguccuccccccuucuuucuuucucuccuccuucccuccuucucuuucuucccucucccucccucccucucccauccccccacuuuuucugucucuugguauauguauguggguguguguggaugugagacgugugcaccucaccacacccaagauuuuuuauguguguucuaggguuugaacccagguucuuauguuugcaaggcagauacuguacuaaugggcagucuuuccauauagcuugcuguacauggcucuuggaaguauuaauuaauacaacucacuagcagucuggcauuuuuccucaagucuaaaucauacauaauuucuaaucuaugucaauucuuggaauuuaacugucauuauauuuuaauauguguagaaugauacaugcacacacagacacacauacacacgcacacauagacauacacacacauacacaugcacacacagacaaguauacacacacacagacauacaugcucacacacuuaaacacacaccacaugcucucaucauacagccaaauguacucucacauguagacacaugcacacauaugaggauauuuacauauuaguaugauauaaaagcuugagcaucuuaauaucuuaucaauaaacuacauuacuaugcauuuuaaaggagaauauuaaauuacauuaaaaagaaguguuuuggggauggacauuaccucuucuggugugcagacaaaauacccacuacauauaauaaaucuuaaaaagaagagaaguguuacugauggauggguggauggauggauggaaacagaucaauaaccaagauguauuaagugaaagcccacaagguacauauuuuuaugcacacagguuuuaaguauguauuggcuaucucuacauggacuuuagugaacugcugggaagagaguuugcuuucauggcuucacucuuggagcuguuggaguuuaaauguguguugacucuuacuguguucuguguucuuuccccuggucagguggagcggcuccuuccgugagugcgaggcacgcccucaucauggaugaggucgauggcauggcaggcaaugaagacagggguggaauucagguaacacaagcacuguggcuucuguuuuacugugggcuuuaauuaagaaaauaaccguuaugugcauggauaauuguagcaguugagagcuuuuaaaaaauacuaaaauauauugaauaucuguuauuuuauaaaaauaauuauccucauauucuaaauuugucuuuuaggagcuaauaggccugauaaagcauacuaaaauucccaucauuuguaugugcaaugauagaaaccaccccaaaauucgcucauugguucauuauuguuuugaucuucguuuccaaagaccucgaguugaacagauuaagguaugaugauuauaauuacaaagaauuuaaaaaaauuuugggaguauguguguucacaggcauacacgugcacgcucaugcaaugcaguaggguguacauguggagguaacagggcauuucugggugucaguucacuuauggggguucuaggaucagucgcaggcaccaggcaugaugggaaaugccuguacccaucuugcugucucaggguuccugucacuaugaugaaauacugacaagacaacuugaagggcaaagguuauuugccaggaagucaggaguugagagaggcaggagcugauucaugguagaugcugcugaauggcuugcccagccugcuuucuuauagaacucaggccaccagcccagggcuggccccaccuaucauagacuguacccuuucccauuagucacuaauuaagaaaaugcccuuccggcuugccuacagccugaucuuagggagguuuuugucagucaguuuuuccucuucucagauaguuucugugagguugauguaaaacuagccugcacacuagcccagaauauuuuuaaaaugacauuauuauauuuauauaaagguugauuuuuaacuuuaggcagugucagugcgguaaccagugaguuuuaccuaagauaugaugauugauaacugaaaacucaagggucaauuuuuuuuuucaaaacagggcuucuguguagcccuggcuguccuguagcucucucuguagaccaggcuggccuggaacucaauagagaucugucugccucugccuccugaaugcuaggauuaaaggcuuaagcaacccaacucaagggucaguuuuaaaagaaucucauaaauauccauagaauugcagaugcuauguguuaaaaaaaugucaaugacaauuuucuuguuuguuaauuucagagugcaaugcugucuauugcauuuaaagaggguuuaaaaauccccccuccagcuaugaaugaaauaauuuugggagcuaaucaagaugucagacaggugaguuagauauuuauuuuggggaaguuguuacuuuucuaaauuuaauuuuauuauuuuauguguguggauauuuugccuguauuuaugugacuuaccacuugugugucuagauuggcagaggccaaaagagggcaucagacucccuggaacuggaguuacagauggcugcgagcugcuuuguggguguugggagagcagcugagccagcuucuagcucuuggcaguugucaguacuuuagcugcccacucucgaaacuugcacaggauaggaaaagagcagccauuucucauccuggcauugucgucuuuguguuuuuucuagguuuuacacaaucucaguauguggugugcacaaaguaaggcccugaccuaugaccaagccaaggcugauucucagagggcuaagaaggauaucagacugguaaaaugaguuuccauuuuuuaguuauguuaugaaguugguguuucuuguccugcuuauauuagcuuuguagacauaauuaucucuugguguacuucuagagcucacagacuugucagaccuguagacagugagcuuuuuuucuagcauggccaucuuuauagacugaugaaaagggauauuuuaaaugagccccaugcuuccucacugagagcgauuuuuccauuggaccuucugcaugcauuuguggccuccgugguuguacuauugggaauucuauguuucaagugcguuaguuuaacuuccaaagcuagaggucucuaucucuugucucugcucugcuuuacuauccaaaauuauagauaguuagcuuuuuuaaaaaaagaaaugauauacuuuagauuuugaaguaguuuuaaguuugcagcaaaauguaguagaaggcacagagguuucccaugcaagccacuccagcguacacuucauuuagcauccugcaccagagucucagucaguaacuucacuagggcucauucuugacauugcacacucuguguuuucucacaggcgggcagugguguguucuaccacugcagaacuacaguaguuucccugggcucagacucggcauccuuaauuccuuccucuuuuuuuaaaaaaagguuuauuuauuuuuauguauaugaguacacugcagcugucuuuagacacaccagaagagggcaucagaucccauuacagaugguugugagccaccaugugguugcugggaauugaacucaggaccucuggaagagcagcagucagugcucuuaacugcugagucaucucuccagucccccuccuucuauaaccaccagucuuccaucuccaugguuuugccugagugccauguagugggaaucauacagugugcagccuuuggagauugacuucuuucccacaguagaguguguacauucaaggcuccgucauguccuuuaaugaacuguucuuuuuguuuguauggucuuuugagauugcauugcugguaacucacuugagcuggccugaagcucaguauguagcugaggcaggcuuugaaccucaucucuaagugcuaggauuacuggugugucccaacauucauggcugauauuuuuauuaaaauuguugaguccaaggccugagauauaucaguuuauuuaucauucgguuacuggaagaaguaucuuaguacuucuagauuccacaguugggaugaaagugcuagaacacuauguguaggauuuuguguaaacauaauuuuaggucauuuggaaccccuaaaguaucauauaauucuccucagcaggcagugaaggugccuauugcuccagcgucaucuucaccaguauuagguuuuggucauucagucauuuucugccccuuguuggcagggcccauuugaugucacucggaaaguguuugcagcuggagaggagacugcacacaugucacugauggacaagucagaucucuucuuccaugacuauuccauagcaccccucuuuguccaggagaacuaccugcauguaaagccuguggcugcagggugagcacugagggcagcaaggggcaggaucgggguucucuacaccacagagaccagagccuugugcaagcguggcugggaguggauaguaguguaacuagacuggcucuucucugcagaggugacaugaaaaagcacuugaugcuuuuaagccgggcagcagauagcauaugugacggugacuuaguggacaaucagauccggaguaagcaaaacuggagucuucugcccacccagguaaguguaguuggguuuguuguuauugucugucugucugucugucucucucucucucucacacacacacacacacacacacacacacacacacgcacgcacaacguauauuauuuauauauuauaauauaaauauuuugcuuauauuauuuauauuauauauaguaaauauauauaaagucugugcuuuaaaaauacauagagaaaauaucuguacuucaagaaugaggcaucguuuucucauuuucaaacaaacguguggauguaauugagaaggccgagugugguuacaccaaccugugauccagcaaaggcugacacaggaggacugccauaagucugagacugcucuggguuacagagugaguaccaggcuaaccaggcuccauaucaagacucugucucaaaaacaaacaaacaaaacaaaaacaaaaacaaaacaaacaaacaaaaaccagggggcauccuucuuggagaucuuuguuacauggacaaauaauagccccaacauucagagcugugaguggagaugagugguagagagcugucgcaaggguacacggcuuugggugcaugcacacguaaacacaccacaaaauuuaaguaaggauacuuuucacuuuuaauccuggcagaggccagaggcagagggucucugaguuugaagccagccagaucuacagagcaaguuccaggauagccauggcuacacagggaaacccugucugaagacccuuccucucucaaagaagaagaaaaaaaaagaagaaaaaaguuucccaaaacauuaguauuaguaggaaaauacugcagaaagcucccauauuugguuacagaaggaugcuuaauuauagucaguccucuggaugaaguauuucuaccuucuacaauuuauagagauuaucuaaagaaaacuuguaagaaaauacuaguaaagcaggauacaacacuuauggaaaguauaauaaaaacuuucaaaaaagacaaaauacuggcuagaaagggcauccaacguuacaccccuccguuuuuucuccgaccauccuugaaugauagauuauucuguuuccuuccuuccuuccuuccuuccuuccuuccuuccuuccuuccuuccuuccuuccuuccuuccuuccuuucuuucuuucuuucuuucuuucuuucuuucuuucugauuuauuguuauauguuaguacacuguagcuaucuucagacacaccagaagagggcgucagaucuuauuacagaugguuguaagccaccaugugguugcugggauuugaacucagaaucuucagaagagcagucagugcucuuaacugcugggucauuucaccagcccgauuauucuguuuucaacuaggcaguccauauuaaucucccuguguagucaguuucuuaugcuaaaugguucugugcugugagacuggcaacugagaaauggcagguauucugaggucaguuggucaaggucaggaugaccucugagauaguuggagaccuggguugauuggagucucuuccuauguucauuaccucucccuccacuucugugcacuggagugugugugugcguucacauguaugaggaggccuuauucaucgggugcuguccaccuugguuucuguuugguuugguuuuguugguuuuucucugagcagggucuuacuauguagccuuggcugcccuagaacucugaacucucucuguagaccagccugucaccugagaucugccugccucugccuucuaagucccgggauuaaagguguauacugccaugccuagcuuuuuucuuuuuugagagaagaggggagggagagggagagggagagggagagagcgagggagagagagagagagagagagagagagagagagagagagagagagagagagagagagagagcgagagagagcgagagagagcgcaugcacacgugugcucaugugugugcgugcauguggguggauacauguggaagccagaagaggguguugacuucccuggagcuggaguuacaacaggugguuguagccacacagcuacuuguacuggaaacugaauuugugucuucuggaagaacaguaagcacucuuaacuguugagcugucucuccaggccccaccucucccuccauauguuuacuuauuaaaguacauguacaucuauguguugugugugcaugugcauaugagugcagguacccauggaggcagauguauuugaucuucuugaaacuuugaacugcccagugugaaugcucagaacuaaauuaggcuccucuggaagagcaguacauguucuuaguggcugagccaucucuucagccccacgauaauagagacagugucuugauggccuggaacuugauuaggcuagggugaccugucauugagucccaaagauucucuuguuuccucccaguguugggguuacuagugagaguauaaauaaaugccuuuuuuuccccguggcuguuggggaucaggucuucaugcuuggcaaacgcuuuaccuaaacuuucuucccagucguuauuuuguuuucuauaggagaaauuucuuauaccuguaauuuggacagggagcuagcacacuguacucagacagugggcuguuucuuccuguauagacugcuuuuccuuuuucaguugcuauaacacacugcccacaaacugggugaaauuuaaaggaaaguuuauugagcucacaguuuugggagaugaagagccugugucugguagcuugcuuacggagugcugcgguggcacaaggcaucacauggcaggaggggcgcgcgcgagcacuguauauaugcuugaucucucuuccucuuacaaggcauccaacuuuuacucaggagagcucccuuguagugacauucucuacuacagaucacucugcauuaaccucaccuucaaaugcuacaguuggauuguuucacucuuuauaccucgcagugaggaugcagagcuuccaaagaaaucgccuuauaccagauuucaauucugacucuguuugauugcuuuuuuucuuuccucccaggccaucuaugccaguguucuuccuggagaguugaugcggggcuacaugacucaguuuccgagcuucccgagcuggcuggggaagcacucgucuacgggcaaacaugaucggauuguucaggaccuauccuugcacaugagucuuagguaagcagaagcagugcacccucugccauuuuguuaguaggugcauuagccuuuauagcauaggauagcaugugcuuaaaggaagguggguguucuaguuuuggcuuuguugcucaucaucugaaggaucucuccuaaguuccugcuguuuggccugaguucguccucuguuaucagcaugaagguuuagaagcagccaggcggcauuugucuugugaugggagacugauacauuuuaaguguguguacaucugaggucugcugguguuuguuguuuuuaguggaauaucuucccugcuucagaauaguuacuaugaaaaacugaaguguucauaaagaaaugaguuaguuuuuaccuguuuuacuagaaaagcuggccuggucaucugagauagggaacacgguuggcauguaacaggagaccgccacuuggauaacgaaagugaauacacuugaaagugauuagaaauucagaaguauuugaguuuaucacaguuuguuaaaguuuauaaauuuuuaaaaugugaaggcuuauaaccaagaaggcuguaagaaucuuauuuccacuucuggaucccagaauguuaccuauugguccagacccacccaggucccuggguaaugcugaggccauuccuguccugugaaauucuaguuccuacuaaagucccucuucuuagaucuuggcaacaguuuuuuauuccacucauagugucuguugcugcucuacacagaauggccacacauuuauugucucccugagggguuaccuaggugggcccaguggagucaccaggucuuuguaaaguagaagcugccauguaugucagggucauagagauuugaaggggcugcuuuguagcaugggggauggaggagccacuagguuguguugagcuugcuaggugucacuucgacauacagcuugugguuccccaagcuuaaaguaccuggacauuaaguuaccagguuugaagccagaagcaauuauaaaagauaguauguuaccauuagaaauauuauuuuugcucaguuauuuuuacaggagugacaauauuagggaggaaaaaaucauuuauuuuuuuguuuuuuuuuguauuaaagagugauuuaaauuuuuugguuuuuuuuuuuuuuuuuuuuuucuuccucuguauagcccuggcuggauuggaacuugcuauauagacuagguuggccuugaacucagagaucugccuccuacugccucuggaguaaugugauuaaagggauaucccaccacaaaguuauuucuugauaacauucuacuagcucucagcagcccagagccugcuucccugcuucuagguggcaccgaccauuucccagcucagcaggcgcguuccuugacguuuucuuggaguuagagggaaagccuuucucuagaugggaagagucagagcauagacaugaggaaguacaagggaggcguuuuuuguacaguugugucuuuuacaaucagaaaccgaaagauauuaaacacucacucacacaggaauggcauaugucaaagaaaaucucacugcuguuucccgaugccuuuacuauuuuggacugggaaggauguauuuggcuaugguaagggugagcacagggauguaauuguugggauguuggaguaagauggaaguuagugaaguguuugcuuucuagucacagagcaaagaaguagaaaacugccuuugagcacaguggggaggagugcuaggugucccacugaacgcugcuagguuugcauaagcaguuuagggugggcacagaagugcaugccuaguuuacagggucucucucucucuccucucucuccccucccucucuacucucucucucucucuccccucccucucucugcccccucuuucucucucucucucucucucucucucucucucucucucucucucucucucucuuucucuuucucuccccucccucucucugcccccuuucucucucucucucucucucucucugggucucucucucucucucacacacacacacacaaacacacaccacacacacacaccacacacacacacacacacacacacacacacacacuuucacucuguaaccuuguguagccuggagcucuuuauguagaccaaacuggccuuggacugacagcucuuccugucacuucuuucgagugcugguuuuaaagcaugcaccaucauacuuggcugaaauuuuuuuuuauauuucaguccauugauugaguggugcgaaugugucuauuucagugacucauuuugaagucaguauucugcuuguguuucucacuguguguguucacgugcgugcuacagagugcuugugaagguccauuugugggauaggcaugcaacucaggucacgaggcuugcaggacaaguaccuuaccccugagccauuuggcugcccuaagagcuguucuccuaggauaaaauacuauucauuaaaaggaccugugaaauaacuuacaugguauaaaaugacuacaugcuuaaaagauaaaaacuugagcugugccugauucacugguguugaugaucuaauguggggaauugggagauagggugccauucacaugauuuaaaaaauaaagauuuguguccuucuguuucagaacuuacuccagcaaaaggacagugaacauggauuaccugucacacaucagagacgcacuuguacgacccuugaccucacaagggguagaaggggcucagcaugucaucaaacuuauggacacauacuaucugaugaaagaagauuuugagaacaucauggaaguuagcagcugggggggcaagcccagugccuuuuccaagcuggaucccaagguaagaugcacugcccacuguccacgguccuuggaaauggccaugcugugcuagcagcgcucgagggaugugcuggggacuguagacaguuuguuccuccccccgaguguuugcuacuguccuggacaguggccagagaaggcugagaccccacacugccuuugugguuuuaucuuggccucaaauugagugcaaaggcgagaggauaagugugggcaguggggcgagccugagugugagcgcgaggcagggcuagagggcuaaaaggaagaauguguucacagccugaggguguuuauaaguuuuucucuuaccaggcuggccuugcgcgccuaauucuccugcuuguaggacuguaacugugugccacauuuccugucuuagucuaccugcugaccuaguguguguuccuggugcucguccauggaggucugucuguggugagcaugagcacccagugaugugacaugacaugugcuggagccucacuccucacacauggaugcacucggagaggacacucugugugugucacguguccucuggcuuacuggcuuccguuuacuguuacaguagacauuccuuguugggaugaagcuugaagcugagguuauuaaaguuacuuaguacuccgaagcaaccacuuuuaucauagcaaagaugaacagacugcuguucuuucccagagcuagagacagguccucguaccuucugcaaaccagacaugcacucuacugcugagccucucuccagcucacaagucacccaggcugaccuucaccaugcuguccuuagcccaggcaaccccagagccugcacucuucugccuuagccuccucagguggcuggcauuacaggcaugugcuacuggugugccagcugccaugguuucagucaagccuagcuugauucuuagagugagcucuuuuugacuuauuuuuugauucauagaccaaccacuaauucguuuuugguuuugcucuuuuugagacaggguuucucuuguguaguccggcugucuugaaacuuguucuguaaaccuggcuagccuugaacucagagauccaucugccuuggccuucugagugcugaggugugccaaccacuuugcugagccauugauucuuuuuuuuucccccacauuuuuuuauuagauauuuucuucauuuacauuucaaaugcuaucccgaaaguucccuauacccuccccuuacccugcuccccuacccacucacucccacuucuuggcccugguguuucccuguauuggggaauuuaaagguugcuagaccaaagggccucucuucccaaugauggccaacuaggccaucuucugcuacacaugcagcuagagacacaagcuccggggguacugauuaguuugaaccauugauucuucaucuuuuuuuccuugagcugugggcucaaaauucucaaauaaaauaaaaacaaauggagauguagcugagugauggugugguuuaguguacacgaucucggaacacacacacacagaccgucucuagagaagaaugaagguacuuguaucucuguuagguguguaccuaguuugcaaauaauuucaagggcuuucccaggcuucucaaaacuuggacuuaacugaugcucaggauugugcagcacucacaaccucucuucucuuucuuuaggugaaagcggccuucacaagagccuacaauaaggaggcccaccugaccccauacucacuucagguaguaaagacaucgaggcucagcacggguccagcacuggauucugaguacagugaggaguuccaggaagaugacacucagucugagaaagagcaggaugcaguggagacugacgccaugaucaagguagugcacucagcugugggcaggguaccucuucuucuguguaaagugccgugugaaaauaaggccuguucugcagguagcauggagagcuggaaauacaauuaugucuugcucauuuuaauugaaggugaugggauagguuucauuuuuuauaaagugaaguuauggccaucauaauucuguaggaagagugcauguguguguucaaacacaugugggaccuagaggucaagugucccucuauuccugucuacuuaguuuuugagacagagccucucagugaaccuggagcuugcugcuuuggcuagguagcuagccagcaaguccucagggucugucugugcauguuccccucucccuagcacugagguuuuagaugugugccguuauguagcuguugaggaucugagcuuaggcuuugaagcuggugaaaauaguacuuugcccucucagucaccucagcugccccaggagggcacugguuauaccuggccauuaguauaugcuuuaagccacagguguauuuuacagcguaaacagaacaauuuaaaccucuugcccacugcuguuucucguguuuuaugggccaucaaauuaucuauaaaaauuucucagaguaagacuuguuuugucuuuugcuaguaaagguuagauggggcauggaauccugagaccgggcacagccuccuccaccucacugucuuccuguguggcacgccuguuagacagacgugcuuugcaguuggauuggcuuucuuucucuucacaaaaugagugugcucagauguccugugggagaguaagaaagggaaguuccucauguagacagugccauguuuguaagucaccuuuguuuguucuggcuucccuaaguacucuauguucugaauccagagccuggcucacacgggguguaccuagcucuagaccugagcaauuccugugcuguugccuuucaggacgagagcuugcuugucacuucucagaggcagcgguagauacugugaccucgcuuuucuaauuaaauuguagggaaagagucugucggcgugucauuuacucagcgguauauuaacuguuguguuuccuccagcagaaaaagacaagaucuucaaaaccuucaaagucagaaagagagaaggaguccaaaaaaggaaaaggaaagaauuggaagaaaugaaaucacuguuuaguaccaauaacugcuguuaacuuacccucucggccaguccagcuggccuagagccugagagccucacccuuugccagaguaacaaguuugguguagcacagcgggguggccugguggucccauuauaaaggacgguacagcuagaaggucuaacuagccagcucuccugcaccucuuauagagguggguaggacuguuccagcccugcagugucccugccuaacuguuagauugcugggcuucaaagugacuguguagaaucaaaacuagaaaguacacaggcauggagucagaguuuaguuaaccauagcaagacgggacgcagugggcaucuuuuguagcuuaaguuuauccuaauggccuuuagaggaacaaugcucaauuuuuuuuuuuuaaacaugguaguuauuuuauggugaaauucuguaaauaaaucuuaauccaaagcagcuaccaccuggagccgaguauucuugguguauuaucagguauuuugcaaagcgugcaucaggaaucagauauccacguagcgcaugggucacugucaccuugaguagcagacuguuaugcuguauauuacuuuccuuauuaauuugguuggauuacaguauucagcaguucuuacuaacucugugaauugcaguucugcaggugaagggucagagcucaaauucccagcauccccuuguccugaccacauugcugcuauagguagucugagagaagccacuuggcuagucagggugugcacacaugggacugcuacacauuccuguccccaugcagucuuagccaucagguugaaaccaguaguggaguguaggcugggucagacccacaggcucauucuggccgggagaugcuguccugugauggagucuauaagcccuacuggaauuccagauuguaucuagaacugugcuuguugagggacccugggccuuggcuguaaccuggccuuuagguguuuaguucuuuuuaaaucagaaagugcucagaggucuaugcugccucugagagguauaugccaaaaagauuauaaaggaagggccaagcucugucuuuuugaguucucauggccuuguugggagaagaaacagaaguccuggagacauugaaaguguauuaaccagcaugaaagauguguuucguggaggucagucgguuauuauggaaauaaaacacugccuuaaaccugag

SEQ ID NO: 2474 - RNA, 3071 nt, Mus musculus
cggauuacaagaacgugaugacgaaagacguucucucuuugccccaucuacugcgaggugaggagcuuagggaccgggugccccgggaaucugaacccauccucuguuuggggaccccggcggcauggagccgaugccccaaggcuuugucccgacugucccccagcacgacgugcguccuugggacuugguggcgcgagcuggaaguggcguucgggcuuucaggcccaucucggucguagcccuuccgccauggcgcaccgagccgggcuuccuuacucuucuccggggcccccgguccaguccuugucccggacacaccuggguccuuguugccggcuuucguagcuggcgauucccguugggagcggaacgcugccgggucucggguguagagcgucccccgccccagccgucucacccgggugucuguguuucaggaugaagaccauucucagcaaucagacuguggacauuccagagaauggugaguagauggcuccccgccggccgcugacggcuuuccugcaugcucuaaaccccggccuauggucucaccaguucacuuucucguuuagucgaaaucacucugaaggggcgcacagucauugugaagggccccagggggacucugcggagggacuucaaucacaucaacguggagcugagucuucuugggaagaagaagaaaaggguaagaacuugugucuuccgaugcuucgggugcuugcuuguaacaaaacccgguaaccgauguuaaucccccaccccaugcguggccgaguggguuacucggacucaguucuuuuaugagugaacuugggugugugugugucgucccucugguguccugugcgugugacauacggugcauuuguacauggcuuugcgugcuaguacucgccagcuaaaagugcuguguuuuaauucuaaaguuguuguguuucagcuccggguugacaaauggugggguaacagaaaggaacuggccaccgucaggaccaucugcagucauguucagaacaugaucaagggugucacgcugguaagucagcccuccacucugcccuuuaacccuuuggaagagguuccuuggguguguauaaaugucuagggccaggauggacuguacuucuacaaaggaggcacuuucagauauuggggguggguuagcacagaucagacccaggaauuugcugggcaggcuccuuuacuucuguuucagggguuuuguuuguugguagauacauauaguggagauugcuggcugguauguuugggacucaauggauagaaaagacagccagaguuauacucugucucaaaaaaacaaacaaaaagaucugacuugugcaucucugaaguuacuguucuagauccuuucucccaaaacaguuaaugcugaagagguguuguuuuauaaacacaagcuguacuuuguauaccuauuggaucguguuacccuguugcuccuggggaggacugggccuuuuguuuagucuggagucacuuauuaucugguggugucuguaguaacuccacagaugccuaaugccaaaaaugaggaucuuaugcccucaaaggaugagauaguaaaagaaagcuuccuccuggagcuuugggaagauguugcaacuugcauaugguggguagagugcguguguuaaauuuccacgacaugacaaaagcaccuuagggcauuuagagcugacucuaaauucagccuggggaaacugaagaagaggaaucucaaaaucuaggccagcugaaccgaaaacuuugaguuuguucaggauggcucacaguugcuuguuugaugcagggcuuccgauacaagaugcggucuguguacgcucacuuccccaucaacgucgucauccaggagaauggcucuuugguugaaauccgaaauuucuugggugaaaaauacauccgcaggguucggaugaggacaggugugugugggccuugagggaugaugggaacuugcuacaguucuuuguccuugggucuggauggagccuugguguucggguguggugaagacuguugggugguccugagcuugagguuuuccugaagagggaguaugcugaaauaguuguaggaugcaucagccuuuugugggaucugggagucacauuugucaucugagaugacaggagguucaauuccaacccuaaagucuuagagaacuugauugguugcuugggguuuuaaauggaguuguauuggugagaugucucuccuguuaacgcuguugaauacacaccucuuucagguguggcuuguucugucucucaagcccagaaggaugaguuaauccuugaaggaaaugacauugaacuuguuucaaauucagguguguauauuugucauaacagacaguaacauuuuaucugagccuugagguugaaugugugucugauuucuguuuccaaacuucugagaaacaggaagaaauccauuguggaucuguuguguagguauuuguaugcugugcuuuguaucaugaguacaaaaugguugugugugcucugcucguagauguucaaauuggguggcacauggcuggcuugguugggaaaguauuauucguuuuuaugucuauauugggguguguaugccacugcucagaugagauccaaggacagugaaggagccccuccuguguaggcuugagggauugaguucuaguuaguugggcuuguaugagaugaauuuggcuauguacuuuuuuguguccuguguagcugcccugauucagcaagccacaacaguuaaaaacaaggauaucaggaaguuuuuggacggcaucuaugugucugagaagggaacugugcagcaggcugacgagugaggaggccucaggugggugcccaugucugcagcugacugcuucggaugagcacagugugauuaaaaaggauuaaaagaacuuucugagcaggaauauuggcagaagauuuuacauguguguuuguuuuacaguuccuggccccagaaacgagauccugaccacaugaacaauuugggcucuuuugggagaauaaaagacuuauauauugauu

SEQ ID NO: 2475 - RNA, 21533 nt, Mus musculus
cgagcuagucgagucgcgccggucggcgacgacguaucgcgucaugacucaagcgacgaguuguuggacgcguccggugccgggggugcuguucccucgaucccuugacacuccugagaccuaaaagagggggauggcucuacgcugcugggauacagcucgcagccuggggucccgggugagcggcgggaacgccauugcuuauccuaaguucaaaacuagggaaauuguuccagauauccuuuuuuuaaaagccccgacagcuguggcauaucuuaauuauugcaaacuuguugacaacauauuuuaguaccuguuuuaggaauagaagacaugaaaacguggcauguuaagucacccacuaagguuuucuaaccuauauuuagcgguuaacuuugaucugcgucccacuuuuuucccccauuugucauggcugagcgugcaucagggucucuguaaucuaggcuggccugaaacuaaauucuuagaccaaagacgacuccucacucugccuccucugagagcugcauuacguguuugagccgccgugacuuacgguucuuucaccuugagucuuuuucagguucugaucuacguaguuugagcucuuaaaucguuuuacauaauuucugaaucaauuucuuuagcuuugguauuauaauggguuaaaacuaaauuauuucagagucuacugagugaauguuguacugaacccuuuuuguagauauuuggaagauaugcguucacgguuagagcauuaaguucuuugccagauaagaaaaaggaauuuuugcauaauggaccagaccuucaagauuuuguaucuggugaucuugcagacaagaguacaugggaugaauauaaaggaaacuuaaagcgccagaaaggagaaagguaauugaacauuagauuccacuuugacuuugugcauuguuugguuuuguuuguuuguuuguuuguuuugguuuugauuuuuugagacaggguuucucuguguagcccuggcuguccuggaacucacucuguagaccaggcuggccucgaacucagaaauccaccugccucugccucccaagugcugggauuaaagaugcacugccuggcauugugcuuuuuuuuuuuuuuuuuuuuuuuuuuuuuucuuuuuuaaucaagccuuguagguuuuucuguacccuuuggccauuucuucauccuuuccaaaaugaccauuuuaugcugccauaucccauuuuauaucuagcaucuaauugagaaaguauagguuuuucucuugauaguuauuuuauuuauuuggguuuuuggagaugguuucccuauguagcccuaacugcccuagacuucucucuguagaccaagcuggccucaaacucagagauccauuuuccucuuccuccugagugcugcaauuaaaagugugcacaaccaccaccuggcuuacuuuauugauuuaugccuucauauaguuuuaauuguuaauggguauugaucaucuaacuuacucuuuuguuuguuuguuugagauggggacucacuauuuguucuuggcuaaccuggaacucucuauguaggccagacuggccucaaacucagaacugagauccgccugccucugccucccaggugcugggauuaaaggugugcaccuccacauccggcucaaacuuguuugcauguagccuaugauuccuuuaucuuaauuguuuuuuaaugacguaagguugccuggcaggcagaaggcucuggaugccagauuccuagcaacacaguaaacaaauaauaacagaagacugguguacagcguagucuucaaaaaugcuuaucaaacagcuucuagaucagaaguggauagucaaggaaaaucaaagauauagcuugcuuuccaaaggguaggccugucuuuuuuguuguuguuguuguuguuguuuucauuucuugguuucuuuuaaaucaggguuucaucuauauagucugggcuagccuugaaaucacuguguaguuagauuugaccuugaacuccuguuccuccuacagcaucacagaugugaaccacugaaaccagcaaacggucugccuuuauuaaugacuagaauuuagaaugcaggauaaauggugugcaguuggguuccuugcuugcccugaguuuacuauaguaauuuguagcauucauagggaagaguaugcucaaacccgaauccguccuuuaguuagaacaggauagcaauguacguuugagggucgguauaagcaucacaccccuuagacuccgguaucaggguuuccuaaagcaucuuaagcagaccugaauuugcgucuuuguucuaaucacuaugauggaguugaguuaguucagaaacacagaaaaggcuaugcugggaaacugcuagagcaaggugcgugcuuuccacugguugguaauggaccgcucucucuggcuuucccuaggcuaagacuaccuccauggcuaaagacaaagauacccauggguaaaaacuacaauaaacugaaaaauacauugcggaauuuaagucuccacacaguaaguggccaguguauuuccucuucguuuuacccaaugccuauacuguuucucuauauuuguaaaggauuuuuuuuuuuuaaauauagucucaugagguagcauaggcuggucugggacaaacuguauaggucuguuuguccucaaucuugugauucuccugcccuaacuuccugggugcuuggauuuuaaaauggguggugccagaugagaccaaaaagaaaugauugaugagaauauaaaguuuagcaaggaaagcagaugaggaugaaaagugaaguguuaucaacaguaauaaaagcguacauagacguguaggggccgggaguguaucccagugguguccuaguguguguaaaaccaagucgaauuuuccuacaagaaaaacagugguuacauuucuuuugcacucuuuggagacauaggcaguggauaauggcagugguuaagagcacauggcuggggcuggagagauggcucagugguuaagagcacugacaaguccugaguucaaaucccagcaaccacauggugccucauaaccauccguaaugagauaugacgcccucuucuggugcaucgggagacagcuacaguguacuuaaauauaauaauaaacaaaucuuuaaaaaaaaaaaaaaaagcacagggcugcucuuccagagacgcuagguuugauucccagcgcgcaugcgguagcucauagccaucucuaguuauagagugaaaccaacucuaguuucaggggaucuagcauucucuccuguuuugacacaaggcaugcaugugguucauagauauacacacagucaagaaaccuauacacagaaaauuagaauaaaaauaaucuuuuucuuucucucucugucuuuuuuuguuuuuuuguuuuuguuuuuguuuuucaaggcagaguuucuuugcauagcccugguuguccuggaacucacuauguagaucagguuggccuccuacauaucugccugcuucugccucccaaguguuggcacuaaaaucaugcaccaccaccacccagcuaauaaaaguaaucuuuuuuuuaaggauuuauuuauuuauuauaugugaguacacuguagcugucuucagacacuccagaagaggguauuagaccucauugagccaccaugugguugcugggauuugaacucaggaccuucagaagagcagucggugcucuuaaccacugagccaucuauccagcccuaauaaaaguaaucuuaagaagaaaaaacaagaacauuuaaaauaccuaguacuucauuauugguagauggguccuuucaaccugauguaucguuucccccuuucacaggugugugaggaagcccggugccccaacauuggagaguguuggggagguggggaauaugccacagccacagccacgaucaugguaaggcaaccuggucucuaccgcuuaguucaggcaugguacagagaugucgaugcccuccuccuacgaacguguacugugaacauccagugagacucuuaccacauuuaugaaauguuuauaaauucacaaagagagaaccuggccgucuugacacucguugugacuucacucucucugaauuaaucuguuauugguucuuccacauauuaguaucugaugucgaacucuuuggcgccuuaggguauauguuugcauuaacguuuggaaauauuuuucguacuuauuugcuuuguguauuuuuuuuucugucucaucuguuuaacaagugguacuucccucguaacuccaugcagaucugcauguucaucuuucaguugaauauauuuucaggcucggccagauggcucgauggguaaagucacgugccaucaagcccggucacccgagucacccacaggacccaccggugaaggagaaaacugucucccauaugccauucucugauguccuggcgugcucacacacauacauacccguacccauaaaauaaauaaaaaugucauuuaaaaacaaguauauucucagcuggguagugguggcacacacccuuaaucccaguacucgggaggcagaggcaggcggauuucuugagcuugaggcuagcuuggucuacagagugaguuucaggauagucagggcuacacggaggaacccugucucaaaaaaacaaaaaacaaaacaaaaaaaaaaaaacaccaaaaaaaccaaaacaaaacuuuuaaaaaucauuucuuguugauuagaguugugaggaaucuuuacaaacuaugaguaacuuguaaagaaacaauaacagcagacgacugauaccucugguuagaggcuagaacuuuggccucuccacaaacucuaccuugcgaucccauuauuucauuuuauuucuacuuuguuugaaacaggauuucuuuacuagcccuggguggccuggaacucacucuguagaccaggcuagccuuauauucagagaucugccugcuucugccuaccaagugcuaggauuaaaggugugcgccaccaccacccagcugaauuauucuuaauuuuguguaagugcaggugcauguauaggcuuaccuggcgugggugcugggagcugaacgugggucuucugaaagaacucuuaaacacuaagcuaucucccauuuaaauucugagacugagucgcacugugguacccaggcugaccuugaacucacgaucuucuugccucaacuucucaggugcuaggauuacaggcaugcaucaacacacuugacuuuaaguugaaauucuguuguuguugaugaugaugauggcgaugaugaugcuuguguacauguggagauguguggaggucagagaacagcuugguggagucuguucuuccugccuuuacauggggucugggaaucaaacucaggucauuugcuuggcaagugcuuuuccccacuagccaucuugcugaccccuuaaauuauaaaauuaucuguucccucuuggucccacccccuccaguccucuuaacacuuacuugaguguauccuuucuuuuuccacaucuguauuucuuuuuguuuguuuguuuauuguuuggguuuugguuuuucgaggcaggguuucucuguguagcccuggcuguccuggaacucacucuguagaccaggcuggccucgaacucagagauccaccugccucugccucccaaguguugggauuaaaggcaugcgccaccaagcccggccacaucuguauuucuuaaccagauaucauuuaauaucauuuaaucaugaauguuuuggauuuccuuuuuuuaaaaagauuuauuuauuuauuuauuuuuauguauaugaguacacuaucucugucuucagacaaaccagaagagggcauuggaucucauuauagaugguugugagccaccaugugguugcugagaauugaacucaggaccucuggaagagaaaccagugcccuuaaccucugagccaucucuccagcccuuuggauuucuuauacacagaaccagucugauuacauucuuugccauauauuuuuggcauuguauucuugggggucaucugccuacuugauacaaauugugacaucucuauucuaguugaugggggacacaugcacaagagguugcagauuuuguuccguuaagaccgcaagaaaucccccuccauuggaugccaaugagcccgacaauacggccaaagcaauugcagaguggggucuggauuauguuguccugacgucgguggaucgagaugguuaguagugugucacuguggcuuuagcuaaguuguggcacggcuugaacaguagcuucuuuuccuucuagauguggccgacgggggagcugagcacaucgccaagaccgugucaugcuugaaggaaagguacuugucucacauuuguugauguaaaucuugagcgcucucucucucucucucucucucucucccucucccucccucccucucccucccucccucccucccuccuucuuucccuuuccuuuuuuuccucugucuucuuuuuuggagacagagucuauguaacccuggcuguccugaaacucacuacauggccuaugaacucacagagaaacaccuaccuucugucucccaaauucugagauuaaagaugcaccuccacaucccacccagcccugaguuuuaguaaguuacuacuuaagagugguuaguugaggauacagcuuugugguagaauacuugccuguucaagacccuagguuugaugcuuacccccucccuccacgcacacagaaaacuaagcguuuaagaacaugcagugcugagcugggcggugguggcgcacgccuuuaaccccagcacucaggaggcagaggcagguagaucucuaaauucaaggccagccuggucuauagaguucaagacaggcagggcuaugcagagaaacucugucugggaaauaaagacaaagaaaccauguacugcuauuacagaaggccuggcuucacuucccgguuccgacagccauccuaacugcacaggggauccagcacccacuucuggccccugugggcacugggcauacacugaaugcauagacacacacgugcagguaaaacacacagaaaguggaaauaaauauaucucuagaagaauaaaaagccuaaagucauaugagauaaacaccaucauuguaaaauacgugucuggacaguuuucaucuuuaucucucuuaccugccaauuuuauucacagucuacguuaaaaaaauuuuuuuaaaucccauucauuuaaaaaacauuaaaaaggaacaaaguuuaauagauugguggcacaugccuuuaaucccagaguucaagagcagagacaggaagaucucuugaguuuaaggccagccuggucuacauagcaaacuccaggccagccagggcuacacagugagacucuggcucuaaagacaaaaggagcuaaaucguuucuggaaccuggugcuaguguagggucuagugagauaacacauaguuuuccacuuauaccccagggguuuuguuuguuuguuuguuuuguuacgguucaaaaauauauuuuguauuuuucaguucauaaaauuucuuucacaagccacuaaugcaugucaugugggauuuugaaaaagucaguuucagagucacacacugugaucuuugagcaucuuccguucccaaggagacguguagucuuuccuauauucucagggagcagcugcacgcugccuuuggguuugcaaacagcuccgugaccuaguucauaguacagagcuucacuggauaaacacagccaccauggaaaccagaagauuaauguuugguugguaauucauugaaaaaacaaaaaauaaaacucaugauucagcaaacucagaaacagcuuuuaaagcugagagcguggugagguuugccuaggggcggugagggggacggugucugaugaauuacugaggagagcaaaguugaagaagguggcauugugaccacagaagagacaucccaaucugcuuuccaaacaggaaaauaauaaggauaguaauuauguuuuauauuuugguuccuuuaagugauuuuguuuuuuaaucaucugcuccaauugggauuaaaggucaguuucuacuguugugucugcagguagacauccuggucauggugugcauacacugcacucuucugaggguuuucauggaguggcucaccuagggccuuucuguguccgagccuuccuuacaagguccaaggguugcggaaguacugcagccaauggugacggucugugugggugacagaccugccagcucuuguccucaguuuaaugcuuaccuuuccuccuaggaauccaaaaauccucguggaaugccucaccccagacuuccgaggugaucugagagcaguggagaagguggcucugucuggauuagauguguaugcacacaauguggagacuguccccgaguuacagaggugacugcccgucagugggucccagugcugugaccucccaccucacagcugcuccuuccuguccccgcuucuucugcuccuuucauucaguucuugcuucacaaauuaguagaaaaucaggaaugcugccaagagugaguggccaagggcuagagagauugcucaggaacuaagagcacacgugcuugugcagaguuccgggcaucucugaaggcagcaucacugcacgugcauugaauuguguuuuucccccacagaauacuuaugaaauggaaaaugauauaacagaaaaaucacuguguuaaaucuucuaaaaaguagacaggguagcugucggugacacugcccuauuaucccagagcuuagaagacugaggcaggagaucaaaaguuugggaaccagccugggcuauauauaccuuuucuuuaaaaaaaagcccagagugauacuguacgccuuuaaucccagcacacaggaggcagaagcagguggguuucuugaguuuaaggccagccuauccuacaauucaaggccagacagcuacauacaugccugucucaaaacaaaccccaaaacaaucaccccccccacauacaugcacacaaaacacuaguaugcucuagucuuccuauuaaucuuaguuguuaggaauuaugaagaacuguuauucuacauaaagaguauauucagauuucagaaaaauuaagaguauuuuagcugcagacagauuaauauuuuccuuuaacuuuauuguggauuuggcugugauuuaauuagcuacucuucacuguucugugucucaaaucuacaagaaguuacagugaaugguaccaagcacauuacuccuggauuguaagcauuccagagcacagcguuaauccagaggagaaauauuuugucagaaaugauucugggcugacuaaaggacucagugggugagcuguguguuggugagccagaugacaugaguucaaucccuggagcccacgugguggaagagaacuaauuucagcaaagcuguccuugguguccacagguaccauugugaguguuugcacacaugcacgcgcgcauacacacacacacacacacacacacacacacacacacacacacacacacgguaucuugcuaagugcaccccgcugccauccuagcccagcacacauguacacccauguacaagucaugagguugaggggagaggguugcaaguucaaggccaacaacauggauagcauuacugucucagaaaguaucaguuuucuauacugucaguuuuauaacauuuuuaaauugcuguguuuuaacuugcauuuguaugugugaaugugugcaugugugcaaggacacagacaucuauguacaagucaaagacagcuuauugguuguuggcuuuuuccuuguauauggguguguugccuguguauugugcacaugcagagccucuggaagccagaggccagaggaugaugucaguccccugggacuaguuguuagccccuugugguacuggaacuugaaccugaauccucuggaauagcagccaguuuucugaacuacugacccaucucuucaaaccucugccuuuuauuuaaauuaaaacaaacaaacaaaaauccagcacacaaggcugcauuagaauucagccaagugcugaucuuaccugaguuucugccagcccguugccuuucuucucauuuaagccauagugcuuuggccacuguugaaggguagcacccagccuguuccaacccuguggccauaucgccagcagugggugccagucucccugguuucacuuagaaaccuuauccagccagugaaaaucccagaaugcuuuuccucugagccugcagugcuauuacuugccaguagagggcaggccaaccugcaggaaagacaugcucauaaaaguuucaaaguggauguucccuccuuggagguuugucuugucuucugccagguuucuuuucuugcuagaggucauuauaauuuugaguuucagaauucuaauuucucaauguauaaaccaagugauuuuuuuuuuucuuuucgagacaggguuucucuguauagcccuggcuguccuggaacucacuuuguagaccaggcuggccuggaacucagacauucuccugucucugccucccaagugcugggauuaaaggcgugcgccaccacgcccggcaaccaagugauuucuagucugguuuucgcugucucaagacuugggaggccuaaagaguugacagacccaggaagcccggggaagagcgguuuucuuuuccauguuaauaaacuuugugcacagauguaccacuaacacauaugcucagugaaccguauacucuagagcaguggcucucaaccucccuaaugcugagacccuuuaauacagucccucguguuguggggaccacuggcuauacuauagucuuuguggcugucacacagugugguuuugcuacuguuaugaauagucauguaaacacuggcguuucugauggucugaggcacccugugaaaggcuaagcagcuucuucuagaaugugcuuucugagcuuccagcugcuugcacaacagugcaguugguugaacuuguuuugucacugagagccacccuguuuuccaggaaaguucgugauccccgggccaauuuugaccagucucuucguguacugagacaugccaaggagguccagccugauguuguuuccaaaacaucgauaaugcugggccuuggugagacagacgagcaagucuaugccacacugaaagguaaagaagcugaaaacaaaacccuccccauuucccugagugguagcaggagcuccauucuaaagagacuguuagcuuaugccuccuccauggucaucagugccgauggcccugagaacagagcaccugcugcaggugcaggccaguaggagcaccgcugccugcauguccaccugcugcaggugcaggcggugggagcacccuugccuccauguucagaaccagaaaggacaugggcacaaacggcaauaugugcgggaagggagccuuccuaggucauggaaugugugcauuuagcccucuucaucuucaccuguucagugaaaacaggauuucauccgcucuucucuuucugccuccagaugguuugagaggcaguuagguaccaggcauugguggguaaggaagaugcugaagccauggcuauagcuuagagguaggcacuugccuaccaaguacaaccaacagagaaggacucugguaugccagaggcuaagccacacucugagaacacauccugcucaccgaggaaaguccuaguacagcauguuuggcucagauaaaugcuuuugccccagaaccguaguuccuuugccuuuucuuuccauucagguagaguuggaguuguuaagaaaacacuuuagggcucaugagauggcucagcuguuaaggcuaggcucacgccgggcgugguggcgcacaccuuuaaucccagcacucgagaggcagaggcaggcggauuucugaguucgaggccagccuggucuacaaagugaguuccaggacagccagggcuacacagaguaacccugucucgaaaaaccaaaacaaauaaacaaaaagaaucccccacccccuggaaaaaaggcuaggcucacagccaagaaaauaagaguucaguuccuagcaaccauggcugucucuccagccaucaauaaaaaagaaaagaaaaagaaaaagaaaaaaauauuugaaugaaggcuuaaguauggggauuaagagagacaguaaaggauugucaggcuuggccguggcuucucaagaguccucucccuucgccuuuuaugccuaacagacuuccugcuccaaauccucuccuccuauuuuagcuuuuauuugauaccauuaaaugcacuuaucuguuuuuuuuuuccccccucugaaccucuugcgccaccagguccagccuuauauuuucccugucucccaguuucacacuccugugguaaucauugcuguguuuccaauucucauuggaauccauggcucgauguuuuugaaugaauggguuucucccaucuuguauugccuauaacugugacaacccacagcaugcaagucccccuuacaguacaccuguaauuguaacugaacgccugcuaaguggaagcuuugcuuuuuccccuuucagcucuccgugcggccgacguggacuguuuaacucuagggcaguacaugcagccaacgaagcgccaccuuaagguacaaaugucugaguugccaaauauuuucuuaguaauuugaaguaagucuuuauuguccacagguagaaauuagaaaccauuagcuuuguaggauaaugucuguguguuuguagaaguuuccgucuuauugcugcauagagcagcaacgcugguacuuacuguuacacaaacuguccgagaguugagaggugggagauaguacuuccugcauuuggugguccugugacuugguuacaguugccugagagacaaagcugacuuaagagaaggaaggcaguuuucuguuucuaugauggagcguuuauuuacuggagacuauuguguggaguaguaucgugugcuguagugagcucgggcugugguuccgugguagagccuagcaugugugaggcccagggucaaccccuauacugccaaacaaagaaaaguaaaauaugccaggauuagugcuaaacauaacauacaagcugaguuggucucuccucaggcaacuuauacgaggucuuggagugacauuaacgugcuugcagacugaggucaggucccagaacacacuuuuucccccuuaagucaggaaugguggaguaugcuuauacucccagcacaggggagacgaaaacagguagauuccuggggcucacuugccggccagccugaucuacuuagagucccaagccacuggggggccuuguagcaaaagaaggugaggaguacccgaggagcggcuuccaagguugucucuggccuguacacaugugcgugagcaccgacaaaagugugcaugcacacacaugcauaugugcacacacauacagacucuuauaggcacaaccaguucuggcuucuacuguuaauaaaugaagaacaaauauaaaugcucuauauucuuguuuucuuuacccuuuggaaaagcuaauguaguaaaaguguucuccuuccucucuaauuccucugugguuaugcucuaauagaacccaacacauaauccaacaaaggugggggucuggguacuacauggguauagacuuauauagaaucaaaaucacuaagaauucuggagucuggucuaaagugauuauuuacaucaagguugaagaauauguuacuccugagaaguucaaauacugggaaaaaguagggaaugaacuuggauuucucuauacggcaagugguccuuuggugcgaucuucauauaaagcagguaagcugacugcaggggguggcucuguucaguccauuaacucccacagccgugcccaucccaaagcuccagccaacgcucuaaagcaaguuacaauggcugugguugucucuuaccagggggauuaaaaagaggucuuccuuuccuagaaggucucucauagcuuugcuccacagggucauacuaaaaggcuucucuuuagcuucauuuguuucucauacacauccucgcuguucucgauaucucagccauaugacaagaacacacaccauucgcguaguugguuauuccaugugugacuuucaguagcggaucucccagaaacagagcauagcccaugugauacaguuuucauuugacaguggugccugcugcaucuccaugugcaucaaaagcauugcuucuugcacaguuaaucuccuuguugauccccuagacauaaaagggaaaacugaaaucauuuuaucccuaaacaacuuucuagugguuuuacuaacuuauuuuuuacuuuuuuuuaagacuuauuuacuuaucucauguaaguaaguacauugucacugucuucagaccagaagaaggcaucagaucccguuacagaugguugugagccaccaugugguugcugggauuugaacucaggaccucuggaagaucagucagugcucuuaaccacugagccaucucugcagccccuauuuuuuacuuuugauauguagcucuugcuuugguaagcugacugagcucauuuugaaaguauagacauuuuccaagggguuaaaaacucauuuggagcuaggaauguacuucagugauagagcucauccaagcaugcuuuaggcgccagguucaguucucagcagcacaggaagagaguaggaaagaagccggguagucaggcugcggggccagcauuugggaggaugaagaggaagcuguuccucccguucguuaacuagggucauccauugggauugguaaacuagguguuuaggauauguacaaaauauguuaauuuauuaauggucaucuaagggauuucugugugcacugagaucugaaucacagauacaaguuagaauaaaaaaaaaaaaaaaaaaaagaaccuuuuuuguuguucaugauacucagugugccugucagggagggaaucugagagcagggcauggcgguugugcucgaguguccuagcaggugggagggggaggucaggucguccucaaggccagcgugggcuccaggagacucuuguuuuaaagaaaaacaaacaaaaaccaaaaaaaaacccaaaaacacgauaagaaaauaaauuuaagauauucucacgaacaguuuauccuaguuauaaaagccaauaauuugaacucuaugcuauuucuuaaauaguaauaaaagaaagcaugaaguuggaguguaugggaggaguuagggggcagaguagagaagaauaugaucaaaauauguauucaugucugagauucuuuuuuuuaaaaaagauuuauuuauuuauuuauuuauuuuauguaugugaguacacuguagcugaacagaugguugugagccuucaugugguuguugggaauugaauuuuuaggaccucugcuugaucuggucaacccugcucacuccggucuccacucucucagucucugcucacucuggcccaaagauuuauuuauuacuauacauaaguacacuguagcugucuucagacgugccagaagaaggcauuagaucucauuacaggugguugugagccacuaugugguugcugggauuugaauucaggaccuucgggagagcaaucagugcucuuacccacugagccaucuugccagcccuaagauucugaaaauuaauaaaaauuacaagaauuugguucagcauugacuaacaggcugugaauuagaaguaagaguuaagcagaauggcuggcagguuggaauacauacaauacauacauacauauaauauauacauaaaauacaugcauauauauauacaugcauacauauacauacauacauacauacacauacauacauacauacauacauacauacauacauaggcuagaaccaguauuagcuucuagaaauggguaccuagaguaguauuuauuuuguuuuuugucuuuucuuuuuuguggugggugguuuuuaauuucuuuguuuauuuguuuagagacacagucucacuguauagucuuugcugaccuggaacucaucauuuaggucagacuggccucaaacucacagagaucugccugcuugugccugccugugccuaccuccaaggucugggauuaaagguguggacaggcauguacggcauaacgugauauuuaaaaggaaauuuccaacauuuauaaggaaaugaauuaugaucuuuuagugcuuuuaaagucacuacuaagagagagaauguugguguaaagagcauuggggcccagauggugggcuccagucuggugaccuuuguucuguguccaccagauuuaggcgaaggacugagcaguacagacuagaugcucaggaucuucgguaaucauaucggaugaugguggcgcucugauuguauuuguaaggugacagaggagcugauccaacuccucaugaaaugaagccuguggggccacucugcugcgggaagccugcgcucaucugaagcugcacugaauggagccuaaugggcuggaagggcguguacgccucagcacaggagcucaggcuccagcacaggcaacaaaagcucaucagggaagcagagcuuguuucccuggagggcgagggaguaagagauuccaucagaugagcgcuccgcugcagggagggccgcuuucuaagcaucagcuccaggcuaaagaugguggaacugcucucaugucagugaagaggaauagucagccuucaccacagugaggcaagcacgcagaaccagacccacgggcucagugggccgucuugcagaacauuuggguacuggaaggaauaauagcugagaguguagagaugaaacaaucccuauggucccugagcaggccugugcuguuacagagcgagaaagggcaggggagaugugguaauacauuacaaucucaaaaaacaagaaauuaaaccaaaaucacuggggaaaugccaaagauaaggaguacuuagacauagauagaaguacuacagccuuugaaaucugagaugagggaagugccuguguucugugugagggcgggauucugaaacagcagcuuguggcuggcuuuagggugauauucaugcauuuuuauuuuuccuaaauaggugaauuuuuccugaaaaaucuaguggcuagaagaaaaacaaaagcuucuaaaguguagccaagcccuucaagaucacaggaguguugcgauuuugcuuccaguuggugugaggauggugucacccugucaggauuccugugagugcaaggcagcaccguucugaagggucugauggcugaucgaagcggaaugguguauaccuguaauuccacccaggaaaaaaaaaaggaaaagaaaaagagaaaagaagaaagaaaagaagccuauaacccuguaaacgacacacauuuagugauaauucauggacuucuugcuggccuuuguccucauccuugucagugaugacuugaucacagaacagcuuggaacggcuugcuguugccauuguaauucaagucuaugaacauuuagaagaucuuauaaauuacaguaacccaugugaaauuucuuuucuuaaaaagauuuauuuuuauuugcguguguguauguguguguguguguguguguuaguguguuagaggaacacaugcgcacacacacauauggacuccgugacacauaauaaucuuuguaagucagccccaguguggaguugggaaggcucacgagcucccaauaaugucaguagcugaggaggggaggcggucuucuuuaaggguguggccuuugugugacccaugcucuagagcaguggcucucagccuuucucacgcugaggcccuuuaauacgguuccuaaaguauggugaccccagccaucaaauuagcuuuguugcuacuucauuaccgugauuuugcuacuguucaugaguuguaagugugugauacccaggguauugugacccuuacccucccgcuagggucgagccuuugugguccuuauggacacuuccucuuguagucauuacauacccaugcacucugcuguccacaaaugucguaaagccucugggccacugcuggcuccuuccuacucuuguuuuauugaauuacacagccccuacugguaccucuugcuacucuuaauuauaguggguuccuuacaaaaagaacauaccugugugcacaggauaagacaugaugguacacacuuugaaccucagcaguuguguggaagauugcagugaguugaaggccagccugggucaaagcccuuuauuaucuguccuuccaaacuggauguggacuuuuuguuguuuguugagacagggucucaugcagcccaggcuacucagacuggcugugugguagaggaugaccccugauguccuggcucugucccuaagugcugugaucacaggccugcaacacuagcuggcaaggaguacacucucacaccaguacuuggaggcaauggagaagaucacaguauuccaggccagucuagacugugcagcaaagucacccaaagucaccuuccuuaccugccucaagcaaucuucuguuccucauguuccuccugaacuccagaccaaacccagccuuuauuuuccugucuguugugugggcuaugagacagggucucacaguguagcaaagguuaucacagaacucaguucuguagucagggcuguccuggaacuccuggcaucugccugcucugccucacauuacagggagaaagccacuccacucugccuccugccucuuuuuguuguugcuaaauuuuaaaauaagaucuacuuuuuaaaauuauuuguauguguguuaucuuacauaauuacuugugugugggugcccguguagggcagaagcacugguccaagcaagccgcaucccuggcucccuaaccuuuauccuaaguacugauuuaugauuuacauggaauccguuauccacacuaccuacuuuacaauauagccacauaaaguuuccuuuguaagacgcagaguaaacaaagacaggauucugagucagaagauaaauugaguuuuauuauuuuagaaagaacuuucucaggucauggcuguccauaucacucugccucucugugccaguggacucuuaauaacauucuacuucugauauuagaguguucucagcagcaaggaagaacaucucuucaaacagguucuauuaaucgugggcauuuacaccgccaaacagcaagugcgugucagagaugacuuagugguucaaggaagccauuagaaaccaucagucuucaacuccuucucucgaguugcggcaagccuuguacuuuggauccucucaucuuggacacccaacacugacauuuacgccuguaccacuaggaccagcauauugauuuauuacuaaguauauaucuguguucguguguguguagggggagccuuaggaagaacagcagcaagugcacuuaaccacuggggcaucucucuagccccauuuguuuauuuguuuguuuguuugaaacaggaucucauagcccaggcuugucucguuauguagucaaggcuauccuuaaacuccugacccuccugcuaccaucuccaagucugucacuucacuuguaucucuaggauguguguccagaggagcacauaccauagagugcaguggaggucagaggacaucgccacggaaucgggucucuucuuccaccuuugcaugggcuucagggaucaaaugcaggcuuguguagcaaggacuaaaccuuguacuuggcucuuagcacugucucuuuucauuucaaaaaccauuuucuuuuacaucuaaaaaaaguuuuuuuguguguagaguaacugugugacacacacacacacaacucgagcucucgugugccuuacagggagaguggaagucacaagaaacuuguagcugguucuccuucuaccaugugguucccaggaacccaacucagggcagacuugguggcaagcaucuuuuuuacccacuuggccaccuauuggucccaaaaaacaaacauggucuuuaauucacacaauagaggaccaaaagaucucaaaucgcuguacccauuuaaauguugagucacauauuucuuccccaccauaaauagcaaauuuccuaggcuuugucuuugguccauuuucuuccauuugcauuuuuucuaccuuuugaaccauaacuguauuccacaauuauuuauuuuuccacucuagguacagcuguguccugcaauuaaaaaggagugccuaauuuuuuauuuucuugagacaggguuucucuguguagaccuggcugaccuggaacucacuuuacagggauuaaagguguguggcacuguuaaccgguguaggaguggcuaaucuuaacugcuuuaguaagaugucuuuggguuuauaauccuauugacaggcauauacagagcaaauucuaauccuuaaauuuaugcucaggagucuuacaaauaaggguuaauccuuaaaccaagaugaguucugauguuugcaaagcuuuucugaggggccaaauagccaaucguuuuuauguuuuguaggccaggagacaaaagugagacuguuguguaggaaauucuauaagcauuuaaaauguaacuaugugggaggcagaagcaggcggauuucugaauucgaggccagccuggucuacagagugaguuccaggacaaccagggcuacacagagaaaccuugucccaaaaaaccaaaaaaauaaaauaaaacaaaaauaagaugugacuauaggggcuggagaggugacugggugguuaauagcacuuguuuuguuucugaucccagcacccacaucguagcuuauacagcugcuuauaacuccaggcccaggggcacuucaauuucuauucuuccuuacucacacaguuucuaaaggaugagacauguaucuguguaacaaggcuuguguauccuuagugcacacagcaugaaauggaaauagccacugcgaaggauucaucaagagacagaaaauagagguuuguagauacgucuuggccauuaaagccacugacugcucuugcagaggaccaggguuugguucucagcgcucacacaaugguuuacagccaucaguaacuucaguuccaaggagucugaugccauagauagggaaacacucauacacuuaaaaauaaguacacauacaaaauguuuaaugcaaauggggaggcacacagacguucuuuaaacguauacugggcuaccuagguggcucgggggaugagggugcccaccacuaagccuugccaugguucagcccccaggacucacacugugggaugacauaacagauagauaccccagaguuucuucugaccuaaacacacacagaaaaaaagauagauagauggaauaaauguuuugaaaag

SEQ ID NO: 2476 - RNA, 92854 nt, Mus musculus
auauaguuauaauguaaacuaucuuuucccuuuugucaaaagggaagcugggaauuggucacacaauagugcuuuuaaauaguguaugcaaccagagcauaagcauggugguccccacuaugucucuaaagaagaaaugugguuugugugcugacaucugcugcaagaaagcuaggguuguagcucgggcaguguaugccugaccugugacagccaggacucaacacccagagcugccaagaauguuaucuguguauaugugcuucuaagauauccugaaagaucuaguguacuauacaguccauuuauuuauagcauuucagaacaucaaaaaugcuaauuauaccucaauaaaauuggagaacaguuuuaaguguauaauuccaugauuuaaugcaaagauuuccacaucgaccacaaaucaauuuuagaaagguuucauuauucauuaccgaaaacauggcccucaggagccacgguauccaucaucaugacaagcucucaaguugcugcauauacccauaaucccagguauuggggugugggggcaggaggaucugaggucgcucguaguauauggcugguuuaucaucaucaugagauccuauauuaagugugauucuugcacuuaauauaggaucucacacacucaugcccaucuguauuauuuagcuucuacugcuuaucuuccauacagcaaucauauuaagacaaaauagcuuuuaaagaaauugagaguaagcuauauauucuuaugaugcuguaaaagacuuuacauuccuaucagcucucagcuagcuaccuuucuccccuuuuuguaauaggagagaacugaguggccuuuaacuuccugcauagaccacuuucaaacaaggaauaaauacagugcuguuuacagagaaugacuuuguuugguauaauaaagucuuugcuagguaaugucaggagcaaaaggguuccaaggggagaaaggcaacaaguguugauaagggaagaguacccccaccugaaauccugaucaucaccuugggccagcaaccugagaaauuagacauucugccugugcuagaauuugcagccagacagaagacaagcaaacagguguuuauucucacacagagugugcuccugugugcacauagguuguuauucucaugagugugugccuguguacacauagguugguuguuaaucucgaagcucuggcuuuuuccaguguaaguauaagguaaaggcuuguggggcuagcaguuccaacucuuuagggguagaggcaggaggacuaggucuucaaguucacccuuaacuacacagugccuucaaggacaucuuaugcauaagacccugcauuaaauaacucuuuaacuacaugggcuggggguguuggagaguuuaaagauuaagagcacuuauuuuuugcagaggaccaggggucaauuccuggcccccacaugggggcuuacaacuauacuuccaggguauucaacacucuuuucuaaccuccaagggcacuaggcauacaugugguacacaugcaaucaaaacaggcauaaauucaagcaaaucuuaauaaaacaacaaccaggaaaggaacagugucagagaaugagugacagaaggcuuggcagccugagggcuacauuaccucagcaaguucaguugucagagcugguaagagacuuguuggaauguagacagagaagucugaucaauacacuggucccucacuauggacauugguugaggccuaugcucaaccuaccuuugagauauccuaccuuuguaaauguucuaggcccauaugaaagagugcagugaccacauaagacugagaccuguucugccuuauacuucauucugggaacgcugaucauagaguuuuuauuaaaacaaagggcuaauauauagugcagucuggagacuaaugaaaaaaaaaaaaacaguacaaauaagccccccuccccaauauucuuugccuuuagucuuuuuuagccacguuauagacuaucaagaggccaacuaugggaggcaucagacauagauaggcugauggccucucuuaaccucuuauucuauccgaaucuuagacaucgguucacuccgauuaaaguuauuaaacuaguauauaauggucaggcggugguggugcacaccuuuaaucucagcacucgggaggcagggaaacccugucucaaaaaaaacaaaaacaaaaaaccuaguauauaauguccaccauuugugacacagagaauaguaggaaacaaugaucaucuuuaagaaacuuuggcaaagauccaucagaauugaucccccuguacugucacugugagcuacaucagaggcuugaaaaauggaaagugcacgauggucccuucaucagcccuucacaugggcacaugaauauucacguuuccacacuucuacauaaugcugcauuucuugguuuuauuugaaacagugcauauuuuaagcauuuuauggaaggauuuuacacuugucauuuacacaaauuacaagguucggcuuaaagucuuuaaaaaaauucuaaaaauccagcccaugugcagcacaagaauaugcaaaacuacuuuacaguauacacacuuuuuaucaaaggagauacaaaauucuggcuuguaguuuuagacaaauacaagaagcuucaaacuagacacaaaggguuaacauuaauucucaauuuuaagucugcacuuuuguguuguauuucucugagauguaaauaccaaauuccuaagagauuuuaacauuuucuuuuucaaagaaaaccugacacauuuccaguaaacaagucccucucaauuugcuuaauccccaaccaguuuacucuuggugccagagaccaggcacucaugaggaacagacccugacaguaacuguuucaaugcaaaacuccaaagagcuguaacagaugugaacgcuucugcuguauucugaccagugcccuuaacauuuaggaaccuucuuccuuacacugugugacuaacugcucaacauagaguucacuggguuccagcaaagaaguuuugguagugacaaacugguggcccuaagucaaacuuguaaauagaauauagcacugacugaaugagggaccugacugacgguaugcauagaugcucugucagcagauuggaggcaacaggaagagcagggcuuuuacgcccuuucaagaaauauuguuucuaucauugguauucacuguucucuagccaucuucugacaccuaaacauguacauguaaaauacuuaaaagaagcccaccuuucacccagaaucaauuuauagccaacucucacuuaucuaugagaaccuaauugacauacuaucaaagaauuucauucuggagaguuuugauacuucagugauuuuacacaucccagcaagaccaagucauaaugcaaacagagcagcucgucccacuaggauuuuggguacaagccaagcagaaacaguggagacaggcaaaacaccugaggaggauaagagaaaauuaauuucaaacgucuccucauucuugcacauguccauaguccuacaaaccgagcaccugaggcacagucacuauuuuacauagauaagggagaguuggcuguagucauguccuucugugacuuuagcccuuucacauaaaaauuccuaagaaagcaaagcaugauaaaaagauaagacuuacauaagacaucuaaaagcauuuauuuuaugcaaaaauuaaauaggauuaugugcacagaaauacuguacacaguaucuaugcugaacaaugaaugccaaggaauacaauauuguaacaguugucuguaaaauaaaaauaaaaacugagccccaauuaucagacaaaaauaaaaggccuauuucccaacagcacggugccagacgucgagagcauaucucugucccucacaaagcugccaguguccaucuacugauaguuccaaaaaaacaaaacaaacccuaaaaacaaaaccaaccuuuuuuuacauuaauaauaaaaaucuggugacaauuauaaaaccaaauccuggacagucuuuacucccugaaaacccaauuauuccaucauaaucacaggaguaaaaaccauucuaaacugauaugccuuaugaaacaauauguacauuuauugcaaauuauauuaaacuaaaaugggagaaaucauaauaugaaguguuuacuacuugcagaucaauaauuuuaauuauuuucucauucugauaaaaaucagaaagcaacauuuauaaaauugccacauuacuuuucauagcagggaacagaaaucuguacaucucauuuuuugcagaaaaguagacaggcagaaagaauaauacauaaguuuccaaaaggaaaacgaagaaauaugucaucugcucucucgcuuguaaagccucaguucaguagacaccugcucgccuguguggcacgggguucugggcucuaggauggaccaguucucagcaucagugaauggacgcccuguuccucucuaaaaugaaaucugcagcauggaaaaaaugguuacuaugccuuuaaguuccagauaugcaggaccuggaaccaaguguuaagcaauuugcuuaauuauugacuuuucccaggaaaagucugggggaggggaagaacagagaugcucuuagccucucuagagucugcuguacauuucaccagaggacuuaggcuguguaaaaaggaaggcuagcuucguucaguuuucaaggcagaaaguguguauuugaagugagcuucguuuucuguuuggggacauuggaauccaaguuuuuacagaaccuggacucugcuucuguuuggccuucguuuucuccuuuuaccuugggaacagaagaacacaaaguuagaaccaucuaaguuugugaaauaaaacuucauuaagcuacauaaaacuaaagaacaauaugcaaguuucuauucgauagccaaguucuguggucaagacuaaucuguuuaaaaugcuaacaccguucaucucaaaaaacuacagauuuucaaucaauucuuucaaaaaugaaauuauaggacaaaauacuacacauuagacaguaaauuuacaaaaaacaaggguauauuuugaugggggggggagaaaaagaaaaaaaaacaacaacaaaacaaacaaacaaacacaaaaaaggcaguccagauccuugagcuccucaaagaccuacacucaaugugcuaggcagaccuaaacaagacugcuacucauuacccaagagacacucuuuaaguucaacuuuccuauaaauacuaaauaugaagacuguccgccaccguuuugcccauuaguugaacgucugcugaucugucuccaucuuggaggacuacaggcauggugccugaugccuacucucaugcugagggucaaggccggaucucugugaaugccaggcaagcauccaucauuguagcagugugugagccaccuccacugauaugaauaauuucuuccuuaauggaugaaucuggacuggaguguaagcaaaacauauuaagaaucagugauauuuacuagucuuuuguguuuauuuuucacauuuuaaaauucauucuaauggccagaaagagcuuggugaguaagagcagaggaccccagguuuggccuccaacauuacagcugguccucuguacugugugggauguggggguaugcagucacacucaguuggcaggaaguuccuuuauaggcugcaccaucaguaccuuguuucugaauuaaaaaaaaaaagucugagaacuagccagccuugaacucagacauuugccuaccucuggaccucaggugugggaauaaagguaugagccacucuugcugacuuuuguuccuguuuuuuuuuuuuuuuagacuggguuuugugauguaacucaggcugaccuggaacucacaauauuacuuucaaugcagaacuuagugaacagugugccuuuagcuaauaguugcaauacacaauagaaaguaauucaacuaaagaaacaucauccuggagcaguuaaacucacagccaagacagacacccgcugcuaagacacuguggcuuuaccugaccgcggcgcuaucauggcugagucuuagagauguuccagaggacaaacuauucuacaugcagauugaaacaaggacaggacacuuacugguccucauuuacacagugcuguuggaaaacccuccucugaccuauguacacacaugugcguacaaacgcaugaauacacaugaacacacaccccacagagacaagcacacaugcacuguagaauggcugaggaggcggcucauagauuauggguacuuccugaggaccuaacuuacagccacagcagaagcuuacaaaugccuguaacuccagcuccaagggauuagauacuuaaaaaaaaaaaaaaucaaucuguuuauuuauuguauauggguacacuguuguugucuucagacacaccagaagaggucguuggauuccauuucagaugguugugagacaucaugugacugcugagaauugaacucaggaccucugaguuacucggucacugcucuuaaccgcugagccaucucuccagcccaauuagguacuuuuuuccugacaucuguaggcaccccuacaucccuacacgcauggcauauagauagauacacgcacacaaaauaaagaaauagaaaauacaaaaacagcugggcgugguggcgcacaccuuugaucccagcacucaggaggcagagacagguggauuucugaguucgaggccagccuggucuacagagugaguuccaggacagccagggcuacacagagaaacccugucucgaaaaacaaaaaacaaaaaaaaaaaaacaaaaaaaaccccacaaaaacaaacaaacaaacaguacaaagucucaaugguuaagagaccuggcugcuuuuccagaggacccaggcucaauucccagaacccacauggcagcucacaacugucuauuacuucagauccugggcaugugacauucucacagacauacauacugucaaaauuccaaugcacauaauauacaaauaaauuaaaaauaaagugcauggucacccuucagugcaaggccaggccaguuaaugugagacucuuaaauaaaacaauagggcuggagagaaggcgcagcaacugagagcacugacuacucuuccagagguccugaguucaauuccaagcagccauauuaauuaaauaagcuaaacaaacaaacaaaccaaaagaaaacucuuucaggugaguaaggugacaccugcuuaugcacucaguauuuagggucagagcuuugaaagaugagaauucagagucauucuagaucacacaaugaguuugagggcauuuuuuuucccuaaauaaaaaguuggauaugguuagucacgacugaaagucuagcauuugagaugcagugaaaggcaaagugcugugaauuagaaccuagcuugucuacaaagggauuuccaagcagccaguucuauaaagugagacuugguucaacaaaauaaguaaaaucaagggggucagaaacaauacaaggagaaaucacacaacacugaacacggacgguguaaaagauauuucaaaauaacuuacucagaaaagaaacaucugcagcuaccauuguuagcagccuacugaggugggcaugauuuauuugcaauaauggccacacuuccuuauuccuucaguagggcuguacuaauacacuugcaacaacuuucccuauuacuaguauuauuccuaauauuaaacuuaaacacacacuauaucagacauuauaccaguggcuuucaacuuuccuaaugcuguaacccuuuaauacaguuccucuuuucuugugaccccccauaaaauuguuuuuguuacuacuucauagcuguaauuugcuguuaugaauuguacuuuuacccguaugcugagagccccacccgacauuacagggaacuaaucaguuuuaccauugcuuguuuuuuuaucuacucuuaugucuuacuuccccucuuuccuuugguucuuuucacuaaaccuuaagcugggggcuuuucuuucucuauguaugcucugaaugaagcuggcuuagagucuaguuuaaaaugggauuauguuaaauuuuugauguuuacuuaacaguuacuaaaucuucaaaggacaguauuuuaggaucacaacacacugcuuugaguuugaaugcacuaacacacacauggagcucagcaucaggcuucacucacagaagucuacuagcauuuuaacagguuacauagaccugagcucaaaacggaaaacuaugaaaugcuaaaaagagacgcuggccugaggaagaugcgugggagacuacauaucagcucuaggggaggggugugcucaagaauacagacccguuacaaauaucacaggaaauuaccuucuuucucucucuacccuucucugucucucuauuuaucucuuguuuuucaagucuuauuuacguagccuagacuggccucaaaccggacacgggugaccuugaauuucuaugugucacaguuagaaggugcugggaacaaagccuaggacacagugcacaagaggcaaaccauucuaucaacugagaugcauucucagcuccuauuuucaggacuguauauaauaaacauagcagcauaaggcaugguggcucaugucuacaauccuagcacuugagugaccaaaccaaaaagacugcccagaguuaaaggucaguuuucacuaaaaggcgauuuccaggacaucguagucuagaaugagacugugucucaaaacaaacaaacaaaccccaaacaacaauagcaucaacaaaauaaaaacaacaacaacccaaaagcaaacaaagaaaaaaaaccaaccaacaacauuaaaaaaaaauuacaagugccaaccaggcaugguagcacaugccuuuaauuccaguucuuaggaaggagagacaguuccaaggucagcauggucuacaaagugaguucuaggacaagcacugcuauaaagagaaacacugucucaaaaagccaucaaccaacaaaauaaaaaacaaacaaacaaacaaacaacaaaacaagaaaaacuauaaaucucugaaauaucaauccaaaaugauucugcuuuccagaaucagagaauauaacagucaacucauauuuuucugugaaguuuuuuuguauauuauucacaccaggguauaaugaccaucaucaccuauuuccaccuucccagcaugcuuagcugaaacuuuauacaugcucccuaaggucugucuguccccuuagucuccaagagccacuccuaaagaauccuuagaggcugcuaaucacaggcccagcugccacacaacacacaugaggacagagcaggaggccugcccuagauucaaggcuugucaucaucaucaacaacagaaaucuggacuuuugucaacaacaacaaaaauccugauuuuuguccuuucaagacugguuuauuuaauuuugcauaaugcccucaagguccauccauuucauagaauauucagaaugcuauucucuuucagaaguaauuaaaaacaggguaauucuucuccucuaucucuacccuccuugcccucccuccccacuuuuuaaagacaaagucuuacuacacagcccagcgugguuuuaaacucauaacccccuuucugccuccaagggcugggauuacacgugugcaccaucacacucauuuuuuacauuuacuauauauagcaguacacauaaugaagaugcuuucuauuucccauacaauggguaauguggggaagcccgcuccgucagagccagaguccauccuacacugaguaucugcuauugccagccauucccacugcugacaaggugaggaugaguggggucacauuaccuuuguaaaucaauuugucucucugcuggaacugccuuuuuggcuccaucuuguagcuugggcgcuuuggcauucccugccuccagacucuccuggcugccugcagcucuuuuccuucccuugcuaacagguuuauuuagaucaucguuuuugguugcauugcccugagauucagauuuggggcgacguccucuccgggguuuggaaggggcaggcgguccugacucaucuacuuucucgucuggcuuuuggauauucucugcaccagcugcuguuacaauucuuuucuuuccucugucacugcugauguugccuuggguagacugaucagaauuaauuuccuaaaagagcacaaaaacaaauuuguaaacauaaaucccucaaauguuauaguaaaaaagauuaugaauuaaauaaacuaaacugauaguucuugauucuacugucuuucccucugcugcgguuuuacagauacacaugaaaccuguagauaauggcuaaguuuugguugugcagcaaaugcucuuugccuuucuagcucuuagaaaguucuuuaaacaugucauuacauguuauuuugugugugugcacuugcguagaggucgagaaccacuugcagggguuagcucccucucucugaccauaugcgaccugggacugaauucagaucaucagguuaaccauugugaguggagucaugacaacaacccccuugacaguguuguaaagagguuggaacacuaagguuucugauuaauugcuuauauuacacaaaaaaguaagcucccaguggauaaggcuagccgugcagcccaccuuaguuguguguggguauacagcacagaagaggggcagaaagcaccuauggaccaaaggaagaggggaagugcucucagcucuugaacucacugccccuaugagcucauugcacaagaucaggcagacaagaugagagcagucgggugagcagcacugacuggacucaaaagguuacaaacaaacaaaaugcuccacuccaugaaagguaacacccacacguggcagacacacagacaccaguaagacucaaagacacucuacucgauuuuccaucauauuccuuaguuacuuguuuacuaaggcuauucucuaaauuuccaugaaagggauauuuucauaaugcaacauagcuuuauuauacaccucuagaacaaaagaaccucuuuuguucuuucuuauuagcugcugcauuacugaaguuuuuuaaaaugugaaauccauauuuaacccaccguuacuacauuuuaaaauuuagcauuagcccaaguauaauucuacaaguaacaagaucccaugucaucaaaacagguaccgugggcuucagaaaaagcaguaacaggcgaaaugaaauuggccuucucacaggaacuuuaggaacaaauuauaauuuuaauuguucuaauucuauuuaauuaaaagcaaagagaaguuugacuugacauacacuaugaccccaguauguggaaggauguggcagggaauggcuauaaauuugaggccagcaucaguuacaaagccaaguaccagauaagcccagauuacauauugagacagcaaagcaaaaaaauaaacaaccaacaaaaaaaaacaccaacaaauagaagagaauggucacugugcaaggaaaaaaaauaugcaucuuuucaaacuuucauuuucccagaaaaacaucuccagaauggguggggcuuucuugaaguuucucuucaaggaugggcaauccaaggccuucccuauagcaguccacagaaaccgcacccaacaacucacaguggcucagaaaaggacuagacauuaaguaacuggaagaaacagggagauuccuggggaaaacaaacucugucagucacacagucaauguuuuuauuaacuggggauuuagagcccuagaccuggguagguccucuauggcugagcuaagcccaaacccaagcaauauggugacugguguguaaccucaacucuugggaggcuggggcacaaagauuucagguuugaagucaaucuuggcuauaaggcagauagacccauaaggccacauucacuuaugcaaauuaggugcacaugcauguguaaggaaaccaaguaaauagaaagauaaaugugggagacaguucugacaaugucucucaccugaauccauguggugugaguucuuugagcauucauuuuuauguuacuaugugacacacagagcaaauacaaugauuuuuuauaaauaugcacagcuaaguuggauguaguggcauguaccuauacccuuagcauuugagagauugaggcaugacgauggccaugaacucaaggacuugaaauaguaaagaccugggcaguugugacuauggauuaagacugucucaaaaaaaauccuucaccaagacaaguaauaacaaggccccaugaauguacuacaucugacuacuguaaguauaugugacccaaugucuauagcaguguauguagcuucaguuucuuuaugcccagccuacuuaacucuauauagggaucccauaguaagcagacuuauuucuuucuguacugcaagaauuauggcagugagauaguccugauuuuugucuaguaauauguuauuucaagccauuccuacuuguaguaggagaugagcuaccucucauuaaacaaguuaauggaaaguuaaugaaggcagguaaucuaaaucaauucaagucgaguggcagagcacauacuaaaacaagaucugacgcaucuccuaucguuuagcuuuccugcuuucuucccuguuaaaaacacuaguaaggaaugggaguggggcuccaugagcuaguuuagggcuuagaguacuuguuacucuugauaacccugugaaaugccaguuccagaagaucugauacccugcucugaccacugugggcacuugucacacaugugguucacuggcauaugcagcaaaacaaucacacacauaaaacaagauuaaaucuuuuaaaaaaggaagaaagaagaugaggagguggggacuaaugcuucugaagaggaccuagguucauuccuagcaccaacauggcagcucacaaccacaaaugcaaaccccaagugcccaaauucuucuccuggcuuccauaaaaacugcaagucguucauacauacauacuggguaacacacgauggauggauggauggauggauggauggauggauggauggacggauggacggacagacggacugauggaaagugaaugggugaacuggaugcuccaguuugaacaucacgaacaacaugucugucaccccagcuaucugguggcaggaggaucacgaguuagaagcccccugugcccacaggaagacugaggacaugacucagcacuacugacacugagccccauucccagaacauaagccagaaaaguuuauugaauggcaagcaucuguaagccuggguccagccagccucgaguaaguugagcaguacaaacaacaagagacuuugccucaauaacguggaaggagagaaaugacuccuuaacauuauccuuugcuguguaggaaaggaacuuggguccucugaaauaucagcuaguacauaacugcugagccauaucuccagcccugucuugugcaaauuucagagauauaaacaauaaaauaacauuuaccuuauucuuuacaguaucaauauucuuuacaggugugacagaaauuauucucacaggauucuccucauuuucacuaacuccaguuucugaugccucugaacucuguucccuacuagaaagacagacaaauaaacaaacauaaccaaaaccaaggccuuuuaauuucagaaacgaaauaaucaauuuuuauugacugguuauauuacuauauauccacuugccugagagaccucacugguguuuuagaaugcauuuugggaagugugcuauguaauuguggcauuuaggauuguaauuccaguauucuagaggcugaggcaagaggccugccacaagcacauagccugacacauaacaaggcacuggaucaaaaagcacucuuuaagcaagguauagagaugugcaccuugaaucccagcaccugagaagcagacgcagaggcaggugaaucugaggccaaccuagccuaauaucaaguuacguggugagacccugucucaggaaacauacacuacacucuugagucucauuaaaaaaaacccuaaucacaugaauauuauaauacuuuuuuacauaaguccauucuaugauccagugccuugaaaauaaguuaaaauguuaagccaagcaagcagugagcaagaaaacaagauguauucagagaaaaauaaauugccuugaacgacuuccggcugaaggacucagcucugaauuggcguuaauauugcuuccagucucugugccggcgcuucuaacauaaggcuuccuucccguugcugauaaaggcuuguucacuguaccuaauacuccaguaggcuuuggcugaggaaaaaaaaaaaaaaaaaaaaaaaagaaagagaaaagaaaagaaaagaaaagaaaagaaaagaaaagaaaagaaaagaaaaaccacacacuuguuauuucacaccuaagggaaaggaauaugaaaaauuuuagagagcuaagauguguuaaguuguucuguuggaguguuaucugaagugauaauucuggaaaaaacaaacaaacuaugguucuuuuaauaaaagcaaaagcaaauccauuaacuuuacuuaaggcaauacugcuaucucuuuuuuuaucuguuauuucuuaauugaaacaaaauauaccuccaaaacauagaaauuaaugacacacuuaacuuaguagacuacugaauauauacuuuuauaucaccuuacuuuuaugaaauacaaucuuccuaucauuuuagccuuucauauuaaucucuuuauucuccuucccugagucucuccauguagcccucgcugacucuguagaccagacugacagagauaaaucuaccuuccugagugcugggauuaaauucaugagucaccaacgccuggcuuguuugucauucucaucuacuucuauuacuuaugaaaaucugcccuagaugaauuuuaaauaaauuugagcuucucacuacuuuaagauuaaguggcaauucugaacagugguuaauugcagaaaagaucugagaauaccaacacacaaugcauccccacaacccuggggcagaaagcagaaagaacacacauuaaacaaaaaccccaagcaauuacguauacaguaccuuuccuguuaacagaagaacucuugucucuucugaaauauagcuuuugucauuacagaaguccuauuaaaaaaaaaaagaacaaagccaagcaaagggagcaguguuaucaucucagugucuccagcucggcgcugcacggccaugcacucugcucacacacugcugagacuagacaaaggcaggaggugugcuuuccacuccauggugcaacuucuauacagagaacugcacagccuuggcaagaacuuucuggagacaugauauccuugacuuuucacauuuuuaauucauuaguuuauucguuuugagacaugguuuuuuucuauagcccuggcuguccuggaauugacuauguagaucagauaggccucaaacucacuguugugccuucaaugugcugggaauaaaggaaugggccuccaaaccagcaacaccuauuuuauuuuuauguauaugaguauuuugccuccaccuguguuaagugcaccaugcguuuauugugccugagaaaucacuuaaauaaacuucauuccuaguuuuucauauuguccaaaguacaauuaccacccucuaauauauuauaaaaucuacuuuucagcugauaaaaucaacaauauuuauucacugacaccuuaaauuuauauuuuucaggcagucuccugaaaaucagcuguaggauuucagauccuucugccacaccaugccaggcuuguucuaggcacagaauguuuauucauuaaacaauuucauaauccauuucaauuauaggaauuggaaaacugagugccugccauuuuaaguaacaauauuuugagauaaguagugaugugugcuuauauuccuagugcugggaggcagaggcagaggcucuccucugugaggcuccugagcuccaaugaccgugugucaaaaagcagauacuuauucuuuauaacuuggauaucuauguaaaagacaaacucaccacaacuacaacaacaaacauuccuugacacuagugauaccaauuaguuaauaaacaaguucauucaacugugaauacugaugucuugcugaauuaugucaaaaaucuaagcuuuuaggggguaggaguaagaaggaacccugguggacuuggaacuagauagguagacuaggccagucuuccugaccccaguguugggauuaaagcugugcaccaccauacaaaacauccgaugauucuccauucuccucacuaaauacucugggcaugacaaauaaaguacaauagugucacgaauauccgcaccaauaccaauacaccaccacuugggaggcugaagcaguaagaucacucgccaucaggagacaagaucacccuuggcaauacaacaagaccuaaucuagggaaaaacaggugggcaguagggugcaguggacugguuuacuaaugucauuuaaaaaauuauauaaacuacauuguacacuugcaugacagcuuccuuauuuagcaagguauaagaaaauguaucugcccauaguuguugaguuagaguccugaacaaguggcuuaaauguaccaagaguugagcuauauucuguuuuucucucugugcuuuguucuugaggaucuuguuauguauauuuagccugagcuccuuagugaaagcaaggacuaaaaguguuugccaccaugcccauuuuacaaaauaaaauaaaauaaaauaaacauuaaaaauucugaauguccaauuuuacuuacuuugcuuuuuaaaauaaccuauguaagccuggugcccuaguguuugaccuuacuagaugaaaagcaauauguuagaaaacaaguaagaaagcggcauauaaugaaagaaaaacugggcagacaagauggcucaguaggugggguuguuuguuagaggucuucaucuugagucugauuccugaaacccacaugggggaaggagggcugacucaaauuguucauuaacuaacauuuauuuaauagauucaagugagaacuacaaauacccuaacaucauuucuucccuuccaucugcccacccacccauccucuggccucugagugcugccaccccacugugcagcacagcacagcacgccuggccugagagcacugcacaaaggagcucaggcucaagcuucuugcccagcacauacaagguccaggguguaauuggcagaacacacaaacacaauuacaaacaaacaaacaccacaaguaguauuuauuuuuuaauaaaaaaaggauaaauuuuaaaaucuaauaugcagaauuaacaucagaacaauaacagaaaguuaaccugucuuccauuccucaauaaguuuagaggcuuuuuuuuuuuuuuuuacucugaccuuaaaacuauccaauauucgucaccaguacuaacugaaauuuaaaucacuuuuacuaugacagagaaauuaugugagggaaauuaccuuuucaggcuguguaaagaacuucauugggaggacuggguccuuuggugagucugcauugcacaaagcacuuuuacuauuuauaacacacagagccacgucacaaaccguauaaaguuucuaaagagugagaaaaaaaauuacacagcaaucaaaguuccaaucccaucacaggcauaaucugaaguuguaaaaugcaaaugaaugcuugucuguuaacauuccaucucugcucagcauucuuagauucccagucaaaguaaacuaaaaguauccauuuucgcucccuagaaagaaguuucuaccacaaagugccauauguuuuaucaguauuugucuuccugucuuuuuuuuuuuuuuuuuuugguuuuucgagacagucuuuauagcucuggccguccuggagcucacuuuguagaccaggcuggccucgaacucagaaaucggccugccucugccuccccagugcugggauuaaaggcgugcgccaccaugccuggcugucuuccugucuuaacuccuaaugccuuucuagaauguuaaaaguuuuccaaaaaaugaaauuuugccaguauaggcauuagaaagagauucaaaaucagggauggagauaaggcuuaacagcacuuguuucuucaguagauauugugaguuuaguuaccuacaccaacaugguaacucacaaccagccauaauuccauuuccaggguauccagccccucuacugaccucuaugggcaccaggcacacacuuggcacacauucacacaugcaaaccacucauagacacacacacauacaaaaacaaaacaacaacaacaaacccugaaaaaaauuaaguugcaugaauauauucuaauaaacacuguaauuuaaacuaugauauacuuguggaggaaaagcgcggguugguguauucccuauguauccauugccuuacuucauuugucuuggauucaucgggagacugggcgucucugguuagcuugauauucucugccaucuuuuucaugaaugcauggcuguuguuuucauucuuugucauuaagacuucaagcauaaaccacaggcaccuaaguagaaaauacauuaaaaaggauaaaugaagaugauuuuuuuuucucaauggauuaagucuucaaugaaaaguuuggcugucagcauaaaggaauaucaaaacaguaauauacaauuuuauuaaugguaucaauuuuaaguauuuuuuuuaaagauauggucucuuguaacacaagcuggcucauuguguaguucgaacucaucuuucacugaguguuaggauuacagguauacuauaucuggcucaagaggaaaaagucaaaaaauauuuaaaauaaagcugcuugguuuuuguccaguucccagaaugauuuacauauaagagcaccugcuuuucaccucuggaaggguagaaugaauuugguaaaauuaugugagggccuaggcagaaagccuuaaguuucuucucacaagccaggcaugaugguacacaccuaaaaggugcagagucauggucauccucacuacacagcugauaggagcccaggcugggcuaaaacuaagcuaguuuaagagugcacaggucaaagugugaaguuggcagaguucuauuuagaugagaauggacuguaaacaaacuaguggagcagaaagggcaacaaacacaaaucacccucuaccagauuucauccaucaagaauuucuagagagaucccauaccucaagguuacaauaaaaccauggagucacuauaaaacuuggucugacuuuacacuucuauaaaacacaagugacaaacauagccagccucaugcaugcaacugugugugaaagcagcauuauuugaacaaguacaguugaacugagcugcggugacaacgcuggaggagugcacugcauaaggcugaggcacccaguaugcuaaaguagacaguuacuaauuccauuaauucucugggguucagaauccucuauccuauuaacuccuaagaguccugauccuuuuacaaagaccaacagcauaagaauuauuguuagaaaggagaugaugaggaaguauucucucugccguaagaguaugagacuuauuccuuuuacaagguuuuuuucuuucuauuuucuuuucuuuuucuuuaaaaaaaaagggggggggagguaagauuuuaaauaugggauggagagauggcucagugguuaagagcacugacugcucuucuggagguccugaauuuaauucccaauaaccacaugggugguucacaaccauccguaaugagaucugauguccucuucuggugugucugaagagagcaauggugcacucaaauacaucaaacaaauaaauaaaucuuuaaaaaaauuaaaauauagccagguauugguggugcacaccuuuaguccuagcacuugggagguaaaggcaggcagauguuugaguucaaggcuagccugguccagagaaacaaugucucaguaaaauagagagagagagagagacagagacagagacagacagacagacagacaugaaggaaaccucuguaacaaucuaguauagauuuauacuucaaauugaaaaugcuaauaaggucuaguauaaaaaaguauauauacuuugcauauauguauauaaaauauauaaaacauauggacagguuaauuuuuuuguguaaaguuagaauauguugaaaacuuaaaugucauuugcacauguauguuuugcuuguuuuuaguuuucugagauaguaucuuguucagaauggcuuagaauucuauuuuuuuguuuuuuguuuauugagacaggguuucucuguguaguccuugcuauccuggaacucacucugcagaccagguugaacucaaaggcagaaaucugccugccucugucucucaaguguugggauuaaaggcgugugccaccacugccuggcggcuuuguuugaacucuuaaccccaaugccucagcauuauuauuguauuuauuguauuccucaaagcacauuuuucuuaacaaaucuuuucacugaguucccuaaaauauaugauuuugagaaacuaauggucccaccaugcuuuguuucaacucacaagccacugggauuaucggccuccaauaccagcuacaaggagccaaaacuuuuuuuuuaaauguagguuuaauuucauacuuuuuacaaauggaggaacuaucacuauggugacaacacugaacagaugaugaacaggccaaugcuuaaggguaauauagaacaucuuuucuguuaaaauuuugacagcauuuaagugaccaaagugguaagagacagaugaauguccaguucaauuuaggaguaagauuugcuuacugacguagaaaaauguaauacaaacaaaugauacuaauuuacaaaugcaaaacaaaauauagcaaugguccuacacagaaguggcucaauguuuaagggaaaugguuguagguacauacuggaauccuugguuuggguggggcuggggcucuaacucagagccccaugcauacuauguaaaguaccaacugagccauauccacaguacuaaagauuauuguuaaggaaagaugugguucuauuaaaaaaaaaguuauacaaaugaauaaauuaaauucuuuuuuuuuuuuuuuuuuuaaaagauuuauuuauuuauuauauguaaguacacuguagcugggagucagaucucauuacagaugguugugagccaccaugugguugcugggauuugaacuccagaccuuuggaagagcaguugggugcucuuacccacugagccaucucaccagcccauaaauuaaauucuuaauccaugaggagaaauuuucaucaguuuuauaaauuaccaaacucaaaggcaaaaaaaaaaaaccccacaaaauaucuuauuaaucuauuucaauauuagauaaguguaagcaguaaacagagggcuaagaauaguucugaaaaaaauuuuaaaacuuaacaguaaauuaaaaauuucagaaucauaagaaaaauuaaaaugagaauaauaauaauaauauaaaaaaauugagugaacacaguuuguagaauuccugaaacacaugacuuacucuuuuauaucacgaaguugaucaacaucuugugaccgugugaaaucaggaucaugggcuaggaggugaaucauguauggaaccacauauucaggcagcagugacaauaauuucucuaaagaaaaacagauuuuauaaaugcuguccuugucugaguucuaaccguuugcuucuauuucccuuagcuauuaauaguuggcuacuacacagcacgugacuggaaaaguuagguuaaugcagauacucgaacaucugacuaauguacagauauuaaagcacacuaaugacuacagaaggaaauacaauuaccagaacauugcagcuaaguaaauaugacuccaauacaagauuucacuuucuacauaugcuacaacucugauaacacuguauauauaaaguuaaacauuucaguauaaacuccaguggaaaugcaagcggcccucugugagacacacugugauuaucaaggacauaccaguggccaugggguucuguuugauguacucccugcggaugcugauguucuuuaacaaacacugccgagcgugugcucuccuuucuuucacagggucuuuggcacacaaagcaaagauggccauauacuccagugggagaagcaacuucacaagugccuuaugaagcuucugggcaaauaucugccuuacuugguagcacucauccugcauaagcacaaaaacaaagauacagauggguaaaaccguguacacauacaaaugcacacacacaugcaccuucuuugguaaaaaaauuaaaaugacgguuauguuauauuggagggauggaaacaacaaucucuucuguguguauauucacauaucaaaugcaucuauauucaaagaaaaguaaauacaaucaaacugaagacuaggauuugaaauaaguuuuccacuuacauuaauaaccagugcacagagcugaaacuguucugggguaauaauuucaugguagcaagguuccugagcaagcuucauuauggcacuaccagcagcuaaucgcaagcgagacauaucagauuuacuauaaauaaacaaagagaaaugaacauuuccuauaaccuuuuacacauaaaauuccgauggcuuuuugagugugagauuggcaguugguaacucacugugcaaauaaaggcaguuacuuugugugcuuuguuuuucuuaagggacuuguguuuauugacuaaacauagaggaaaagucccagccccugaggugcaugaccaagcucugccuccaacuucucgcacaccgcgccaguugcuuuauucuacuaucaaaccacuaacaguacuaagaaaagccacguucaucacagucuguauucccuauucacauucauuguggaacacugacuuaaacaaaccaaucaucaugugaaaucuaguucgaacaucauauccauuuauacgcuacacuaauuguacacauuuuuaugaaugucaguguaacaauuuaaaagaaauguucauagagauuagaauaugguuauauguguaucuuaaaggacuuuuauuaaguuucaaaaauguggaugaaucagaauuaauaggacagauauaaacuauucuacaguccuaaaaagauggaaccaacucccaaggagaacaaggacagaauucauuuuauuucccagugagcaaacaaaaauucccuauauauuuuuuaauuugauaaggaaaagguauuacuuaaguuuagauugcauuacuucgcuuagaacaacaaauaguuaaacauuuuuuuucuaagucaagugauaauaguaagccuucuauacaaagcacuucaguacacaguuaagauaugcuaaauaagaaauuuucauuacugccaacccaauucuaaucauuuuguugcuauaaaacuucuguugccuuacugaacuuaaaaauguuggguuucauuuacuuuuugcauaucucuucaauuuaucaaagcauuaagcauaaugaacuauaacuauguaucucuucaaguagauuuuuuagaggaaauaauuaauguuaucuuuaaauaacacaaugguaccaaguaucuaacaguacucaaugacuacuaaaugcaugaaaaaaagauuuuguguccucucacauaaauuuaaguagaaaucacgauuuaccacugcuggugcucuggaugucaaguauuugaaaauaaacaagggacuugacaauuucuucauguaagaaacaaaaaggagccgggcgugguggcgcacaccuuuaaucccagcacucaggaggcagaggaggcgaauuucucugaguucgaggccacccuggucaacagagugaguucuaggacagccaaggcuacacagagaaacccugucucgaaaaacaaaaagcaaaacaaaaaaaaaaagaaacaaacaaacaaaaaggagacaguaauuucacuacacugaaaaguggaaauuaauuuaucaauguuuucguuuugguuguauaaacauuccuugaaacugccagaaagaaggcuucuccugcccccuuuuuugagcaaccacugugagucguucuauuuguucaaucauauuacggggugaucagacucugcuacacuucucauaguguuacagaaauucaacaauaauuucuuauacagcaaauauggauuuuaguaacacugagcugauuuaaaauaaaaauuuauuagcagaaguucauaguuuuuggaaaugacaaaaauauaccaauauucuucaauguauucaagagagauaaauccacagcuuaaggugcaauuaaaacacucacuauuagucaacucuuacccaaucauggguacuaggcaaguggaaggagaagagcucaccugauccucuuuugcucugucaggucgcccucacuaaccagcauggcugauaauaaccgaagaguugaguuggcagauuuagacugguuguuuuucauacccaacagccaccuuaccagaaguuuaauugccuguaccuauaaaauauuaacaugcuaaaaaaagcaacuuaaaauucuaauuaaagagaagacuaauuuaaauuaacuuguuuaaugaaacuauccauccuaaucaguggaaauguauuacccaaagcacugggaaaagacaaguaacaacaagaauguuacuuccuguucaccuccacacacuguacagcagccacacagcuccuaugcaguugcucccagucucugcucuccucacaccucaucauggcuaaugcuaucacuaggcaauuaucacaaagacagcacaguccccuccacccaauguguaaaaauuccacagcugugcaugcucuuacuuccaacagagaaagcaaaagauauccauuccaugacugauaacucagucaagucuuguuacccagauuuuugauauaauaagacuuuuguaauuacugaaaaacauacaacuaaaaaauauuuacacuacuaauuucuagauauuagauaggugugaggaggaagaaauagauguuaccugguacagcaacauacauguauagauggagugacuuuuauuuauucauuuguuuacuuauuguuuggguuuguuuguauaaagacagugacucucuacaaagcucuggcuuuccuggaaaucacuauguagacaaggcuggccuacagauccaacugccugugccuccugagggcuggcauuaaagacaugcaccaacagcuggcuaaauaucaacuuuaaauaagaucacaauuaauaauuacauuuuaacaaugacuauauuucaaaguagcaaguagagauaacuauggacauuuuuaauaaaaagaaugauauacacuaacuuuucugaucuaaucauuauacauuuuaacuccauaaaucucuaguaucuucaaaacucuucaaaaacuuaaaaauagacaacaugcuguuaaaaacaauuauuuagaugaaauauuauagucccagaaaacuaucgaauauauaaagucugguacauuuuaaauaucucgacgaaaacguuggggcuuagguaauuauuuguggccuuaauuaucugaaagauugcuaucaauauauaugaagagcuaaagaccuaaauauuauuucauauauuuacugacaaucugacaaaacucagacaaaauauaugacuaagaaaguaauauagagguucauauacuuaaguguacugaaugucagagggugugcucaguggaggaacacugaugugguuaaauccuuccaccaccaggucauaccaucaaacaaaauauagcaaaaauccagaaacaacaacaccugcaauuccuuagagaaauauuaauguauaaugaacucuaaaauaaagcccauuuagguugaagaccagaccaggcucaacaguuuugagcacuacuugcucuuucagaggacgcacgugugccccaacccacacaaggugacucaaaaucauuuguaacuauagcuuuagagcuaucucuagccucugagaaaaccugcacgccuaugugcacacaaacacauacacacacuuaauaaauaaguaauaaauaaagcagcacacuagaaaaugcuuauuaacuauaauaugaaguccaggauaccugcacgcauucccuuuuuuccacauaaaggucauuaacaccuaagcaaauauaccuuugcuagaacuucaggagaaacuuccucaucuggagaccauaauuuuccauucuucucaccuguugacuauagauaguagaagaaauuuaguuuuucaucccaauuacuacacagugugaaaauauacagguaaaaggacuuagagaacgaaauuagaggagucacauuuuccauccucaaaacauacuacaaaccuacaguaaccaagacucugaaaaaagaauggaaauacacaacaauggaauagaagaggggggaaaaacuuuuuauuaaaaaacaacaacaacaacaacaaaaacccccaccaaaaauaacccuuuuauuauaugggucaauucacuuugucaagaacacaaauaccacguucugggaaaagagaaaaccuggugccaacaaauuaagaauguugcuagacagugauaccaucuacaaacaucaccuaaaaaggaaaacccaauaaucugucagaagacacaggaaaagaaucuuccucgccuugcacuuaauacuaaagaagaguuuacuccccugaauacacaaguaaacgugcugguacuguaaugaacgccuuuaaucccauaauuagaggcagacauauaggaucuaaaggccagcuuuucuuauacauaagguuucaaauccagcgggggcuaaaugagacuguaccuugaaacugucaaaacuuacaccucaacaguaacaaccaaaaacacuaaaggaucugaacagaccacucuccaaaaauacacagauggcaaauaagcauguagaaaauaauucuaauuaaaaagagaaaagaauaccacauucauaauaaaauauuuuauauuuauucucucaaaaacguguggagaaacuggaaccuacagacuuguuugauaaaagauuaaaaaugaacagacacaauggcaaccaguuuggugauaucuaaaauauguccaauaaucaucugacucagaaauuuuacuuuugcuauauauagacauuaacuacaauugccaaaacccgaacuguuaauuaauagaccaaaaaaaaaaaggugaaguauuucuaagcagggaagaaaauacaugaaaucuugaucacuaauacaguaaaaugaaucugggaaacaugccaaauaaaaaagauaucuagaauauauccauagucaccaugaagaauucugagggcacauauauauauuaagggaauuugaguacauugcuuaguagguagaagaguguuuccauuugggaauauaucucucucgagugacagcgaagauagcucaaaagaagaagcauuuacuaccaagccugacaaacugcuuuucccaggaaccacaugguggaagaagacagcacucuauaaagguguccucugacacucacaaacaaacugccaugaaccccuagacugaauaaauaaguaacuuuuuaagagacugggcauagucgugcacaucuuuaguauagcuuucaggaggaagaggcagguaggucuuugugagguuuaggccagauugagcuacagagugaguucuagaacaccaaaccuacauaguacaacauugcuuuacagggggagggagggaggaaaggaaaaggacaaucagguuggacauguuggcucacuuauucucucacuuauugagagacagagacagguauaucacuaauguguucaaggccagcaugggcuacacacccaguuucaagccaacccaagaagacucugccucaaaaaaacaaacaaacaaacaaacaaaaaaaaaaaaacaaaauagaaaaauagcuggauaugggcuggugugguagcuuagauccuauucugaacaagaacacaaaccaucuuaacaugaugaucgcugugaauauuugguguuaauccucaucuucucuaauuucagaaaauaggaguauaaagugcucaauguuacacuaaaaauaaagauauucauaaaugugccugugucugcacacucucucauuuuagacuguaagauccuuuuaaaaauauaugauaaaauacacucuaagggcuacaaagauggcucaguauuuaagaaaacuugcuauagccuaguugguauucuuagcacucacacggggcugucuguaauuccagauccaggugauccacugacuuucucuagccugcacaggcauaccacacucaugacgcacagaaaacaugcaggaaaaacaccaauacacauaaaauaaaaagaaucuuuuuaaaaagaaacuauuauuuuaaagugacacuuaauagaauguagugugauauuucaaaacuuguaccaagggacaaaaaguuagauccuauuggacacauuagucacaucagacuacacacacacacacacacacacacacacacacaccacgggacugaaaaagagauguuuccacgauaaaaauacagagagucuuaaacucaagacuccagauguaauuaaguuagaaacucacccugucguucauuagaaggucuuuaacaauaaaguuugccacuacagauuucaucggggaggcaaacugaucuggugcuaacauggaaauguggcccagugaaacuaauggaguuauaaguugcucugguacaucagcauucagacuccuacugaguggcuaugaaaagaaaacaaacaauuaucaauugguuuuguaaguauuuagauauucuacaguccuaauaauuuuaccaugcccaagucaaucuguuuuacugaaacauucauaauuaauuguauccaucuuagauacuguuauuucaccuacugaaauaugauuuugguaauuaaaugagaaaggccccauuagguucacauguuccaaugugugguccccaguuacuggaacaguuugggaagauuagaagauguggccuuacuggaaaagguaagucauuggaaaggccuuugauguuucaaaagcccacaucaaacaguguuaugucucuguucacaacuugugggacagaugugaacucucagcuacuucuucuaucugccagcugccauacuucccaacaugaccuuugacacuauaagcaaggcucuaauuaaaugcuuucuucuguaaguuacuuugguuauaaugucuuaucacagugguaagaguaacacagguaauaauaaaauugaaaaaauacagaaaauagauaaugcccaaguaaaacagguagaaauaaggacaucugcauuauucucuucuaauuuguuauguugguggauuuuuuucuuuuuuuucuuuuucuuuaaugcugagaagacagcuuaaacaaccuugaauuguaaaaauaagaguuuguggaaauauaucuccaauuuguaacaauaggaaugcuuuucaagaagcagagucuguccagagaucauagacagagaauggacgagaagagcagucuucagguauaguuguagguacuuaagcaagggcaguucagcugugaggauaagcuagcguaggcaagacuaaagcuaaggagaguacucucauaugaaacacaggacuaacaguguaagaagacauacaaacagccuugaaauguagacucuaacuauuccaaagcacagagccugacaagccaauggaaacauauuccauguauaccucaaaaaucugugccagcuggaccuccuuguuugagaagauggcauggaugcagugaacagccugcuuugcuugguguggagugccccgcuuggcuuucugauguaaaauggggaucaagguucuguaaaaauaauaauauaguuguguuuuucuuaaguauacaaaucccuaagucucuucuuauccucauuuacucuacuuagauauguacugguggugaaggcuuucuuagaaauuauuugauugcuagaaagauuuaaaguuccuucucugucucacaaaccaagacauacaauagggaacaauuuuucauuuuaaaacuaaaauaugaauauaaaaaaauaacaaauaaaccacccuuaauaaucuaugacuugcccuagggcauauaaucacauuuacauacuaagaacacacuccuaauuuuucaguucccuuuuagaauucccuuccauauuucaaaguagccaaggaaaaaaguagcaggaggucaaguguuauuaaacagcugaaaugauacuugugaugguagguacacaggaauagaaagguuuccaguaaucaucuagaacauguguaguuaccauccuagguauuuuuaaaauuggauuaauuugacuaaugaauauuaacaccugaaaagaaauauuauauauagcaaagcaaagaaagcaaaaacaaaagaaugaacuacaacugccaaagaccauaugaauaagagaaggugaggcuggauuuucaaaguuuaaaaaaaaaagauaaaauaaaugcauuuaaucacuacguuaacaugaaagauaaacuaaaagugcauacaucucuagaacaaucugaaaacaaguaucuuaaagcaauaagcgcuggccauauagaaaagauguauuugaaggaaauauauucauauuaacgacaaaauauguacauguaucaagacggaaagcauucacaaaacaacaguaacagcucucuuccuuuuauuuuccuaggcucacacauauaucccaccuccaaaagucaggcccuuacgcacacaaugucaccaccagcauggagccacaugaaacccuugguuucaacuuuucaggauaaacauaaacaauuauaaucagggucuaacuaguccaggucuaacuagucaggccugugauggucaagugucagacucccugaagcuggaauuaaaguuauucugagcacuaguguccucuguaaucauauagcagugugugcuuucaguugcugagccaccucuccagcccaagauacaauuucaaucaagauguagguauauguaguauuuuuuaaguaagccugaaauaauauaaaaacaaaugaacuuuuccucugcuuuguuuguguuuucuagagugcuguaauuaagaggcaccauugggguuguuauugaggucuucaguguuuuugcauuucugauuauuucuuuuauccucaacuauuaagguuuccaucuuugauucuaaaguuagccauuccacguauaucuauuuuuucuaaugcuuauuuugauaaagcauucuuuuaaaaauaggacucuugccuuaaaauguaaacuauuccaaagcuagaagaaaacgucaaacuugauccuacauguuaauaaucuuuuuuccuuuuaugugcacagggguuugaacaaaggccucaugugugccaagcaaguauucucucacugagcuaaauacuuacugcccagguccuuguaaaaacaauuuugagacaaagucauucuugccugguuucugaccuguuccaccaagccuggcccuaauaaucuuuuugauuuguauguauugcuauauaaacaauuaaauuuuuagaccacaaaguuccuugaagacagagacuaacuggauaaucccuuuguuccacauaaauuccauuuaauaaaaccuacacaaguccauuuguucuauuuuuauuacauuaugagacaaauauuguuccuauuagguuuaccaugaauuuuucauguuuauguuaccaaugaacauaugaugcaauggacauaucaauguguucuuucacguuucccauccuuaccacaaguauaaucccaaaauguuaaaugaaacuaugaaacuguauuuuacucuuaugaucacuguuaauuacaaagcaacuaauuaauauuuuaugaacacuaccauuuaauucauauauauauauauuugguugggacaggaaguuggucgcuacuucauuuauagccuacaaaaauuagaaagauacaugaaccauacuauucugugauggcuuuugauuacuagacuuucaagucccuugcaucucuacaguugguccgacugcaucuauccuaccugugauaggauggggcaggagacagagaaaucaucacucccccacacagaaaccuuuacauuaaccauguaaaaaaaaaauacucacgaccguaucuggggaaggucaguuucuauuuuguggccuguguuucuaaaaauuuguauugcagcuucugcuaccuugucauccuccauucuuaggcacuguaacaaggacucauaugucucugcagaguggaacgagguaggaugugugaaagacagaaccuggaggaauagauacaccuuuaggaauacagacaacagcucuauucuauuuaaaaaagaguuuucuuucaauaaauagaauguaaacuucuggugugcaaacgcuagcuguaacacuuggaauauaaauuacaucauuuagccccaacuacaguuacuuuuacucagagacuuuaacaagaauccugagggguacguuccagucucuuucccaagauaguuuacaaacauguuaccaggcaucuguaaucacaguauguggcaggcuacgaggcagauggauagaugagacuuucaugccagucuaggcuauagaaugagauucuuguuuuuaaaaaaacaacacgugccgggcgugguggugcacgccuuuaaucccagcacucgggaggcagaggcaggcggauuucugaguucgaggccagccuggucuauaaagugaguuccagaacagccaggacuauacagagaaacccugucucaaaaaaacaaaaccaaaacaaaccaaaccaaccaaacaaaaaaaagauaaaccaaaaaaacuaaucuuuugaauaaucuaacuuaaaauaaucccccucauguacacccuaaagggaacgcccuuauuuauuuuuggaaguuaauggagauaaaauuaccaagaagaaauaccuuaagaagcucaaguccugagcggauggcugagucuggacugacacccuccucuucaucaucggccgucccuucgauugacuuauucaucaguuuuaccagugcacuaguaagugaggaaacgcagguuaguaagacuacugaaacuaguguaauguaucccaacuauaauaugauaaacagagaguguaaaaagacuauggucaaagacaacgucuguagccugaggaucaguguggacaacaccauaggagagcuuacgguuauguuacccuuuccaaaaaacuuaauguguuauaguaauaagaaucugacugauaaauaagccaguuaaauaauauacuguaauauuaauauuaguucuuccaauauuuacacauagaaacuuuucacauauaaagugauuguaauauauuuuaauaaaaacaauauaaaaauaguugaagauugggcaaauggccauucagaacaaaauucacagaguagaagccaaguaagaugacucaguggguaaaagugcuugcugucaaucuugaugcacugcaugugaguccuggaacccacaugauaggaggcaaggauuccuaacauuauucauugaccucaaaguaugcggaacacaugcaugugcauacucacaaugaguaaguguaaugcaaacacauagcagugaacauaugcagggaaaguagcauuaauuacacuaggaaauuuauagaaucaguaauuccauacuaagaaauuacuaacagaaccaauuaucaaaaaaaagcauauuuacaaacaugcaauuggaaacuguguacugucaauuauuuaauaccacagaacauuacaugaucaauaagauccaacuaccuaacagaucagaugguuuguuucucagacaaggccucagcuguacccucagcugacucccugaggagucagaucugccuaacucagucagggugggaggacugcacaggacuacaauuacagggcucuacuuaccuccucuggcuaaaggcauagcauuuaaaacaaaaacagauaugagacugggaguguaguuuguaggcagaagggcugccuagcuugucaaacucuggguuugauccucgaugccacacaacugggugugguggugcucaccuguaauucugauaaaauuaaggcuaaaguggaaggacugucaugaguucaaggccaguguggauacauagcaauaccaagacagcuagauacagcaagauacugucucaaaaaacagagugagacaaguaugugggugugaaaggcagggugagaaauuuuuucuccuuuguugacauuauugcuucaaucaaauuaucaugacuuguuuagaggaaagagucucucuguauauugucuagacucucucuuuuuuuuaaagauuuuaauaagauuuuuuaagauuuauuuauuuuauguauguaaguacacugucuucaggcacaccagaagagggcaucagaucucauuacagaugguugugagccaucauaugguugcugggaauugaacucaggaccucuggaagagcagacggugcucuuaaccacugaaccaucucuccagccucuagacucucuuuuaauuaacucuuacugaucaucaaucugaggaggguuuaacauauacuugugaaaaucaagaaacuuguugcugagacggucuuacauagccuggcuggcuuuacacucaauguguagcagaggauaauaaugacuauguguuaagagcuggaccacagacauuuguuaccauaaaggauauuuaaaaaacaaaacaaaacaaaacagaaugaaccugaauuguguaauagacaauugaauauuagcaguugggaagaugaaggaagaaaaauacaaguucaagaagccagcaugaacugcaaaaaauaaaauaaaaucauuaggguguggagguggcucagugagugguaccacauacuaacuaccacaccugcagacaaucaagguuugguuccuagcacugaugucacuugguucaagauaacuucaucuucuuuuacuuaaaggagucuguguuuauugucucacauuccaaccuaucuccuaaagcaacuagaauuaugaaaaaauauuuauaccucugauuucucaaaugucaguguagcugagggggaccagggcucuacagucuucugugcgcaaauucuaccguuuguuuuuguguagcauggugauggucgugcgggggagcaagucccgagucuuugucaucaacaaagcccuagagucaccucucuaaaguaucagagagaaacugcacgggccauggcacucuccccuucuuuccugagcuagcuguuagcauuuauuuaacuuccagguaucccgugaggccuccaccauuuaguuucuuuucucauuuucuuuaaagauuugcuuuuuauuuuuugugugcauauguggugccuacaaagggcagaagauggcauuaaauguccuagagaaagagauacagaugauuaauuaucagcugccuaauaugaguacuaggaacugaacauguguccccugcaaggacaauacaugcucaaaaccugguaugauagugcugaccuuuaaccacaggagaaagaggcagaucucugugaguuagaggccagcccggagagucuacauagugagugccaggacagacaugccuauucagagaagccaucucaggaaggaagggaggaagaccauaucaucuucaucagcacgaggaaagaggacccaguucucuucuucagccauguggauucugggaaucccacuccaauuacagauaggguuggaggcauguacuuuuaugugcucagccaucaugcuacgcuaaacuucacaccuuauauaauucauucauaauuuucuaaguguugccauuccuuguuaaaaaaauacuuuucauaauucaugucaucauuguagccucaguauucaguucuuucuccuuaccucuguccacucuaauuuaguucauuccugaguuucaaccauuaucacaaugaucacauaauuuugugauaaucuuuucuuuuguauauuuucugaaacaggguguaaauaagccccaacuauccuggaacucaucauguagaucagguuagcccuaaaguaacagagaucuaccaggcucuguuuuuuugguucugagauuaaaggaguguaaaaacaaaaacaaaaacaugucugccaccaauguuuucucuuaaaaucuugauuauaaaaucuucaugauggguggucugagccuauauccccaacacccaggagucagagccaggaggcuaacaagcucaggaccagccaggucuauauauaaggaaguucuaggucacucauagacauauagugagacucugccucaaaacaccuaaguaaauaauaagaaccuuagcacuauuuugaaguauaugccuccgcccccccaccccccccacagaguuauaacucuggccugucuaaguauuucuuaaucucuuugucccuuuucuuuguuugcuauuuccaccuaaaacaacuauaaauaucaaucagcauguuauauauaugacacaugguaaauuguguuagauuauauguuuuauguauuauuuaauauggauauuuacauacauauaaauuucaauaauuuuaauaugugauaauuaucauuacuguaauuuuagagagugguauacugaagcucacagucccuaagcaacccagauucgaggcuaggaaccuggacguuauccccaguaguccucacucagcuaaccccaguaauuucuacuuccuuuuaacacucaucagauacauaacuuauuuuugaagucuucuauaacaauacacccacacacaguucaaguuauauaacuuauucuuuacuaaguacacaauguacuuuccacaaagccacuaaguuaaaaaaaaaccuuuauuuauaauaauauaguaguuuguaacuaucuggauaaauauaaagaauauggcuuuuacuucuugugaaauaggauuuccccacguaucccagguuggccugcauaucacuauguagaucaggauggccauaaacuaaaauauccauuugccucuacuuuaaacauguugggacuaaagauauacaacauauauguuuuucucauaaaaauuaauaaacacugacauucuuacaaaauuacacucggguagaaauauuaaccaagauguucuucuuugagaucaaauaacucaugaugagauuucagcagagucugaacacugggaaucaaacaauaguaauuugcugacaggaugaaccccugugagacaucaugcuguuacagcacauuccuucuaaaguuaauaugcacacucaagaguuccuauuucuacuacacuguaucuuuaacccaauaaaugugaugcuagagauguaggggugaacugauugauaagaacaugcauuuagcauucgaaagguucugauuucaauccucagcgugugugugugugugugugugugugcgcgcgcgcacucucaugacugcacauacacacagcugcacaaaagguaggggaggcagaaaguaaaaggcacauaccaaaggauacugacaagaaauaauauggccacgauuuugaaacuaacuauaaacaaacauguugugacccaacauuuuuuaguuuucuuuuuguuuuaauuugcaaaguagaaaacuggaucucgaaaucuuaaaaauaguagagcucauguauaagcugucccauugcucaauaguucauagauuccagcuaccagugucucagaacuugacucuaucuggagauugggcaguaaggaaugauuauguaaggugaagucacauggauggaggagccuagucuugguugagcacuauuuucuuaagaagaguaggaaacagauugauccugggcaugcaagggaaugaucaugugcaaacacagugagaagaugguagcugucuagaagacaaagagaaugacuucagaaaaaaauguuaauaucuugguacugaaaguuuuaguuucuacaacuaaaaagaaauuguauuuucuaacuugccagccaacauuauccuauuagggugacccuugaacacuagaagaacaugccuucucacagaaccacaauaaugacucacacaggugacguggcuaaugcuuccagguaggugcuacguacugaauuagguccaaaucagcaucuaugugaauuaagaauuagugagugcuaugugcggauuuuucaaauuagcauauacagaauaaauccaaaugcagguacucuuuaaaaaaauaaauaaaaaauaaaaccuuaaauaauaaugcaaugccuagccuucuauuagaacggcagguacacgcugcuauaaagagagcuuuaaagagaugguuuccagaucucuaugggcccagcaccuaagcucacccccaugcacuuuccaugcacuuccuaccuuaccuuauggcuucugaaucgaugugcacaggagcaauucuuuccaaaagaaauuugaccaucucuagaaaaggguugguuggcugcuuaggauuugcaaguuuccgagcuauuucccucuauaaaagaaaaagguuuacuguuuaguuuuaaaccuuaguauuuuucacaauuagauuaacuaaagaaagaggauucacugaaaaacugaaaacccagaaaaagugaaaacaaugucugcuuuaggcacugauuauagcaagcacucacuguaaaauccagacagcagaaaacagaaaagggacagauaggugacuucuacuuauugccuuacgcuucugcuauagaauuuuuauuuacuuuaauaacauaaugcuuuauugaaaaauuuuuauuuauaaguauggauaaaugguuuuauuauuuuauaauuuacuaggauauugcauuuuauuucaguuaauuucccugaaaagcauguuuguccacaugagcguaaugcccacaauucagagaacaguauuagaucuauuuaucucuauaaaagaaaaaugugaggcuagagagauggcucagugguuuaauugucuguauuuaaauucaagaugacaguauuauauaccaacuacccuugacaaagaauggcauucuugcaagaacucucucauuuuuuuuagaccuuccaggugauguaaccgugauaguacaucuucaaccgugguaguccaaaucucagauuuccaggugacaagucagacuacauauauuuaccuucuauuuuuuuuaaauuuuauuuauuauuacuaguaugugucuuuuuugugggugcacgcuuuccaugacuuauauguagagaacaaccaccaguaaguauccaguucucuccuuccauuguagguuuuaguuuugaacucaggugggagcuugccacuaaaaauagcucucuucuauuuuauucagaaauguucauuuccagaaacuagagaugcaguagccaauugugacacaaugaugcuguuucauuuagaugcuggccucuaacacuuuuuuuuucaacccuacauaagcacaauguaugacuccacccccaccccaauuuacagggucuuguaauuaaauuuuauauaaaagaacauagguaauuuaaauaauauauacaaguuauacugugcuaauaauuaauaggaaggugagaaaaacaggaacuaguagcaaccucuuaaauuaaaucuaucuaauuuaaaggauucuguuuucucccucuaccacauggguacaggaucaaacucuuuugacuucauaggaaguaucuuuaucuaccaagcuauuugauuggcugucuuauuuauuuauuaacagcagacaagcaaacaaacaggaucgcgauacugauugcagacuggucacgaagucauggugauuuucuugcccuggucuccuaaagucugagauugcagacaagaacuaccaugccuaacuaucaugcucuuuuucauuacaaauauaguauuuagguccaacuuucugauucauaaaaccagcagcauugauugcauacauuucuugcucacugaauucauuccaggauauuuuaauuacaaacaccugaguuuaacuuuaagacuaacauguucccagaccauuuuguaagaacaucuauuauaaucuuuaauccccuguuacauauuuaaaucaucaauccuuuucagaacaaggguaaaaaguaaauaaccaaaauguugauuuuuuaauucauauuuaagccugauucuuugguauaaugugucacaacuucauaauagcauaaaugcugaagacagaaacaaaauauguuuuucucccugaguuucuguuaugauccuggcuucccauaaaauaauaauaagugcaagaaaacagaaaucuaccuaggaauuccuuucuuucaaaugaaaucucaugugaugacauaacuacaacuaaguuauuaucagguuuuguucccaugcucagagaugaaaggaggaaaagcaugcauacaaaacauuuugaauuccuuccauuucuuaagugaagaaacacacauuaaauaaaaaguguuuuaucuugguuauuuccuagggacagucucucuggcucaaaucugauuuuuuuuuucuuucccgcuuggaauauggcuagagaguguuuaggaaaugagaaauuaguuacaucuaaauagaacucuaaauaucuuagcaucuaccauacaguuaaagucagagaaaaaaaguaguuguaauaaaauacagauuuccuaaaguuauuagagaaaauauaaaaucaugauucacuaaccacacaaacgucagccugcuugcaugaacagguugggcugauuaauaauuccaacugagaccucaguuucucaucaucaccaagaaccugguuaaauuucuuuacaaaaucuugugcuuuuccagggucaggcaaauucucuaugaaaugaagaaaauaaauauuagacaaaaaaagauaacuacauuauaacugucuuuaagacacuggcaaggagcuggaaagacggcuaagcaguaaagaauacuuccuacuccuacaagggacucaguaccucuguuggggagugcacgacugccuguagcaacagcuccaggcacugcagguacaugugcccacacagacacacaugcuuacacauaaguaaaaauaaaagcaaaguaaggcuaaaaaauacauuuaaaaaguaaauaaauacugauugagucacugagaaaaucugacgaauggcacugauaaacaaaauuaacgauuuaucuuuuaccacucuaucauuggcuaaauuaauaaccuguuuugagugggcucaagagauagcucagcagguaagagcucuugcugcucuuagaaaggauccagguuugauuuccuagcaccucauguuggccuacaagcaucugcaaguaacuccaguuccaggaaacuagacaauuacaucauacauacauacaaaacauucauacacuuaaaauaaaauaaaaaugaaaaggccuguuuugauauuacaugcucacuggguaaauaagcauacucacuugcuauggucaucaguuucccaaacauggcagaacaguucgcuucugacugaaauuuaaaccauaaaaaaaguacuagucauuucaauuaauaauauacucacauuguacaauguguuccuuagcuuuaaauagacucaccauaaucacacuagaaaauggcuaacccccacccccacccgccuauguguguuugucugaggggagggggaacacuagcaaagaacaguggaaaguaaacauuaggauaaggacaaagcugauggcagcaggauggcacugaaagcucaauagugaggaguggcagcaugcgccugucauucaucugcugagguaggcccacugcuuaaaggcagaagucagucagccuaggcugcaugaccagcaagcuuguugaaacucucgccaccaugccuuucugcugugguggacugucccuaauauugugagccaaaacacaccguccuucuguaaguucucuggaucuugucgaguacucugucaccauaguaaggaaagugacuaguauaugacuaaaaucucaccuagcaaugcugagaaaggaaggcugucaaggaauuugccgcagauuauuaaccuggguaacagugauuucuagaccaguuugagcuaaaaaaaaaaacaaaccucaaaaccaaccaaucaaacaaacaagaaaugcuuaagaaacuaacaaaaaaggaaauuuagcucugaaaacagcuuaacugacauuaaaaauuaaaaccccuugagauaauuuaauuacauuauaccacaaaaaaauuaaacauugauuuacaaucuaugauuuuaaauaaaaaucauaaaccuacuguaggcugcuuguguaaguccaauaguucacgcacaugacuucgaagcauguucugacauuuccacauuucauugagagcucuguauaaauaugaaaagguacauuauuuaauaacauuacaaacuguucaacuuuuuuaaacuuuuuguuuauuuguuugagacaggguuucgcuauguagucuggcuguccucgaacucacuuuguagaccaggguggccacccacuagagguccaucuggccucuaccucccaacuguugggauuaaaggcgugagccaccacaccugacuuuauaaauuuucuuauguguuauuucuauauucauauaugaaaaauguauauaacaguuuauuagcacuuaagggaguuuaauauaaggcuuaucauaauaggaacuaauauuuuuguaaugcuagagauaaaaucuggaauuuuaagcauguuaggagggcauuuuaucaaugagaaggaaugguuaaguuccaaaggaucaauaugaucuuucuggggaggucaaaaauugacuuaaagacuauuuaauccuaaacaagggaagcuacagaguucugguguaaugaaagauaaaacaggaaaaucaaaggaaugaaaaagccagguagagaguauauaacugggaggagguauauggaaacuggaguacaucacagauaaauaaauaagggcuacugcaugccagaacaagagagcuaugaggaugaagucagcgggaagccucucccuaaggacuaagcucucacaguccacaaagugcuauacacacuuccgaggaagggagcagccaauagcacuacccagcuguggcgggugccuaggaaccacagcuagcauggcacaguaacuaguuucacuccuauguugguuguuacuaacaucucucuaauuaucguuauccugcaacaggagggacaaucaugccugguauuagaaaccuagacaauaccccgggcuagggagaucaugaaucuuagagauaaacuaacaccauuuauuaaaccaguacaauuacuaauuauuuuucaucaaagaagcuucucuuuacaacagaugaaaauaacaacuaccaaaaugcagaggacagugacucugucauaaucauccuuaauccacaugucuacuacacagugaaggcaacuaagacuuagggaaccccacagacaagggagcagaaauauuuuauggagcagaggaacagaaaaucugcuaagacuguaucucuuagaaaggggaggggaaauuuuaccuggaauacagguaaacuauaccuuaauauuauagaugccuaaccaagaccugaacaagggacaauacuaauagacaugcuaacauggaaaggaaaaccucacgaggcccaaaaccuagacaacacuauaugcaacuaaggaaaugcuaagagggaugcacucccaaguucauuaucuaacaccaacugguuagcccuaaaaccauauacacauaaauaacacuaaagagacucagguguacaugcgcacauaccacccccaauaagaaguaaauaaaaagaggccaugacgucaagagggaacaaaggaaggugugauacaugagaaguuagaggaagaaaagggaagaaaaucaugugacuguaauuuuuaaaaaauguuuugguuuuuguuuaguuuuuuugagacagggucucucuacagaacuauggcuauucuggagccagaaauccuaguccucaugaaugugucuuuguagucaagaucuugcauauccagguuaggauuagacucacuaaguaaccaaggcugauagcuuuauugguugaauaccugaaauuuuuuacuaacaccauuaccaaaagagugugugagcaggugauaaaaaacacauggagacaucgucucacaugugcagcaggguagagcuggccuugguagcugggguugcugaugagccagcccaagggaacaaguguaguagagccaucugacugaaacucagauaucguucagacccagaucuggggcuuugcauuggcccugcccaacacugacuugauugaugaauagcggggaugcaugaagugaccagccaguccuacagauccaaaacuacaugauuucuuuccauggcacaggacaacagcaggauagcugagagaguccuagugaggauccagaacugauagucuagcagaagauagaggccucauaccagacaaauaaauuauugcaaugaacaucuaucuguaaauaaguaaguaugcacaaaaguguauacugggggccacacuguuacagcuuccacaagauuuuuguuauuguuuuugaggggagguugcaaggguggagggcagguccuaggagugaaggagaggagugggauugggguacaugaaguaaaauucacaaagauccaaaaaguuaauaaacaaacaagcccaccuaggaaguauaugaaacauugaaaaguaacuuacuuuacagcauuuggauccaagcuagcauauaaauaauauaagcauuucauucucucuucuguuuccagguuguggggaacaagauacugagcaaagauuuucucuaccaauagucuaugaacaaacacauaaaaacaauuaugcuauuuaagaagugaaauuaaccauuuuguauaaaguggcuauauaccaauaauuauaucaccaauggugugguuuauuucaugauaugucauaaaacauuuguucuagacugccugaauguuauuucacccuguagcaaggcuagccuggaaugauggagcuccuacugacucagcucuccuuagugcugggauuauagugugagcacugguauugccauuaagaaaaugagaacaauuucuguacugguugcaacaguauuaccaaaacaaacaaacaaacaaacaccccagugaugagaaggacuaccaaacagugcuuuacucugggcaugagugcuacacacuucauaccuaugugcacaugacaaugccauuauuacuccuccuuauuuuaugaagcugaaguauacauauguaaaaaugauuugucucuccugccucacucucacgcccauguuucuuucacgacugauaugcuaucaucucucaaagaaucauauguaagcaugugugcagaaaauuauuucuauauuuaaaaugaacuguguaaaaauuaaauagaaucuuuaaaaaugauaagcaguuuuaggaaaauauuagacucacuugucaucaaugcuguucugauaguagauaugcagcagcuuguccuuuauccagcugacuuucuccgcggcuuccuuuccugcuuccccaugaagacaguauuucuuauagagcugagccagacccaucauggcuucuuuucuuacucgccacuagaaaauauagcacugugaguggggcaagacaccaaaacucuauucaaaucuacaaccugcaaguagcugugcaguagucacugugugcaugcacaggcagcacauuggaucuucucacaagcagcuuugccaaacuguuuuacuaauaaccauuuugcaccuauuucugguaagacaguagauuacuguauacacuuuucagugccguacugcuaaaugaccuaccaacuucuuaguucccuuuaaacaaaauauaguacagauuucauucaguucaauucuuuaaauagauauugaugaauaaaaggcauaagugaagauuaugaauuauauaauuugcccuguacagaaggcggcuacggugccuuaguuaacuacacauccuucacuguacuguguagauaacaaagcucaggaucaggaaucuagaaaaagaaauguuggugagagccuucuuguccucuuaggugaacuuucuucccuugcagacuugcagauaauguggcaugagccaccaaugcccggcauccauuuuucuuuuauauagaaaugcuauuaaaaaauucucuuccauaauaagaaaaagauugaggauugagaaccaacauauuuauucauauggaagcaggcagaucucugugagucugcagucagccuguucuacauaguaaguuaaaggacagccagagcuaagccugaaacauaaaaaugaauaguuuuacauuuagugucauucugguauccaccagcugcaacugguguaaccagacuuacacaacaauaugaacauagaaagucaggaagagcugggcagugguggcgcacgccuuuaaucccagcacucgggaggcagaggcaggcggacuucugaguuugaggcuagccuggucuacagagugaauuccaggacagcuagggcuacacagagaaagccugucucgaaaaaaacgaaugaagaaagaaagaaagaaagaaagagagagagagagagagagagagaaagaaagaaagacagacagacagacagacagacagucagucagucagucagucagucagucaggaagaacaaagcccccaaaucuuacccguuuauccaguguccuuucccugacaaagccaagcaacugaucauuuacuaaggcaaggucucuuuuggcagcuguuauuauaguaacaauaacaucaugacgaauggcuucuucuggaucaugugaccuaacuuucaaauauucuguaauugaaagaguuaagcuaaauguuaguuauauaaauugucaugauucugaaugauaggaaaaaaaaaaccaaaagcuuuaaguucuguccauuuuaauauuuauaaauuauaggacaaauuaaaauuaucuauaagacagcaauaaguauaucuuacuacucauaauauguuuauuacuucagagcauaucuaaauaauuauuuuggugaaaggccaaaugacaacauaguuuuacagucuggaaugucauuuauaaauuaaaaacuaaaaaacaaacaaacaaaagcagacaaacaaaagccccguacaauaacaaggguagaagaggcucuccuaaagcugaagccugacugugguauccauuuccuaacagggcuccuggucuguucucagugagagaggaugcaccuauccgggcagacuugauguggaggaauaccuaggaaggggccccaccaucucagaagaggaggagagggguuagggaagggucucuauaaaggagguguacuaagaagaggguaguguuugauagaaauaagcaaauaaauggaucagcaaucuuuaaaaaaaauauaagaaaugcuaaugagaaaaaugguauguaaguacauaauauaaaauauagaauaugaccuuuuaaaaauaauauaaauaaaaucaaaauaaguuuuucuucuguuucuaauaaacaguagcauguugacaaaaguguucuauuugcuacuguccaauagguagguuuaaauacuuggaauaauaaaagucagaugguagcacuggaggagaugguaagcagugguggcagaggcugagggaugcagcuguggaggugguucacaguuguaagcuagccugaucuacacagcgagcugcagagcugccaggacuaugcagagaaacaccugccaugcccuuccaaaaaauuuaauaucaaacagucacaauccaaucuagaagauagacacuuugucuacacacauuagguaaguuacuauauuuaguaaugcagaagugauuuguuucuauguaugaaugcauguauguacguauguacauauguauuauuuauuaauuuugagacagggucuuauuguguagcacuagcuguccuggaacucacuguguagaacaggcugaccuugaacucacagagauccaucugccucugccucugccucugccucccaaguacugagauuaauggagugccaaacaaauccaggugugauuccuuucugaaucuaaugucuuaagaauuacauuaucucuauuuauaauuucuaaaaaaaguauucccaagaucaauacacgaaugcuucagggccaguuuuauuuuaaaacugggaaauaauuuccuagcccgcaaagcgaacaugaagccaucuugcaaucaaaucucuuucaggaaguagaguugggcacagccacaucugagucugugugguuagugugugcggcuuaccugucagauccuucgcuaagucugggugauucaucaaacaguggcuggcaaacuucacacuuucuaaccucacaggaacaugaaugucauuaaaucuaaacagaaaauuauuguuaaauauuaauaagacaaaacauuuauuuucaaauaaauaucacaaaaguauuuauaaacaaaaauggguuauugaauagacacuauguugauuauaccgacaguugaagcauucuauggaaaauauaacaaccuacaaauuagaaauggcgggucaugccuuuacacgcagcacucuggaggcagaggcagcaguucaaggauagccuugucuugucuacauagugaauuuaagacagcaagagcuauggaagagacacugucucaaacagagcggggggcggggggagacauaaaauucuauaaaaacauucuugcaaagaguuauaugcuugccauuaugaaaccaaaacuaacauauugccaauucaaacaugcauuuuguagaccuaaaauuacuaaaguuuuacuagaaauaaagaauacucagaacacagccauacacucaugcucgaaguauuacaacaaugagugaacuuucuucauaaauacuuuggcccacaaucuauauaacacagaugucagcaaagccaauuaaguaucaauuaauauuuugguauggguagcaaagccaauaaguaucaauuaauauuuugguaagaguagucuuaacuccaugggcucuauaaucacacagaacauacaaaauucuaaaaucaugcuuucuuaccgcccaagaaagcacugccagagaggccgauucuguguugcuaaaucugaaucuuuagagccgaacaauuuugcgaggagucgaaccacagcuaggcguucuucaccaucguugcucuacagagagagagagaagauacaaccagggggccugccuuuacuuuugacuugcaaaaugcacaauguaaaauauugcgugcuaguguuuacuguggaaauguuuuucugauuucauguuagaucaccuggcuuucugaccuuaucucauaucuucccuaccacuaauucguaccuacuuuacaacuuauuugcaaagugcacacugauuauauauagucauuuuguucaagaauuuuaaaggaauuuuuacaaaaagcacacaaucuuccuacccuauuaaguuuccuucauaaaaauuauuugcugcacccgaaaaauaaaaaagaaccccaugacuagugaugacuuaagggucuaguauacaaugccagcaaugacccuccacugacuagagaacauaguagugaaaaacaacgcuauuagagaaugggaauucaaaauucaaguuaucacugucagaaagcuugugggcaguggaguaaaaguugcacacuuguauaaagcaauggaaaaugacaauuauguaaggcuuacacacaguaguaacaaaauggaaacuuuaaaaacuuuuuucucaaccaaaauaaaacaauggucagcacuauaaacauuuaguaugucuaaaauuuacuaauccaauuugcucucuuuaaagaaaaauuaaugucuuaaguauuaaacaguagacuuuauaaaaaauuuuguauuacuugugagugacuauauuuacagacccaugauuacuucaaguaaugugagguuucacaucuauaaacuacuaaaacaaaacuaaucugaucuaaagcccugccgccaucacuguaaggugucauguuucucaaguaaagcugaaauugccuucaggaguaaaacgguuuguuauugcugacagacaaauguguugauuugucauaaugaaguauuaugauaauauaaauauguugaacugaaaauaucccuuaaugagugaaaaguccaaaaauauaaaaauucuacauuuauaguuuaaucaauuauuuuuucuaguauuacauuuauuuaguguaugacugaaugugcauccuaauauacuaaauugguaagaaaaugauuaaacccauuacuuauauaauaaguaaguuuaguauuuacuuaaauauguaaauguucuuuaauauuaauacugaauauuguaaauuucaaagaugacacuacuuuuacaucuccuuccacuguuuaucagcagauaacaacuagggauauguuucauauguuacaugagcuaaaugagauagacuaaacucauauuucacucccauauaauuagagaaaaaacaucuucaaaguagauuuuuuuuucccuauacaccuuaaagaauaccuucaguuugaauucaagcuguggcaugacagauaacaguaacugaggaucgauagcaaaaaguuccugaaucagaucaaauacguguucagacaggucgcugacugaugaucugcccagcaccaggacuugauugaaaaacuauaagagacauuacaauaaaaaaaaaaauguguuauuuuauuuaagaagcuaaacaguuuucuauaaacauacauguaaagacugauugagcauuacccauauaacugaaagauacaaauuagcuacugaauuucuaacauguaagaggagagucaucuaaacaagagaagaaacaaacuuucaaauaucuaaucaugaaugggaaagggagaaauuaaaacacauuauugguuguuguagugagaauuuugguuuuuuagaaacccaguuauauuauaugaauguguuuuauuuuaaucucaggugagggauaagaagcugcuuuacagcaggugacuaugauuugccuugcgcacaagggacaugaguuaugccagcagcagcugauaguuuaauucuggggacuguggagaggguauaaaugggagagcccaagagccuguggaggcugcugcuccccccgcugcugcugcuccuguugaagcaguaugucaagugguugugagcaaagagacuagaauaagagaaauucggacaacaaagcuggacuugcccccaaagaacucuacaccccucaucagcagacagcagucuaaagaggucuucgcuucuuuuccccucuaaccuucuuccucucuuaccuagcguugaggauuagaagguaucagaguggaguaaggguuggaagggagguagagguauaagaacccaauaaaguagagcaaaaaacaugccaacggguuaugcuucaaauaagaauaauauuucugaaaaccuuaauucucauuaaaguaaaacaauuuagacagcacguauaauucacuauagagaaauuuauaaaggacucacuacauggaagaaauuuuaaagucccaaucugauuucuauuuaaaaauuauguuuuuuccuccugaguuuagugaaagauauuacuuuaagguauuuauguuaauauuaaucauggggucuuuaaaaagacuaaagacaguuuucaauauacacaaauggggcuagagagacagcucaacagucaagagcacuggcugauccuccagcaggcucaggacccaaauggcagcucuguaacuccagucucgggagguaugauacccuauucugaccgcuauggauaccagauacacacaugguacacagaaaauaccuauacauaaaaacaaauugaaagaauaaauguauacacaugccgggcagugguggcgcacgccuuuaaucccagcacuugggaggcagaggcaggagaauuucugaguucgaggccagccuggucuacaaaaugaguuccaggauagccagggcuacacagagaaaccccgucucaaaaaaacaaaacaaaaaaaaacaaaacaaaaaaaaagggggggggggcgcacaaccaccucagagaguggugggaaaagaacaacccacaaaacaaagaccagcuauaccuaucaguuuauccacuuaccccuagcucccccccaacacaugcucuguuaaauuauauauauauuuaucaacaucuacuaaagaagaaacagagguuuucagaagaacaaccuagaagacacaaagaggaaaauguauucagauaaguaagagacaggcaaaucucugaggccagacuguuaagccccaggucauccagggcucuauacugagaccccuuuucaaaggaggggcaagagacauagacaaagucaaagaguuuugaguauuuggaagguaacauggcaagcacagauacaggaggaggagugggaagauauuuaaaauguuacacuguauugcucccauuuuggucguauucaaguuccauauuuuucugaauaaaacuguuuagguaagaaauauaucugugugugaaugauucuaaugaauucauauaauaccucaagaaucacagcguuaugaaauguauacagaaauacauacauuggcaauacaugcuucaauagucuggacuguccuuuucaguaggacuuuugcaaggucgaaggacuguuuauuuaaguucugaaaaacaaaaacaggcaaaacuucaaaugaauuggugauugaugagacaaaaucacuugaacaguaaguauucaaaucuaccaaaguaugaaaggaauuccagucacgguuuuacauagaaggugccaaaggaacucaacaaauuaaauacuacauuacauuagacaggagccaagaguccaaccuauauaaaacagaugucaagguuuuugagucuguacguuaaccaccauaaacucacaacacacguuauucuaaauacacacucucuccuaaacccaauccaucacacucuaaauauuucauuguuuuaucaaugugugcuugaagaaauguacuggagaugucacucagugguauaguugaucaauuauguaacguuuaugaggcccuagauucaaauuccugaaccaugaauaggaagagguugggaaggccuuuaacuuuaacuguauuuuuaugacugucccaaguucuuuugagacagggucaucacuagguaguacuggugggccucaaggagcugccuguuucccaggggacuguaggagaggugugagccaucacacacacauuacuuguuucugacaugagaaauacuauguuacccuaagucccaaugcaccauaacuuaaccaauuaagacuauaacaaagaugguacccacugcauuuauuuaaauuuuaaaaacuuauugagaaaacuguuuucaagaauaccuguuaacaccuaugcuaacauagauucuacuaaaucuauaaaauagauucagucuuauucaucuuauaccucucaaaaagaagcuagaaacacuacacuuuuuuugaggccagugguggugagcacuggcugcuuuugcacugaguaggaccuguauucccagcauucacauaguaccucauaacugucuaacuccauacccucuccaggcccccgugggcaaugcauacacacaguucacagacauauauguaaguaaaacacccacacacacuaaacaaacaaagagcuuuuaaauauuuuaaucaaugugucuuauaaaaauaauaguuauaacacuaaugugacuaauucuacggacagaauaggaauuacgauauaaaauuguaaauggacaaaaccaguaacugauuucuuuagguaagcugaucuuuaauacggugauucuauacagaccuugugugcagggaugagguugauaagaauggaauccaauaauucuugaguaacuccaucaccuuccaugaugauagaacucaucaagucuaacaugugcauuuguacuuucguauuguggcuauugcuaaaaaagaagaaaagauuaaggcagauaaaaaagacaaacuccccaggguuuuuucuuccauguaccuguuuguuuacugguaacaaagucuuguuauauaacccaggcuaaucuccaacuccuguugcaccccccacaccuccuaagugcugagguaacugcuaaaguguccaguuugaagcacuaaucuuggcaccugagggcggucaccucagcacucaggagacugggagggaagaguacaucauagcuuaaggacagcugaacugauuaggcgagagucucucuaggggagagaaucaaguugggaaaugcaguucaccggcagaacacuugccuagcacauaugaagcccaaaccucaaucacaguccaacauaaacaaucucaaguguaaaaagagacuuacugaagggauggauccccgcugacaaaggcagacauuucagcugucauauuuaccaccccgccacucccaaggcaccugaaccauguuauuauccaacagaacagacaccacccuaauuucuaauaaaguauucucuacaccucacuuaccuguauauacucacacacaauaaaaaaagcacaauguauagccuacagaauauaaccuauauucuacaguauaaauacagaggcuuaaaacaaaauugaaagacugaauaucuaaaggguuuuaaauguuuuuccugaaauuuaaaagauaaauaaauuagacccaucuagcauuuaacgaugaaaacagaaacuuuuauaaguuguggggaggggggggggguugagacugucacacaguuucuauaacuuagaaaucaguucuuccacaugugcucuccaaauuacacauuuuacaaaaugucaucugugaaggccuacugggugcacaauucucaauguguaugucuuguguguguggcagaggaaaugaguuggaagaauauagguauuuagcuugauacaaacaacgcaaaacaaaagccugagugcuugauucucagauccauauaucugaaaagaaagaaacggguacagggaagacacaugaaagagaccuuaagcgcucgcuuccacagcacagagaagauuagcauggccccugggaaaggaugacauacaaauuggugaagcguuccauauuuaaaagaaagaaagaaggaaagaaagaaagaaagaaagaaagaaagaaagaaagaaagaaagaaaggaaggaaggaaggaaggaaggaaggaaggaaggaaggaaggaagaggugagagagaccuuaaaaaacuauuccaggccaagcuuggugaugcaugccuuuagucuccugcuugggaggcagaaguaggcuuuaaaguauagaguaaauuuugugugaauaagacaaaauuuuguuuuauagaaagaacaaaaucgugggcagagguggaacacaccuauaaucccagcacuugggaagcagaggcaggcggauuucugaguucgaauccacccuggucuacagagugaguuccagaacagccaggauuauacagaaaaaccccgucucaaccccuccccccacaaagaacaaauauauauauauauauauauauauauauaucaguauuuucagauuguugaggcuaguaaaauaaauuucaaaacggaagccuaugagauagugguacaauacaaacagugguuacaaauuguucacuuuaauuuauuuuugguauuuauguguuggucuauguguacagucauguguacaaauacucauuugagcacuauuuagggugucguuaugacucaccaaguaggcuguuuggcuagagaaccccaaauucugucugucuuuauuuggccagcauugaaauuacuagcaugugcuacugagcguagcuuuucuguggcccaaacucagcucuucaugcuugugaagcaacugaaugaccuccccaaccacugcuccuguaggccacauggcaacgaugcuccauccaugaagacacggaggcuaccugaccauccuuuauucuggguuuacaaccuauacaucuacaaaagcacucuuucauaaauaagcaaccccacagaaccacgugcugaaagguuucucuuggauauaauuaauaaaaucaucugcuucuuccuacaugucuuaaugugguggagaauucaaaauuaauacaaggcauuugcauacaauauaauaccuuaagacacaucucauagaugucugguauaaacaauaaaacuacuagauagaaaucaguuuggccucuccuaaccgcuaacuauauagugaucuucuucuacuaguuucucuacucuaugaaaagcugacuuaagcaauauuugugacuuuaaggagucagggauguaguucagugguagagcauuugccuaguaucuagcaacuaugagucccuagauuccaucucaacaguuucacaauacaaucauuacuuacauacaaguauacauucauacaugcauacauaccuaauuccaaaaaagcaaugucagcaaguaaggagacuaaucuguccugcuccacagcccuccacuguuucaggucucgugacuuuuacacuacaacaacacuauugcuuauaccaguuguuccucccaaacaaggggugagauaccuccuucugaguuaggguuucagaagcccuagagucaugucuaacaacagagcauuuccacugcuccugacugcccacgacaacuagaggguaaaacucuaccacucaauauaccuugguugaaggggggggaaaaauccaaguuggaauugaugugaaaacuucccuccuccauagcuagcuuucauagugcagacagcugggagagaaaagucaccaguguuauuauacaguggugaauccuaaaggcugcaauggugucauaaaaauuaugaggguggucaacugcuuucugguuggaucugaggccuguuccaaggagagaauacauaugcaauauaauaaaucugguuugcagcacauggcucagaaauucauaagcccugaggaugauaggugguaagaacccauucuuguuguuuugcuaaacuguggccucagacuuuauguuuauacccacagaucagcgcugcuuuacacccugaccugggaaguuucuaaauuaggcuccaguuacugcagacucauaaccagucaaaguccugacaauaagugauggcugcaugcccaguucuaagugaaauauaccugcagcauccacugcccucccaaaccaaggcuugaggaccaucaaggaagagggauagaacgcauggggguggggggcgcagggggaagcacuguggaugcuaucuucugaacauggagcacccacccugcugaugaacuauaguucgaugcucuaugguuaccuacacaagaucaagccaacaguaacauucaguauucuagcaggaaggacuacaggacucuggauugcuggggugagggugggggguaugaaaaggaaggacauaagguggguauccugaggguaaagauggucugugugugugugugugugugugugugugugugugugugugugugagaaauuuuuuuuuuuccuuuuuccggagcugaggaccgaacccagggccuugggcuugcuaggcaagcgcucuaccacugagcuaaauccccaaccccgaaauuguuaaauuaaaauuaaaaauuuuaaaacuccaaggacucuaauuuaauuuauuuaauuccuuuaauauuauuuagccugaaauauacaaaaaaacucggaaaccaaaagcaauugaucuaucccauaaauuuaaagaagcaaugcaaaggugggccugcuggcucaauccaaaccaucucaucacucaggaggcugggaggagacugcuaccaauccaaggccagcuuagcuacuuaaaguuccacugcucuuagaguuauaaaguaggcccuacuuuauauugaaauauaccgggaaauauugaauaauuaacugaaacaauggcaaggacagcucucaaacaacaggguuucuuuauuuaccccuuugcgaucaauucucuauaaaucuagggaguuuuacauacugaguaaugacacauuaauacauacaguaagaaaaaaaaauaaagcuuaaaaaacuuacuugauuaccgagaagagaguucuaaaaagcugaauaaaaauuucauugcaaucuuccaacucaaagcagauguuauaugauuuaacccaagcuaaauucuuaaaucaauaaauaaaaauaauugguuaaucacauauauguagaacuguuaaacaaaagcacacucauacaauuuaauuuuuacaacuagaauucuuuauaguaaagucuacaaagauucaauguacacaauuacaagucauuuuaaucuuuaaauucauggcuguggcaucaacuuucauguugaaaaguacuaaauaguuaggaauauauauauaaacuucgggagcaguaaauuuuauuuauaaauuggaaaugaaaauaaaaugucaaauguuuuuuuuucagaaauuauacuuuuaacuuuuuaaguauaaguaauaaugucuuacuuauuguaaaguacagauuuuccuuaugaaacauaagacaguuuauuaaauaaguuauguguaaaacaguuucacuuuauauuauaguuauaaaaaucuauaacaacauggaauuguacuuauuaaauaaagaauuuuuaccucuaauaaauaaaaauaucuauuaaacuguggacucuuuguauccuccaaaccuuuuaacugucugguaauaaagagaaauauguccuguuaaauaaaaaaaaugaaaaauauauuaacuuagacauuauuacuugucauuuuuuuaauaucuacaucuacauagggguauagauauaaaaaaguaauuauaaacuacaauaaagaacguuuuccuuuauuugaaugcugugggacugccuauuccauuauuuuaaaugucugaaaaagacuagcacaaaaucuuuuggaaguaacacuaaagacugcuacuucuacugcacacuucagggcuucucauuuaagaauacuaucuuacuauacucuuguccauaacagagcucuggucacugucuguacuuucaucauggcaagcuacuuucuccauguguaaugaauuuaaugagucuuuucauuauuacgccugacauguaagcaagcagcuuaugugugacaacaaaguuauugaagcaccccaaggcacugaccugacagcugaugauggugcuuauuuccuuacuuuuuaaaaagguauuuucaaugaaaauagcauuagcaugguacaaaaugauuuguuuuauugugauccuccuuacugguaauguauuuuggaaacugguaauguauuuugugguuuuccuuauauacucaugauaaaguuuauccuaugaacuaggcacaguaagaaacgaacaaaaguaaccacaaaugaaacaauguuauuaagguuauaaaaggagucaucauuaaaguaaguaugacuugaguauaaacacuacgacacuacucuagcuggggaaguauccaaggcagccaccauaugauugacaagcagauggcuaugucucaagaggaauaaagccugacagucaacuucauuauaguccuaaaaacacuauuaaacugaaaauuuauggaauguuacuccuggacuuucccacuuaauacucuggagcauggcugaucacaugugguugaaaguauguaaagagaagccaaacaggcagaagggcaauacugacuguacuuaaaaggagagaaggcucaacauuugcuguucuuccuagagaagcugaguuuaauucccagcgccuacaucugauggcucacagccaccugcaacucauuccagaauauccaacacccuguucuuaucucugcaggaaucuauguaugcaaugcacaugaacucaugcaggcacacacauauacaugaauaacuaaaaguuuuaaagucacuccaagguuuccaauuucccuaauaauuacugaaaaaauauauaaaaucaguucaauaaauagcuuuaaaaauaauuuuaaguuuuuuaaacaaaacagaaccaccaaaaugagcaguuuuagauauuuaauauucagcauuuaauaaccuguaaggcagacauuauaugagugggcaauccuagaacauuacuguuuugcaaacuaucacuaagccauuccuuauccuuccuaucuaugcaaccguccaucaggaggguuaaguaugaauagacaacccuuucaaagccucauucuguaccagucacuucuguagauaaauaauuaaaggaaucuaugaacaaaacccauauucauaugacaaaaauaaaaguaaaguuauuuuguaaacauucuauuuaccuuaaguuuaucaugggaaguauauggagcuucuggggcauagauucgaaauauaucagccaaacaacaugcuacgagaaggcgcacaucuuuauuaggguuccugagaaagaauucagaugcgagaugcaaggcuagugggagauacuguugcuuuucaucuucugaauccugauccauauccauaaaaguuuucacuaccaucuguaaaaaacauaauaucaaccuguaauacucagugaucagcuaagagccaccccuucuucccuuuguucuguaagaugggaaaagggagcuggaguuguguagguuagggguagaguacacaaagucuuagguucacucccagccaccacaaacaugcacccacucacccauccacacacccugaagaaaggaaguagucauaaaaagcauggucacaaagaagccuacaaaccccaagcaucagccuguacauuacccaaacaccacauuuucuuaaaaagaacuuagaaacuuguacuagcgacuguacugagcauuuacuucaaugggaucuugcuagguuguccacacuccucucggcuucuguggauucucacgcaguugacgcuggaggagcauguccacaugcuuagcuuucauuacucagauguaacuuaacuacaaaggguuugaucccauauacucaacuaaucugacaucuagcaucuuuuauaccauuuuuacuuuaugaucaaaguuguguuacacagcuuccuuaaaccuacuucauuuuaaauuuuauuugccuuuguaugauaaaaacccauauuuaaauguuucauguaauuguauuuuugauagaaaauuuugauuguaaauaccuuauguugaguuuaaggccaacuugaacuacagagcuagcugcaagccaguuugagauacauagcaagacucaaucuugauuauuucuacuuuucaaacauacaugaaagguauguauuuuucaucuauugcuaucuaacaaagucacccugaaugaagcaccuugaaacaacaauuaugcauuuaucacguagauaauauugggaacauggcuuaaaccaagcuuggaauuucucaagagguugcacuaugacagagauauuaccugaagccuugaaugagucuacaggguauuucaguaguaauuuauauucaugguggcucuacuuugcacuacugugugaaaagaguaaaguucucuccagggccucucuaaguagcuacaaaauaagcaagugccaugacaucugcaauguccucauaguuacugaggccacaccuacucuguguuagaaaggacuucacaaggaauauaagaaauauaagaauauaagaaaacagauaccauuugaggcaaccuugaagacuacuauaauguacugguuauauuuuaugucaacuugacacaaacuagguucaucaggaagagccuuauaauuuauuuuuaacuuuuaaauuauuuuuuuguguauuaguguuuggccacaugugucuuugcugcccuuggaggccagaagaggacacuggaucccagaaucugcaguuacaggugacugugagcugucacaugggagcugggaacuaaccuaggucuuuugcaagaacagccaguguucuuaacugcuaaauugucucuccgacacagggaacacaaucucaauuuaaaaaugucuccagagcuggcaagauggcucagcggguaggagcacuuggcucccagcaaccacaugguggcucacaaccagccguggugagaucugaugcccucuucuggcaugucugaacacagcuacaguguacuuauguauaauaauaaauaaaucuuuuaaagaaaucuuuaaagaaaucuuuaaagaaaucuuuaaagaaauaaauaaauaaauaaauguaaaaaaaugucuccaaaggauuggccuauaauaagcaaaucuguagggcauuuuccugauauggaguuacccaguucacuugagagggugccacccuugggcagguaguccuggacaguauaagagaacaggaugaggguaggugcagucaaacucccugcauuugccucaagaggccaugugagugagcugggcgugguggugcacgccuuuaaugccagcacucgggaggcagaggcaggcggauuucugaauucgaggccagccuggucuacagagugaguuccaggacagccagggcuacacagagaaacccugucucaaaaaaaaaaaacaaaaagaggccaugugauaacugaguaagccaggaaucagcaccccuccaugaucuccgcuucaguucuugcccugacaucccuuugaugauggacuaugauauggaacuggguguaagcuuccuucccaaguugcuucugguuugguguuucaucacagcaauagaaacccuaagacauaaacaaucccuccaucuuuaaaucuaauguaguucuuucuuuccuacaauggcucugggaauacccacauaacguauuugacuagagagacauuagcuagcuugauggagcugguaaauacuagcauacugagcugcaguguuccuuauggaaacccaacucccguaauguuaucaaguaucucugcuaaauggacaagccauauauauguaguacuugggaaagagaccuugaaaaaucauuuacagaaaaacagggugagcuagaugcccaucuaaaguuaaccuucaagacagcacucuauucuguuccugugguuuauguaucuguaccaucguuuuuauuucuguagguuuuuuuucuuccuuucuuuuuuccuaagugagugggugugcugcaaacagaacagaaaggcucagcaaacucugaagcagcugaagaaauagcucaaagccauagugcagugguuaaacuucugcaucaucauauuagaccuggguucaauuuauuaaccuccuuccuauauagcuuuuucuuuacucuaagaaauuauuauuauuauucuaagaaaucuuugccugaacaaguugcaaagauuuucuucuaaguuuccuaauaaaguucuauaauuuuaggcuagacauugauaucuacauuucucuuggggauaauuuuuuuaauuuugcugaaaguuuuaugucaagcaccauggcaacauugcuaaacacaccaccacaaccucuaccaauaaacauauuuucuucucuugaguuguuuuggcuuuuuugguuuuuuguuuuguuuucuuuaaaaagauugagggaaacaugguauguaggacuauuuuucuagacucuauuauauuccuguggcuuauguuucuguaccauaguucugauuacuacagaucuggggguuuuacccuuuuuuuuuccauguguaugguuaugcuacacauaaauguuuggaaguauucaaugaagguugcacauguaugugagugcacauguaugaagauguacauauauguauuggucaaagguugacauugaaaaucauuugugauagauuuucuaccguauucauugaggcagggucucggucaaacccagagcuuacugauguggguagacuugcuagccagcuugcuuuggugacacagagucucugccaucugagguuggaauuauaugccagcugcaaugcucaccugacauuuacaugagaucugaggauccaaacauuugcccaacgagugcuucaaccacugagccuuuuccuagcucugauuacuauaguuuuacaaugaauuuugaaagcagguagcauaugagugcucaggagguggaggcagaggcaggcagaucucucaguucaaggccagucuggcauacagugagguacagggcagcuagggcuacacagagaaauccuaucuagaaaggagaaggggggagggggguagagaaggaagagggggaggaggaaaaccucaagcaagaaagaaaauacaguaaaaaucuagauauaaaagaaacacagcuggauguggaggcccauaccuuuaaucccagcacuugggaggcaguggcaggcagaguaugaggccugccuggucuucagagcaagugacaaccaggacuauauguaaagagauccugcagagguaucucugugaguucaaggcuacccuagucuacaucuacaaaccaaggcuacacaguaagacuuuaucauggaacaaauaaacaaauaaaaaucaacucauucauaugguauacucauauaaaugaauggcagcugacaauuaaaggaaugauaaaggagauaauuccauguauuaaucuuuaaaauaugaugcaaugacaccugacacagagaacagaaaaagauuaaaagagaaagggauaaaacuccugggugugacagguauucaccauuaugacaguaguagugauguuaagaaugaccacaaacacacacacacaaacacuucugaauaaauauauccagcaaagauuaccaaguugauguugugacaucaauucucugacaccaaguaagugacuaucccgcaacacucaacaauaacuuuccagaguuaguguagaucucacaaguuaaaagguucuaggguuagagagauggcucagcuguuaagagcaacugacugcacuuucagaggucccaaauucaauuucuagcaaccacaugguaacucacagccauauguaaugggauuugauucccucuucuggugugcaugaagccagagcacacauauacaugaaauauguaacuaaagaaauacuuaaaagguaaacuucaccagacuccccuuagccacuucauaugccagccaaaagucuugugagaacacaggacuucugauaaaacagcuacaaaucuaggcuuugcuacaacuccuucagguucaauaauuugcuagaagaauaaacaauauguauauuuacaagauauaacucagaaauagucaaacugaaggggcagugcacuuaaaacugaaaaugacuuuuaagaaaauauauaggccugcaucuguaauuucaacaccugggauuagaagauguccacuauaaguugaaggauagccugaucuauguagugaauucccagccagacaacaagguuuucuguguuuuaaaagugagcaaaagaucgaaaaacaaaaaacaaaacaaauaaacaaacaaaaaagcaaaagaaacgcucugguaaucuguggcagaauacaaugaggauuuugaauauuuucuuccaagugcucauguguuuuuuuuaaaaaaacguuucccagaguggugcuacuaggccauucauuugcuucucuguugcuaucaggacacacucaccacaccaacuuggagggaaggguuuagcuuacacuuccaagucauaguccauggguaagggagucaggacagaaacuaaagcaagaacaagaagaaugcugcuuacuggcuugcacaguuuccuccugaccccaaccuccuuuucugugacaagaucucacuauaaagcccuggcuggccuggaacucacuauguauagcucaugcugaccucaaacucaaggaccuccucuuaccucgguuucccaaguccugggagucaacaguuuuguccuugacgauguucuaucauuuguccuauuuguaaagucuuuuguaaucauuuauuuguaaucauuauuuaaagucuuugugcuuguacaagaaaugaaaacauugguugcuuccuuucucuuuaauuucuuuuguuguuaaauggauuaugaaugagaggaugguugaaauguagauaaauaaaauauccaauaaaaaaauuuuuuucuaaaaaaaaaaaaaaagaaugagaggauggaaaaauuauuaagauucuaguagacaaguauauauaacucugaaaaagaagacuggaauucauccugguguaaagccgugaaauuccucagaaacuagaagaaaaggcgcagggaggacagaggcaaggccaagaaacaaaagcaaagcuuuccaacgccagggucuaguccacuagcaacuagaggaaaggaaacuaaguagccaguuuucugaauagcucaacaaaauuaacagcucuagcuaaaucaaccaagaagaaaugaccaaauucagauucaaaugaaauauauuucugacuagacaaaaauaaaacagauuauaaaauaccaacaaguuacauaacagaugaaaugcauaaauuccuaggaagucaaaaacuacugaaauuaacaagagaaacagaaaaugugaacagauaguaaugaaaaaaaaaacuacacaaggaaaaacccagguuucauuauuacuaaauuacuggaugguuaaagaacacuacuaauccugccacaaaaguaaaguuccagaucaauuugagaaauuaaccugauuuaaacaagacaagaauaccacaagaaaauuuguaucucuuauaaauagaaauuuaaaaucuccaauaaaauacugacaaaccaaaaucagcaacuguuugcuaguuggguuuugauuuuuuguuuguuuauuucuuuuccuuuuuuuuguuuuucuucaagacaggguuuuucucuguguagcccuggcugucuuagaacucacuucauagaccaggcgagccucaaacucagaaacugccuucugagugcugggauuaaagcuguaagucaccaccgccaggcuauugguuaguuuuuuuaucaccuugauacaagcuagagucaucuaggaagagggaaccucaauggggaaaaugcaauaucagacuggccuggccaguagggcaaaucugugggggcauuuucuugaaugaugauugauuugggaaggucuagcccacuguaagaaaguccuuaggacaagagguccuaaguuguauaaguagagaaaauggggaucggggcauacaggugaaugccuuuggucccuguacuugggagguagagacaaacagaucugaguuccaggccagccuggccuacauaguaaguuccaagacaaucagaacuacauacugagauccuaagugaaccaugaagugccaagacagcaagcagcacuguucuaugguuucugcuucaggcuccuccccuacuugagcuaaugcuuacucccuuggcuucccucaaugauggacauguaagucaaauaaagcuguucuccccaagcuaguuuuggucauggaguuuaccacagcaauagaaaguaaaccagaauggaaguauauauaaaauuacuuacuaugacuaaguaggauuuauaucaggaaugcaagguugguuuaauagcugaacaucaaucaagcaacagaauacauauuauuaaaauauaaaacaaaaucaugcaaagaugcagaaaaaguauuucacaaaaucuaaaacuuauugaugaaaacaaaaauauccauacucaguauaaguaugagggugaagauguuccuuuaugggauucugugagagagaagaaaguucugaggaauagauuggaaucaacauggaagugacaagacagcuaaaaggcaugggaaccagaaaggcaaccuaagaaaugcagaaggcagucuguaaauuacuccuccgauucugucuaucaacccagggugagaggcugaagacaaaaccaaaagcuaagacuugcagcucugugacaacaaacuaacagucuuaacuaccagagagaacaacaccucucagaagccuuaaauccagugcagagaaguauuugugacagcgaucccuccuguaaugacagacuagcacuggacaagaucaacuuacugcugccccuauagcucagaaugugccagcucagcaccaucacagaagggaccuucuguuuuugcuuuaguuuguuuuugaggacugagcuauucuagaaaucuucuagaaaucuagaaacaagucagggagucuaaggacaugaggccacaguguacagaugaagaaaaaccacagaagcagcuauggcaagagaaaggguuggcugugggccuacugagaaguugaaacagcagagcucaggcuauggagcuuagauuauuggugauacagcccucggaaugaaagaacaaucaccugugcucugagccauguccaaaauacugcccagcaucuggcacuaccucacuaccaaguacaguuugcugcaaggcaggacugagacccuaaacccaaaccuggugaaucuggauuacugcauuucuguagcuuccucccuuauaggauggcuuacagcugcacaaggucugaaagcaccagaccaguagacugagugguucccucagauccgcuccuguguaaagcucaaugcugucugcuuccaacgcucauaugugcucagaggacauccuucaacuuggauaucugcugucccaccccauguauccccaccccuacccaugaacaagcuagaagaccucaugagaaccugaccagcauauaugccuauagcuuguuggaacaagaaguggcaaagaaauuucuaaaguuaauaaaguccuuaaagacuauaaccagccgggcaaugguggcacacaccuuuaaucccagcacucgggaggcaggcggauuucugaauucgaggccagccugaucuacaaagugaguuccaggacagccagggcuacacagagaaacccugucucgaaaaucaaaaaaaaaaaaagacuacaaccaaaaagugcauaggcauuguacggauuuuuuuuuucuuccuuuagucaaguuggcacuaacuagagucacuugggaagagagaaauucaauugaagcauuugcuucacuagauuagccuaugggauauuuucucagguguuuauuaauguagccccgugcccauuucuaggcagcugggccaaccaagggaagcaaaccaguaagcagcauuccucugugauuuuucagucuccacuugggcuugaguuuguacuccgacuuuuccucagugaugaauugugaucaggauaugugagacaaauaacuccuuucuuccccaaguugcuuuuggucaauggugcuuaucagaguaccaaaagcaaucuagaaaaaaaauugugcuaacuacuuuuagcaaaguagcagcauuaauuuaaaaaaaagaaaaaagcugggugcagugguggugcacaccuuuaaucccagcacuuaggagguaaagaaagaaggacuagcaguuccggucacuccuagaaaaacaguuuaaaaaggccaguuugcacuauaaaacccuguucaggaaaagggggagggagggaggcugcagagacagcacagugcugaugagcaccuguugcucuuauagauuuggaccccaacacccgagugggaguucacaagcauccaaucccagggaguguaaaucccuugucugaccucaggggacaucaagcacacauguggugcauauacauaguagacaaaacauucaagcacauaaaauuuuuaaaauauauuuaaaagaaaaagagaaagaaaaaauucuaaaaauaggagccauuaagauggauuaguagguaaacgccugugcugccaagcugggaacaugaguuugaucucugggaucaauguggaaaggggagagaaagacuccuacaaguuguccuuacuauccaugaacacacaccuuaauaaaugcaaaauauuaaaaaauacuacaaguaaaccuaaugaaaaaagugaaagaguucaacaguaaaaacuauaaagcucugaagaagcagcugugagaaccacuguaggacugaaaggcugccucucacgcuuagggaccagcagagcuaaugcugugagacagcccuguuauucaagcugaccgacacuuucaaugcaaugccacccuccagggacugaguuuucagaacuagaaauagaaaaaaaaauccuaaaauucauaugaaaccauaaaagacccugaacagccaaagcaagucuaaaaagaaaaauuguggauguacccuugauuuuaaauuauacuucaaaaaccacaaacaaacaaaaaucaguccacugacacaaaauagauaugauaaccaauggaacagaacagaggagccaaacacacacaguccacugacagggaccuaauucuugacuuuugacaauggugccaaaaguauacacuaaagaagaaagaucuuuuugcugggcuuagcuauacaugccuuuaacuccaguguaccaggggcagaggcaggaagaucucuauaaagagaaucucuugugcaaugaguuaaaggucagccugguucuuggguucuggaccagcagggcaauacagugagaacccaucucaaacaaaccaagccaagaccaaccaaccaaagaccuuaguacucucccaauggacccaagccauagucugcagaagcugacacacuggccacacacugggagggguggacucaggaaagacaaaagaauccuggaaaaagggaaaguacaaggacucaacugauuacagggcuggagagauggcucagcgguuaagacucauauacauaaaaucaauauaucuuuaaaaaacauuauacaccgggcgugguagcacaugccuuuaaucccagcacuugggaggcagaggcaggugggauuucugaauuugaggccagccuggucuacagagugaguuccaggauagccagggggcuauacagagaaacccugucuugaaaaaagaaaaaaaauauuacaaagcaacaauaauuaagacagugugguaugaugcaaaaacauagaaaucaauggaaaugaauuaauucucuucaauagaaacgaauucuuuuuuuaaagguguauuuauuuauuugaaauauaugcguauacuguagcugucuucagacacaccagaagaaggcaucagauuauuccaucaaagaugguugugagccaccaugugguugcugggauuugaacucaggaccucuggaagagcagucagugcucuuaacugcugagccaucucuccagccccagaaacuaauuuucaacaacaggauaaaacaauggaggaaaaagggcuuuuuaauaaauggcauaagagaaggaaaaauaaugaucuuuaagaugguguaaggagcuggggaggcagauuggcaagcagaucucugagucugaggcaagccuggucuacaaagugaauuccacgacagccagggcuguuacacagagaaacccugucuaguggggaagggggaguuauaaagagaauugaauguccacaugcaaacaaaucaaauuagacccuuaucuugaaauacagaaaaauggauuaaggauuuaagaauuuaaacugggccuagaaagaugguucagcaguuacgaccagcacuugcucuuggaggacucagguuugauucucaucagccauauggugggcacaggcaccuguaguuccgguucuacucugaccuccuuaggcuccagacacauacacgauacacauacauacacauaggcaaacucacauauauaaaacaaaucuuuaaaaaaagaggaacuaaaacuguaaaaauggcagggcaguggugguacacgccuuuaaccccagcacuugggaggcagaggcaggaggauuucccaggacagccagggcuacacagagaaacccugucucaaaaaaaauaaaauaaaaaauccauaaaaacauuagaaaaaaacaaagucauaagucuuugugaucuugauuaaaguaauggauucuuagauauaauaccaauaaagcaagcaacaaaagaaaacagagaaacuaaacuaauuaauuaaaaaaagaaaccagacuaucaguuaauagaagaaaaaaaaaacaacaugagcauggacaauuuuuuuuuaaaaaucguguuucuauuaagguauuugaaauauauauauauauauauauauauauauauauauauauauauauauauauauuuguuauuuugguguguguauuauuuguguggugcugaggaguguacauguuagaucucacacauguggaagucaggacaacuugaaguuuauccucuccuaucgagugaguccugggacucucacucaggucccuaggcuugaccacaaaugcccuuacacuccguaccacacaaauaagcaaaugugauuuuuuaaaagauuuuaaucuuuuuagaacaagaaagauguacaaguugcuaaucaacacaucuaaagauuuacacaaaaaagacaaaucaaagccgggcgugguggcgcacgccuuuaaugccagcacucaggaggcagaggcaggcggauuucugaguucgaggccagccuggucuacagaaugaguuccaggacagccauggcuacacagagaaacccugucucgaaaaaccaaaaaaaaaaaaaaaaaaggcaaaucaaaacuaaaaggaagcuagcugugguggcauacuuuucuaauuccagggcucaaaagguagaggcaagaucaggaguucaagacuagccuuggcuacaugggaagcuucaggcuaacccaggaucuaagagacacugucauaggcuguuuaaguggaaacuuaaggguucuuuggaggaucaguuguguuggaugauguuuugcuguggcaaacauaugaaggaguguuuagcugaagcagacacaggugaaaggauauucugcuaaagcaagcaagugaaaggacagguaaaagaaaaggucaguuguuugcuaagacaggcauauguugguccacauuacauugcauaguugagcugcauuuguugggauuccauagcaucaaaacuuacugguggugcgcugccgguuucuugccacuucugaggacuaaggccgauuuggaagggugaugucagcuaagacagacucacauacacaagacauguggcaaggcaagaccaguacagggcuugugacguuuggagggaguauaaauaguacuugacggacugugagaacaguuuggguugcuuguagagcuagcugcagcacuuuacugagaaagagacacacacgcgagaacuucuguuggcccuagucccuccugcuaacucaugccaauucagcugaggucuggcuguucaugcuaaggcaugccacugcuacugaguuugcuaucccaacucuaccaaacuggacugcugguguaucugugaaguguuugcaagugaaucaagcuaccacugcugaccugugaacucaacugcucauuuccugacaacacagaugggaguugcuccacagaaccuuucuaaacagguccauuucucccauguccuuucuuuuccacuaccucuguuggguaguggguuagaagugagguuaaaacauuuaagaaccaucauuaaaaauaggguuugaaaaaauuaaaguuacaggaugugaugguaaucccagcacuuggaaugcagaguugaaucucugcucuauacaaacagugugacagagaaacugacuagaauucuucucuauaagagaagagaacuuguguggggcagggagaaggugugagauguggagcggucagaugguagauugggggggauggaauauggaguguaaaaaauaaaaauaaaauaauuuuuuuuuaaaaaaaggaagagaacucaaggaaagagauuuuuaaucuauaucuucuauugcugauaaauauuaauccaggaauagauacaaauccucaauaaauuucuaaauccagaauucccaacuaagaauucagacuugcaauuaauuagagaucaaggacccaauuauuuuggcuuucauaacucuccacaaaaugaccaugugcccucaauaugcuccagaaaggucaaaucauacuugcagucuuagcuuaacuauuggcagcagcucuaacuugucucaccaguguucaucuuuauaaaaccuuagaagcaccuagguuucacaacucauuucacaacuguuucaccuccagcauccuuaacugcacaauuuccuuucaaaaccuaugaacucuucucuuuuuuuguccuuagugaaucuauuuaccuugaacaugaacucuaaaucaaauuguguugucacucuugccuuacuuccucccuaacaauguggaacuaaacagccauuucaacccugcuuuaguguuauccuagaguaccaaccugaaggucaugggucuucagccuggagaguuucuacagucacauacgucaagccaaccagggcacugugcaauacagacagauacucauucuacuccaaucuccaaaauuaaccucuuacuuacaguaauaguaggacacuauaaggauaauuauauuuugggcuuacuaagauaccaggugucaauucaguucugucuuuuaaugaacagaugaccuaaauuaaauaugcuauucuuucugugauuggaaaauaaagacagaaacaaaauugugaugucuagacgugauagaaaaagugucaauucuacuaacagacaaaaauccccauacuucauccauucuaaggcuacauuuuaacaccuauugaguggggugugucuuacaauaaccggcagcagaggacaagagaacuagcaacuuacccuuguacacauuagacucugaaaacccugcacugcuaagcauagcauuuauauguaauccaacacuuccaacagcaggauccugaguucaaggucauucucaauuauaugggaaggcugagaucugauaguguuacaagaagcacuuucucaaagaaauaaagcaaaaaaagaaaaauaucaguuaacacuucuuaacauuaugugcaaaauacauaccacaauaacuagguuuuaaacagaugaaaagagcugggagaggcacaggccuuuaagcccagaggcagugaguuuguggugcaccuagucagcagacaagaguuccaggacagccagugccauagagagagacagugucucagaaaacaaaaacaaacaaacaaaaaacuaaggggaucugcaagauaagcaaacacagauacgaacucaauuccuaaaacccacaagguaaaaguagagacaauguguguccacauguacauauauauaaaaacaaucaaucaauaaacagaauuuuacgugagaaaaagcaaguacaauggugcaagcuuguaaucccaauccuugguagguacagguaggaagaucaugacuuuaagaucauccucgaguguacagaaugugcaaaauuaaccuguguuauaagauauaagagauccuaucucaaaacauucucaaaaucuaaaugugaacaguuucaagaauaauaaccaggggcuggagagauagcucagcgguuaagagcacugacugcucuuccagagguccugaguucaauucccagcaaccacaugguggcucacaaucauuuaaauaggauccaaugccauuuucuggugugucugaauacaguuaugacauauucauauacauaaaguaaauucuucuuuuaaaaaugaauaacggagccaggcaugguggcgcacgccuuuaaucccagcgcucaggaggcagaggcagguggauuugaguucgaggccugccuggucuacagagugaguucuaggacagccagggcuacacagagaaacccugucucgaaaaacaaacaaacaaaaaaguuuguccaaauauuagaauuuaauuggugaggagcugcaggucauagugcccaugaucucugcagccaucccacagugaccaugggggagacagaccaguggaauggcucgugguuagucagguauguguccucacccgucaaaccucaguaagguucuauuuuuaaacuguaaaauaugcucuagacuagugacaaacugcuauuucuaucacugaacaaaggucuaaaaacugaagguaaaaaucagagggccccuuucacuauuauacuuaagaccauagucaauuuuuuugcuuccaccuuaacauuuggucagcuaauuuaugguuuggguuuucaugagaagaauguauccaauaaccuuagaauacagcuuuaguucuacacuuuguaaaugagacugucagccaacuacuuugagcucucucuucaggcagaugaagcaguugaggaggauuucacagugaggguucaguuaaaugaucccaaguacuguaagaaaaccaguuaggggcuggugagauggcucaguggguaagagcacccgacugcucuuccgaaggucaggaguucaaaucccagcaaccacaugguggcucacaaccauccguaacgagaucugacucccucuucuggagugucugaggacagcuacaguguacuuacauauaauaaauaaauaaauaaacaaaucuuuaaaaaaaaaaaaaaaagaaaaccaguuagcuacaaaagaagagcaagaggaaaccuaaccuggaaauuagauggucuagacguguuucucaaauccuaagugguauagagucaagugacguauuuuguuuuuaauuuuuuuaaaaaagauuuauuuauuuauuuaauguauguggguacacuguugcugucuucagacacaccagaaaagggcaucggauccuauuacagaugguugugagccaccauaugguuacugggaauugaacucaugaccucuggaagaauggucagugcucuuaacugcagagccaucucuccagcccuuguuuuuaauuuuaauauacuuauaaaauaaaaaaaaauaaugcacuugaucagauacuauuacacugagaaacaaccuguaaacagaaacucaacacccaauguauaaugcacggaacuaaaagcucuuaggggcuggaagacaacucaguguuaaagagcacuuguucuuccauaaaaucugggauuggcccccuacaaagacacaggagcacacaacuaccuauaaguuguuccaggacauacccucugcaggcaccaggcacauacaucaaguacagauacaugcagacaaaacaccuauacagauuaaauauguaaaauuguaaagaaacaaacaaaaaaagcuccuaggugaugccagguauagugguacaugccuuuuaccucaacacgcaggaugcaaagacuaugggaucugacuaagaggccagcgcuuuccagagacuauuacuuuuaaauaaauaaauaaauaaauaggggucgagaagagagacaggaccuagaaaaauggcucugccagucgacaaagugcuuacuguacagcaugaggaccuacauucagaucccagugccuuuguacaagcuggggauguggugacucauaccuauaaucaaucccagaaagcaaaggggaaacugggagagacaagcaucucaagggcuuagcauccggccagucaaaccaaaaagguaaaccccaaauccagugagagacccaagaaauaaaguggagaucagaagaagauacauacucuggccuccacuccugugugcauaccaucccggugucaugugcacagaaaugcauacacacaaaaaacuuuagugaacaaugaauuaaaacaacaaacauaaacaaggguaauuuggacagagaaguggaauugaucccaaacugucagacaacauuaauuaguuaaggggggggggggggggauaagaaauaaacauuugaagaguuaacuguugaauguuucucaaaaauaacaaaagauaggcuaggugugguggcacaugccuuugaucccagcacuucagagauagaggcagaauugaguucaaagccagccuggucuacacagcaaaugccaggacagucaggucuacauagagaaacugugagcauauacgcacgcaugcaugcacacaaauaauaauaaucaaagauaaacuauagaaauaauaacugaguaucccaaacaaacuaaauacaaagaagaaaaucuuggaaacaaccagagaacaaaggucuccuuccuagcccaggcuagccucaaagccaaguuuccucaguuucuucuuugugagugcugaaauuacagacguacucuaccacacuuggcuguaacugcugcucucauuugaguaauuugcaauccuaaauauucuguuaaauaacauuaaguuugcaaaugaaucaaaaaguaauaaacucauguaaagguuucauuuuugaugacucagaaguguuaaccgagaucacaucuaauauguaaauaaaaauuuuuagcugggugugguggugcaucccuucaauaugguucuugguaggcauagccagaugaaucucuguaaguuugaggcaacacugcucuagagagcaagugccaggacagccagggcuauaagucuuuauugacccuccugccuuaggaaaaaggaaaccgagaguggcacaacccccaccccucuucaucucaacccaagucauguauaauugguaggcuaaggcacaaggacugcuuagcuuaaagccagucugcacuacaggaucagaccuuaugucaaauaaacaaaaccaaaaaagcaaagcucucgggcuggagaaauggcucagugguuaagagcauuggcugcucuuccagagguccugaguucaauucccaguauccacauggugguucacaaccaucuguaaugagagcugaugcccucuucuggugugucugaagacaauuacaguguccucauauaaauaaaauaaauaaaucuuuaaaaaaaaaaaaaaaaaaaaaaaagcaaagcucucuuuaguaaaacgucugagaacugccacuucuacuuaacaaccuuuaaaugcugaagugcuguacuuguagccaucaguucaaaugagaaggaacaggaugucaugaaaaacacuuggaaaccuagaaugucugccuuuacaaguaaauacaugaagacuacuuuuguuaaauuacauguuuaaaucaccaguaaaauaguaaaauuagaaaguguaaguuccaggugacccugggcuacauaaucauuaaaaaaaauuaauagccggguggugguggugcacgccguuaaucccagcacuugggaggcagaggcagguggauuucugaguucgaggccagccuggucuacaaagugagcuccaggacagccagggcuacacagagaaacccugucucgaaaaaccaaaaauaauaauaauaauaauuaauaauaguaauaauauuuuagaaagcaucauuuagaaaagaaaaaugacaauuaacaaagauauaaaguuauaccuaaaaaguauauagauuuauaaaguguauuucuagaguucacaauuauuuucuuuguaucaagaucacccaggaguuuacuuaaaaugaagguggagggacuggagagacaccugaggcuccagguucauucuccagcagcacccacaugacagcucacaacugccuuuaacuccagucccaggggacacaacauccucuucugaccauaagcacugcaugcacaugguacauauacacauacaugcagauaagacacugauauacauauaaaguaaaaaccuaaaacaaaguaagagggcuaaagagaugguucaugguuaaaagcauguacugaucugguaagaccccaaguugccaaaacccacauggcucacaaucaccugugacugcaguuccagggggaauccaguauuuuuggccucugaaggccuguuuacaugugaaggcacaugcauucaagcaugucacacaggaucaaugacacacaugcacacgugcaaaaagaaagcaccaggugcuacuuaggaacucuaaaacaaucuacuuuaagacacaaugcuuauaaauaguauuuaaaauccuuguuggagaacuagagauguaccuuauucguuagguacacuugcugaccuggguuugguucccagagcauauauggucacucaaaccaucaguaacuccaguucaggagauuugaugcccccuucuggcuucugugggcaccaggcacaccuacaguacacauauuuauauccaggcuaaacacucauacacauaaauaaaaauuuuaaaaucuuagccugguaguggugauauaugccuuuuaucccagaacugaguucaagaccagccuugucuauagagugaguuucaaaacagucaagggcuauacaggaaaagcaugucuugaacaaacaaauauacauaaacuuuaaaaaauaaaaguccuagccaggcagggcgugguggcacacgccuuuaaucccagcacuagagaggcaaaggcaggcagauuucugaggcuagccuggucuacagagugaguuccaggacagccaaggcuacacagagaaacccugucuccaaaaaaaaaaaaaaaaaaauccucuaauauccauuaaaaaugcucacuuuggccacauaagcaaaaacaaauaauauuaagaggcaaauuuaggacuggcaagaugauuccauagguaaagauacuugcugucaggccggaacaucugagcagaucccuggauugcuauuagguagagaaagaacugacuccuucaaguuguccucugacuuccacacgugcaccauggcacacgugcacucccauacuuacaaggacaauaaauaaaugucauuuuuaaccuuaggugacaaacuccacuuaguuaagguuaaagaaaguauaaacaauauuuaaguguauaguguucaggauuuaccauguuaagaaacagaaccaaagcugggugguggcacaucucucaguucaaagccaaccuggucuacaaagugaguuccaggacagccagggcuauacagagaaacccugucuggaaaaaacaaaacaaaaacaaaaaggaaggcaggaaggcaagcaggcagaacaagacaaaacaacccaaagaacuagaauagaaacagcuaaaagacagcucaaugaguauaguaagggcuguauaagcaugacaacuccaauucagguccucagcacuccuacugaaaacaaaaucaacaggguagugggaggugaagaggacugaagagaacgugaugcucgauguucuuccagaggacacuaggcugguuuccagcauccaugccaggcauggauggaguuacaaccuguaacuccagcugcaaaggauccaacucuuucuucuggccucuagggguucauauacacguggcauacucucagacagacagacacacauagacauaaacaaaaacaaaucuugaauuauaaagaaaaaaaaaugguuggaaccaagugagguaaaacaccccaaagcaggaggaucucuuugcgaucaagggcagcuugucuacauaaagagagaauuuuaaaaaauuaaaaugagggacaugcaguccacaccugcaaccacagagguaagagugugccuggguaaccaggcaaucucucuguuuggugaacuccagguccagagagaaagcaugucaagaggagagaggaggggaagaaaaaaaaggagggaaggaaggauagggucacacagacacacacacacacacccccaucacacagcacuggcagcugcgggucucuauggcuacgguaagcacaugaugaaaagcauccuggucuugaaaggacuaauacacacacauacacacauacaaaagaaauaaaugauaaauguaacaacuguuuuaaaggaguaaacacaugaguaaauauuuagaggucaaggaaaaauaaagcaaaaauaggaauaugaacuucagugauaacacugugcuaacuuggauaaagguaucaaucacucuaagguagacugugaugagggauuggcugggaacuaccuuucaguuaauuuugcugugaaccuaaaacuacucuaaaaaauguaaccuauuuaaaaugcaaaccaaaagacaggcccaugacuuuaauccuggcacucaggaguagaguaaaucugaguucaaggcuagccuagucuacacagugaguuccaaaacagccaggacuacaaaaagaaacccugucuuuaagaaaaaaaaacaaaaacaaaaaaguuuaucuauugcaguuaaagaaaugaaaaacugaauaaacaaaaugguauauauaauuauucuacaaggauauaaaagcaauuucauuuuauuauugccuacuuuuuaccacuuucuuuaaagauauuuacaaauauuuucaagacauauucuaaguaacuuuggacacccacaugcacgcaugcaagcacacacgcaccagaaagcagcuaaaguuacaguuucaaguaacuaacauuguacuuuacaugcccuuuagugggaaaaacaaaacuacagaggcagcaggacaccucagccagcacaagugccugccaugaaagccuacaaucuguaguagaucccagggaaucacagaaaggccacagugaaccaacuccaccaagcugucuucugacacgugccaaggacacaaaucauacagauauaugcacaguaauaauaaaauucuaaaacaaaaugaacugcagggaaaucuuguaggcagguauuugaagcauaguauagccugagacccuagcaccucaacuuuuaacaaaagaaaccuauaaaugguacugguaaaaaagaugugaauuuacuuugugcuuaagcaaaauggguaaauuuaucaauguuauugaaaacaggccuaccacguaaauaagggggaaaaaagcaacggagaaagcuuagaaagaacuuuauauaauuagaguuucaacuagagguaucaaacaagcauuugauuuauugauuaaauggacuuaaguuuauuuccuagcuuugaauauucagagaacuugaaggaauuauacccuaugggcaaacacaugccuagauuuugauuuauaaacaccaucuucuacuaaaacugaaaauagggccaccagaauaaaaaagcuaucaaaaucugagccaggaaguguaagauaaauaacaccguauacaagaaaaaguaaaaggccuacuccuagaaagacagcugcaggugauguucuuuucugagcaccuggcaagaugacggaaguggaguaaaagaggcacaacuuccucaaguucaccuacuaugacguggaccugaaccagcugcuaaccauguccuaugaguagcugaugcccuaguauagcaccugccagagguggcaccagaagcaaggccugcaguggacacugcacucacugcccaguagcuagugcaaggccaaggagaugccccacagagaagccagagguggugaagacccaccucugagacacauccugcuggagaugauggcaagcacgugggcuuguacaacgaggccuucagccacaagucucucaucaccuacgcaggccacccaagccucccacucuguuccccucaaggagcugugaccacaggggagguaggaagcggguacugggaaaagcagcccaguggucacgagagcacuugcuuaguucaacccucagcuugaggagacucuuuggcugcacaguaguuccugaagucgaagaggcaugaaaauuauacaaauuccaggaccaacuaaggcugcaccacaagacacugguaguaaaaaggauacuagagucaaaacacucauuuuagacagucugaacuccaacucagaaaacagaguuugaaguuugauucuaaagaugguaaauuguaaguuuuuugucaacuggacacaauuuagagucacucaagaagaaaaacccucgauugaggaauugccuucauccaauuggcaugugggcauguauguaugcucuuuguuuuuuguuuguuugucuguuuuuuuuuuaaagauuuauuuauuuauuauauguaaguacacuguagcugucuucagacacuccagaagagggagucagaucucguuacagaugguugugagccaccaugugguugcugggauuugaacucuggaccuucggaagagcaauccggugcucuuacccacugagccaucucaccagccccuguuuuuguuuuuagacagggucucacuguguagcucugguuggccuggaaauuguuaggcagagugggcugaccuugaagagauuugcccaccucuggcucaggagaguuggggguauguuuuugguuaaugauuuaaagggguccagcagugccacuccuagacagauaguccuggguuauagaugaaaacugagcaagccauagagaacaacucuguaagccaagauagcucuuccuuggucucugcucaguuccugccuuggcuucccuagaugaacuauaaagcaaccuauaauccccaguugcuuuaacugugucauuuaacacagccacagaaaagcaaaguaggacugcuggaaaacaagcuauucuaauaaauaaucuccaaaagcaacaacuuucuucacaauggagaacugaccaaaugugaacaaguauuaaacagcauaauuaaaaggacaaaugacauguuucucaaaggacacagcucugaccaaaucguguacuugccauaaaacuuaacuaagucuaagcaggaggaaauaagagaaccagauuauagaacuuuaagauacacuacaugaaugcauuaaaaauguuaugcuaggcuggagagauaggucagcagcuaagaacacuggaugcucuuccagaagacuaauguucaauucccagcaccaccacagcaguucacaaguaucuguagccccagugccaggggauauaaugugcccucuucugaccuaugaggccacaaagcacagacaugcaugcaaacaaaagacucauacacauaaaauaacuauaccuaaaauaaaaaaguuuacgucagagagcugaggcuuuagcucaguguuggaacacuggccaaccaagagcaacucccugagcucaaacaauacauagacaaaaagaaaauuuuaaaacaaauaugaaagacugggcaaugguggcacaugccuuuaaauuccagcacccaggaggcagagacagcagacagcaguucucugugagucugaggccagucuggucuacagagugaguccagggcuacacagagaaagccugucucaacaaaacaaaacaaaacaaacugcccccucugaaagaaagaggaaugacaaaaauucaaacagguuaaagagaaauuacaaauguuuauaauucuauacuagaauuaggggagagugggaaaagugaacuuuuaacauuuucaauuuccuccaaaaccaacgucuuuuuaguauucuuaauacaaaauaggagagaggaaaauugucuacauacaaguugcaggccagcuaguuuggaggaacaaggcuagcaaagacaagaaagaccuugccuuaacaagguaggagauaacugacucccaagaguauucucuuuuguuugguugguugguugguuuugggguuuuuuuguuuuuugguuuguuuuuuuuuuugagacaggcuuucuuuguauaguccuggccguccuggaacucacucuguagaccaagcuguccucagaaauccaccugccucugccucccaagugcugggauuaaaggcgugugccacccggccaagaguauucucuaacguuugucaagaaagcacacaaacacacacacacacacacacacacacacacauuuuuuuuaauguagguuaagaguaggaagaauuuuaaauacuuaaccaugaaaguauuuaaucacuuaccaaauacuuguuguguaucuauguaauagguauuauaauggaaaaauaugcuguaauaacuaaaaguaaaccaggcguguuggcacacaccuuuaaucccagcacuugggaggcagaggcaggcggauuucugaguucgaggccagccuggucuacagagugaguuccaggacagccagggcuauacagagaaacccugucuugaaaaaccaaacaaacaaacaacaaaaaaaaaaaccccgaagaaccaaaaguaaacaaaucugaccuacugccuguauuuguaaagcuugcacagaagacaaaucaaagaaagaaauggaccaacauaauaucaaaacuguauaacugaaggaguuaagacuaccuaauaugaaaucuaagacacuauagaaaaaggauguaugggggcuauauaaugggaacuaucuauuaaagcagaaaugaucccgguauauucaaggggaccaaugcaacuguagccaaaccuugcaaaauacauaaaguaauuuuccagaaacuauaacuaaaauuuuacuaugaccagcuacuaugauguacaauuuuaauccagcacuucagagguaggcaaaucuuucugaguuugaggccagccugguccguguagaaagaccuauggcuauguagacccaagucucaaaaguuguuuugucccagcacucgggaggcagaggcaggcggauuucugaguuugaggccagccuggucuacagagugaguuccaggacagccagggcuauacagagaaacccugucucgaaaaacaaaacaaaaccaaaaaaaaaaguuguuuuguuacuacccgagcauggagauguucuagguacauugcauaaacccagcagagaguaauggcagcucuuggaagguagaagcaagagaaugaguucaaggucauccucagccauacagcaagcucggggccagcuuuauggagccaguaguaaguaaaaguguuuaaacaacaaaaugcaaccaagugugacaaucaguucaaucccuggcucccaaaugguaggaaaaaggagaacuauuucaaauuguccucugaacuccacaugcacacuuuggcacaugccaaccuacacauaaacuuuuuuauaauuguggagucaaguucauguagugguacguguuuguaauuccuaggauauaagaaucagaauuuugagguuagccugcucauaccuacaugagaucuuucaaaaguagguaauaugcccagcagugguggcgcaugccuuuaaucccagcacuugggaggcagaggcaggcagauuucugaguuugaggccagccuggucuacagagugaguuccaguacaucuaggaacacagagaaacccugucuugaaagaaaaaccagaaagaaaaaaaaaaaaguagguaauaugaaggggaacacugacugaggauacuggucaguugguaggguuccaguccagcaugcaucaaauucuagauucaauccucaggcauaauggucuacacuucuaaucauagcauuuucagauuuggaguuaggaaguuaaguucaaggccagccuaagcuacaugaccugaccuaacuugagggcagccugagguucauagcaaguuuguaucuuaaaaaaaaaaaaaaaaaaaaaaaaaaaaaaaaaggcaggaaauuaaaauugauaaaaauaaaugucaacuuuaacuuaugaaagaauacauuaaauaaauggauagcuagccuaguguuaaccuugacuuucaguuuagaauaauucaauauaucuauagguaaaagauauauaaagucauaauuuccuaucuguuuuuagauuuuuucauugcauuuuacuuaaagaauaugugugugacagagacuaugcauggcuugcauguggaggucuuagagacaacuugugggaagccauuguuucuccuaccauaugagagauccaacucaaguuuucagauuuagcacauuuaccuaaugaaucuugcuggccccauauuuuucauuuaaaaaaaaauguucacccucagaauucaaguucucaauauucuuuaauuuuuggagacagggucucacuguguacuguuagguggccgagaacacccuauguagaccaggcuggccucaaacucacagagauccuccagucucuucugaaguguuugaauuaaacaugaacaccaccauguauggcuauuucaauuuuuuauuuuuuuauuuuuuauuuugguuuuuugaaacaagguuucucuggguagcuuuagaacuuagccaguguagauccuuagagauccaccugccucugccucugccucucuagugcugggauuuaaggugugaaccaccaccacuugguuuauuucaauauucuuaauuugaucagggagggagcugggaaaacagcuaagugacugguguuugccuccuaagugugagcuccaauucccagcacauguacuucaugugguugcaggcaacugugaucucagcagagaauucuggaggcucacuggaaagccagcccaacuuaacaggugaacucuaggccaaccagaaaccuugucucucaaaggacagcauuucugaggacaauacccaagacuguacccaauaacuggccuccucaaacauacacaaaagugccuuguaugagaacucuggaaguuugcuuuuuuuuuuuuugguuuuuuuuuuuuuuuuuuuuuuuuuuuuuggguuuucgagacaggguuccucuguauagcccuggcuggcuguccuggaacucacuuuguagaccaggcuagccucgaacucagaaauccgccugucucugccucccaagugcugggauuaaaggcgugcgccaccacacccggcacgggaaguuugcuuuaaaaaaaaaaacaaaaaaccacagaaauauuauaagacuauguuuuaaucccagguguggggacaugaggcugauuuacagcagcugacuaaugacaagaggaacgguuuuaccagcugcagagaguuucugcgucuguauaucuggaauucugggagcuuucagaggguauauaaacaccaggacccugagaggcagagucagugauuguugguccuuuacagagguuguuugcagcuuguuaguagucaugcacaaagaaacaagaagaaaucagauucaggccucucuccagccccuccccuucuuuaucuagugaugggguggaacuggaggacagaggaugggaaaagccccaccaaguagcaaagaccagcuacagugccucgcucgguaccuacacaugaacaugcauguccacgcaguaaccucacacguaaaacaaaggcacauugaguggagcuugacggcacguucccaacacuucaaaggcaaagagaaguuguggccagccuugucuacagagcaaguuuuaggccagaaccuaucuugaaaacaacuaaaagauuuaucugcuuuagacuaagguauagcucagagauagagcagagccugaguuuaauaugugcucccugcacaagucccuaccucuagcccuggaaaaagaaauggaaagaaaauggaaaaggugccuuuuaauuaaagaaaccaggucuuucaaaaaggcaacaaauggaaacuuaaacacaggaacacuuuaaacacacaacauuuacugggcacugugcucaauccuaaaaucaggcccuagaaauccauuuuauaaaguugcauaaggcagaaacauuguccucgauguucccugccuagccuuccaccaugucugacuuugaagugcaccuuuuaacacaaugggucucaaccuuccuauugcuuccucauguuguggugaccucaaacaaaauaauugcauugcuacuucauaacuguaauuuugcuacuguuaugaauuacaguguuaauaccuaauagacaggauaucagauaguugggggggggucucgacucacagguugagaaccacuguuguuggcagggugugguuaugccacuaguguuuugggaaguggaggcaggaaaaugguuaaguucaagggcaggcagcuggguuacuaguccucuuuuuuuuuuuuuuuuuaaagauuuauuuuacuuauaugagcacacuguagcugucuucagacacaccagaaagggccaucagaucccauuacagaugguugugagccaccaugugguugcugggaauugaacucaggaccucuggaagagcagucagugcucuuaacugcugagccaucucuccagcccacuaguccucucuuaaacaagucaucaaacccauucuuugccucucccacuguccacacuguacuucaauaguuuaagaucuuucacuagacaacuguuagccuccucacagaacgucacagccuacuccccacaagccaacugugacaaccaaaaugacucugaaauugccuacaacacccccuggugcaucaaaguuguccaaagugacaaucacugcucgaaacugauuccauaacaaacacugcccuaugcaguagcagaaaaguuaagucccaaaaugacagcgcaagauuguuacaccaagaaaaccggugcgcacacacaaacacaaacucacagacauaucaacaaucccguccuucaacucucuugggcauguguacuaaaaucaucauuucuccuuaagcucgaauucugaaaaaucuguacacuguauuaaguuuagcccacuguauagauaguuaagcucccauuagaaaauuacgagaaucuaagggggacaauaugguuguuugugcucaagucagucuuuucuuggaguagauaauaauaggaacuuucguggguaaaaucacugucuacaccucaggguaucgagccccuuaaacaacauccacuaaauaaaauaaccacaagggaaacaacuaaccaugcaugcguucuuauggacagaaaaugaucacacucuuuaaauuccccguccuuucagaacuuauccaaagauaccgccaaguuagaacaggacuuuuccggggcgguuaagauaucuucaaaaacuuaguacuaaaaacuccaaaggccagguugagaguaguccaaugaaaccacacgagucacaaaagccauccagagcgcagaucgccgacccagacccuuaccuucagacguuugaucauuucaucgguggugaucuugucggugaucucuuuuacucccggaggguaagcgaucuucccguccgcacucacgacgccacagagggcaguggcaggcuucggcugcgugaaguccauccuggggaauaacuuuucucucacaguccucuaccggccucuaucggucagaaaaucaaaguucagcgggaaaaggggcgacuuuguaaccucuuuuucauuucaaaaaucucuaaucuagaaagggcccuuucuuccccccgaggccggggaccccgccacucgcuccuucccuggguuucggacccggcuaggcguccgccacccccacccgagccagccccggugccacgggguucucggcugcagcagccccggccgcgagaggcgccgagcagcucccggaguuuccuagcccucuuuucacaaugaaauguauccccgagcaccuaggacggaaguuugguggccucggggggacauugaggacccaacggccccacuuggcucaggagaagcggcuggguccccgccuggccggucaccuccgggaaaggagacucgaggccuagaggguucagcuuaggccgcaaaacuagguacccaagaggacccacgcgcggcgccggcgcccgggagcagaacgccauagccgugccgagccccgggcucccggcguccccgccgcgcggccgccccuccccggccagcccgccacccccgccagccgcccgagccccucgccaggaagcgaaggacccggcuccgcacuucacauuuuuguuccuuaacuucagcaaccgagcccggcggcaucucaagccccucggucgcccggcgcuccucggcaccgccaaggccugagccgccgcuccgggcaaccccgccgggccuccgcgcgcgcccuccccugcggucuccccuuccgucccucccucgccgccgagggcgcgagcccggccgccgcuuuaccuccuccucaugcgggcggacggugcagcgagcgccgggccucugucaggugguugcgccgccgccgccgccccucgucgggcugcacacaaagcggcuccguccgucccgccgccgccgccgccgccgcccgcccgccccggagcggcgcuggggcuggcggugccgaggagcagccgccgcggggggagaagcgggccgagcgugcgccggccggggcgacacugccgcucuccgucgggcugaggaagcgcagccucggccgcggcuccuccgagagcccgcgcgcgggugcacgcccgcgcgucccccgcgcccgcccggccgcucgcucgcucgccggccggccgcccgcaccucgcgcccacccgcaccagacgcccucucgccgcggcgcgcucccggcccgcccgugccccgcggagccugagcgucgccgcgcacagccggagcccg

SEQ ID NO: 2477 - RNA, 2827 nt, Mus musculus
uuuuccucagccaaagccuacuggaguauuagguacagugaacaagccuuuaucagcaacgggaaggaagccuuauguuagaagcgccggcacagagacuggaagcaauauuaacgccaauucagagcugaguccuucagccggaagucguucaaggcaauuuauuuuucucugaauacaucuuguuuucuugcucacugcuugcuuggcuuaacauuuuaacuuauuuucaaggcacuggaucauagaauggacuuauguaaaaaaguauuauaauauucaugugauuaggguuuuuuuuaaugagacucaagaguguaguguauguuuccugagacagggucucaccacguaacuugauauuaggcuagguuggccucagauucaccugccucugcgucugcuucucaggugcugggauucaaggugcacaucucuauaccuugcuuaaagagugcuuuuugauccagugccuuguuaugugucaggcuaugugcuuguggcaggccucuugccucagccucuagaauacuggaauuacaauccuaaaugccacaauuacauagcacacuucccaaaaugcauucuaaaacaccagugaggucucucaggcaaguggauauauaguaauauaaccagucaauaaaaauugauuauuucguuucugaaauuaaaaggccuugguuuugguuauguuuguuuauuugucugucuuucuaguagggaacagaguucagaggcaucagaaacuggaguuagugaaaaugaggagaauccugugagaauaauuucugucacaccuguaaagaauauugauacuguaaagaauaagguaaauguuauuuuauuguuuauaucucugaaauuugcacaagacagggcuggagauauggcucagcaguuauguacuagcugauauuucagaggacccaaguuccuuuccuacacagcaaaggauaauguuaaggagucauuucucuccuuccacguuauugaggcaaagucucuuguuguuuguacugcucaacuuacucgaggcuggcuggacccaggcuuacagaugcuugccauucaauaaacuuuucuggcuuauguucugggaauggggcucagugucaguagugcugagucauguccucagucuuccugugggcacagggggcuucuaacucgugauccuccugccaccagauagcuggggugacagacauguuguucgugauguucaaacuggagcauccaguucacccauucacuuuccaucaguccgucuguccguccauccguccauccauccauccauccauccauccauccauccauccaucguguguuacccaguauguauguaugaacgacuugcaguuuuuauggaagccaggagaagaauuugggcacuugggguuugcauuugugguugugagcugccauguuggugcuaggaaugaaccuagguccucuucagaagcauuaguccccaccuccucaucuucuuucuuccuuuuuuaaaagauuuaaucuuguuuuaugugugugauuguuuugcugcauaugccagugaaccacaugugugacaagugcccacaguggucagagcaggguaucagaucuucuggaacuggcauuucacaggguuaucaagaguaacaaguacucuaagcccuaaacuagcucauggagccccacucccauuccuuacuaguguuuuuaacagggaagaaagcaggaaagcuaaacgauaggagaugcgucagaucuuguuuuaguaugugcucugccacucgacuugaauugauuuagauuaccugccuucauuaacuuuccauuaacuuguuuaaugagagguagcucaucuccuacuacaaguaggaauggcuugaaauaacauauuacuagacaaaaaucaggacuaucucacugccauaauucuugcaguacagaaagaaauaagucugcuuacuaugggaucccuauauagaguuaaguaggcugggcauaaagaaacugaagcuacauacacugcuauagacauugggucacauauacuuacaguagucagauguaguacauucauggggccuuguuauuacuugucuuggugaaggauuuuuuuugagacagucuuaauccauagucacaacugcccaggucuuuacuauuucaaguccuugaguucauggccaucgucaugccucaaucucucaaaugcuaaggguauagguacaugccacuacauccaacuuagcugugcauauuuauaaaaaaucauuguauuugcucugugugucacauaguaacauaaaaaugaaugcucaaagaacucacaccacauggauucaggugagagacauugucagaacugucucccacauuuaucuuucuauuuacuugguuuccuuacacaugcaugugcaccuaauuugcauaagugaauguggccuuaugggucuaucugccuuauagccaagauugacuucaaaccugaaaucuuugugccccagccucccaagaguugagguuacacaccagucaccauauugcuuggguuugggcuuagcucagccauagaggaccuacccaggucuagggcucuaaauccccaguuaauaaaaacauugacugugugacugacagaguuuguuuuccccaggaaucucccuguuucuuccaguuacuuaaugucuaguccuuuucugagccacugugaguuguugggugcgguuucuguggacugcuauagggaaggccuuggauugcccauccuugaagagaaacuucaagaaagccccacccauucuggagauguuuuucugggaaaaugaaaguu

SEQ ID NO: 2478 - RNA, 2937 nt, Mus musculus
agucgcaaugaauucugaugguucauuaaaaaaguuuagugacacauugaaaagaccuuacuauucucuuuacucguagggcacgauucaguggcuuugccuacagggcucuaccuggccugcuaccucacccucuucugccucaacaacagcugcacuuauuguuacaauguuucugcauuguaacaccuuaccaaacacuuuaccaggagccgccuugaugucacucagggacauucuucaggaccuaaccagauguuucccacaaaagcagaagauauuugaagaccaugcuuguauuauugucucuuccaaggugguaaauugucccuugagcccccucuuuccuuuacaaauaggaguggccaauaaguaguugcaaacucauucucuucugugaccuugggcaaguugcuuacacucagauccuuagucccagauucacugugguuuaaaauaacuuaauaaugauauugaaaugcaaagcaacugugaaagauaaaaaugacuuuuaagugagaagcugcccucucaauuuuaaaguaaauguuaggcauaaguguacucauuaacacuguagccuagaauuuaauaugcaaaugacaaagugaacugaagcucuggccuagcuccagauucuucugugacacugacacucgucaaacuggcaagcacauuaauguauucugaaagugugauuguuaaauguauuaguaauaaaguuauguguuguugccuagcaaaccaccuucaaaaugacuggcaaguucacagggucauaaauagggcaauggcaggcaggcugaggugacggggaauggggugcuguuguuuuagaacgggaugauggagaccuuugagauggaugcugguguugguuacacaguaauaugaaugcacuuauuaccacucaguuguacucuuaaaggugacuaaagcuggccugggacgugcucagugguagggugcaugguuagcaaugguuaaaauuguaaauuaaaugcaacauuuuggaaucaaauugggggcagagcuuagcaggcucagcucaucucugcucuacauguuaucuccugggacaguuuaacaaggaguaucccuguuggugggcacuuuuagcagaagaccccuguucacucucuggcuucucagacuuggacucucuuuacauguguccugucuguggcuagaugaucuagacuuugugugugugugccuucuuuuuucuaugcaaugcugggagccauccaccuugguccauggcaggcaaggucccuccuucugagcuaccuucucacuugggcuuuagguucuuuacaaggcaauuaggaucuaagaaaaugggaugcucuaaacuccuuaaggcuuggcuuuaagucccauaaaauuaauuacccugcaucugcaucuucuugguuaaaugaagccauugugcugucacauauucuaccccagagcaaaugagauaagacuuuagaagccagugguuccuuuaaagccauuauaugacaaucuccacacacagucucuguaucaguuuguuauccugucucuuuaccuugaagcgccucuaauggggcuauuuaucuaagacuagcagggucaugacaugaggguggacucugggacuucgaaccuuagcguugccauuugucacaagaccugaaucaaguuacuuguccuuucuguguuucugcuucguugaugaauaaacauuuaaaagaaggaagaaaagaaaugaccugacuacuucuaaaguauggagaagacuuuuaauguagcuauaaaggagaaagcaggcagagggaagaguccaggguguacaugagcaggaaagugggggagggagagcaagagaggugccacacagaucaggagaagcagcagagccaagauacaggcuguuuuguaggguuuggguuuggggaagagaagccccgccucugggggagggguuuagggcggggcgugaaaugaugggaggagccgcugauacugagugugacuugucccagguuucuuugagauguaauacuugucuaugaaaugaaucugguaauaguauuuaugucgucaugccgcugugaagacucaaagaguggguauggauuaaagacaaaacaaacaacaacaagaccugcaaacaaugcuugagcaaggcaaggcaguacaaaucuguaauuccaggacucuggguagccaggcagaaggaucgccccaaguccgaggcaagccuaggcaaaauagugaaugucaggccagcaaugggggaccuacuaagaccuucccucaaaaacaaaacaagaacaagccaaugaacagcccccuccuccgaggccucugcaucauuuccugccuggaguuccugcccugaccucaucacuaaacaaaacaaccccgcccccuuacaaaaccgguguacaaaguaugaacuauauaagcauuugcuaugauuaucguugucaguugauguuaauaagcuuaaaaauaaaugugguaagaaaggaauauuuaagagguaaauaagaggcugggaacuacccaggaccuccccgccucuucagaguucucgcuuagauuuaaaugcugauauuuaaacguccguccuuuuguucugcccaccggagacaggucugcauaauaugaagaccugcacugaguguuuaagggcccuaagaggcuaaucuguacagggguaauggaguugauagguuuuaauccauguaaauuugcaggacuccaagguuaaagacaggcaucuccccuccccuuuccuccagauccgcggauagcuggggcuucuccuaguccuuggaugucuucccuuucuuugaccuuaaaccuaaaaugggcgucuaaggaccaggagcucacugugccaguuguauggcucuccuccacuggaucgaaacaauggcugaggucaaaaccagucuu

SEQ ID NO: 2479 - RNA, 2406 nt, Mus musculus
cugggcuggaaagcugaggagaggcacauacaccagcagcuccacagaauggacuccggacagaaugaagacauuugccccgggucuuggucacaucaagccagaguugaucacauaaagccgaggagagguaacgaaccacgcggaagccauaggguaguuugaauggguuaaauaacuaauaagcuaguuggggaaugaggcgaagcuuauugucaaggcauuucuuaauaaaguauuagucuccaagccauuauucugggagcaggggcuaaaagaggggacagauuuacuguuuacaagccagagacagauauuacauguucuugauggaagcuaaauaaacaaaaacccuaaaguugaucucauugaaacugagaagaguagccgcuagugaggaggaaaaggaagaggaggaagaagaggaagauaaugaugaagaggaggaaagaaaggaggaggaagaggaagaaauaauuccggauauuguagaaggcuguaugauuagaagugaaagcuacacaggaggaauaaauucuaguguucuugguagguaggcugacuacaguucacaccugacauauuuuauaaaggaauuugaagguuuucaagacaaagaaauaauaaaguuugagauggaaacucacuacccugauuugaugauuucacauuauauacauauaucaauuaucacauuauccccugaaaauguaauuacuuuagguccaaacuaagaauuccuuuuauguuuuauuugcgugugugcgcacacaugcaugucacuguacacguggucuaugggagccgguucucuccuuccauguggguccugagacuuaaacucagguuguccuuggcagcuagguacuuuaacugcucagccaccuugcuggccucaaaguaaguuucaaagugcuagcuucacagaaguuaaacaccaaagaagggcuagagaugcagcucagcugucagaaugcuugcccaguaugaacaaagcccaggaugugacccucagugcaguguucagugugguagugcaugccugcaaccgcaguccuuuagaaccaggagacccugucucaagacauaacaagggugagauggcucaguggauaguguuuugccacucaagcaucaggguacaauucagaccccucagaaccuacaugucuuaaguaggguuucuaucacugugacagaacaaguuaccaaauguaacuagaagaaaaggguuugucuuacccuuguagucuauuaucucaagaaggcaggguaggaacccucaggcagggacugauacagaagccauggaagagugcugcuuacuggcuggcucagacuacuauuuauacauuccaggaccaucagcccaggggguuacacccaucaguuaagcugggccuucccacaucuaucaucaaucaagaacauauaccgcaggcuuguccacaggccugucugguuagggaauuuucccaaauagaaauggggcgaaaucuccuccuucacagaugacucaggcuugacaguuugacauuaaaccagccagcauaccacacaaagucagacucaguagcacaugccugcaaucccagcaugucuauagcaaaaugagguaaagacgggcgauucccagaugcuggggggucagcugcccucacguagcagcaacgagcacaaggcuccaagugcaaaacaugggccaacaccugaggcugaccucuuuaugaugccaugaaaauggcacuguguuccugucaagguauuagucaggaaaacauuagacaaacccaacuugggacuggggagaccacucagcgggugaagcucucugguacgaugaaccacaaaaacaaaaacaaaaaacccaggcaccauggugagaaucuguaaacucggcucuccugcagggagauggaguggagacaggacagcuggaggcucccacgugcagcccagccacggucaccagagacugccuccaccaugguggaagagaacagacuccagaagaacuguccucugguugccacguguucacugugccaucuguguuccugcaccccuucuacccccacuaaaucuuaaggggaaagaaaaaaucuuuaguugagggacaacuugcaaacugcccacucguuuuaguccuggcucuagacgauccaguccaucaaacugagaagaaaggcuggagcaauggccacuguccgaaagagcccaacguuccaugugauucugaccugaaagaggucauucagugaacaaggaaaucuccagcuaacgguguugccaggacugauuguaauaugaaaccaacauaaaacaucaaugauauagaacacugggugugcacuuuauggaaacuguucauaaauugccuauucauauccccccucucccucucuc

SEQ ID NO: 2480 - RNA, 2513 nt, Mus musculus
cugguucuaaaggacugcgguugcaggcaugcacuaccacacugaacacugcacugagggucacauccugggcuuuguucauacugggcaagcauucugacagcugagcugcaucucuagcccuucuuugguguuuaacuucugugaagcuagcacuuugaaacuuacuuugaggccagcaagguggcugagcaguuaaaguaccuagcugccaaggacaaccugaguuuaagucucaggacccacauggaaggagagaaccggcucccauagaccacguguacagugacaugcaugugugcgcacacacgcaaauaaaacauaaaaggaauucuuaguuuggaccuaaaguaauuacauuuucaggggauaaugugauaauugauauauguauauaaugugaaaucaucaaaucaggguagugaguuuccaucucaaacuuuauuauuucuuugucuugaaaaccuucaaauuccuuuauaaaauaugucaggugugaacuguagucagccuaccuaccaagaacacuagaauuuauuccuccuguguagcuuucacuucuaaucauacagccuucuacaauauccggaauuauuucuuccucuuccuccuccuuucuuuccuccucuucaucauuaucuuccucuucuuccuccucuuccuuuuccuccucacuagcggcuacucuucucaguuucaaugagaucaacuuuaggguuuuuguuuauuuagcuuccaucaagaacauguaauaucugucucuggcuuguaaacaguaaaucuguccccucuuuuagccccugcucccagaauaauggcuuggagacuaauacuuuauuaagaaaugccuugacaauaagcuucgccucauuccccaacuagcuuauuaguuauuuaacccauucaaacuacccuauggcuuccgcgugguucguuaccucuccucggcuuuaugugaucaacucuggcuugaugugaccaagacccggggcaaaugucuucauucuguccggaguccauucuguggagcugcugguguaugugccucuccucagcuuuccagcccagaucucacgccacucccuauuucccagaauccucucucuuccuaccagugucccaccuccuauuuccugccucagcucauuggccauaggcuuucugauugacagguguugcuuagauucucucuaggcuagcuugcuucaucuagcagaguggagucuuguuucuccucaagcaaguugcugugaacaauaggcuucuauucuuucuuacggucagauauuucauugugugcagcaggcgcucucugcuccucagaaggaagugaccauuacuuacgagccuucuauuaauguaaaaacuaaacaucuaguugucuuuguuuccuuuccuguugcugugauaaaaugcuccgacagaaaugacuuaaaggaaagugggguuguucaggcuucacagaugaggauacauaccguccaucaugccgggaaaagcaaggcagcuggggcuugacacagcggcucacaucacgcccguagucuagaaaccaagggaugacggugugcugguccucagcuggcuuucuccacuuacaccauccaggauccccugcccagggaauaguccugcucauggugggcauggccuucccaccucucccaggugauucuggauucugcccagcggacaacgcuaauccacaaggaucgcagcgauucacagguuucuagcggcagacagcagaaacuagagggaugccccuuaaauucucacgugcguuaggagggaaacgguugcuguucaaguugacugaacguguccuuggcuuguuucugucucaacagaaaugauccucuaccucauccucgugucauguuaaaauagacugagagagaucuggaccagggcuuaggaagaagcucaaaagcuuggguuuaaucuuuagcaccaaaauaaaaacuaaaugaaaccuacuuaaaagccagcgaagauguguaggaaggguguggccccuugaaguuugcaucuagggacaccaguuucccuccagugagagaugcaguucuguccacauccaaggccaugggagggcagaucccucugcgaugaggugacucagaggaccaggauucuccagcagacccucugauuggcaucuuaguuugucagagauuuauacaugagcuuauucccuuaauucguuucucuguaacauggcacuacuauucuugggugauggaggggauuucauguuuucagcugacagagguaucugaugcuagaaaucucuccuuuuaaacaaaugccccuaaugucuaauugggucccuugagcucauagacuauucagauaauacccgggcugccuaaacacacagagacacggagaaauguucacgaaagaaccccaugagauagcuggcuaaaaugugugugugugugcgcguccuuaaagccaggugaaguguuggcucuacuccaaguaugcuccauaaaugacuacauuga

SEQ ID NO: 2481 - RNA, 2513 nt, Mus musculus
ucaauguagucauuuauggagcauacuuggaguagagccaacacuucaccuggcuuuaaggacgcgcacacacacacacauuuuagccagcuaucucaugggguucuuucgugaacauuucuccgugucucuguguguuuaggcagcccggguauuaucugaauagucuaugagcucaagggacccaauuagacauuaggggcauuuguuuaaaaggagagauuucuagcaucagauaccucugucagcugaaaacaugaaauccccuccaucacccaagaauaguagugccauguuacagagaaacgaauuaagggaauaagcucauguauaaaucucugacaaacuaagaugccaaucagagggucugcuggagaauccugguccucugagucaccucaucgcagagggaucugcccucccauggccuuggauguggacagaacugcaucucucacuggagggaaacuggugucccuagaugcaaacuucaaggggccacacccuuccuacacaucuucgcuggcuuuuaaguagguuucauuuaguuuuuauuuuggugcuaaagauuaaacccaagcuuuugagcuucuuccuaagcccugguccagaucucucucagucuauuuuaacaugacacgaggaugagguagaggaucauuucuguugagacagaaacaagccaaggacacguucagucaacuugaacagcaaccguuucccuccuaacgcacgugagaauuuaaggggcaucccucuaguuucugcugucugccgcuagaaaccugugaaucgcugcgauccuuguggauuagcguuguccgcugggcagaauccagaaucaccugggagaggugggaaggccaugcccaccaugagcaggacuauucccugggcaggggauccuggaugguguaaguggagaaagccagcugaggaccagcacaccgucaucccuugguuucuagacuacgggcgugaugugagccgcugugucaagccccagcugccuugcuuuucccggcaugauggacgguauguauccucaucugugaagccugaacaaccccacuuuccuuuaagucauuucugucggagcauuuuaucacagcaacaggaaaggaaacaaagacaacuagauguuuaguuuuuacauuaauagaaggcucguaaguaauggucacuuccuucugaggagcagagagcgccugcugcacacaaugaaauaucugaccguaagaaagaauagaagccuauuguucacagcaacuugcuugaggagaaacaagacuccacucugcuagaugaagcaagcuagccuagagagaaucuaagcaacaccugucaaucagaaagccuauggccaaugagcugaggcaggaaauaggaggugggacacugguaggaagagagaggauucugggaaauagggaguggcgugagaucugggcuggaaagcugaggagaggcacauacaccagcagcuccacagaauggacuccggacagaaugaagacauuugccccgggucuuggucacaucaagccagaguugaucacauaaagccgaggagagguaacgaaccacgcggaagccauaggguaguuugaauggguuaaauaacuaauaagcuaguuggggaaugaggcgaagcuuauugucaaggcauuucuuaauaaaguauuagucuccaagccauuauucugggagcaggggcuaaaagaggggacagauuuacuguuuacaagccagagacagauauuacauguucuugauggaagcuaaauaaacaaaaacccuaaaguugaucucauugaaacugagaagaguagccgcuagugaggaggaaaaggaagaggaggaagaagaggaagauaaugaugaagaggaggaaagaaaggaggaggaagaggaagaaauaauuccggauauuguagaaggcuguaugauuagaagugaaagcuacacaggaggaauaaauucuaguguucuugguagguaggcugacuacaguucacaccugacauauuuuauaaaggaauuugaagguuuucaagacaaagaaauaauaaaguuugagauggaaacucacuacccugauuugaugauuucacauuauauacauauaucaauuaucacauuauccccugaaaauguaauuacuuuagguccaaacuaagaauuccuuuuauguuuuauuugcgugugugcgcacacaugcaugucacuguacacguggucuaugggagccgguucucuccuuccauguggguccugagacuuaaacucagguuguccuuggcagcuagguacuuuaacugcucagccaccuugcuggccucaaaguaaguuucaaagugcuagcuucacagaaguuaaacaccaaagaagggcuagagaugcagcucagcugucagaaugcuugcccaguaugaacaaagcccaggaugugacccucagugcaguguucagugugguagugcaugccugcaaccgcaguccuuuagaaccag

SEQ ID NO: 2482 - RNA, 4763 nt, Mus musculus
agguuacuugcuuagacuugcuuuuucuuuuuauuaucaacaaucaaguuaaugguacacucuuggaaaacuauaugcacauguagaaauauuuccccuuuaaauagaagcauucauuauaacacguauaaauaaauuugaaaaucugaaacauaacuuaugacgcucauguucacaaacauagucccaacgagaagaaaaggaaaucagacagacaugcaccugauaacaaaaauauauaccauugucugaaccuggucucucuaaacacaaaggaaucgaacccgugagaaccuuauuacgucauaaagacacaccauaaagacuacaagaggagaaaaaacauuauacggucacguagaggagacggucuguacugagaguaacacgauacaauugagucacagaacacagcuguagaaagacaccgaaaaaguuaaagccucaacauucaacuaauaucuauaguuuugugccuuuuaaaauaaaaauuuaaaaaaaaagcccaacagagaugucuaaacugcgcauagaaggaauuaucaauauacagucuguccacccuacaggaggaguccagcucggaucacucaaucagaaacgcgaucugagacacuuucugcaaacuugugugugccuuccccuugcuggguaagacugauuucucugcagccagcuauguggacuacaacugacuccaaugcaaagcagugccaaaaaaaguuccauuaaagcugguggaagaaggaaaugccgguggggguggcgggagagaaaaaacaggaacgcugugaaacaugagacacgguuugcagagcuggagggugagaagggaucuccuguacagggcaucaucucucagggccaagcggcugcgaagauuaggguucaggccagagcagagugugggaaaucaguugcgcuaauggcgagaugguuuccagcgagguggggacaggcaagcagagcuccagaaagucacuuuggcugccaggacagucugagugagccaucacugcaaugaccagagcacagggaccugaggggaaccggggccggacaggcaucaguacucuuuccuauagaggagccgcaagacagucugugcagucgugagcgagagaauuuagggguucgcaagaccaaaaccucagcgccagccacaguccucccucgucuccuuuguauuuucaaauuauucccuccauuuggaucuuuuaaaaaaacuuuuuguaauuuauuucauuuuccuuuuguaucuuugcugcuuuccaacuuuuuuuuccuaagaagucacugaguugguuguggugcccccgucucucccuaucaccuacuuggggccacagacacacauucucugagacagacauacacccgucacucagacacagcccccugagagugccccgaaguccaagcucacaucccuugggcagcagguggagcccuguccuaugcgcagcccaaggcaggugaagauuuuuguuuguuuuguuuugcuuuguuugggggugaggaaagggguaggagugggguugaaauggagcgacgucauuuucucguuguuuuuucgaaucgcgaucauuuuaggccuucgaugaaaaaaaaaaaaaaagccacugacagcagcgacacuagccuugggucuacccacucgcccacucgccagcccgggccccgggcucgcccgccgccgccgcagaucgcagaucagaacauacugcucuucacuaaggcggcuuuggcaccguugggucuuuggagcgaagauaagacgcuggcgaagggccccccaagagaaucugggauggaggugauggggcccgggccaggagcccagccuuguccggggccuccggccgcagccaggccucccgccgccgcagccgcagccgccgcugcagccgcugcagcugcagcagcagccgcagccgcaccgcccuugccggguucgccucccgggccccccgggcccgccgcccccggagcuccggcugggcugggcccuccgccaccgccgccauuugccccacagcugggggucggguugggguugggucccgggcccccagugcugucgggaucagugcucuuggccucuuugcucucgucgucccgggaggagucagacuucuucccggaggagccguuuuuggcggcggcggcagcagcggcggcugcgcgcuccugcuugcgaaacuuagcccggcgguucuggaaccacaccugccaaagagagggcaggcgauugaaccggugaacaaaaccagaaaccaaaguggcgcucgagacccacucuguuucucacacacacacacacacacacacacacacacacacacacacacacacacacuucgcuguaugaauggaccauugagacacuacagagcagaguccgacaagucugcccuucucgcugcuacugccuuugcugagaaacuuuccuaggacccaaacgaaagugccaaagaaaugacaccguaagggacaaguacaaagauagcaggaaggcccuaaaagugaagccuuuuucuuuuucuuuuucuuuuucuuuuucuuuuucuuuuucuuuuucuuuuucuuuuucuuuuucuuuuucuuuuucucuuucuuucuuucguucuuucuuucuuuuuuuuuuuuuccguacucuuaaacgggcgucucaccuacuucuaggcuucucaggucuaaugguggaaggagggugccuuucgcuuuggugacacaacggauccacuggccauccacagaggaaccuucuuagugcucaccgaccuuauacccagcuagggggaccagcuccagaaagcaccuuugcucccaauugguuagcuauaguaaggugcggguuucugacucuaauggaguaacaaccccuucgugaaucuauuucaaguccugguuacuaggaaauuacuccuugcgccaggggcacuagauuuuuuaagggcgcuugaguuaagaggcacugugggcaaacgaaucacgcaauuaagcugacauagauacagguagaggaugcaaucuuccucucacgggacacuucucuccaaaaaagccuuguucguucaaacucccaaaccccugcuuuggugggaaacacugcaguugugaauaaauuaccuagagucuguguccuagcccccaccccccauccccgcucgugcgcauaacacuccaaaucccauuucugugacgggccugggucccuuuggaaccguaagcgucagcacccacccccucacugcugcugcggcacucggucucccguaccuggacucucgccucggugaggucgaucuucagugcuagcucuucccugguguagaugucaggguagugcgucucagcgaagacccucuccaacucuuugagcugcgcgcuugugaagguggugcggaugcgccgcugcuugcguuucucguugaggccgccguggucggugaagaguuuguauggaacuagaggaugacagaggagacuagagugagcaaaacagucaggaugugaagggccacugaaccagaacgcggggaccaaggucagauagcccgggagccgcuacagacaccaggcacuucuagaaggagguuuuaguuacggcgaccugccaagaaaacccagcaaauuaguaucauacagaaacaggggcgcgaguguaacuuugugccuguuuuuguggcccaagugccuuugggugagaugaaauagcaaguuggagaguguuugaggccccaaauggaggauaguucauucagcaggaaaacaguccaaaaccaucauuaguuggaauaucagaaagccaggaacgaaguuaaccacucacgcccacuguugcaacuuuucaauucucagaacuugauaccgcaaaguugggggauagugcuguaaagaaaaccaauaaauucaagaaaugaucauaaaaaugaccggccaaagaggugugagccgcugucgguucuuuuaaaaaaagagacaccgccaguaaugagcuuuacucuuuguuauuuaauuauuuucuaagcuuuacgucucaucgcaaaguaaauaaauuaugccuaucauuuuggcagcuuaagauaauuuuguuggcgguucgggugugacuaggauaguguaacccuguaagugaauuaccccucccugcaaucgcuucuaacgugauaaauucuuucauuuguguaagcaaauuucguuugguaaauacuaaacacauuuccauuuucaaaugcaaucaaggcuuccuauauacgagcggaaaggcagcuucuuccgcugagagagcuagcgguccuuaccugcggcguacggacugcucugguggucccugagggugcccaggcugcaggaucccggcgugagggacgggcaaccggacguggccccaaaagugguccuuaucggguuauacuggaagccacuggccuggcugcaggaacugaagucugcauaugcugaagccaagcuggagguauccaucccggccauacaggacucguaggcagaggaauugagguaagaauauuccauuuuauacauugaaaagguucuggauggcucagccaaguggaaaaaugaaauaaaagauggauguggagacgguggcuggaguggggagaugugcacugcucaacgccugccuccacacuggccuccuuacuaccagccgagccuaguuuuaugaaaaagccuccugugagaugccuugucugaggucucuagaguauauaguccucauaauaaacuuggcucuu

SEQ ID NO: 2483 - RNA, 1042 nt, Mus musculus
ucaagauuuauggccagaauuacuuuuccagaaaccccugauuaacucagcuuguggucguuuuugcucuauugucucugagaaggucaguguuauguucuuuuuuuuuuuuuuuccuccaagcgucugucacauagccgguuucacuagugcuugaaauaagaaaacuaaaucacaggguuuggugaaucgcuaucuggagagaucauagauauuucugaagcuucuguauauggaaguagagagauuuuugagguucggaagccagcgaggaaaaucgccugagugccgguuaagacgaaaguugccucggugguuuuacuuaacauuuccgugccaauuggcucguagggaagguggaaccaaaacaaggagaaaaacugcauuucccgucaugccuccggaaaccacgcccggugacucucaacgucccgccugacucacguggaaacgaaaggaucacuuccgguuuugcaaccccgggaaccggcggcgucgaucggcccuuuaaggccuuucuccgaagcuccgccuucgcuugggucuuucuagaaaggcagcuucggucuggaccgagcggggcagguauuaccgggccgccauagggggacuucugcggcugugugcugcacgcguccgggagggcccguuccuccggggguuugggguuccugccggcucugaaagcaggucggagggucgucgccccgcacugacguuuugcucuucuuugcuguugcagcgucccgggcucccgagugucucccauggcggauacgaccccgaacggcccccaaggggcgggcgcugugguaagugagcggccuggucgcccggcuccaucagccggaguuggcgaggagcaggaaguguuugagagggcuagaggguucuagaagccgcugccugccggacugggguuagggaggagccgaguggcggccagaggagcuccaaguuuguuucaaaggcgacaacaggcaguucuggagcaggcggcugucaccugucagcuagggauguuggccuccuugccccuucc

SEQ ID NO: 2484 - RNA, 31241 nt, Mus musculus
ucaagauuuauggccagaauuacuuuuccagaaaccccugauuaacucagcuuguggucguuuuugcucuauugucucugagaaggucaguguuauguucuuuuuuuuuuuuuuuccuccaagcgucugucacauagccgguuucacuagugcuugaaauaagaaaacuaaaucacaggguuuggugaaucgcuaucuggagagaucauagauauuucugaagcuucuguauauggaaguagagagauuuuugagguucggaagccagcgaggaaaaucgccugagugccgguuaagacgaaaguugccucggugguuuuacuuaacauuuccgugccaauuggcucguagggaagguggaaccaaaacaaggagaaaaacugcauuucccgucaugccuccggaaaccacgcccggugacucucaacgucccgccugacucacguggaaacgaaaggaucacuuccgguuuugcaaccccgggaaccggcggcgucgaucggcccuuuaaggccuuucuccgaagcuccgccuucgcuugggucuuucuagaaaggcagcuucggucuggaccgagcggggcagguauuaccgggccgccauagggggacuucugcggcugugugcugcacgcguccgggagggcccguuccuccggggguuugggguuccugccggcucugaaagcaggucggagggucgucgccccgcacugacguuuugcucuucuuugcuguugcagcgucccgggcucccgagugucucccauggcggauacgaccccgaacggcccccaaggggcgggcgcugugguaagugagcggccuggucgcccggcuccaucagccggaguuggcgaggagcaggaaguguuugagagggcuagaggguucuagaagccgcugccugccggacugggguuagggaggagccgaguggcggccagaggagcuccaaguuuguuucaaaggcgacaacaggcaguucuggagcaggcggcugucaccugucagcuagggauguuggccuccuugccccuucccacaccgcggucuccgaucgucuucggcccccaagguggaaaauaccaucuauucaacccacaugccucguggugcgcgucguaguauugcccuuuguaccuacuucaagccuuuuaagaaauuuugcaaaggggagagagugguguguuucuuugauuagucguuuacaaagaggaggacugcccguuuguaaacuuuauaauuaaaaauguugaucuacaggucgacucgagguaguuuuuguguuuuugcccuuaaauugaaguuuugauuuuuuuuuuuuuaaaaagcuuuuuacaacaccccuguacuguguacacgcacuuaacuuugcugacccauuuggagauuuuugauaacccaaaaauacuuaaguauuauuuuccacuucauuacauuuggggaauugaacauggaugcauuuuaaucuacuuuguaguucacgugcagauuuccuuaacuguccauugucccuuccccucuuugggaagcagccauuguguuuauuuguucugccucuuuacucccagucaguccauggaaaucccucuauuaucucugggcuuugaagacacaccuaguuucaaaagucuagaccuguuuuacagaaggcucuagaaacugaaauuacauuuugauuaugcccuucucaggacacaagaaccauuuuauguugauucuuuggggaauuagguaugauccugaaucaacugauuugccauuguaaaaauagauuucacccuuuguaaguaagaaguugucuggccuaauacuuugaaacugugaauaauuuguccucaagucuucagucccaugauccauuaaaauauuuuguuguggaacuauauauaccaggccguucacucuacuuaaaccagccucuucagcuccuugauuguguaauggaguguacguacgugcagaagacccagaggaagggcuggguagaugggcucguguuuauaagugagugcuucuuuugcagaagacccuaguucaguuccuagcacccacagcggggggugggggaggacuuacaaucaccuguaacuccagcuccagugggauccccuggacuccuugguuacuguaugcaccacacauacucacaguuaaaaauaauaaaaucaaaucuuuagaauagaugucuaaaauggacacuucagugacuugcuaaagaaugaaaacccuacacaaauacuuauuucauuagggaguaucauguguggaggucggaggacaacguauucuuauaaguucucuacaucuacgguggucucaggguucacaccucggucaucagccuugggagcaugugccuuuacugcugggccgucuugauggcccaacaaauggauuguaaagagaaggcucugaacaaacugacaugguaaucuagauuucauccuugcauuugacugcugcuguugccagucagcuaaauuuaguagcaucgcagaauuauagauagaauaaacuagcaguauauuuuauucuugaaauugcuagcauguaacuaaaaggcauguaauaaaauacacuugaauuuuaaauauacuugcauuuuuuccuaaaaauguuuacaugcacaaaaacagugacauugcuuaaaacuaguauuuaaaaaccucagauagaugcaugaauauguuucaaaaucagcuuauuggaagcaccagcuagaaacaaugccaccacauuuaaugagaauguguauugugagacuccuuucaguucacauacccacauaugugacgucuugguauuagaauuauuucugagcauuagaguuaagauacaaaagccccuuuagaaauugguaugaggcgcuuguucgcacuaaagcagguguaaguucuugcuuucaugauaagcuuacucuagggccacugauaccaggguaaacuugcaugggaccugagaagcagauagcaguucauauuugauaggcuuauuuccagugacuugggggugcuaggcaccucugcauauacauagacaaauaaucgucuauagacgaaugaguucuaugccaacuguugcaacgauuuuacacuucucuuuuuaacggauuauuuaauccagaccuaauaucugaugcuuuauucaguucugaguccugacuauguggguuugagauuuuucuaagaauagacauuauaauucucuugagagccauuagucauuauuuaaaguuguuuuaaaguagauggagccauuauuauaaauguugaaauagcacagaaaguuuuacugucucgauuuuuuucugaaaguguuucucaugcuuuccauagcauaugugugagcaagugguuaaguaacgugaguuuccacuuacugaucugcaaaagcaaauauuacaagaugguguuacaauauucuucauaggauuauagugcauaauuuguccuuaacauaguuuuugggcuuaggguaccauaauuuuuuuuuuuuuaaucuagcaauucaugaugaccaauaaauuggacacagcaauguggcuuucucgccuguucacaguuuauugcuccgcucuguucguucugccucuucuuggguauguauuaucuuguuucugacucagagguguucggucaguaucuaugacugcuuuuuagcuuuagaauuguucaauuguaaaugggauuaagacuaacacaaagcccacuuaacagcaacaguaaucugguaauaccaauuaggauguuuuauuucuaguuugugugacugcucguugaaaagcugaggaaaacuagaugucuuggguugagauggauucugcaggucuuuuaaguugacaaaaguaugacugcuuuauacuaaucaguuggauguguaugugaagagauguuucccagaguguggaguacauuuguguaauuuguuuucuauugacaauuaaaugauuuagguguugugcaauuaugaugcaauucacaaaggaggaagagacgugguagcuguugaagucucagaauaacuuuuccucugguaauuugcagguugcaugaagcagcgagcuuuuaccagcgugcuuugcuggccaaugcucugaccagcgcucugaggcugcaucagagauuaccucacuuccaguugagcagagcguuccuggcucaggccuuguuagaggacagcugccacuaccugcuguauucacucaucuucgucaacuccuacccugucacaaguauccuuucauugcugggacaguggaguuuuccuguuggaaggauacagugaugauagaguucauaaagcuuguuuugcuuuuacucugucacuugaauuuuuguccccaaaauuugaaauauaaacucuguagagcuguuuugugaauuuaaacuucaucucucaauguucuuggauauuuaacaguuaacauucaaggcacaaguuuauaccugaauucaauauuuaaauuuuuauuucauugacuuuauuuauaucuuggaggaaagaugcaaauuucauuuuacuuaccugucugaguguuuugccuguauauauguauguguaccacaugcgugcugggugccuguggagaccagaagaggauguuacaaccccugcaacugaaguugcagacaguugugcacuacugugugggugauggaaauccggcucagguccucugcagcagcagccaguagucucaauccccaagccaucucuccaguccuaccacuguguuacuuaaaauaagaaaagaucuuuggcucccccagcuuccggugagccagggacaaaaauucacccagaaauaacuuaguaaaguacaugaagugaaaguagucugcuauacguaaaacagaaaggacauaaguaagcuacugugguaguauaggccuguaggccuaggcggcacagguaggcuaaaagccagccuaauuugcauagcucauuucaggccagccaggguuucauggugagaucuugucucaaaaaacaaacaaaaaaaacguagcaaguuggcccaacaagguuaauucuuaggaaguacugagcaguagcaagaacccgaacuagugagugguaagaaugcuaaucuaauucauaaagaaguugggaauuacggcagcaugcaaaagcgacucagaguaacccuacacauguacuugggccuuuguucuuaaugugguauauuguccuugcuccgucagugacuggcacuuaagacuaaaaugguagccuuuucaccccuuaucuuuucuaaauaauuuaaaagugacauugaaccaggcauguaauugcagcacuuggaaaaucaaggcuagccugggcuuccaugagauccugucucaaaagccaaaaaucaagauggggaaaaaaggugacaucaaaagcuaagaugaauguugcagagguuugugaacugugggcaguuagggauaaauugcucauaagaucuccuugaucucuguguagccauguggcagaggaugaaacuuggccgaggaagaugagguuugugagagccaggacaggaacccgagcaagggucuuggcuccuggcagaaggcuauacuuuggcauugucuguuacugaauuaggcuucaagucugccgcugucagaguuuacgcugaauuauugaagcuucagcagaguuucacacaggccuuacaaaggagaaguuuguaguuuucaagguuuaaaggagucugagucacuaaagaguuuuaaacuggagccagacauggugguguaaaccuguaaucccagcaccuaggaggcuucaacaaggaggagggagaguuuggggccaguuuaggcuacagaggaaaacacaaguucgaauuuagauucuucuaaauuugggcagagaugcucaguggugcuuggaauggguuuugggugcuaaguaaguuaagguuaaaaugaacuugauacucagacuauuagcacuuagcaauuuccauccaugccauaccuuuaccuagacagaaaaauagaaugauucguuucuugugcugaucacagagaacauuuuuuuuuaaagauuuaugcaguguucugccugcauguauuccugcaggccagaagagggcaccaaaucucauuaaaagugguuaugagccaccauguaguugcugggaauucagcucaggacuucuggaagaguagccagugcucucaaccucugagccaucucuccagcucuauugagaacaucuucaggcuaguauuuuuaccacucauguugauaaucugccauuuacuugauagguauucuauuauccaccuagcaaaaauuggaugggauuuguuucuauuuuuucuuuugaaaaguugaauaaaaauuuuguauuuacccacaguauaaggccauaccauuggacuuaguguaaaaauuccuugcuauuguaauuaacuugauagaaccugugguagauuuuaugcaagcugagguauacagucuucuuuuuuacaaauucagguuuuuuuucuugaaaguauaguuucugaaagugacgggacuuaagccauuagcgucugucaacagugcaccuucauagcggcccuguggaagacugggauuaagauccagucggugcacuggagagguggcuuccauaccugcagcacauccagguucgguucaaaugccuguaauuccaguuccaaaggcuccaaugcccacuggccuccuaggacaccugcauguguguggugaacguaaacucaugcaggcacacacaacuaaaaguaagaaaucaaaaaacccaaaacguccauugugguguaaacacugcacuccguccuuugggguggccugcaguuuaguuuuauuuaggagguuuuuauggugcuuuauugaaaacgauuuugacuuuccagacagcuggaaagcuuuagaaaagaaguuauuuccuucuagguggcaaaacuucauuugauugaaagaugaaggaaaagccauuccacuaagcucagucagguguugcuucagcuccuuugcacguaauacauagccauguacaugugugcgcaccgugccuggugacaugaggcuuuccuuaauggcucuccagugaguauuuuuccagucuuguuauuuucuuugcuccaugcugccacauacacuaagaagguccuggacguaaguaaacuguuguuuucguugccuuguagauuguagauaguuggcaugaguuugagugucaggcaguucucaccaaaggucccugcagucuccacaaacuuugauaauuuuuuuuagauuugaagauuguaugguuaaaaugucacaaaauagcguuuuauucuuaaaauugucuuccaguucccugaaguuugaaauauauaucuucacuaaauguguuaaguuugauaaggcgucagagaucuucuucacugucacuaacuuaugcaucaguagaaccaugggaagugucuguauagcaacuuuaagaguuauuuucaugaaauuaauuaacuaauuaauuaauuuauuuauuuaucuugaggcugucucuuuauacagagucccuggcuagccugaaacucuuauguagccagccucggcugcacucacagagauccaccugugucugccucccgagugcuggguguuacaaguguucaccaccaugccuggcccgagucuguggguuuauuguacuuuauuucucuagccacggaagcccuaaggacuccagaaucuguaguguaguuaucugagggucacagagauuuuaacuguugcuggacagucagaauuuuguuacaacuugggagaaauaaccacuguuuuuuguggagaggguggaauuuaacuuucugugggaaauaaaguaagaaugccaaaauguguuggcguguuuggguucuuuggagacauagacuaaagcagggaagcacaaugagcaaguucuuaaaguuacguggaaauacuuggccuuuggcugcauuaccugucaagggugcuacugauagccuuugguguucauuaguucuucaguuugaucaaccauaaucaaaagaguuugccaaaaaagugugucuguacugaacaggcuuuucuuggcauucccuaaaugguacagugagacaacggcacagcuuuugugucacacuaggcuguaggagauguagagauggguuaauguauagaaaaugaguguguuguauguaaauguggugccacuuuagcaagcauccacauauuuuggcacuagggugacuaauugaguuguuagcgaugccuuguaacuucuaaugcuuguuuucuuuuguuuuaggcaaaggguucaaauaguuuaccucuguugagaucauucuuggauaaauuaaguacuaaccaacaaaauauucugaaauucaucgcuuguaaugaaauauucuugaugccugcuacaguuuuuaugcucuuuagguaagcauucaaauaugcuuguuuugaaagauugaugcuaagugaacauaaagaugcccgcacagauaucauacuuugugagucagcaggugucagcuuguauccuuagguagagcaucccagcugcucuagaagggucacugagacgcagggaaacuagggauuucuguucucccuaccccacaguguuuaacagcuuuuagaauuauuauucuuugacauuuuuauacauguguauuuugagugcucguuauuuuucccaccccaccgcccccaucacucuccucuuugcucuugcugaaacccuucccaacaagcccagacuuguuuguuugauuauuaaguaaauguauuaacaacuuaaugcauguguacaauaugugugacccucuuguauuucucucauccuccucaaaaucuauucuucccuacaagugcuuuuccuguaauuuuuuguuacucauugaguuuaaaccagggccaucugugugcccacgggugugaaacuauccaguguagcacggugggcucaccgguguguguacagcugaagacaaugacuccuuuccccagcagccaugaauagcccggggacagggacuuuguacaucauuuaacucuugcaaauuaacuuuacguuuugacaguuaauuccaaaaauacuccauuuaaaagaauguuuuuguccucggguuaccgucacugaugacauaccacaggcaaagaaagcgacuucuuggggaggaagggauucuuuggcuuacgguucccuaucacagcucaucgucaggaaccuggaggcagggugcagagccauggcggggagcugcuugccgacuaacuacucauggcuuccuuagccuguuuucuuaacccagaaccaccagcccagggauggcaccacccacagugggcugggcccuccuccaccaaucacuaauuaagaaaaugccccacaggccugccuacagccagaucuuccagagacauuuucucaaccgagguucucuccucugagaugacuauaguguguaucaaguugacauaaaauuagccagcacagucuugaagucuaauuugauucauucuuggccauuauugagaagguauuuuuuucuuaaacuaaaagcaaacauuuuuuuucauauuaucucuuuuuuuuaauauuuuuuauuacauauuuuauuacauauuuuccucaauuacauuuccaaugcuaucccaaaagucucccauacccucccccccacuucccuacccacccauucccauuuuuuuggcccuggcguuuuuuuggcccuggcguuccccuguacuggggcauauacaguuugcguguccaaugggccucucuuuccagugauggccgacuaggccaucuuuugauacauaugcagcuagagucaagagcuccgggguacugguuaguucauaauguugguccaccuauaggguugcagaucccuuuagcuccuuggguacuguauuagucaggguucucuagagucacagaacuuauggauagucucuagauaauaaaggaauuuauugaugacuuacagucggcagcccaauuccuuacaauuguucagucgcagcugugaauggaaguccaaggaucuagcaguuacucagucucacacggcaagcaggcgaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacaauccaccccuugucaacuugacacaaauaauaucucauguucacaugaaacaauaacaagguuguaaauacgccuaacaugauauaacuaucccucguacaaucgcaaacgcauuaguaaauuuacaaugggcauucauauuacuuuauaauccucguuucugcaacugguuacguggccuuaauugguauuuauaacuaccuuccucuacuacccauucuguauuuccuucaccuucagccagcaccucagcaggucuuggcucuuuuccuggaggauugacccauaccuucauuccugaugggucugcguccuuugucauccugcuuggauuaggcuguuguaguuucccauugacuuuaaucacaggacaugguaguacuaagagacgcccuaagggaucuccugcacuccagacauaaucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaaugaaauguuuguuguagcuccugguaggagcacuccccucucuggagccaaaacuucuaagccagcagaaccuagaguuauggggacaggaagcaaaaauuuuccuagagggucacuaggagugauaguaaguggaacuauuccguuuuccaccccuugauuccuggacccaugaauccuggcuaugggugaaacuguaccauauaucgagcgcugauucaaagcauauacugccuucugaagaacucugccccagccuuccaagcuguuaccaccuaauuggcgcuguaacugcgucuucaaaaggccauuccaucuuucuaucagcccagcugcuucaggaugauggggaaugugguaagaccagugaauuccaugaucgugagcccacugucguacuucucuggcugugaaaugaguuccuuggucagaagcaauacuguguggaauaccaugacgauagaugaggcauucugucaguccgugaauggugguuuuagcagaggcauuacgugcaggaaaggcaaauccauaaccagaauaaguaucuacuccaguaagaacaaaacgcuguccuuuccaugaaggaagugguccaauguagucaaccugccaccagguugcuggcuggucaccucgaggaauggugccauaucuggggcucaguguugguuucugcuguuggcagaucuggcaaucagcagcagcuguagccaggucagccuuggugaguggaagcccauguugcugagcccaagcauaaccuccaucucgaccaccauggccacuuuguucaugugcccauugagcaaugacagggauggcuggggagagaggcugauuguccacagaacgggucaucuuauccacuugauuauugaacuccuccucagcugaagucaccuuuuggugagcauuuacaugggacacaaauaucuucacauccuuugcccauuuggagagaucuauccacauacuucuuccccagaugucuuucucaccaauuuuccaauugugaucuuuccaagucccugaccauccagccaauccauuggcuacagcccaugagucaguguauaaucguacaucuggccauuucuucuugcaaacaaacuguaauaccauguguacugcccgaaguucugcccacugugaagauuucccuucaccugugucuuucaagguugucccagaaagggguuguaaugcugcagcuguccacuucuggguggugccugcauaacgugcagagccaucaguaaaccaggcucuagucuucuccucuucggucaguugaucauagggaacaccccaugaggcuauaggugcaugcuuggcagcagauggcauuguaacaggaguagaaaccauaggcauuugggcaacuucuucauguaacuugcuugugccuucaggaccugcucuggcccgaucacguauauaccacuuccauuugauaauagacugcugcugugcacgucccacuuuaugacuugcagggucugauaguacccagcucaugauggguaguucaggucgcauagugacuugguguccuauugucagacguucaguuuccacuaaggcccaauagcaggccaagagcuguuuuucaaagggagaauaguugucugcagaugaugguagagcuuugcuccaaaaucccaaaggccuuuucugugauucaccuacaggggccugccagaggcuccaaacagcaucucuaucagccacagacaccucaaguaccaucggaucugcugggucauaugguccaagugguagagcagccugcacagcagccuggaccuguugaagggccuucuccuguuccaggccccacacaaagcuagcagcuuuccgagucacuugguaaauaggccuaaguaacacacccaagugagggauguguugucuccagaauccaaauagacccacuaaacguugugcuucuuucuugguuguaggaggggccaggugcaauaacuuaucuuucaccuuagaaggaauaucucugcaugccccacaccacuggacuccuaagaauuucacugagguagaugguccuugaauuuugguuggauuuauuucccauccucugauacgcauauguguuaccaaugaguccaaagugguugcuacuuccugcucacuugauccaaucagcauaaugucaucaauauagugcaccaaugugauauuuuguggaagauccaaacgaucaagaucccuucuaacuaaauuaugacacagggcaggagaguuaauauauccuugaggcaaaacugugaagguauacuguuggccuugccaacugaaagcaaauugcuucuggugguccuuauggacagguacugagaagaaggcauuugccagaucaauagccgcauaccaggugccaggagauguguuaauuugcucaaguaacgaaacuacaucugguacagcagcugcaauuggaguuaccaccugauuuaguuuucgauaaucaacugucauucuccaugauccaucuguuuucugcacuggccagauaggagaguuaaacggagauguggugggaaccaccaccccugcaucuuucaaguccuugauaguggcaguaauuucugcaauuccuccaggaauacgauacuguuuuugauucacuauuuucuuuggcagaggcaacucuaaaggcuuccauuuggccuuuccaaccauaauagcccucacucuacaguucagggaaccaauaugagaauucugccaauuucugaguauaucuaucccaauuauacauucuggaacuggggaaaucaccacaggauguguccggggaccuacuggaccuacugugagucggacaucagucaaaacuccauuaaucaccugcccuccauaagccccuacuuuaacuggagggccacaauguuucuugggauccccugggaucagugucaacucagaaccaguauccagcagaccccgaaaagucugauuauuuccuuuuccccaauguacaguuacccuuguaaaaggccguaggucccucuggggaagaacuggagaaaggguaacagcaaaaccuuugagugucuuaucaagauccuuccucagcggaaccuggccaccccuucauucaagggguucuggaucugcaaacugucucaagucuggaaauugauucacuggccgagauugcuguuuaccacgaucuaauguagccuuucuuucauuuggcuguuuaccacgaucuaauguagccuuucuuucauuuguuugagaauuuuucugcuuauacagaucaaacaaauaugcaguaggcuuccuauguauuucauuccuggaaacaccaugauugguuagccaguaccaaagguccaaccgagucaugccauuauaaauuucaccucuccugugcugaccauuacuggguauguuauuauaaacauucuuuugucuacgcuguccauuauaauaacuagaaucaccuugucuccggcgauucaaugcugccaccuggcccuuguuaccucggaauccaacuaaacccagugaauuuaauucaucuaauugagcagaagcaucuccaaugcuaagaucuggcacaaggaaaagggaaagaacaaaacccuucaaaugugcuggugccccucucaccaauuugcgucuuauagagcuagugaaaggcauaucuucuggaccuucccauuguggacaauuaugcuuuacacaauauauccacucuagcauugcaauuucccuaagucuuaaaaucccuucaucaacacuaagccacggaauaucaggcaucuccaagucauuuccaguaggccaucuuuugauaaacaccucagccaaccauucaaacaaacuuuugacaccuuuuuuaacuaugcgagcuuccguauuaaaccuagaaucucuacucagaggacccaugucaauaaacucagccugcucuagucuuauguuccuuccacccuuaucccacacccuuaaaauccauucccacacauauucaccagguuucugcuugaaugaauuagcaaacucauuaagcuccuuaguaguguagcgaauuuccucauggacuacacuuucuaccuccccucuaggagccuguuuugcuuugagucugguuacaggucuagaagaaacuauuggugggccgugagcagacucugcaaaauuaauuuccucauguggggaaggcauuauuucaagggguggggcugaggguacuacuuccucagguggggcaaacccuugagaaucugaggauucaaaauucucagcuucaacauggucuucccacacauccccaucccauguuguaggaucccauucuuugccaauuagagcccuuacuuuaacugucgacacacucugaggcugagacuugaauuuucgcuguaguucagccaaccuuacaaugagaguuucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauaguugaaagugcugguggaucaacaagccaauuccagaauuuuaaaagauucauccuuguacuucuguuacucuagaaccacuccugguaccaacuucuguauuagucaggguucucuagagucacagaacuuauggauagucucuagauaauaaaggaauuuauugaugacuuacagucggcagcccaauuccuuacaauuguucagucgcagcugugaauggaaguccaaggaucuagcaguuacucagucucacacggcaagcaggcgaaggagcaagagcaagagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacagguacuuucucuagcuccuccauugggagcccugugauccauccaauagcugacugagcauccacuucuguguuugcuaggccccggcauagucucacaagagacagcuacaucuggguccuuucgauaaaaucuugcuaauacaucuggguccuuucgauaaaaucuugcuaguguaugcaauggugucagcguuuggaagcugauuaugggguggaucccugcauaugacaaucacuagaugguccauccuuucgucucagcuccaaacuuugucucuguaacuccuuccauggguguuuuguucccaauucuaaggaggggcaaaguguucacacuucagucugcauucuucuugaguuucauguguuuaaaagcaaacauuuuuaaaguauauagucuuucaguaacaauugccuacaauugugaacauacuuuguaaucuggaaaugaugggugaauaaagaaaguuuucuuuugagagguagaauaucacagcuguacuggucucucuguugacaaguuugcauuuaauuuuaaguguauacauaucuaccuggaugcuuuauagauaaaguaauagggguagcuagccuauugguuggcugugcugugcugugcugucaucugugaauucaugauggagcaaagaaagacuccugcacaauauuuuaaauaagguuacugguguguuggaccugagcuuuggccucacaggcuccagguuggacacacuucucugcuaacauaguguuuuacgaugcauuuuagucuugguucuuucugucuucucugucccagaguaagcaguuuaauggguuugcauguguaggccauuuagaaaaguacaugucuguaggaaguacacuuugccugguguagcuuuguuuguuuauuguuuuuacugugcauuauaguuaucauaauuauuuguagcuuguuuuucagucaggauguauuuuguggucuguuugugucgauaucuagaguuagcauuuguuucuuuaaaagguuguacauugucaccuuuggguuaguaucuuauuacccuggcgauggguggugggucacaguuuuaguuucccacauaguggugcaguaaacaccguucuuagcuugcuuagaugugugugccaacagugcuuucuucaacacagauaucaggauuaauuuuucuaccuuuaagcuuaauguauuuuguauuuaauagaaccacauccaauguuccuuaaaauaucagugugccuguucaggccuguaaucccagcauugggcaggcuaaggcaggagguucaaguucaaggccagcuuaggcugcacaguaagauucuugucuaggaaaagaaaucuguuuacuuguuuuucauaauuuugcucauuuguacaaguuauuguuaccaaguauaaaacuuuauacuuuuuaaguguuuguucacugaccaaugagggagccagccuuccucccucccucccuccguccgucccuuccuuccuuccuuccuuccuuccuuccuuccucccuuccucccuuccucccuuccucccuuccuuccuuccuuccuugcacugagguuuaagcccagggccugcacugcuuacugagcacugucuaugccacugagcugcaauagcuucaguccauuuuccuuuuuuuuuuuuuuucuuucuuauuuuaaaacaaggucucacuaaauugccucugcuggucuugaacuugcaaccuguaucaucccucuuaaguagcuaccugcaagccuguaccaacagacugacuuucuuuaaauucaucucuuucauuuuucuaaguuacuuuuuuucucgugaauucuaaggcugcuauacacuguucaaguugugggacucugaauaguauaaagcucuagaauaaaaguuuucauauuuauuuguuugagacaggcucuuuauguaguccaggcuauccuggagccuacuguguagacuggguuggccugaacucacagagaucauuguaucucuacuuccccaaguacugggauucaagguuugugccacuauacuuggcuauaaaaauuuuaauagguggugucugaccuagacuuuaguugauaagacuuaacuuguucugagccuugaauugccucauguagaaggagauacucccuagcauguguaaggcuuuguguugaauuucugccacuguauucauuguagcuacauuuauacauuacugagcuccaaagcuuacacacuaacagaagaucuuaguuuagaacuauaguaaguuuuaaccucacugauacuuaacucaguugagcucauuaaggcauuuauuuaacacuauggacaaaauugucaacaucuuaauuuucaagaguuuaccagaaauacuuuuuuuuuuuuuuuugguuuuacgagacaggguuuuuuuuuuuuuuuuuuuuuguuuuuucuuuuuuguuuuuucgagacaggguuucucuguguaguccuggcuguccugggacucgcucuguagaccaggcuggccuugaacucagaaauccgccugccucugccucccaagugcugggauuaaaggugugcgccaccacgcccggcuaagaaaacuuguuuuuguuuuuguuuuuuuuuuuuaguuuuuugagacaggguuucucuguauagcccuggcuauccuggaacucacuuuguagaccaggcuggccucgaacucagaaaucagccugccucugccuuccgagugcugggauuaaaggcaugcgccagcacacccggccucagaaauacuuuuaaagauaauuuuuucacuagaauuucuuucuuuaauuaacuaguguauguguguguguguguguguguguguguauguauguauguguguauguggugauacacauguguauguuuuaugugugucuauagaugccagagguugacauugagugucuuccauuaucaugcuccugagucacugaacugggagcucaccaucuugccucagacuggcugauuagcgagccccagggcuugugaacucaguucgucaagccugugcaacgagcacuuuagccucugagucaucgcucuggucggcucccguugcggcucucagcuuguccguauguccguaugccucuucccuccuagcuucuggugauuaguuuucuacccucuucuuugaaaucagcuuucagcuacugcauuugagugaguguucaaucuuucuguccucuauguuauguguaugaauguuuacucugcaugcauguguaccgugugcaugccugguguccagagaaaccugaagaagcccaguaucucauccucuuaggacugauuaucauugaaccauguauguauagguagguauauguagcaugcccauucaucugcugauagauccugcauuugagucuguguaugggcuguggugaguagugaugcaguaagcguagccugcacagaucacuuggugaagaugcucucaucuccucuggguacacgcccagaagugggaugguuggauccugagguccuuacauuaucuguccaucccuuuuccgugauguugguacuagugcacauugccaccacauggauacauuaguuuuucucugcauccucaccacugcuggcuauguuuuucuuuuucuuuuuuuuuuuuuuuuuccuaauugcucuucugauggacgaauuuguaaacugcuuuggguaacaugauguuuuaacaauacuauuuuuuucaauguauaaacaugggagacuuuucugguuuuguguguauuuaauguuguucaucaguauuuuauaauuuuaauuauuuaugaaguuuauuugucuuuggggaucagguucacagcuuugacacgacucuaccacugaggcgccguucaugugaaauaggauuuauauauugaauacuuaguacccaaaccauaaaauuaaaguagccaugcuaucacuugucuuuauaugccaccuugguggcagacauacacacugucugauuaguagaggccguauuacucagaacucuguauuuaaagauaaacugcagucuuaguuuaucuugucucugcaugcacauaucugcaaagacacaugcucauuguaaguuuguguacugcuuuccuuccuuuuccuucauucuuuuuaguuccucucuucccuuucccuuucugcuuuccuacauuucccccagguuugggguuaugaaaagcaaggccuuguuuuguagcccagguuguucuugaagccauccucccacuuguauuucuugaguaccaggaugcuggggcuucaugcacccuguuguguuuuuuguugguuuugagagguuuaauccucaaaaaaacccaacucuccaaaacgugugcguauagaauguuuugcaugguaagcaggugcaaccaagcuacacucuuagcuauagcauuauuguuuuccuuccuuccuuccuuccuuccuuccuuccuuccuuccuuccuuccuuccuuccuucuguccuuucguucuuucuuuucuuuucuuuuuuuuuuuuagauuuauuauuuuauuuuuaugaguacacuguagcugucuccagacacaccagaagagggcauuggaucucauugcagaugguugugagccaccaugugguugcugggaauugaacucaugaccucgggaagagcagucagugcucuugaccucugagccuucucucccgcccuagcuuuauucuuuuaauauuuagaaucagucuaaauauuccuaaaaugagggaggcuugauacauaauaguaggacauaagacuuuggagugcuugaagcuguagaaggaguaagauaauugcaugcuaucucacacauguuacauguuaauauaaguuaacguugguuaacaaccuacaguguguucugauagauuuugggguaugcgcaaggaucagugcauguuucuuuaccucacauuccucuucgugucaagccgucaggagcugguaacuagugacuagcauaugaggaguguuggguaguguuagucaguguacacauguguauguaaauuccgcaaggauagauuguggagaguguugcaaaguuuauaaagggcuaaguuggauaauggcaaaauugguaugcaaugaauguuuucuauauuuucuguuagaauuuucaguuuagaaaguuggaaauuacuucagauuauuuguugggcaaaagauacauaacauuaaguaauaagcuuauagucaugucauucauuuguauuaaguuauuguauaaauuuugacucccugcccucguggaucauuggccaguaucagucugugggcaaagggagcagagaugguugaagggugucggaagccccgugaguaugaguacacuaggaccagaugcagggaggcagagcaacuugacuuggggugauucaaggcuuauagaauuuugggguaggaauauccaggcgaaggucaccgaggcuuagguuaccaaaaugccucauuagcauggggaaggaagcauuucaggaaucucaggucuuggcugaacggguucuuaucgggagacaggaaguugaaccuguaauguaacuaaggcuaugugacauuuuacaggugugugugggguggggggaguugaacuccagacaaggucagagaaggggaagccgugccaguaaaggaucuuccacugugugccugcugagcuguccagacaaugacagcucucuaccuuaauuaguagaguuuucccacacaaauuagaagaaaagguuaaaaauauccauuuaagagcuuaugugaucguauauaccuuuacauuuuacucuuuuuuaaaaaaaaucuuuuuuguuguuuggguuuuuuuucugagggaucucacuauauggcuguggcuguccugggacuuaucauguagaccaggcuggccuagaacuccagagauucaccugccucugccucccaagugcugggguuaaaggugugcgccacuucaccuagcuuuaaaaguuucuuuuuauuacauuuauuuuugucuguguaaguguguugcucauguguaggggccauagguuaacuuucagaagucaguacucucuucugucauguggaucccaggauucugucuuggcggcagcaccuuaccuacugagccaucacguuuugcuuuucuaaaaaguuggccucugagcuuuucuuucuuuuuccccuuuuugguuuuuuaggacagagugcaguguaggcaagcuggccucaaacucaccaaauagcuaaaacugaccgucuagccgccaucuuuuaaguccugggauuauaggugugccaccaugucuggcuguccauuauguaucuuucauggccgagauuuuuaaauuacuaaauacaguauaauuuacuaacccuacugcuuuacuguccaccugaacuugcaguuauaguucauccuccucgcuagcuagagccuugugccugccugcuacggacuccaccuagcacugagccacauccacugcucauuccuguuuguuuuuuaguuauuugaaugucauaauacagguaguuuuuaaaagaaagaagguuuggaguuucacagaaaauauacauacaugccucuugaaguauuagauuuauuuuuuuuaaucaagaauacuaauuuaaaucaagaauacuaauuauuauagacuaugucaguauauuaauuaguugguauaguuuuguguuuuuauuugcucauauaaaauaaaccuuccuucguguggaaguuuuuuuuaagauuuagaacuugggucggacagugauagugcacgccuuuaaucccagcucucgggaggcagaggcaggcagaucucugucaguuccgugccagccuggucuacagagaaaccaggauuuucuuugagggggagcgggggugggcuguuauaaaauuuaauuuuggguggcaugugguaugauauacgcauguggucucagcucucuaaaugcugcagugggaggccagacugugugacauauugagacccugucuugaaaaucaaaacauugagccuacaaggugauuggcacucgcuugccaaucuaacagucaagaguuugauccuuugauuugaccccuggaacccauggaaacaauaggagaaaucugacuuuacaaaaguuacccucugaccuucacacacagaugccugaaucaucacacagucaauaaagcucucucccucccucucccuacccccuuuacacacacgaauacaaacacacauguacacacaaaucaugaauaauuuuuaaaguacccauaaaacccuugauuuuaucaauugucucuguuaauuauagaaauaauaucuaguguuuucugaguuuuaguauauaaaauuuuaauauauggauauauccauaaaaacuuaacuaauaaauagcauuuuguucuuuucuagucaucuauauucuauuuccuuuguaagagugauuugugcuuagguaggucauuguacugaccauuugaugcagacacauacucugcuuuuaaauugccuguaauuuuuaauguauauaugaauuagucaugugugcucaucucucuuguauuuuuuuauuucaguggccaaggaaguuugcuccagccuuuuauauauuauagauuucuuacucuucgauauuccucuagaagaaauccauauugucgguaagcuggugacuagcuuaaaucucuucuguguaguauaguguccagauguaggauuuauaacucuugggaauuucuuuuuuuuuuuaagauuuauuuauuuauuauauguaaguacacuguagcugucuucagacacuccagaagagggcgccagaucucguuacggaugguugugagccaccaugugguugcugggauuugaacuccagaccuucggaagagcagucgggugcucuuacccacugagccaucucaccagcccucuugggaauuucuuaacuaauaguuuagaauuuagaaggaagaagugucuuugcaauuuagguuuaggcuuuuaaagaaguugggggugagugaaaagguaguuucucagcagcugaccuuugacgcacagguuuccauccugaucaguguacucuuaccccggcaaacagcuuagcagcauagggcuccagaggacgccaugguacugcagcugucugcuguaacacagcagcacaguagagaugcgccacauaaugcuagccuuagaaaagaugccaucugaaugaaguaggcugcugcugaguguuugccacuuuugcagcagucuuaaguaaaaauacuggagguuaaaacauucgcggauggagucgcuauguuucuuuuuuauuguuuaaggcgcugcuagugcuuugggaauaugagaccuaagccccauucuuaaggacuuaguugaaacaaauaugauuuguaaaaauucacaagucaauauacaguagucuccuuaagcacacuguagcuuccuauacuuuuguuacaugagcucuaaaaagcucauagccaugcaaggugaugcacaucuguaacccgaaggugaugcaaucuggaaucucugucauucucugcacucacgaggaucccaagcucaggcccaacgaguaacuaaaaguauccuugaggauacaccaaacuggcuucuaguccauuuuguguaugauguguauguacauaugcauguacaguauggaaugaaggguacuucguggguaggagaggucaggcaaggaaggccacuuagccuggggacaaacaaagccacacaaacaaacacacacaaaaaaagcacuguccgagcugcagcaggacacagcaagaucacaccaggucgugugagcucuuggguagguuuucauaggaaaagcuaguuugaucaggauccaugcuaguagcagcauugaauguguuccauguagucuccauuaucuucacuacagcacugaaauuccuaguguccagaaaaggugugagagagcauucacuuaaagaaauuguagauugcccaugucauguaaucuuucagucauuuuuagaauaauuugaauuugucugaaaauuugaaaacugacuaacagaaaaaaaguaaauaauccauuuuagauauaacugcauauuacacuuguauguauggcuuuggauguugucugugaugagaaggagugcucaagcugcccuggcuggcucuccaccuccugcacuagcagcugagggcugggccugccaggugagcguggguucuucuuuguauauuccccgcaguguacuccagauucaucuuuuacuaaaugguuugggcuuuguuuguuuugagacagggugucacuguguagcuuuggcuguccugaaacuuacuauguacaccaggcuggccucaaacucagagaucugcuugccucugccccucaagugcuaggauucaaugugugugccacuucacccagcuacuucuuuaaauucuuuuuggucagcuuuuucuucugcauuucuuagcauuguuuguaucuguugucuuuuucuuguguuucugaauaaaacuauuuuaucuuauaggaacuuguuuaaugaacugaggauugugguugaacacauuauuaugaagcccuccugcccacuguuugugagaagacuaugucuccagagcaucgccuuuaucagcagacuggcaccaacaguugcguaguuuaacaucuaguuaagcuguguuuagaagauuaacauuauuagcugguaauucugauaggggucccaaauuacaggucuaacacugaccucaguccaauuuacaugauuuacauaaaugcaucucagugcaaaaauaauaauuuuccuggcauguuaaaucaagccuuuaacacuuucugagaaaauuuuacuguacauuacuguuugugguuauguaaguuuguauuuagugauaaauguuacuaaauuguuuuagaugcugcugugccuacaucaugaaauacauuuauuucuuuuaaaaagaauucugaaauuuguuuuacccuaacuauuaacccacguuaugucuguugugaguuaugguacuagaugaguugaguauguuuggagacagugguuuuccauucuguaaguuggguugagauuuuagcagaagcacaccuccugcaguuucaguucacacgcuacuaugcugcuuucuagggcagguguguuuagccugcaccauaacagagaagucugucugcgucuuaugaccugugaagcuguuguucccauagugcaucuguggcuaugaaugauguuugaaaaauggauugccuguacaccuauuuugaauuagaucuuuggggccauguaaucauuuacuguagaagacaguagugacacagagaccuacugacuaacuuuuauaaaugucaaccaguagauuaucaguguuccuauaguuuguaggauuacauaguuccagaaucuugacuuuaguuuucuugguuucuuaggcuugaaauuuccuagccaugugcagcagcaguucagaugccuuugaaaggauaugauugaagacagcaugugauacacuuguauguucugaaauaaugaagaauauucuguagaugcauguuuacccagcaaaugugguucagaggguuuaauggaaagggcuauggguaaggcaacucauggggaaugggccuggggaguaguugagggcagcgauggguguuucagccugguaacgcauagaugaguuggggggauuggauguauaaugcaucugugauugaggcuguguaauauguucaauucuuuucacucaauucuauuccuuuauaaaaggcauucugauccuuacuacucacuguugcaugauuggaaguacuuaaaacacugcacaaguuuaauauagaguaauggaauguggcuuuuuuuuuuaauacccaguucuaucugcauguaauuuggauuuuucaaauacauucauuaguaacuuaaaacaucaguuuucuuuuuguuuaaguuacuaaucuauagaaaggugauagucuugggguagauuuccagaaaauacuacuugauagcuuagcuuuaaccagcuacuuuuauauuuuuguaauauuuauccaccaaguuggagaagcaaccucauaauauccaguugauuuuuuuaugugugugccuagccuccuuaucacuauguuuuaagaauacaacuuuguagagcaauaaagugacuaucuuguuauguaaacauacugauuucuaaugauguuuuaaaacauugucuugaaugacaucaaguucuggcagcuaaaggcauauuuauuuugaaauguguuuucuccuacauuuuccccccuaaucuuggaacauuuuagauuuauaagaacuucaaaaauagugcugagagugccuaugcaccucuuacuugucuauuuuuauauuagcgucuucuuuuaauugguaggacauuuaugcaaaguaaaauacuaacuuuggaucagcuaaaguacaagauguguuuguauuucaccaacucuuucauuugugucgugugugcgcuguguugguaccuggauugccuuuuauguuucaaggccuauaagugaguuuguucuuuaugguauugguacagaaacuuuccuuagaagagcuaauucaugcugacuuuaacaugaauuuuuuucuuaaaauuguaauuucaaaugcuuagugauauaauuaagacucuuuaauggcauugcagaauuucauuauuucugauaacuugugcaugagugaaaauguauauuuguuccuuaagggaagguguaauauaauucucaagcccaugagaaggcaaauuuuauaauuugaacauuaauagauguuaguuugcaugaaguugcaguuagaaauauuauacucugugugaauauguacaaucaacugaucucaaaucugaaauuaguguuuccauguacacaugucaaaagugaggacaugacuagugcauagaguggacgagcaggggaacuuuaauacugcguaaccaagcaguuuaaaggaaguugauugaucaagcagaauaucuagugcuuuggaaacuggaauggugcuggcguguuuuaaaccuuguuggacaaguggaagcuucagacaaagucuguuguuuucuaacaagcauucaauuucuacugcauacuucaucucucaccgaguuggcuguaauuuaauaguaauccauagagcaauuucuuaaguauaauuuguauuuaaauuuccuugaaauaaaauuucacuaagggagaugcuuuugaaagaaaaacaagagagaaagcuaauuuuaaagauuaaguugagaucuuuguauauaucccugacagagaaugucaaggcaagcuaguaacaaaccugaaguucugggaagugaaugaugcuguuaaauaagaaucgcaucguucucagucgguauagagauguagacagaaguuugaauuagguuuguaaguuuagcgaauauccuggauaggaucacgaaugcauauauaauaagacaaagcagaagccagguaucuaagcauuucagauggggaagugagcaccugugauuguaguuuaaaaaacaaaacaaaaacacucagguaguguauuggaauuuguauugacuaacucacccagggagaaauuagcuguggacaguuagguuuagaucgguaagugucacuguuuccuuggguaguccccauuuucacaaguuggguuagaagauuaugcugugcuacuuaaagugcuuaguagacuauaacccuaaguaucuugguucuaugaccccuuuaauucaauaguggacaguuauuugcuaaguauuuacuaugugugcugugagauggggauggggauugaagccagggccccuuguucuacuacugagcuauauucccagcuuaugaguaccauuuuauaacaguaaaacauucaaaagaagugcguugucaauacaagccaggaaaacagggcccagucuggaguggcguguguguuagugucucuucuuuucauuuucagccagucauccaaguacauaaauuguugagguuauucuuuucccuuuuacaaauguucaaagaaaugauaacuuuucuaauauagagagauggaauuuuaauuuuuucaugauuauuuuguagguacacuagauagaauccguuaaauuacaauugagauuuauuuuuuccccuguaauuugaaagcacuugaguguuuggaaacuacuauaucaguaaugcuaccuagguuugaagaucgaguguaguucauaaagacaacaaauuuucgcuccaccauuggaauucccuggaucagggaaguucaacacuggcaauguguugguguagcucaacaggcacuacauagcuuuggaagcccggaguuguuucucagcagcuccuuaaugcacauggucuuucauaguuugacugcaaagccauucuuggagcuggugucuaucaaagauaucaaaggagcugcugggaauuugaaagguuuccuguaauuaguuaaucagugugaauuuugugauuuuugagauggcacuuagguggcccauucagaauggauggaaucucggguaaaggcuucucucuguggccuucucuuugugaugcgcaugccauguacccagcccacacugagugugagucaguagugacagacagcaugcaguaaguauucucuguaucucaaguggcucuuucuuagaaaaccauaggaaaaagauuauugauagcuguguuugcuagagucuuuuaacgacgcuauuggcuauuguaggagaaagaagggcacaagagucauacccuaccuuuuccuuccuucccuccuuccuuccuuccauccauccauccauccauccaucccccugagacgggguuucucuuuguagaccuuugaacccagggauccuccugucucugccucccaucuuuccuaguuuuuuaaagguacauuaaaaaaaauaggcucagcauuuuuuaaacuaacguuguucauaacauuuaauuccaaacguuuacuauuuuuuguuacuuuaaggacaauuccuuuuggcacuaguuuuugucuacaaguaucuguaaguugagaccaaaagagcaaacucuuagccaggcaacacuuacauuguguauauauuggaacaaauauacaaggcuugcagagauuagcaauacucauaggaacuguuugauuuauaacugcaucgcuucuggugcuugauacaaugggaucuauugagcuaaaaaaaauuguauauacaguacgucagcacuucuuacgucucuugaauccauuuuuaauauauuguauagguuggggaguuauauauacucuucaagccauuauuauccuggcuauaaauuuauaaaauaaauugaaaaauuuaucacucuccuguauucaagaccaaagcacauaaugcuaauguagggcucagaggggaaaaucuaguucuccugcauauuugagaaaacguggaguccuuucaagaaaauguaauaaacauaauaaucguagccugcugacacuaaggaaaaaggccucauucgcucuuucuuuuaugcagcaauuuacuggucccugcugaucuucaaauuggaucacuguaguaaauuauccacgcugguacugguggaaguaagcccuaggauccauauuuguuuuguguucugcuuaaaucagcaagaaugauaaauucgauggugugaaauuggaaguaucaagggcuuucuuuggugacugcacaaagucaugucuccaccuggaauuuauuaugaccuuuuuucacuguauguacuucauaugucuaauauuuauuucaaaacaaauuaaauuguucuuccuucaucuauaauguuuuaucuaacauuuuauugauguaaagucaaauuguguaauaaaagucuuccuggauuuaag

SEQ ID NO: 2485 - RNA, 10313 nt, Mus musculus
ugucugcgccguggccgccgccgccgccgcugccugucgccgagccuggcaucuccgagcccccgcgcggggggcugccgcccagcgcugauugacagcccgccucgccaaugccuggagggagaaaggagguaaggagcaaguguuuaggguaauaucugcuaaugaugaugggggcggggcggggccugggcccgggcggcccgcgcgaucggcgcuucggacagggucguggggggagguggggagggggagcccguggcccgaggggacccggugggggaacggaaccuggagggcgucccgguggggacagguggaagagguggcgucccggcucucucggcuguggacgugaggcggcagcgguuguccgcaggguccgagcuuuggaaaggaguucccggcgcccuccugcgugaccucccaacucucggagugcacgaagggggugguaccuagaaguuagggcggggucgccagagugcaagggugggacagcaaguucuucuagaaggaagcuacaccucccuccccccgccccccucccgaaaaagaacaucucgaaggacuuggcacaggccgcugggagguuuguccugccuuagggucuugcugucccaggucuggcggccgaaccagaaagcacucagggccuagugcuuccauacuguuucgcuuguucuccauagggagcugggcgagagagcacagaggcgccaucauuucuuuccauucuacagauuugaaaacugaggcucugaaagaccagauuugaaaacugaggcucugaaagacuaaagggaaauaugcaaauucacgcagaggaguuugugagugaauugcacgguuacauauaggucuucagaauguaaaauagcugguagacagugcaauucaagggaacaaaaugaucccacgguucccuuugggauggugacugcuuugaacauuauuauauuaucuaugcauauacguugcaagaccaaaguggccugggaucacccuuuccuugcguugcucauacuacccggcaccaccgggcuaaggauucagugaugaagaucucaguaauuugccgaagcugccccguaagguucuucaaacacaaggaaggguuccggccucugccagucacuccuuccugucucaaagggagcauccucuaguuaggccuaccccaaucccugcauccccucuucccaagcuuggguuucaaccucguucaucauuauccagguccuugaugaaugaagcucaucucuccaaucuggaguugcuuuuuuauucagagcuauccuucagucuugggaaagugacccauuuucuccugggggccaggacuuuggccucucauuuuccagaucucucccauuggaagaguuccucucccuugcuguuuccagagucucugcucacccacucuggacugucuuccucuccucagcaagcuccucugauagugcugugccccucccccauuuauuagagaugaaauaaauaaugccauaaauaaaaguauuugggaguccaggaacugucagggcugauuagggcauagaggacauuuucuuucucauuaugcaaaagcauuucauggggaaauaaaagagguuucauuguaacucaugcaugucauauuucaaggaauucacgauauuaaucauauuuaacauuauuugcagcguuucuucucccuggcuucugaaaacugcuaaaugaggacacguggaucacugggaagaaagggcgggcgaugagcaagugagggacaguuaagaaauaaugaaacgcuggugaaagacagagagaaugagaugccggggagauguuucuuaggcaccgaagggagaggugggggagaggcucccgagccgggagacagcugaaacugaaugauauacggaggagauaaaugguaacaacccuccccucacuuuccugucuagagagcaguucugaauuuugcaucgaaaucuuucccucccacauuuacucccugauaauuugccaguaacucccugcuuuggaaaagaaauuaggguggucauggugguggucauggggcugagcagaagaaaaccuucaguccuuugguaagaaaaugauuuccuguaucuggggcagagcuuucucuuagauuuauuaauuuuauuuguaugaguguguugccugcauguguauauaugcacugcauggauaccuggugcuggaggaucuggaacugguagcacaguugugagccaccaugugggugcugggaauugaacccaaggccucugguucaacaaguguggccaccucuuuagcccuuauguacauauuuuaaauuuauguuaaccuugccacucaaacaccuugagagaccgggaacgauacuuucuucauguuuuacugacuaaaggaaccaccucuauuuuauauccccaaauagccauuucuacaaaagugaauauucuaaugaaugguugcgguaauuggguuggaagcguaguccccagugcaacaggauugggagauggggcccaagaguagacauuuaguacauacaggcuguguccccaagcuuggaucaaugccuguuacaaaagagcuugagauugugagugaauucuugggugcucgugugggugaugccucugccacuguauggugcguacuacaagaagguucuaaccggaugcugcugcccagcaacccuggaugucucagccuucggaauugcagaaagaaacaaaauaaaacaaaacacccccccccaaaccuaccuaauugaugauauucugucacagcaaaaaaacauaaccuuguauagggaacaagauaaggauuguugcaacaauuucuuuacaaugugaaaaugcccagguaguagaguauggaagaauuuggaagcauaaauuugaaaaagccuagguuccuaugaauggaauauuaaugcugauucuaauaaagacuguugcaggauauuugaucacauggccuccuccagaacucugaacuggaaaucuuguuacuuguggcuagguccucgcacacagcuuuaacccaagagcugcagacaagagcuaaauaaagucaaugguaggcuaggagauagagcuagcaaccaguugguagggacuguacauaagaaaacccaggaaacacgccguuaaucccagcacucgggaggcagaggcaggcagauuucugaguucgaggccagccuggucuacagagugaguuccaggacagccagggcuauacagagaaacccugucucaaaaaagaaagaaaagaaaagaaaacccaggaaagagaaaggagggccuuugaguugaaggguguaggaguucuuuucuucggggacaucagggacauugggggaguaggaaggucagcugcgugggugcuuccccugucucuuugagcuggcaugguagcuggcuccugagucuucguuugguaaauugaacauuugggauuugguuuuaaaaaccacagacgacugggaacuauagguaaagugugggacuuuuuuuuuuucaaugagcuuaagcaguuuugauccgugguagaaaaguaagcuuuggugguucaugaguguaaucccagcaccguccccucgucuggcacccacugaggaggccacucaaguggccugaccugaccauacccagacccuauugaggaaggcggguggagagaagagcauucugaugagugucugaugggaaugaggaaaugagcuggaguaaagacuaucuuuguuugagccgggcagugguggcacaugccuguaaucccagcacuugggaagcagaggcaggcaaauuucugaguucgaggccagccuggucuacagagugaguuccaggacagccagggcuacacagaaaaacucugucucgacccccacuuccccaaaaaagacuaucuucauuccacagaacucuguguguggaaggcaaaacuuacacauaaagaacagcgaagugcuaagauguuuggcagaauaaauaucuaaguagucgcaaagccuucagaaggcuguguagccucuuuugccugagaaaggagagaugauuuuaaaauggaauuuauaaucgaagggaaugcagagcagaaagauggggagauuuucagccuggcacgguaggagugaaaaaagcaugcccaggagagaguacuacggguauagccagucacccuuuugcucaagagauuauuugggcucccguugcuccaguucuaguucccaggauaaugagagaguagccuuaaccauguuucugaaaucuuuuagacaagcuaggacuuugaaggcaagguuuccagaaaggcauuugcuggccagaaucaccuugaaaggcaccuacauucugggugcagcacucccuggcuacuccaggugugccucaaguuagacuagguuagcuuagaagggcggaaguggugagcuuuggaagugucugugugggccaacugggaccaguuuucaaagauguuagacaguuuggagcuuuaggcagagacauggcuggguuacuacagagcauuccacugagggcgguguuuagagaaggcaaacaccuucucccgcaaacaguagagccgcuaguguccagccccauucugggaaagccgaauaagugaaucccagcagagaguaaagaguguccaccgaauacuuccggggcccaaacccuuuagggcaaugauccucaaccuuaccgauucugcgacccuuugauacaguuccucauguuguggugaccccucccccaaccguuuuucauaacuguaaauuugcuaaauguaaccauaauguaaacaucugauaugcgaccccugugaaaggagguugugaaccacacguugagagccacugcuuucgggccucuaggaggugacaaguaguuauucugggguccuaugcuuuaaguauaugguuuaaauacgauggcuccucuguugggaaccgucauauuugugguuuugagauaaggucucacuguauccaaaaguggcuuggaagucacuguguagcagaguacagacuagaauuugaagugauuccccugccucaacuuccgaagcacugggauuacugcaugcugggguuacagaccuuggccaccauuccuggccuauaguuguauuuggauaauguguuugaguucccugacucccaguuggcaaggaauuagccugaggaugaauuaaaauaccugauuuaaacgccgcuccuggacuuaggacuuguaaccuggcauuggaaugaauuuacacuuugcgggauuuugagguggacacuuguauguauguauguaugugaaaauagcaugcauuuuugaggccgggggagggggagggggcacaauacuaaugauuugaaucugucucccaauauuauguagcagaaacaauccccagugugacaguguugggagcuagggcccggugggaggugguuagguccuagggguugcccaccucccccaugaaaggauggauauggaguauauaggcuacaaguaugucuguuguacucccucacccacacacugucuguugugucauagaacaggaggaaagcucuagccaauaagacccgcaucccuggacuuccaagucuccagaacuauaagccuaacaaaugacacaugacccucucuggaauucuguuguagcaucgcagaaaugaauuaagacaguggcuuagcuuugcuuccuauaaaaggucuccuggaagaaacauauuagaaauguaaagcagacacuuuucauauccacacacaggcagcgucuuagcccgcaucacagagaaucguuuuccuagccgagagcacguguaauccaaacgcuauggacgcagagauaagagaauccugacuuugaggccagucgggacagcuuaguaagacccugucucaagacagaauuaaaaaaaaaaugccaguagucuagcucagcgguggaguagaccccuuuaaguugugauuaucaccccucccaccuggguuauacugaacccagagcuguguguggauguguggagcagagccugcuugaccuuggcugaccagaacacugcgauuguggauugauggacagacacucaggaccaaaguuacucugggcuccuuaggcccuuuccuauccuucccuuucaaccccguaucuguucuaacauccuugugagcggguuaagaucuuacaguaagucacuaaccuuaggggaccugugacuuccaccaacucuaaagcuaagaguauucugacaucucggccuguagagaagacuuccuuuccaccgugcgguagcuucuccgaaauugucuaucagugaucuugaaaugugucuguuuaucaccuuuguucuguggcugugaacaaagccucuucuacaguggaacgugcuguucagagaagcucuaaucuguguccuaacccauggucacugucuuugccuaagaauaagcuguuuucuuuucucuuugaaugccaaguuguugcuuugguauaaacacaauagagcuaggcacuuuuuaaaaauuacauuuauuucuuauugauuacauguauuuaugugucuggguacaugugaaggucagaggacaucuugcuugaguugguucuguccuuucuuaauaaauucucuuuuuuucuagauuuauuuauuguuauauuuaaguacacuguuagcugucuucagacagggcgucagaucucauuaccgaugauuaugagccaccaugugguugcugggauuugaacucaggaccuuaggaagagcagucagugcucuuaaccgcugagccaucucaccagcccagagcuaggcacuuaacaaagccauaaguaacacucaguaaacaucuugcucugcucuguagucugagucauaggacagugacuucaucauuaucugcucuugggggccuuacagagaugguaaugacacucaugcuuucuaccucuuuagauauuuacucuuaucucaaaaauacgagauagugaccuuuugaaaaccaaggggcuauauauggacagggugaguuuuuugauuggcagccugucaauuccuugagccaucuagaauauagcuuuuaaauaauaacucagccaugggaaaugcuuuuuauugcaccaauuucaaugauauuuaaugagcuucugauugacuguuugaucucccaauguuuugugcuacuuuuaauucauuucguauaauagaaaaaaaaaguaauuggaauaaaauuuugugacaagauaaugaccuuccacuuugaaauuaaaugucugauuagcuucaacauuuuaaugccgagaugauacugcagcaggcacgggagugugcguacugucauuccauaggaagugacugagaaauacgccuuugcuuuacuuauugcauggugaaugggcguggugucuacagaaucauagaugugcaggccuagaggaaacgcugcagucugaccgaacccaugucuguaguuuuuaacaacucugcuacacgguuguacaaaccauguuucgguaccagugauggagaucucacugccuccaaacacuucauccauucacccggauauuagucaaaaauauuuauuguguguuuacuaugcuaggugucuuugugggcaccgagggauauaauggugagacguaccaggguccauugagggaauaaggagaagauaauaaauuaguugccaacuugcaaauuuuugagagccgcaauuacugagaaagguggguaaaggguguucccguccagccucuuuuccuuccacauaacuaaggaagucucaaaucuucuaccugguugagggugaccuugaaaacagagaagaccgccguuagguggguugauuuggauagcagagagaaaggcaagagguuaggcgugucaggcaaauggcggaaccaagggccaagagcagguggggacugagcagggcaagguuugccaaaagaauaucagagacuuguucuaacugcagugccgacuccggagggaccugaccuguggagugacaugagcagauugauguuauuaaaaucuaauuuucagccaggcaguggaauugcacgcuuuuaaucccagcacuugggaagcagaggcagagggaucucugaguucuaggccagacugguuccaaagugaguuccaggacagccagggcuacauacacagggaaacccugucucgagaaaacaaaugaaacaacagaaaagaccauuuucagaaaagguacaaccgugacucuuauaaagacaguaaaaacaagcaugugcuagagauuuuauuagguguacuugauagccucaugguuucaaaggaaaugcuaguaucgagagaagaaaggaaggcuaacaaaauguguagauucauuuuuccaccggaagugggcaaaggcggaagggagccuuuuccagaaaggauaacuuggaugucuaguaauuaucugaacuugaaaaguagaaaaaucaaucaaucaaucaaucaaucaaauuaaaaccaguggaagaaaaugaguuucagcagauaacuacaaaccaagagccauuagacacaacagcgugacccuaugaaaccuaguauuuucugcacugcuuuuuagaaaacaaaaggaccauuuuaaagaucauuuucaauucacaggaggucaaaaagacggaauagagagucccagauaccuuguaucuaguuuuuacaaggagcacaccuugugcuauuauguucguugcaugaaauauacacccuuuugaggauucgcauguaacucaaggccauugagacucaccuguuugcuacacacaugcauaguauguuccuuuuuaugacuggagaguagccuuugguauggaugcacuauaugcuuuuagccaguccuuuuuugugggauauuauggcuguuagcagucuggagggauuauaugcaucuagccaaccucaacaaugcugugcagguuuuuuuuugugugugugaagguaaguuugguuugguuugguuugguuuggucugguuuggucugguuuuuccaaauaggaucuuucucuguccuagaacuugcucuguagaccaggcuggccuuaaacucagagaucugccugccucuggcuccugugugcugugauuaaaaugauuaaagggauuaaaggccuauauuuacuacugcaugguaauucuuauucucuggggccaaguggcuaagaaugggcugucagugugcuuuaaugugucuuaacaauucuccuuuuuuuuuuuuucuuacaggauuugucugacagcagagagaguuuucaaaucagcagcugugugauccuuuuaaaauagaauugugcuucucuuggguggguguggugauauaugccuaugaucccagcauuugggaggcagaagcaggcagaccucuguuaguucaaggccaagcuaguguacaucaugauaucugggacagucauagggcuacauaguaacacccuguagagaccgugucuuaaaacaaaacaagacaaaacaaaaacaaccacacacacacacacacacacacacacacacacacacacaaucagcuuccagucuccccuucauugucuuuccccucugugguuacacuuugccucuuagagcacauuccucucuccacugcagccucacuggucuuuuugagcaggucaaagguauuuuagcuggcauguuuuucccuggaguguauacacaguucuuuuccauaucucuuguacguuuuccugugguaucccuguuucagugaggccuucacuaagcucccugcuuacaacuguaacccuggcccuuucuugucacacacacacacacacacacacacacacacacacacacacacacaccucccuuccuaucuagcacugucacugucugucauacuaugaagugccauuguggugagauuauaacucccucacaggaagggaggucugcugagucagcagguagacuagugccuagcacaugacagagccccagugaaccugcugggugaggaauggcuugaagagcuguggaagcagcuggaggaagugcuaacauuaccuagauggagaggggagaggcagcagucaugcuagagggacgagagaacacuucaguauuucaguguuucaggaagcgcauauccuauugcagccagcuccgagcagaggaaagguucaaccuucguucucucuuccaaaugaagucuguaauaguuuucuuuucuuucuguaaaggaggcucuguugagccuguuuggaaaagugauguccuuuuaaagaauauauaaaggcagucauuuua

SEQ ID NO: 2486 - RNA, 13737 nt, Mus musculus
cagcuuccuuuuccgguugccauccuugccauccgcugucaugccucuccaccgccacgcuuccccaucauuauggagauggacuuguccuggaaccauaagccaaauaaagccuuccuucuguaaguuuccuugggaagcugagcucaggugcuccgucagcaggucuggcgaagccacagccccgggggccgggcccugcccgcuggcgcucccuccacucacgaccuugccuugucccccugauccuccauucuuuaaugucuuuucuggggcuucuucagccucuucccuuguguuggauggagcugaugcagaggccauggagagguguugccucagccuguuuuccuauagaacccagaaccaccuaugcaggggugaccccacucacaauuugcuggguccuucuacaucaaucaccaaugaggaaagugccguacaggcuugccuacaguuugaucuucuagaggcauugccucaaaggcucccccuucuccagugacucuaaccuguguacaguugacauaaaacuagccagccuaguauuacauccagcuaguuguacaugcgaagccuuaaaacauauauguuggaggcaucucaagguugguguuauacuaaagcagugguccuuuaucugugggucaagauccuuugggaguucaauaaccuuuucacaggggucgccuaagacacaaauauuuacauuacauuucauaacaguagcaacauuaaggcuauaaaguagaaaugaaaucauuuuaugaugcagggggggaucaccacaguaaaaggaacuauauuaaaguguugcagauuuaggaagguugagaagcaguguacuagaggguaugauacugccauuggagguuaugaaaucaucucauaguauccuccuauuuccacagcgaaaugcaccaugggguugaguucaauuagcagucuugcccaagcucagguuuuccuaccaaaugcguuagggaaacuuggcuuacagagcucucuggguuucagaauuagggauuaaggaucauaaaccuuaccuuaugaugacguucucaggauaccuccacacaaguuagggaguacaagugauggguacaguuguuuagacauaauugguaaagagcucuuuuaggcaaaacacagauagcguuaucaguugcuucaagggaccuccuguggguuuuggagaguugagccaugaugucaggguggaggacauucagcugugucauuugucacagcagaggaugugccccucuugucacacuaagucucacucagguuauauccaggcuucuagacugagacacccagacaguguccuggaaggaauccaggggccauagacuccuugggagaugggaaagcuauuauuguauucucauagccguuugauguguccuuuucgagcaucuucucuuugcaaaauauuauaaauuccaucugcauaagcuuuuauuguuuaucuaauguuucagacacaugggccauuuuuacaacccugaaaggaaggugcaguaaauauugucauccuggucugacugcugaggaagcaaaguguuauggagguuaagagucacuuuaaggcacagaagcaguugauaagagacaaaaagccaguucucucuucuguggcgugcauguuagaggucugugcuuugcgaaaacaagagaggaaugcaugcuuuaaacccauaacaguaaucuguuuugcagauuauagcccgacaucagaugcgauugaaguggcuuuagcaaaugucuucucauagagccugcucagccuaggguaguuaaucagauguuucaugggauaaagggcugccacgugccuugccugcuguccugaauccuucucaauaccugcaugaccaaggauuuauucuuaauggcugaaaggcaggcugauggcccucucugggaauuagcauccuuguccaaaguugcauugauuuagagagacagcccacacucaguguucgauaaggggacaaaaaagcccaguuccucugccugaacuggggauaccucugaaggagcaucccugccucagacccucugaggggcuggcugaguggacaguauaauuuugcuacagccucucccuccuccuccuuuuaccuccugugaaaacuauguccaagcccagcucugcaccucagaguccacuugcuggaaauguggaaugaagaaugaggacucagagagaaguggaaaggcaguaccugacaggccuuaaucuaugaggagagacucaacuuuguggucauuugucuuuagucauuaauaagagaacagaaaaugaccucccucuuggauuucacugcgacuuuucacugaccgagagcacccuaacauuugcuauuuccauuuauuuacuaauguccucugucccuuuaauuuauuuccaaauuugaacagccaagucugcuugaaccaauauugcaacugaaauuugucgaaggccgaggcauuugcugaaacaggaaauggagaacauuacagcagaguggagcccuuuugguaaugaugcauggggcugaaaugaugugaaggggaaaccauuuaaccauguaaauugaacaaaggagaguuucauaauaaugaccccaggcccuagcaugcuggagaauaaaaagguagguaucagaaugaggucaucccagcacacguggcaucgaucuaggguuugucaaccugguuugagucucagccagagcguaaguuaguuuuuucucugcaguccuuuuacuccuuggagggugagagaaaacaaaacaaaacaaaacaaaaaaaaaacaacaaaaccucaugaggugguucuaagcaagagcuauuuuaagggaggaggauuuugacaaaaaguugaugacuuaauuugaaucaguuuucaggucggagcuguuguguuuguaaagaaaaggaagcagagaacaggcuggcacugguaucauuauuucccccuuccugaauauuuccuaccaagcaacugcuuuggaaauaacaaaaugauuucacuauggaaaaaaugccgagaaaagaauccggggcugucugauuggcuaauaaugaacauaaaggacgucgugcuuguugaauggcagauugaaauccgguguguauucaugcagaucuuaugggggugguauuggauugggccacaaauuagugcuggcauuaaugagauggaagcuguaaaauacggaguuccaauaaccaugaucucugauaagauccaacugaaagcacccagaccauucagacaaguucugcgugagagcugugcaauaaacaacagagacauucaaaauggggaggaaacaggauauguaaccgacugagcugguaugggugaaaacggcauuagugugcagcgagugacagacacgggcuugcagagaauaaugauuuguagacacagacaccauuuagaugcaaggcaagccaucagagaggaggcguaugccuacaacaugguagggaaguuuguccaaaucaggcauugcucugugucacugccgcuccugcugccacagccacgaaugcuccuuccgugugguguaaguccugaugguuuguaguacccauuuaccuauguuaucuauuugcucucacaacauuucuaugugacuaguagaaugccugugcuccguuaugucaugauuuccacgaccacgggaaguguagucuuguuccuuguacgaggcaccuccucuuccuguugacugcuugugaauucuccuauguaauuuauuucaaagagcauugcugggcggcaaaaugaggucuacagggcaaauagagcaaauacaugguuguggcagcauuagauaagccuauuaauauuaagaugauugaacaaaggcaccgccuaacaugucuuaguacuuagaugccaucuuaauucuuggauaaccuuagucugcauagcuuauuccagucauuguccuuguguuuccuacugaaauaggcuaguuggugagaacgucugucuaguuggugagaacgucuguccauuuuuacugaaccugcugacuucccagaguuccauugguggcuuucuggauugccuuaggucuugcuucaggacaacggaaugguauaucuccuauggguccccuuaagcuuaucuuuugcucauuugcugucccucuaaggaaaccuugggucaugauaacuguuucuuauuuuggugguuuguauacgaauggcauccagagacucguguguuuauucacguguuuggccccuagggagugacauuguuaggaaguguggcccagggacauugucacuguggaggcaacucugaggucucauaugcuuaagcuaggccuaguguggcauuuacuucuucugccuguggaucaagauguagagcucucagcuccuucucuagcaucuuggcugccuguaugccuccugccaugaugauaaaacauuaaacuuaugaaacuguuagccagcuugaguuaaauguuuuccuuuauuagaguugccauggucauagugucucuucaaagcaguagaaacccuaacuaagacgcuuaaacccacaacuugcuguucaaggcacacauaguguuguccauauuucuuugcaguguugcuauaggacaugggagaaauuacucuuucuccugaugcuugccaccuugauuuucaguacucuaauuuuuuauacagacuaugcuuaguaaauguugaaauaaaugagccaccuuguguucuauauuuauacagggagcaauaaaacaaaaagaaguuauauuuacaaucucagacugauaaaaauuuauagcuaagaagacccacagagauuaacugggccugcuuacccuauuccaccguuugcauugaggagagacagaaaucagaggucaauggacuuucccaggaugcaauaguucgugaguaguuuacuaaagaugaauucugggcuauggucagugucuggcuucucacauguuuuccuaaaggauacaggcaauagucaaucuuuucugucaggcuucuuauuuguauugcuuucuuuauuauuuauuuauuuguuuguuuguuuguuuuuauuagguauuuucuuuauauauguuucaaaugcuauuccaaaaguucccuauacccucccuccacccugcuccccuacucacccacucccgcuucuuggcccugguauuccccuguauuggggcauauaaaguuugcaauaccaaggggccucucuucccaucuuuugcuacauaugcagcuagagauacgaguucugggggcuacugauguucauauuguuguuccaccuauagggcugcagaccccuucagcuccuugggugcuuucucuagcuccuccauugggggcccuguguuccaucuuauagcugacugugagcauccacuucuguauuugccaggcacuggcauagccucauaugagacagcuauaacaggguuccuucagcaaaaucuuucuggcauugugcaauaguguccggguuuggcggcugauuaugggauggugccugcaucgguacugagaauuuaagagacuguauguaucaaggcugcaaggcacccuaagcuggcugccaccgaaucagacucuaaaggucagaagggguccugaagccaucaugaucugaaguuuaacucucuaucucugauguccugacaagcaaucgcauuauuggaacauuccugucucugucuuuggauggagcugacucuggagauuugacaaaaguucaucauccuggauccuucauugcagagucugaguccagcuuucuggagaugcucagaacaacuggauuccuggcgucuaucagucccaauauguuccccgugugugaugguuugaauaagaguggcccucauaggcuccugaauuugcaugcuuggucaucauggaguggcauuauaugagagggauuaggagguauggccuuguuggcauagguacagccuuauuggagaaugggugugacugggagcaggauuugagauuucaaaagcccuagccaggcccaguaucucucucuuuuuguugccuguggaucuggauguagaacugguggcuacuucuccagcaccaugucugccugcaugccgccaugcuuccugccaagucgcuaauggacugaaccucugaaacuauaauauuuuccuuuacaagaguugccaugaucauggugucuuuucacagcaauagaacacggacuaaaacaccaucuuucuuucuugcgucaacaauucuuucuuuaaauuuaacaauuuaaaugguauguguauugguguuuucccugcacguauaccuauguauugugugcaugccuaaugcaauugcagaugauuguaaguugccaugugggugcuggcaauggaacacaggcccacugcaagagcagccagugcucuuaacgccugagucaucucucuggccccaucaaugauucuucaaccaguguuuucuagcuuuugaaccaccagucauaugcugacaaugauaauauuuauguggcacuguuagauaaacuaaagagaaaugauaucuaccugggacuugguuaaaaaauaucauuauauucauguuuauauaguuauauaauaucaaagaugcugaaacccuuuaauaguuccucaugauguggugacccucaaccauaaaauuauuuucaugcuacuuuguaacuguaauuuugcuauuuuuaugaaucauaauguaaauauuuuuggagacagagguuugccaaaggggucacgacccacaggaugagaaccacugcucuagcccuggugucuucagguucucuauugucaucaagaaacugagcuuucaaaaaauauacaguaggugaaauuauaucuaaaggcuaauagcuuuuuauauucacuaacaaaugugauaaguaaauuucuaguguugaugagaaaggacuuuuucuuauuauuuaaaacuguuguggaagccaagacauggacuggcguggucaaaggcacggaaggcugaguucaguucucagcaucccuuugggguggcucacaacugccuguaacucuacaaacaugcgaagcagaccucuuuucuggugacugcuuuaguuuagugaaucuuagguugcaguuccugcuacuugcaugugucuggugagauaggacaauuacauaacaucauuuuacuuauaggugggcacaaagagacgauaaaagucuaggagccauucugagccuguccuccaagacucaggacaguuacagauggcagauaaagucucauugguguuugccacaugucacagcacagcucaaaaacucccaacaauaguccacuguggguuguauauuugggggccauaugacuuuuuggauagaguuuuguaggacauccugcucuaggagauacaagaacagagucugggaugcuucagguauuucaagacuucauguuccagcauacuuacauuguuccuaagcugaguuaccaagaccauguggagacuuaucuuucauuguagaggaacuuaugugaucucuguggagaaagaggcucuggguaucaucaucacaccuacuggagacucucaucucccaucugaccuaagagugucaugcuaugcuauuugggcauccagaauagaaacuacuucaacuauugccuuuggggucaccuccaugaugggcauccacgagcguucgugacaaaauagcugacaggaagaaaacuuaagaagguuuauuuuggcuuguagcucuagggaauacaguucaucaugguggacaaggcggggugguaggucacaccacauucaccaucaggaaacaaagggagaugaauuguggucuucagcuugcucuuaccauuuuauucaguaaccccaaccuaucagugguguugcccacauagguuggucguccucuauuaaagcucuacagaaaaugcucauggacacacacagaggugagucuccgcagugacucuaaccuuagccaauauggcaauggacauuuaaucaccucagucaguauauuguaggugcuuuacacuuggggaccaugaaggacauacagacccugcugugcuuugacaggcucucugggucuguauuggcugaaaucuagcugccuugcauccugcucaagggaugagggguuccacagcaccaggcaugguucucaacuaucuagaguucccuagaagggugaggcagagggaccagaagaccugcuuuucaccauggcuucugcgacauggauuugagaccguuuccguuaccuugucucccuuugucauguguguggucgacuuaugcuuuucccaaaguauggugcucaugccuaaaccccaggcuuauuagcaaaagguacucacuuggacacucaccucucuagacagacagacagacaccgugcuucuaagacaaauggcagggaugcguggguguucuugaauguuauguucuuuaagaaggguaacuuugcaaacaaagcuuaauauuugggcuccgaguacgugaaaugacacugccaguggucaggaaaugagccuggaaaaugauaagcaguggacauuagcaagucguuauguaguaccugcagcaccgcgaagagucuguuuguuucucugaaaaacuuaucuccagcucucuguggucagaauccuuucuagccaaucccuguuucuuuucuuguaauggaguacagggugccguacugacuacuuuuaagugcacaaucucauggcaucaaauacauucaugucaucacguaaccaucaccaccauacagcuacagaauuuuccagaaagaaacuucccaacaugaagcaguuagucucuagccuugacccuuucagguucugguagccuccguucuacuucugcuucuagagauuucacuauagaaaacucauaugugcauagauauguauuuauccuuuuuggccuauuucauuuagcauauuaucuuccagacucauccauguuguaacaugcaucuccuugcucaagguugaaucguaucccuguuucuauaauguauuuccuuuauccaccugccaauggacgcuuguguugcuuccaucuuucugccgcuguaaacaacgcugcccuguguguacauaaaucugcucaggcgccugccuucuuuuccuucagguauauaucccgaaggggaauggaugaauuccgaguugugucuuuaauuguuugggaagcugccauacacacugguuuccacaggaacggcggagucaucugaugcaccuaccagcaguguacaaggagucuaguuucuccacuuccucugcaacauuuguuucucacuauugcuuuguuaauagccgcccuaacgggugugcagugugucucauugacugucccuaaugacgaguuguggcaagcaugccucuguguguuuauuggccauuugccauccacacucacuuuuauuauuuaggaagagcucacagccccucccuugacuuagacacuccacaaacucaugcuuagaaagucacaguaugagccaggaaguugugguuuuguucauguuuguuuuaaaaguauuuauuuauuuuacauagauguguguucagccugaauugucugcgccccaugugugcauccagggacaacagggaagaguccuggauccccugggacuggaguuacagacagcuggaagcuaccacaggggugcuggaaaccuaaccaagacccucugcaagagcaguaagugcucucaguagcugagcuggcucuccaagcucaccuugauggacuuaguccaggggaguugaccuucccuucacuuguggcaguguaguuuguacaugaucacaguagucucagucuccagucaacaggacagaaacugccaaacuggaaguuuuuccaguauuggaaauacaacugugagacccagugccuggaauuccuggcacaagaacacuuuccccagauugcuuuauaauuauuucuucaagugucugccucccgacuaacgugacauguggagcgagucaccggucagagucuuccuugucuccaaaagcgcuuggcaugaugccugauagcaaauauuuaucaagaaccaucugggugccaaagaacuacuccagggaccgcagaaacugcaagggaaacacuccugcccucgcugaggugagccgucauuuuccagucuccuuccuacucaaagucugauguucuucacugcauucucugugauuaguaauaugaggggaaaagaaucauucagagagaaaauaugaacugucagaugagaaugaaauuauaagugguaagaggagaauuaaauuaagagcaguaagcaucauggauuuauaaaaacaagucaugucagacaaacuuaauugcuuuuccugauagaauuacuaaauuaggggauggcggggcacaauauccugagagcaguuuccuucagcgaccagguaaugaauauuauuuuuugaaguuagcagagccuuuugaaauagaaucuguuggaauuguacaaaaugaauucaaauuggcuuugaugugaguuugguuggcugacuugacaacagauugaagaggggaaaacguaagcauccacgagcaacaugguuccacggggcuuacagauacugccugauggaaguugagagucuuuauucagagggauugaucaugauuagagucacaggaugguguguguaugggggcaggcacaguuaaaagacaccgagaggggcuggagagauggcucagcgguuaagagcacuaacugcucuucugaaggucccgaguucaaaucccagcaaccauaugguggcucacaaucaucugaaaugagauuggaugcccuccucuggagugccugaagauggcuacaguguacuuacauauaauacauaaauauuaaaaaaaaaaaagacaccgagagaaaaaucguagcaucugagggagaucacugcacggagugcagaaacaaguuguuucuguuauuauugugcuagcaugaccccuacaaugagaagccccaauauugugcauagcucuucagacgauugguauucaaagugcaauuuucagacagaaaggagguuggagaaacacuuagguguuuguugaacaugcaaaaucuuggggcuggaaagauugggucggcugguaaagugguuuccuggcaaguguggggaccugaauuuggcccccagaacccacguagcaaaaguaaagaagccagguuuaguguagugaagaagccacuguaugccagugcuggguuggcagagacaggaggaucccuggggcucacuagucagccaaccucaccagcugggcaagagaccugucucagaagauacaggaggauggcuccuuaaugcugaaugauaugacuggagguugaucucuggccuccacauccacauacauguguacccacaaacacacacacaugcacacaccaacacugaaaugcggaaucucagguccuaccucagugaccugaacugacucugcauuugagcaucaccccccaccccccaccccccaccccccaccccccaucccccaccccccacccccgccccagugauucauguggacucucuaaagcgugagaaacucuacugggguuauuauaccugccucugugacucagucuuuauaccuuccucuuccucugcugaguagguuucgagcugauguaacaacccaggauucagcuccagucucuguaauuccaguguuucccuuugguuguuuuccugucaagcauccuugcugaagcuccuucacuuugccaggugcugcugucuugguuuguaaggagacaugccugaccugugccccccccccccacucgguguucuuguguguggaguauccacauccuguccuuguaccuuugacucgcugugaacugcagcauucucacugcaccguggacacucugacuguuagcacaguuaccuaagacucauauuuuagccaguggcggagcuacauguggcgcuuccucauacaugcauguucaaaaaaacuagguggggauacuucugggcaaagaauuuaguauuaaaauaaucaauuugcucuaggucaccucaaaggggggaaaauggcuuaggauguuugcuggcaagauucucuggaaauuuuuguuggaaacaaaaagucacauuagaggcacacuaaaaacaucacugggaagaggcagcuucucccugcaagcauaggcgauuguuugaaaaaugcccagcagcaagcaaauucaaaacuaauagagcuguuagauuaagaucuggaagucugacacguaugaaaggaacuugcucuucucuguaccugugguccaagaaaucuuucuuccuacuuuuuuguacgugcccaaauacauagaaaauaaagcccaccaccaccuuagccauuuuuaagcauagagcucagugccuuaaguacauuacauaaauagggaacaggaauaaacaagugugaaaaaaaauuaaggagaagcaggccucccuucuccucugcccagcucucacagggcaaccauauucaugaacgcuuccaaccucugugagguuuucuguucuaggcaccuggucaaagcgaaaucacacagcauuuauuccucaaagaccuccuaccuuagcuuucugaauuaggaagccauauaacccacaugcuaauauuaaagugaauuguguuuucaucuacuuugaagagaaguaugauuaauucuuggccuaguugaaucuguagaaucagagacuagcagaaaaagaagaggcauagacagaucaucugcuucaggcuccugacuuucaugccagcucuaucugguuagaugcuagacuagcguccggauagagcaggaauggcggaugaggcguucucuucugaugcugggauccucguggauugugaaauccaagguauuaaacccaacgugggguauugaagcagugugucacccaugguuucuuauauuuauuuccuacaauuguugcagaauauuggaggggaaguacagaaucaacucaagacccccaaauaagucaugaaaauggcagauacccuugcguggccauucgaugccuacauuuggacacuguguaaggacuaagucuuuuuguucuaaugaagauguuucaugaguuuugccucugcauuaaguggaugaugcuacugaagagacaaacccuggaggcauggagcugcuucuuccugaaccuaggaaugcucauccugcuuuaaaagccuucaggugucagaggcauguggauuucgagugccguacaacgccgauugcccauccuccgcacacauucaccuucugcuaauacuuguucaagggucuaagugccuuugaccacagaaagaaguggguaaguuuggugagaauguauguagcccagguucauguaaaaacacaccuaucauggaacacgugugugucuucagaagccagcagacaacuuuuugugguguuuguaacuucagauguuaccaccggaccagccuggccccauuuucuuuggucuucugggaugugcuuccaucugaauaacauuggcaauauuucuuuuuagaagaaugugguagggucguuuucuuuuuuaauuucaaauaacaccacuccuugaacugggaacaaacaauucacuugcaucucagcucugcauuuauuuguaauuuucacauaaaucaacuuauaugaaaauguauucauaauuuga

SEQ ID NO: 2487 - RNA, 4378 nt, Mus musculus
aaacaacucuccaaacacugacaaaggcagcugaggacagcugaggaccagaaggcuacauacagacaccacuggccacuuccccaagcaugcgggcaucaacguaaaugcuuauuuaguacccugguacuaaaggaggguuaagccuccacaguugcuauggcugagaaacaaaccgucaaggaccagggagaaaaggugagggaagaaaagcaaaugggacaaauguuugagggucuggugguuaugggggugggggggggggcaggaagaggcuguucuguccccugugcuuguuuguuaaguccuuugcuggcugggucaucuccacugccauggugaagguaaagguaggauuccuacagaugagcugaagugaggugggugcuauaccaugugauuagaacucugggcacuuuuuaaggagacauaaacaguuucauacuugguuaauuuaggaagcugaucuggggcucuggguaagcuaugaaauaacaggacaaaugaaaacaggaagauggcugcaagaugaaaggaaagaacugccgggugugguggcacaugccuuuuuuuggggggugggggguggcacaugccuuuaaucccagcacucgcgaggcagaggcagguggauuucugaguucgaggccagccuggucuacagaguaaguuccaggacagccaggguuauacggagaaacccugucucgaaaaaccaaaaaaaaaaaaaaaaaaaaaaaaaaaaaaggaaagaacuguagagcaaagagcuugugacaccugucaguaauaaauucaauggccuaucacuuaggcaggaagcaggaggugggacauccuauaggcagaaaggauuuugggagagugucaagcaagggagauuucccugggaaaauaugacggauauagaugcauggugcuuuagcacagauaaccagccacaugauagaaugcagcuuagaauaaguggauuauuuuaagucaugaucuagucaaagaagaaccuagcuauguggucaagauauuuguaaauauaucuugagucugagucuuauuucuggaagcauggggcuaggaggaagaaucagaacaaacuucuacaaacagcccuccugacugcaaguaggagcaacaguggguacccaagagaagguggagaauuccucagccuguuggaagaaacuggugguuuuugaaaauaaaacugggacuucauucucugggcuacuagcuugucaucagcuauuucucuauuuaugacaauauggaucuaacuugcaugagucaugccugcuaugaaaugugucacugggaaaacacacugagugugugauaaguacuugcucucuuucuucccacuaucugugagcaaggguuuccccuuccauaugcuaugaaaagcagccgugucuucacacacaccaaaggcuguaaaggugaacccaaaccacggagaugguagaagaugacuacacgguccagaaccauaugugagugcccauggagcugacuuagaagcaaggaccugugucuauaaguugccugaguuguacaauucacacccugaaaccugugagcuagagugagagucugagccuuuuaauuuguuccacuugagaagccauagaagccaugggggcuggaggugggaagagaggaugcguaggaacuagaaggcaccauggagauguagauaacuuguugccucacuguugcuagugacugaacugguccccaucacugaagcaugauuuuggcaagccuagcauccuccucuguccaugucauauagaaagaguuaucugagcugaaauuuaccucucugcaucuucuacccgguuuuucuucuguuugcagaagauacagcagaaguauagacugaugucauuuaauguccaucacaaccuguaccauauaaauggauaaacaaagaaagacagcagcauuugguccuugcugugguugugcaaugacucuugcggcaucaaugccucggaaaagcagcagugcaggacagcagacaacagguuuccucuucuaugcaaauccacgagagacagucuuugggagggagcugccuuauagauucaugguguccuaacuaagcagcuaguaccagagaaguagcauucacaaaaaugucaccuuugccauuccuuaugggaggucagacuaaacuccuagggccucaguuaaauuugucuuugaauugguuauuaaaacaaauuugugaugagaaccagaaguuaaugucagacagguucguccaauggcugcuugucugacugugagcaagcaccuugggucauagagugccuuuaccugcugcccgucucucugcccaugcgcauggcacuuacuuaucucauucuacuuacucauugucuuucucuuccuaccagagacaucagcugcggaagggcaugauuucugucaucccugaauccagugccuagaaacguggcugacacagaggaaucccaguagauguuugucagaccaacugacuaugcacacagaccuuggaaaagcaccugagggcaagugaguguucaacagcacuaggaugacuggcauuacggugcuuccaagaccuuggcugccugugggaguagcuccgcuacucucagccaaugccccuuuaaggccgcagagucccccagccuccaaagccugcuuauaccauuuucuguucuaucaccuugcacacugccuacauuaagcuuuuuggcaacuaagaacaacccuaugcauauaauuuagucucagaaggaaguguugagacagggaaggaccggauguagacuacauguauguguguagaggcauguagacucugaacucgacaccagugaccuugcuuuugguggugacagaaaguuauuacccacugugucaggaauucugugaaguuaucucuacacucuuggccuugcuuugggugggguuucacuauguguauuauacggcacacgccaagccagccaguguugacuguugcuaccuacaauaagguacugccauacauauacggugcugauuuuguuaugaaagucagaugaauaaacaaacuguaagaugaucacccaguuuuugcccaaccuuacaauagauauaaaauauuggcacaagaguaaaaacuucuuauauaugcauauauauauauauagucuguagugucaauugagauauagaaccuuaggaauugcaaaaucucacacacccgagaaaucacuucuuucugagaugacuugaguucuaauauaacuaguggcugugcuuaucaugaaaugucacaaacugagcacaggagauccuguuaccccacaagaaacagacggacagcaccuauguuugacaucaugcauggcaguucugucaagcccucggcuggagaggagguucaucugaacacacauacacucauguauaugcacacaucagaaugugugacaagcacugaagugcagcauaguguuaaggaaucaaucuuuuccuuggaucagcgagacugacauguuuuggacaagcuaggagaaccuccagcugaacuagcacaguccuucuauuuccaaugacgcuccagcuauguaaauacaucauccaaagucgcgguagucagaaagcaggaaggaacagagcucccauuagcaguucccaccguccacgaagggaccagaacugugauggagcacugacauucauuucacguugaauuaaacacggcacuggcgugcgucucaggagacgauauuaaguuccguguuuggguaauaccaggaauucuacaggcaggggcagaauuauauuugguuggcuagaagccaaccauacuuugcacuuguccuagaaguagguggucaaaaacucaguucuugucaucagacccacuagccacaguugcuuaagugaucaggggaagggggggucucaaacucuucugugguacucauuuugaagauaaaaucgacacagagacaucuggacacgaaggggacuuaauguguacugagagagguucaguuagaacugagcuugggaaaagcagguucaggcagacaucacaacacagggacagagcagcauuggguuucccacacagcaucaucagagacugaagacauacacugucacacacacgaaccauuuuccucuuccagaaaagaaagucuuagaaaucaaggcagggaggagguauguucccggcucucucugcucucuuuaaaacacaugcuguaaauuuucuaggcuucacagugugcguuucaaaagauaccuucacguucgguggagggaagagccggacucuuggugcaucuggcuuuccuguaaugguauauaaugccccugucuaauaaaucuaaccacauuuuucuua

SEQ ID NO: 2488 - RNA, 1557 nt, Mus musculus
agccgcugucagaggcgcguuguaugcugagcagcuguccucgccugcugccgcacguccuggucccgagcugccugccgcugacccgcagacugcugcucuucccaccacaugaagccauuggucuuguucauuuugggcgggcccggugcgggcaaggggacccagugugugugcauugucgagaaauauggcuccacacaccuuucugcaggagagcuucuucgugaugaaaggaagaauccagacucucaguaugaugagcuuauugaaaaguacauuaaagaaggaaagauuguaccaguugagauaaccaucaguuuauuaaggagggaaauggaccaaacaauggcugccaaugcucagaagaauaaauucuugauugauggauuuccgagaaaucaagacaacguucaaggcuggaacaaaaccauggauggaaaagcagauguaucuuuuguucuguuuuuugacuguaauaaugagaucuguauugaacgauguccugaaaggggaaaaaguagugguaagagugacgacaacagagagagcuuggaaaagagaauucagacuuacuuugaaucaccaaaaccaauuauugacuuauaugaagaaauggggaaagucaagaagauagauguuucuaagucuguugaugaaguuuuuggugaaguugugaagauuuuugacaaagaaggcuaacuaacccugaagacaucuuugaaaucaugcuugaauauugcuuugauagcugcuaucauggccccuuuuaaggcaguuuuaaccuuucaaaauuacaucucaauuaaugucuagaaauauauaguaagacaaauuaaauuauguguuuuuuuaaauuuguggucacugugcacagugaauucagguuuaaaucauuuuagguauuauggugcucacaacaugaagaagcauaucagcuaauucuuguuugugguaaagacuacccuuuuuaucccuuuuaugucugugccuucggugagcuaauuuuuuuaguaugcauguauauccuuuuuguaauugcaguguguugggauuugggauuuccacuuccucuugcugcacauuuaaaauuuucaacccgcuaagugaauuuguggaccaaauuuaaaggaauuuuauguguagcuggcucuugcucaagguguuuaguaaacauacucauaaaauggacuccuagcaaugcucuguuuaucagaugacugaccauuuccuguugaaaguuaaaacuuagagucugauuuauuacagcuuguacaacguuguaugauagggcauagucuuugcuuccaagguuugagucagggaacagggcuucagagccugggcaggauugucagcuuucuucugacauagucuguggggcaagggucacaaguagugacuuguauuccugugcucugugacacaggacuagucaucauaaacugauguaacaagaguuccuaccaguagacccuugacacgaauucacuaguuuacgguaauuugauucaguucuuguuuuaauaauaguucaaaguuuuuuuuuuuuuuuug

SEQ ID NO: 2489 - RNA, 19227 nt, Mus musculus
cuuccuguguuuguguuugcauccggguucucaggcuuccucaguccucaccggcuggagucgcuggcggguugcuggguguguuagcuccggcucuucggucguuggaugaggcuguagguccgccggugaguuuaggggggacacagcuccgaagcggggcuuggacgcggcucguugucgcagauucccggacccggagugaagucuagcagggcuugggcgccccugccugacgccccugagcccggggugugcaaucggccuuagccgagccacgggagguuuccagcgccgguccgcccccuguccucacucugccgcgggcugcuuaggguagagcaguccuggcccagcgcaggcagaucuggggaggggguugcagaagcucagcacugcagcucagcacaccccgugcguggauuguugggcugcccaaagcugugaaaguuccgcaguguagaaguuaccuccccauagagaguucagggacuuggguucagccaguuucccuggggugcccugcccaaaugaaucggcaccugcaguaagcacuuaaagacaaauuggcguuuguuuguuuaaaugcuaccuggccacgaugccgaaucagaaagcauccacaguugagguuucugaugacuguaaaacaaggaaaaggagcguauucgacaucugaauaaaaauaauuuauacugagugagggggguucacugagaaauuuuggaggugaacucccuuaagagcacucccuucagaguaaaaaccaaacaauuugccugaccuuugguugcuuccuugcaguguuucucauuuuagcucaagugcaugaauacacugugauaccuaacugguucucugacuccuuuuaagaucuacuggagccaaggagaggggcccagagucuuuuacaaguuauuauuagugauuccauauggauaaaacauuugaaauguguuuuaaguccaguucccuccaaaacguaauagcuuuguaacuucugcaguauuugaguugcaguuucuaccucgaaagugggggauaaccagaaauucagaaaguauuaaguuaaucgaauacucuaaagcaacagggucaacucauuaaaugugugccuguggagccucguuuaguguuuaacacggagugagcccuggcacgugugaaaaacuuagauauaccggagcgcugugaaguucuuuuucugguccuuacuguuuuuugguuuuuuuuuuuuuuuuuuuuuuuguuuguuuguuuuuucuucugguuguuuguugaauaaucauauuagaaguacauaucugugagagccagccguuguuuaggaguuuuggauauaacucugaaguuauuuuugauguuagauuauuaauagacauaaaugaagacagcguuccuuugugaggcugaguuuuaaaaacuccaugacuucuuuccuauaaacgcugcucaucucuuauuauugucccagaauucuagauuauagugaucauacuuuuuuuguuguuuuagaauucuaaguccuguucuuaagaauaucauuuaguuuccauguauugguuauuagacguucuguuccuguuggcuuacacaguuugauuuaguauucuguguaaagugccuuuacugaacaggaaugcugaagccaccaugucauugaauggucaguguuggugagugacauauuuaaacgugaaaauagaaauuuaaaacugagacuugugcuucuugcauauaggauauauaaguuucuuaguaauauuuuuuuaaguaaaagaguaagcacuucgguccuaaauuugcauuuuugugaagaauuucucuuccaagagaccagcacuuucagucaaguaugaucuuauaaaauccuuucccugcauuuuguguguguguguuugcuugugcgugcuuaugagcaugcacauucgauaucucaaugguauauaaagaaugaugcugaaaauuauuucuggugggauuuaaacauguuucacagaacagaaauuugaucauuaugguauucuuagcagaaauucuggauuuugguaaguaauuuaaaggcacuaaagcuuucuaguacugaacuuguaguuaagaaaugauagguuuuuguuguuguuuugguuuuguucagggauggcugcuuugauaagagaauauaauauacuuguauauaguguagugugauggcuucauuuggauuugaauucuguugugucacugaugugaccacagacaagucaugugaguccauguucucuucacaagauuguuauggauuaauauauacaucuaaaugaccuaacucaaaaugccagaagcucagugcguuuuugacaaaaaagagugcuauuccuacuguucccgguaguaauuguauuguacuguuucagguaugcauuguauuuuauguguguaugcccuccuuaaguauugcucuuuuuuaaaaucaacauaucauauacugugugucugaacaaugucuaaaguacucuaugaauuuccacagguuucaaccucuuggaccgagagcugugcaucacccauaaugaggcuuguaauucuugauaacuaugacuuggccagcgaaugggcagccaaguacaucugcaaucguaucauaaaauucaaacccggacaggacagguacuuuucccugggcuuaccaacagguauaaaccauacuuuuuauuuuuauauacucacauuauguacaguuguggaagaaauagggucuuucuucguaaacuacuucuaauuucugaacauauuaguauauaaagccagaaguauuugcagucugcugcacuaucuacauauggauucuauuuguuaaaauucuauuuuaccuucuacuccaaaaauugcagucucaagaaggauccugcuuuaaaugaugacagugauauuucugcauccuuuucuaguacucuugaguuucuaggacaccgccuucaucaguccugauuucuuacagcucguuuaugacuaacaggugaugacucaguuucgcauugcuacuuuuuugacuccauguuaccuuuauuaugagcucuucucuucuuaggcuuuuaauuuuuauccuucugugauagaaguauuucaagugagaauuguaaaagcccuuguugcuuuaucacagaaauaaacccccauaccaacuacaugugucggcuuuacuucucagcguugccuuuuuaaaacgaucacuugaccacgggguacuuuuauauggauagguuuggagacacugagacucagaacugaguguuaauggcugcaguguauucauucuacauaccuugagcuuuggauuccuuccaugcacagaagauaacauagucauaaugauuauagcuuaaauacuguuuugaagcucagcuaacacaguguguuugcaguguguguguguggaucuuuugaauguagugaaugcuauguaacuucaagcucccaugaguguuuuauuuaaauagacgauuuccuccugauccuccccacggacauucuaaauauguaagaccuguugccaugauucauuuuacuaaggcgauuuuuuaggaauuauguuuaucugcaacagaauuugguugucuguuucguucccucacuuuuuugccuaggacagaagguccuggggagaaggacaaagggauaucgcuguuaccuaggcguacucacagagcacguucaccucagcacccucauguaggccuggauggcucagcaagccucugccucuguuugcacacaauggcuuauucucaggcugccuaugugaaucaggcugucucaguuuugacacagaaauaauagaguaguugaggggagagagacuucaaaguacugccuguuagcagcgagugcuaaaugcuuaccuuauguauuuacauuuacaaguguugaccugccaaggaccugagaaacccuugcuggcauuuuauuccauucucuuuguugauuguuucuuccacuuucgaaacuggaacaugcaguuugagguuaaaaacaacguucuguacguacauuagucauucucccgccaagcgugauuucugggucaugcguguaguuuuaagugauguuuuuuuuuaccugcauauugugaccugggaaccuuacuuucaacacucccuugcccugaauugggcugcuugcgguucagaggcuaugccugaacucuccggcuugcuuuuguuuuaccgagucacugcccuguuauaucuguguauguuuuuuucuuaacuaacagaccugauuuugcaucccuggcuucauugccauuuggcauuuagcaaauucauucaucuuuuucaaccugguucuuauauuuccaauaagaaauaaaccugccaguuuuccaggauuugagauuuauauaaggggauguguggaaacaccuucauagcauauagcuacgugcugggcacauagauguuaucugugagccuuuuuucuccaucuuuugccuguuuuacaaaucacuuuaugguugucaggguuucagcccuucaugacuucaaugaaaugaugucuuaaaucauucuuuuggcaauaaaauuguagucuuuuugcuucauugccauacccuagaauucucuaagguuuucuaccauuguggccacuuuacaguggaagaaaaugcagauggacuuaaauugagugccuccuggcuuucuaacagaggaagaguccugugcuucuagaaauagaaagagagaaacauuuuacccacauauuuauccauaacuuauaaguaacuuguaagcuaacauaugcuuugcuuugaaauccauuaaucaucucucuucugcaccuaugagguauuuauuauucauagccauuuguuauguugucuacuuaacugaggggagacagucuaccacuucugaaacccuacucucccuguguuguuucggccagagacuguuuuuuaaucuaguagauggcuaaguacugccucagucuaaguacuacuccagaaaaauauuuuugugguguuuuuguuucgugauaaugaguugaucagaaauccauuccauccagguggaaaaggucaggucacaugcuaguaaaguugccguuuuucuugugguuauaaugaaaacuacaaaacaaauuuaauaaacgaaagggggaggggacccauaagcugauaaacuucucuuuuguaucauauauaucauggagaaauaaaaacaaaacacuguuugcuaaauugaucaaauaauguuauaaaacauauaaaauaaaauaaugacugcauaaagcggagcauguuuccucugaggaccuccuagcaguccuuucgguuuuaaagguguaacacuuuucuuccucaccuaagccuuugaagggaaacacguggaaggucagugagaaacaaaaaccagaagccugagcuacagagagucccuccuguguuaccuuguaucacucgcgaugcaacucgauuucucucaucaaguguuuaaagauuugaguuuuauaguuugcaaaagcaauucaaaauacugagaacagugcggaauaccuuuccaccuuccauuuauguggauaggcuuccagcuuuacuaacaaaucgugguuuaaugaaaucucuaggcaucguggaaagaagcugccucaaucugucaugaacauugucugcauuuaaguugcuugccuguuuuguaauguagaauguuacacauaaaaauuuaauuauaaguauauuuaaguagauuuucaaguaauuugaaaaauuggugacuuuaucuuuuuuagggaguacaccuuuaggauguuauaaaaagcuaaucgaauaccacaagaguggaaaccuuucauuuaaauaugugaagacuuuuaacauggaugaauaugucgguaaguuauauuuuaauguauauauauauuacauguugaauaucauguauggcuagaauuugagacccuugcguacuggucuguggugaaauugauuccagcacaguguaacgggauauacaacuuggagauaugcauucauucugccucuuaccuaugaugugacuuugcacaucccuccauucacaagucaaugauagccguucucucucccccuccuuuuuucucuuuuucuuucucccuguccuccucuauugcugcuuugcuccuuuccaugagggauaauuaaaauuauaaagaauuaagugauacauauguacagguaguucauauagccucuuuuuuuuucugccaaauuaaguguuauuuguguuaccacccacaaaacuugugaauucuguuaaacuugcuuaacugaacggaucuaugauuuuuagaaauucuuuacuaaagcauaaauagcagaauaauuuuucaaugucuauauaaguuacagccaaauaacugggugcauacaagacuaauguguccugcaguuaauucuuuaaaaaauauauauauacacuauggguguggcuuccacccaugaaguuucacccccgccugccuaaacauggcuuuaacaaaguugucauggauauacaugcuaaugugggaagugaaaucucaagagccucaauguggcacacagaacuacaggaacuaaggaaugccacaccaguugguuauucaauaccagauggccagcccucaagccagauauauacaaguaacauuauauauggacaaaauaugcugugguugguuguauauuuaugaauauauaaauguguauacacauacacacacacauauguaacaacaauaaaaaacaugaggucaagaauuuaaaagagugaggcaggaagcaagguacacggaaggcccuggagggaggaaaaggaaaugauguaacuguauuguaacgucaaaaaaaaaaauaaaagcuauucaaagggugacaauuuuuuuuuuugcucauguuuuagaaguauauaguaacuaagugagugaacuagacuugcaguaugugcacugcaaaccugcaucagcuguaugauuugggggagguucuggcuucauguccucaucuauaaaaugagaaugaugauagcauuuucaucugcauuuacaaauucauuguugguguagaaauaugagguggcacauguauauaugaagcauguauuaagccaaacauuuuuaaauuuaauguacuauaaagcuuuauuggaaaaguuguauuuuuauuauuaauuuccuauuuaggacuuccaagaaaccacccugaaaguuaccauucuuauauguggaauaacuucuuuaagcauaucgauauagauccgaacaaugcucacauccucgaugggaacgcugcagaucugcaggcagagugugaugcauuugaggagaaaaucaaagaagcuggaggaauagaccuuuuuguuggagguauguaagaagucauuggcaucaaucauuugucugcuaauauuugaagaguguuuuuaaaaaaaaaagaacaaaagugucauaacgcaaaggacaccuguuagugacuguuaauaucuaacuacagaaauagaaggauuccaauuuuauuuuauuuucauuuaaaaaaguacagauaagguagagcugaaguuaagauugccacaguuaacacauugcucacauuaggccuugagaaguagcccccaucccuauucugauuaccucuuaagguuggcgguuuaccacguccugcccauccucuuucaggucaucguccugcguguuuugguuauuuugcuguagcacaggcugcuuaacagagcugaauaugugugagaaauggguggauuuuuaucagauuacuccaguuaugcuaagaucauucaaaucaguuaugagugacaugagacuuguuuuuuguguguaugucaccagauuuuagaccaguucauuucugugagugccuuaauaaauuccaaagagaaugaaugguugguuaaccaaauuucacuuauaaauuaaaaugauauauuuaugucuauguauguggguuuauaaauguagcaguaugaaacaucaugagaagguuguugccaucagaaaaguauaaaucaaguacauuaaagcccaaaccauuuucucugucuuuaguauuuaagaaacacaccuguggucuaaacuaccuagguagacucuguaucugauucaugaggcaguuucccagaacugucugcucuaggguuguacugagguggauucaugguugaaguggcugaggacgauugaggugcuuggaugcugauggguuuuacaguaagucucauguuugcaucuuccgucucuguggaugccuguucagguuauugaagguccccauguaacuaaaucauguguaagucaggauuucucaacagugaaaaugcaguguuuuauaacaugcuuaaaaugccuuagaauguugccuggcauacagcugacucauggucacuugguguugucucccaugagccaucgagacuaaugucauugucugugaauuuccugugguucuuaucuaauuauuuuuuuuuauuuuuauaaaugaccaagugugacuguacucuuuucugaagaaaguuuuauuuauguguagagagccaguacugaucauuuucuugcauagauagaauuguuauuugucugagcaaaaauuuuuguuuacuauuucuauuuuaaauagaaugucaugcauuuuaaauaaaucuugcuacuaucacuuuaguaauucuguagagcacuuucauaaccaagcuuuguaaauaggguuccauggcgaaacaacuaccauuuuaccugccaguauuaaggcucaaauagcagaugcuuggaaauaccuauagacagacuuuuguaauuuccauaucgaaauaaaauuaaugaacuauuaaugaacuauacuguucguaaacaguuuaucuuaguuuuauuuuuccaagaaaugauuuaaaaaaauuuacuguuauagugaaaacacacacuguuauguuagagauuaaugauuaaaaugguuguuugaaaaauguuuucauuuguagacauuuauguuuccuguuaaucuucugacuuuacagaaggguccaugcagcaaaucccucguagauucagugcacacaaaauuaacuuaguggcaagagaauggcugacaagacgcucauguucuugucuagaaagcauucagacucuaguagauuuucugagacugcaacucucggucuuucuguagaaacucaucauuuucuauugcuuuaagucaugucucuuuuuuuuuccacuuaugcuuuuggucugaguccucaaagagcaugucucccuuccaaguaacuggagugcaaguuaaacauccgcuucucacugacucuuacuggugcuguuuucuaaccaccuuuaucuuaagcuuccuauaguuauuucuuuacuacccccaaacagaaaacauucuuaagaaaauucuuauauauuagauauuuucuuuauuuacauuucagauguuauccucuuuccuaguuuccccucugaaaaucccuauccccuccccccuuccccugcucaccaccccucccacucccauuccuggcccuggcauuccacugcacuggggcauagaaccgucacaggaccaagggccucuccucccauugaugacaaacuaggccauccucugcuacacaugcagcuggagccacaaguuucaccauguguuuucuuugauuggugguuccaaggagcucuggggguacugguuaguucauauugauguuccuccuauggggcuucagaccccuucagcuccuucuguacuuucucuagcuccuucauugggggaccuuguguucccucuuucauuagcauuuucauuggaggcugaugauccagggccugacauuuuauuuguaccauguagaaagugugauuucugugcauggagaggggcguuagcuuaugcucugccuuccucucuggguaauggugguuggacaaguacuuguuuaugaaagaaucuccuuugccucugcauuucgggauguagguuauugucuuuggaauuuuuaagaugaggcuugguaucuggaucuuaccacuuacccuucuuuuguuccaggguuugguuaauaaaaacacuaagaacugugccaaaugggaucaaaauaucagcuuuaugaaagguaaaguugggcuagagacuguaggucgggcuugaagccaguauugguuuucuccccacugugaaucggccuaggacuagaagagucuaagaacguaaauucacugcuguucacccagggaauuagaacguggguuccuuucccucgggagaaaagagaaaaggggaaacaauacucggagagcuuucauucuuccucggauggcagaaauguuaagaaagguaagguccauccuagguaucucaggaggacccagcgcuaagguguagauaaagaaacuuaaguguaauuacuuaaauuuugauauauaaaauuuaaagaagacugggggaaacuuucauacuuguuuaauuguugcagaagccuuuggcaauagcuggguaacuagaaggggacucaugguguguucauugaaaugauucugguaucguucaccaauucuagagaagggaucaagcacugauuguuuggaaagacccagagagccucagcucucagaagcaacggccccuuagccagcagcugucguguaguuccauguuuguguuuccuuuguuucugugcaucagguaaagaucagcucuagagagauuucccuugcuucagcuuggaguccuuuucucuugccacucccacccaguaugauagggacauaaggaauuaccuuugagauccucacucccugacccccgcuaccuauagugaggaguggagcagaagcuguguagcggggagaaacugcagagccaaccaacgagaaguaucaugcauuaauucauucagcucucccuuauugagugucucuuggguguaauguuuucuacugagcaguaaugagacgcacaaagccuuacucaaaggaaguuuacaaaccacccacagaacucuaggaacgaagggaagaugucuaacauaaucccaccagugaguuccugagaggaugcugagacccuaauguaaaugugaaggacgcagagcuaguggaacauaaagcaugaucaggaaugacagucugucaguuguggcagaaagcagcugucguggugcucuucuaauaguacacuugaccgaaucucaggucauccguaugcucucuguggccuaggucaccacuaaacacaucaauaauaggggaccucugauuaguuuucugaagguuuuauguuucuagcucuaaccuuucuucugugugcauauaaagacaguauacaaauacugcauuuguauacccaagaguaaagcaguauauugaaaaaaugcauucaaguguaauuaaaacauauuagaaacuaagucuguacuuaggaauggaaauaauacuugaauauuaaccauauguaaguccuuauuaaaaauguacauccccacauuaaucacugauagguuguuauguuuuagaacauuugcuucauacuguguuuuucuuaauccuucgaaacuagauuguagcuugcuauauuuuauuauggcuugagaaacuuaccuauacaacaaguaucagugaaauauaccuguugucuccuuaauguaaacauguggaguauacauguaagagauuuuaauuagagaauugguggguuuaguuuuuaauggaaguugcucuaagucugguaacuaggauacauuuuaaaagguucuugauuuuaugaagggaauuaccuuuaauugucuucaaauaagaaauaccauguucuuuuugauauuuuagaagccaucauagaauauagcagguguguauaggucacuguaguuguuaccuguaugucaugaaaucagucuagccauuaauagccagcauucccuucuugcaggacuaaggaaaugaaguguaacagaaaagaccaugcauguauuccaguaaagccaaguguaauuuuaugcauuuuguuuguuugguuguauuuuacguguguguguguguguguguguguguguguguguguauucaauuguagagaaaaaucagaaagcuugaaaugcaccuauugucuuaugcaaauucaugaggaaacuaaacuaaaagggaaccguaguuaauuaccugcccuaaacggaaggaaagcaaagcacagugaggauauacagacccaggcgcaggcaguagucagacggcuaagacuugaauguaucucuuuguuuacuaaacugcagcccugaauaucagcaacaguugaggcguucacuuccguuccuuuuuguguucccaaaaaguagccacaaaauuaccagauacuauauguuguguaaaugcuuucuaagccuguagugcuauauaaaugugaugcuucccugcuaucacuaggacuacauacaugucaucccaugcuguguauucagcacauaugaaaauacuaaaugaaaugcagacacaaacauuguaauccaauaguaugaauucaguucuaaaauaagguaaguaugcuugugguuauuucuuugccuuuuauaacuauguugaaauuugagaaaauauaguauauguuugaaaccuuguuuauuucauguuuauaugagugugcauaucuguuuuuugaaaggaauagguccagauggccauauugcuuucaaugaaccaggauccaguuuaguaucaagaacgagauuaaagacgcuagcaauggacaccauuuuggcaaaugcuaaauauuuugauggagauuuaucaaaagugccaaccauggcucugacuguugguguggggacagugauggaugcuagggagguaagaaauggcuuuuugauuauuuuucuuugagguugaauaauuauggugcuuaauauuuuagagucaucuuguuuucaauaaaaaugcuuaauuuccagucacuaacuuuugccauucucauuguuaagaaucaaguaaauguaaguguucaguuauaacccaggcaccaggagccuuccauucaggggcuccuucaucugccuauucaugcuuugcaguuugagcuccuacagucuuacagucuuagauaagauuuuacugcugugaacagacaccaugaccaaggcaacucuuaaaaagaacaauuagggcuggcuuacugguucugagguucaguucauuaucaucauggcaggaagcauggcagcauccaggcggucauggugcuggaggaacugagaguucuauaucuuguuuagaagacaaacagaagacugguucucgcauggcuaggaggagggucucaaagcccaucaacacagugacacauuuacuccaacaaggccacagcuccugauaaugccauucccugggccaagcauauacaaaccaccacaguaaccuugugguucaguugucauuugaauagucuuaggaaagggcaggugggaaagggguauagagauaaugcucuaccuacauaguuuuggagcucaugggauggauuaaccuaaagugcuuuugacuacaauuaggaggacuggcuaucuugguuuccccauaguuuaaucccugaggcccacauuuuggaaggagaguucgaauggcuacacacacacacacacacacacacacacacacacacacacacaaacacaaacacaaacacacacauaaauaaauaaaaggccauuuaguacuuuuuaaaagaagcauuugauucggcugccuucuaaggaguuccuaugagauuuuggcaugcuaaugaccuaagggacuuccauuccuacagcagagcuccaaguaaaaugaccugagucggccagaagugugcaucuuuguacaugugcuacacaccuacacauugcauuuugguuauuucuguaacaaauauuucauucuuauguaacacuguggguaauaauguucaacaaggagaauuaauuuagaaaucauuauuuuuuuugcuugccuuauaucaaauaaauuaauuuuugcuuucagagggcaaauggcuuuaaggcgauucguugacuauuaguuaaggcucaguuucccaaugaaaauuaauuuuuuuccaaucaggaaggucuuucccaggcaugugcuuuauacauuaauaauaccucugguccucacuuacauguucuagagcuuccuacuguuaacaaguggugcucucgauucugcaggugaugauccucauaacaggugcgcacaaggccuucgcgcuguacaaagccauggaagaaggagucaaucacauguggacgguguccgcuuuccagcaacauccacgcacuauuuuuguaugugaugaagaugccacucuagaauuaagaguuaaaacugugaaauacuuuaaaggugagcauugaauuuuaauaugcguauuagguacuucuaguggaugauaaaccuuuauaacuguggacuuuaaucucucaguggggccugcugaaaacuggcauuaugcuaacaaaauaauuuucaaggacuacagcaucucagauaaaacuuuucaggguuuucaugacauuuuucuuugaaaucucaugauguauuuuaguuucauaucgaauauacaagaucaaauaacucaguaauguccuuucugggucuuuggguuguuuuguuuuguuuuguuuuucuuuucuuuugguaacauuugggaguucugccucauccguccaugucuuacccacgauuccaucuaagcucccugaugucagacacauccauuucagugugcuaaaguuaauguuacagucggcacacuuuaacacaguauaaaauaaccagcaaaucacuuuggucgcuuuagauguccguguguugauuucccuuuuccuuuuuccuguaguauuuacgaaguagcaaugaaaauaauuuuauguuugaagguuaccacagcaugaagaacuauauuaaagagucgcagcauuaggaagguugagaaccacuggucuagaugaucuucuacaaaaacuacauggcaaucccuggcuugagaguucuuuaccuuggauguccagucuguugggccucgugauagcugaggugcugcugugccugagcugugagagcucagccuucucauuuucaguugcuccacacaaugggaugcuucuuccuucccugauuugaggaugccccaggguuucucuuaggggagcacuuccuagagcucuuugcuuguucccuggauaugaucuucuuuucuagguggaaaaugcuuucugaggccuucuuaacagggaauccgcauuucucacaccuuucucccaaguccaguggccaauuuucugaagaaacuaaaucccuucccuauagcuuuuaugaguuuuuaauggccuggaaaauuuaacugauuucuuugcuucccaaacuauaaaauuuuacuuagcucauugauucugucaaagccaaucuuguaagaucuuaauuuuuuuuuuucauuuuaaaagauacguacuacuuaagacguguaucuggaaaagaggcuuuaccaugugacuuacaagcauacauacccauuagaaaacuuccccucuaaagcaugcguauucauuauaaaaugguuauuaaagucuacuuaaauuuaaagucuaaguuuccacaccaaauuauuuaaaacauaugccuguguuguuuugguaaacauucuguggguaagcuuguaaccaacccgguuuguagcuacacauuccaaagucaguagagaggcugggacauggcucaguugaaagccugcuuuaggaucaugaggaaccaaguacagaucacccaguaucuacauuaacaggcagagcaugguggugcgugccaucuaaccuagggcugggagucagacacagcgaucuccagagcaugcuaaccagccagaguuacucccaguuaaugucuguaaucagugagaaaucucuaacaaugagguguaggugguaaagggggacccuugacacugggacucauacacauggaugcaaccaaguuaccacaugcauuucacccaaaagauggcauaggguaguauuuuggaaggcaucuaucuuaucaugacagucugggucccuuauugucaccaacuagagccacugccauaaaaucaaaaccuccauuucuagacaaauguauugaccagccauauucaacuuugccagccugccucuccagggcucugcaaggcaagcacucaggcugcacugggacucccagaguaucuacucaguccacgucuacucugauaauguauacauuguaguucuuaguuucuguagaccuuauaaucaucuaagaaugaaauagucugucuuauaaaucuguucuuauguaaacggucaaaauuaacaaaauuacaacuagaauuaugcuuuuuucuuccuuuuaagguuuaaugcaugugcacaauaaacuuguggacccacucuacaguaugaaagaagggaacugaaggagacccaguugugcuccgaagaaccuuuccauacugauaaaauuucagcuuaugcaauaugauaacaauaugucucgaaaaacaaaaacaaaaaaaaaugacaacauggagaaauaggaagauucauuuauaaagaaaaagaccacgguguguuaaacauuccauauuuagaauaugucuguuuuacacuagguucuagaaguaauuggaucccaaaguucuuuggcuauuauaaaguauagacacuauauagcuaccuauaaacaguauagcagugaaaugugugcauuuuaagagaucugcacucuugggucuugucaguggcauaaucucugacuuguuugaagacacuccaagccuuuccaaugucauccugcucucauuacaaaccuucacuuuuggaauggauauuuuuugugcaucauacacaugcuuuuugccuguaguugccuuagucaucuuucugcaguagcaucuggacaucacaaguccugcuauucauuaaucaaggaaaucugaagagaugacagugcccuaaaguaguuuacauccuuucagaaaguauguguaagugcaugcuucuaugcaccuucuuauguaguacuuuuuuacagauaugcuuauuuuuauuuaaugaccggguuaaugcccuucauaaguauauuggcaauuaugagcuuuauaccuagcuacaaauuaaauaaaauccuuuugaaaaacauuuucugauuauuguuaaauuuuguaaaucauccuuauauaugucuaaagagauauuaaguauguacuaaauuacuguaaacauuuaaauugcaauaacuugcauaauuaaguugcaaauaaaaauauuguuuucuaucuuuaacacaaauaaaguuuacaauaaaauaauuaucucauuuucuuucuaaaagugaaaucacacucaugugggagacuguuaaugguacccaugacacuacauuugcuucuaauuuguugccaucguguagcuaggaaacugaaggcaauacauaagaaggaaaagaauggaggcuagagagacggcuuagcaauagaggguacuugccacucacacagaggaccugaguucaguccccagcacucgcaggguggcacacaaguccacuguaguucaaguuucaaggguucuuccaaugcccucuuggggucccugagggcaccaggcauacaaauacuucacacaaguaauacagacuacauacacgcagucaaaacaauaaugucaccaacaauggugcuuuaauucccaguuaugucuuaauagcuguuauucaugaaacuaagccaaauauacauacauaaauauauaaugcauaaauauuaaaaugcauaugcauauauauauauauauauauauauuagggagauaucaaacaaccauguaaguauaaaggugcuauacaaauuacuggaagcugagaagccccacaugauaggguuucacauccccgagcacauaaauauauauucuggaaccucuuuggauucauagcacuaugaucugucuucugaccuucaaauucacauuuccaauagccugcugaagaacaccacauaggaauacuauggacuauucuaaaauuaagcugagcucuaaaucucucuuaggcuauucugccucccuacuuaguauuaaaacugguacaucauucauucagauggguacaaaguagaaguuagccuuacugguguucuuccucucuuucguccuauaauagaaauauagucacacuacaucauuacauuuugcuuagacaaauaccuggcagaaucauaauuugcucaagggguccuuaugcucuuaacauauuuuaguuaacaagucaacuaguagcauccaugcugcaguaaugauuuuaacacuaucacguuuacucaagauuaccccaucuuuggcuguuuagcaucauaaugaagaguuuacagucucuucugauguaccauucauucccucugcuccaaaggucuuaaaaaaagaucuuuuuuucauucuaucccuaaugcugucucacagugucucuccucagcacuucccuaaucacuauagcauccuaacuuacugugauauacuauuaagacgcuuagaaaccauugaagauaugucagauguagcaaugaucuuugucuuugaagcaaaaccaacauuauuuagcuucugucaccaggggauauaaguggcagcaucuuacccucugcuguuacagagacugaaaaaaguguauuuaacucagcauacuggcaacccauaccaaauuuauuaaguggcaauuauuuuuuugucauacgacuauacaaauugugauucuagaacccgaaggaauaagcucaaguuauauaacucaaaauucagccuagcaaauguuuucuccuguuacuacaacguuaauuccuaaagaauuauggguuaaagaauagcccauaucuaaaguagcucaagcacuacacgguagagauuacaccaguuuuuuaacuuucccuuaccaauaauauaagaacaacauuuuaaaaauugcauugucuuaguuucaaauauauugccauuuuaaaaagauacugcagugggaacuuauuuuauaccuagcaaaucaagcugggagaagugagaugguuuauguaauaggacaaacuaaggcuaccuaacuuauaaauccucacuuuaaaaucccaccaaaaugcuaagacucaucuguaaccuuuuuuccuaccagauuuaugucaugcucaagacagacggcagaaaauaaaauccaguauca

SEQ ID NO: 2490 - RNA, 11617 nt, Mus musculus
cuaagguucaggccugucacgugacagguaucucuacuucucggggauggagccggaagaggggacgccgcuuuggcggcuacagaagcugccuccggagcagggcgccggggugagggguuugugaagggcacgggaaggccgggguccggacuauucuucuugggccccuggagacacaauggcggccuaaggacuuuacgcgguuuaggaauggcccaggccugggugcguguggggucuucuugcuucuagaaagcucgggugguagagcccgagaucugcugcguccgcagucuuugaguucaggucucccgaacgccccuuucugugugagguccggcggaugcagugaggagucgaacccggugggaccuguucccuggagggcgggaggaaccaacuccuaaccagaaaaggaguagccacucaaguuuggccaagaggugaucgcagccgcugaaaacagcucacccauaaagccaggcuuguggagaccagagacagccaaccaggguuucuugcagcacacccaggguccagaccucugugaaagugauuugaugguggcacucugcccugcucaggcuuucagaagucuccacuguggcccuucuacccaaagucggcuucaguuguagaugaaagaaauuuaacgccacucccuccguucuuuagaaaauguacuuuaaacauuuucuuugauuuuacaaaugaggacagugaaauaugucagccacagguuuccagcaagccagggccaaagcucaaaccuaucuauggacugugucuccuaacuuucagggugucuuuccuccuauauagagauggccaaaacauuugacuccugaaucugagagcugagccagcugucuucuuccugggccucugccuuuugccacagcuaugggaaaucccugguuugggucuccacucccuuuucacagcauugguuguuguggugucaccauccuucuuuaccaggccacucuauuuaagaaacucuggguuucauccuuggaccuccccuuuucaaccuccuuuaccuguuuauggucucugccucuauagucucacacuuacuccugcucacaauaucuuggcaaaguuuuggaaaaauaauguaauuacuuacaggaaaguugagugcagauuaaagccuucacuccuuucuguuguaugcaaggccuucugugauuuggccccuacucgccuuuucaaagguccucugcccuuucacccuugucugccuuuccaaagaugcaauucccacuccugcgcugggguuuuauuuccaguccugugugcgggcacauugcguuggcugggaaugccuaauggccacucaucuuuucaauucagcucuuuccuuguuccuuugcacccgucauaaacaccuuuucuauccccucuccucuaccacacgcacuuauuuauauguguacuuuuuuugauagauuggaacucuguuaugguagagcaucauuuauccucaauguccucauuuguaaaaugagaacaguuacaaugcuuaccuuauagaguugcagggagugucaggauacuguuugguagacauuacagguggcuuuugguuguauucccauuuuauauggugagucagaaguuacccaucugugugguguuuuggggguuacuguuccccacggaguggguucauaucuaaggcgauuggagucuaaagacguuuagcucaacgccauuucccaguuacuuggauuuaagugguuggcaggauacaagugucgccuggaacaguaucacaugaaugugauuaucugcaguaggacacggaaggcuugagcuauggaaguagugauaacagcaguaagaacaaaggcagacucacggccuucugaugucuugugccugcuaagaugcucgaguuacugugcucauauguaauucuaugacauuguguggucaggugacauucuucucuuacgcuuggaucgcagagaauguaacuaaaaugaggaguugguggaacuaggaagcauagcaagcaguuuuguccuaaauccagucuucauacucuguuagguucacaugguuucaguugcugguagugcagagcggaagucaggugggaaaggaaagauggccagugcuuuucucagagcaaagcacaacaccccugcugaggaauaggagaguaugcuguugggggccgggggaggcaaagccaaaccgagguaguagugcuccugggggggggggcuuaucugugagaggagcgcgugcuugguuacuacagagauggcaccuucagaucucggagggaagcuucuacgugaacuguucuccauucagggauuuuggaaaacaacaguguaccuuaacauuauuuuauuuucuaaagguagacuucauaauggaaggucugggauuuagcaggguuugguagcucauaccuggaacacccaaacuugagagacugagacaggaggauugccacaaguuugaggccagccuggucuacagaggugagacccugucuccaaaacuaaacaaagcaauaagacaacaaacagaacgacaaagaaaaccaccaacaauaaaucuucaaaauaguugccuuucugucguagcugguuuuauaaaaggcacgucugucaaugucauuuucuuuaaaguacuuugauuuccuuuuuucucccuagcuucuucacaaaaucauugauggcuucuguggccgagcuuauccugcccaccaggauuaucacagugucuggaauucagcugaguggaagcauguucucgaagauguuaccacguuuuucaaagcggucguuggcaaaaacuucucugaggaagagguaguuucaguccugaccucuuuaccugauaauaaguaucauccagagguucuaaugauguucauaggguucuacccauguguucaguagcugaucacaugcuacagcagccgaaggucuaaucgugagugaguggaagaccacauuggauuuucugggacauggcaguuuugucuuaguuguuuuguuuuuuuuuuuuuuuuuuuuuuuuucucccacuguaacacuuugaaagcauagcggugaaugcaggaugcugaagaaagccugaguguucugguuguagugauuagacucuagcuuacauuggaucucauggaaaguggcuuuuaccacuuugccaagaacuauuugcacauauuuaugaguugauuacuuuaguagaugguguuuuauguaucugucguguugauuuagaugauaacucuagauuugcauuucuuugaauauauacauuuaaucugucaugucccuugcuuuuucauucucuuaauaggacuuuuggggaacagaaguucugagguuaaugcaguccaguuugccagucuuucuuuuggcggguagugcugucucugucguauuuaagaaauaugaagguaucuaucuuuguguguuucccuguagaggcuugauuguuuuagcuucuguaaucuacucucagauauguuuggaauuaguauuuugcgugagacaggggccgucucaguuuccucugcacaguuucccacugacucacugccaucuauuggacauauauuggcuguccuugcucacaggcugccgugcagcguugguaauaaaucagaugggcgggcauguguggggucugucucuggacucucuauuggauuccauuagucucugcguuggcuuuuggcaguuuuauacuguuuuaauuaccacagcauuaaagauaugcuagguuaauucuugguaucaggugguagaagaccuucaaccuccuguuucuucaguguugacucuccuugguccuuucugucuucauauacauuuuaaaaucagcuugucaacuguaaaaggcaguuuggauuauaguguggguuguacugaguuucuagauuaucuggggagaauuggcaacaguauuuggcuuccuagucuaugaaaugggguaggucucuuuauuuugauugacucuuauuucucuguguuuuauaauuuuuaauguagaagucuugcaaauaguugguguuuuuaguacucuuuaacuuuauuuucaguuguuauuguuagcuguagacaugguuaccuauuauauccuucucucugucuaauaccuuuccuauuuuauauauauauuuauguucauauguauuaauacauauuaaacaaaaaguagugauaguaaaccuauccuccccacacaccuuagggaggaaauuacuguuuuuccuucuagucaucagcugcaugauuuuauagauauuagugauuagauuaguaauuagauuagugauuagauuuuuuuucugauuuauuucccacuauuuuguuaauauggugauuaauuuuggauguuaaacuaagcucuuagugacuuguuaaauccagccuggucaugauguauucuuggucaugauguauauauaauucaugugcacguuaauuugaugacccacuguuuugcuuagaauuuuugaaucucuauuugauugacacuggccugugaacuuccugugauacccuugucaagguuucagguuuuauucuggguugguugaaugacuuuggguagguuuucauuuuuucucuuuuccuguccuuuggaagaguuuauggaccguugauuuucuuuacuuaauugguauuaaaugguauuaaguuauuuagguuuuaaauugggaaauauuuaucucauuagcuuuuauuuaguuguacagucaucagugacacaaacuuguuaauucaguauugugcauuugaauggcucagugugcgguuuacugugugugaagcugcugugugguuugaaguuuuggggugugguguuguuaugccaugccauuugauuagauggaaguuaaucuuuuuaaguucuggaaaccucaguaaaguaucaauaucucugaauaugcgcuuacccguuucucucuuuaaaaauguagaacuuugcuguguuguguauuuugaagcugugcaguuaggcacacacagguuucaggguugugguuuucucuugaguuucuccuguuucuuguagacuccucgcugaaagggccguggcucugcacagagcucucucgcuuuuguaagguagugccuuucuuuaccgucugucuggcuugcaggaacuugugaagaucugucuggguuccucauuuucagcuugugcuuuuuauaguuacugagguguuucuuuuuaucauccugucacuuuaaggggauggugggcuuuuacauggaagcugcaggccucuuucacucacccucuggccaugugugcuuguuuucacagacacuccagcaacugaaccaacugaauucaugucaccaagaagcuguuuugaaauguuuaaagaguaggagaaaugagaucaagcaggcccuguugggggaaauaguugauauuucuugugcgcagcugcaggauuuugauuggcaguuaaagguaagagucuaguuauuuauauguuuuuguguguaauauuuaaguuuacuuauucuuuuaaaguaaacaugccuaaaauugguuauguugagacuacaguguuccaagguaauagcaaaccucauguaaauaauugguuuuguguuaacuuggacauaagagcacuguaagcagccagaccauguguggugucauuguacugacaaugaauuuucccacaccuaucagucagaaguggagaaguguguauuuaguguauaaccuuggugagggucuuauagaugccauagcgcucucaaaauugauaaaugugauuuuacuucuaugaggaaaguauauguaauaaaguaacaguuuuaaaaacauugggcaaagaggguaguccugaguagagcugagaaagagcaauuucagaaccgucuuuuguucuuuaagguaccauacgaguagacagguucagguccauucugguuccugauccuggcauggucuuagauccagacagugccguauguuguuuuggugaauuaagaggacaaaagaugggaaagugggacagugagguaggcucagaacucgguaaguauccacuuguugucucagcugaggaaaugguucugugguucugguugaggcucagcuguguuaaggauuguuuauuaacaugcuuaucauauugacacaaaccagaaguauaguaagcaugcaauacagccaaagcuugaaaacauuacacugaagguccaaaugaagaaggcaaguuaaucagugauagauuaaauaagagguuucauuuaaguacacauuuaacauugaaguaagcauggaugacuggggacaggugcucacagcagcauuuaugaaggacauguaguugcuuucguuuaucaaauggccccuuaacugaugcagcuucggucuuacauugugcugugagacugcugugcucucaggcaggggaaggcuccuguggaugcuguuuucaagugugcaggcuuuugcaucagcuuauuaauuccuuuaguuuucauugcccaacuuaaauaccuaaacaaguaggacccccgccaggaaagaaugaccaggaauuuaauuagaaucaugauuuaugaagauucuuaacacuggaggcucuguagcugggaaaggucaagccaauugcagaugcuguagauacguuagaagaagacuagacgcccuuuggguagcaucaacaguuuugguagccagucaugagguaaguugcuuaauucguaagaguuucugagugucuuuagacugucuucuacaugaacugucaucuuggaaucuuuucuauaacaauucugauucuuuauguauuggacacuuuuaguccuucugcauuucuauaguaaaccaugauuucaaucuagaauuaaaaguauucuguuuagcuggacaaaccgcaguuuccuuucuuccugcccacuuccuguauguguuuugucuccuuuucucucgcuuccugcucucugacuguguguucugccacaggguuaguuuauucucuuguuucccagaauuugugagcauccugggaaacacugggaugcgagcucuuccccagcccugguauuuguugaguggugucagcaugcuguguaauacugugcauuauucuccucuccuuuccacagcucgcgcuuucuagugacaagauugccaccuugcagaugccccuuuugaaccuucaucuggaugugaaggaagaugacaaagugaaaccguacacuguugagaugaguaaagaggaguuacagagucugaucagcuccuuggaggccgcuaauaagguaugcgcuugcuugaacucgauccaucacacaggagcuuacugcuuaagcaucaggccacccuuguguaaggaaagagaauuccaacuggguuucaaugugucucacucgcugacacuuaauaucaagcacagaaaagacuuguuuggguugucugaccucuacuuuaaagguagaguuaauuagaacuuaaaacauucaguuaccaaguucugaauuuaauuaccuacuaguuaguuuaaaaaaaauaaaaagcaguacuauucuaacuauucauuuugguuuccuuuaguauucauuaagcuuaaaaauaaaguuuaucuugagaucacgaaauuaguugauucugaaguuucucuaguaaaaaaaaagaucuuuaugauuuuauaacaaaaaaaaaccaaaugucuuauuuggauggacaaauguuaaaaauugcuuuuguaaaguucugaguuugggagauaaaauauaacuguaguuaugacagaaucaggcugacauaugaugugucugaaccccagcagccaggcccaguguguaguacauagaaaacaguggugagacagcagagaugugcuguggggaaaggaaaacaggauuuuuauugucacuguuugcucauuacugggcagcucucaggaacuggcucccguucuuccuggucaccucccuggcugccaucauucuagaucccccugcccuuuuaagccgcaauaaccaucaccuucuuccuagucugccuaguugcucauguuuuaauuuugccuucaugauugacccucauguccgguaaccguacuuguagucgaagccugguggccuucggagagguggguguggcagagccuggacugggugugagugaccgagcacagaucucugcagccaggagccauaagcccuguccccauuugccaguugcucuucauaucgcucuucagaggucaucuagcacauagcagcuuccgucuagucuaugcugacauggcuucucccuguuuguguuucaaggugguccugcaguuaaaauaacuggaaauggugaccaucaacaccucagauuucagugcugcaccguggcagagggagugcuguccauauucagcggguggaugcuccaucaggcugagcaggcagcagcucugagaucacagagauggaaauccgucagaaacccuaagggacaggaaauugcaugacugauaggaagugcauaggaugaaagaagaaagagcugaagucacagcccguguuuucacagugaucgcuuugucucauuuauuaaacaucugagaaacuuuguagauaacguuuuaucaagagguaaaaauaaguucugaaguaauguaaacacacagagcacagacacgcuggacuguucuuaaaugcaaacagcaagacauguauucuuaauauguaauuugugauauuugaaaauaauguuuuaagguguauccaagcuacauauguaauguaggagguuucauaucuuucucauguuucaaagaaaagauuuuuaaguuguaaauuuuuaaagaaaaucuguuaucagacaugaacaagaaaacauuuaaaauuuguaugcauaguuugggaauaauuugaauaacaaaauuccuaagaaauuuaugaacuaaaacaaaaacuucaaaaaaaugcaaauaacauuguuauuuucacauccucacuucuugggagaccauggucugaggaaauaagaaaacugucaaagaugguauaguuacauauuguuacucacaucaaggguguuuuuauaaggucugaauaugaaauuugagcuuuuggauggugacaaaguaauuguaauacaaaccacuuaucacccuagcuaacugaaaauaagcauucugaacaaauacaagcuggucgucucuuccuguguugcuugauuucagugacuucccaaauagcucacuuguugguacagaauuaacuggucgcugccgugugcaguucuguggcuccauaaggcuccagucugacagccgggagcggugaugacuacuguucuccuccuacggcugcaggcagccucagacaaggcugcucuaugggcugcgacauagcagugauuaggaaaggagcuugggccagcggguucucagugugcugcuuuucucaucaagaaauucggguguggaaaguggaccuaugcgguauguucacgcaguuacugauuuccuuguuaggcaaguuuauuaagucagcacggagcauuggcagcuuguggaacaauguaucaggccugguccagcagucucuauugcuuccuuccuuucagggcagcccuucauaggagaauaccuuguucucuuccacccccaacagccuguugcacagcuuuucugauuggcacacaguuugauugacacacuauaauguccauauuuaaaguguugguucaauacauuugaccaacagauacucaugaaagcaucuccguagucaaggaauacaggcccacaugcaagcuuucucuuguccucgauagucuccaucccugggcguucacccuuggucacuucugcugcacuucuagucaccauggguuagggaaaaugggcucauacaguaugucuuguucuucucuuuacuguugguaauggugcaggacaccguguuuuccaaccaagcuuagucugccuccaaaacaaacaauaacaagccaaauuaaaucuguuuuuuuuuuuuuuccccagcaucuuucuuuguucuuggacagggccuuaacugcugccugggcuguccuagaacucaacuacguagaccagguuaggucuugaacucaugacagucuucuggcuucagcuuucuaaauaauuggauugcugauaucagccagcaugcaugauguuagcauuauuucaaguuacucuuauugcacaugccaguacuuuguuccuucuuauggcugaaaagcaucauguuguauaauucuuacaguuuaucuguugguagcuuuuuggugguuucaacauuugcuuguccuagugaagagaaugcuaugagcauuugugugcauaucauguaaugaagaaauggugucuuuggagugacauagccagguccugugauaggcucauacuuaucuuucuauuacucauauuccauucccgcuuguuuguuagcauucugauccaccuucccuuagugugacaggucuuccugguuucagcuauuuuggugucauauuaugggaucucauuguguuccuuuucuuuucuuuucuuuucuucccauuucuuuucuuuuuuuuaagauuuauuuauuuauuucauguaaaggaguacacuauagcuaucuucagacccucuggaagagcagucagugcucuccagcccccucauuguguuucuaacagucacuuaaugaccaaucgaauucaucaucacuuaacauguucuguugucugugcaucucgcuggacucuguucagaccuagugccugguuuuuuuuuuguuuuuuguuuuuuuuuuuugagacaagguuucucuguguagcucugacuguccuggaacucacucuguagaccaggcuggccucaaacucagaaauccgccugccucugccucccgagugcugggauuaaagucuugcgccaccaugcccggcccuagugucuguuuuuaaggcggauucuuagucuuguuucuuagcacugugcucugacaguuccuuucuaaaugcaaggccuucggauacuccguuccauacuccaggaucuuuuuguuuuuccuguacuuaggugauauugauuucagaggucagcuuuagagagaaagguuaagaggcuggcagaguuuccauaucaugccuaguuucuccucguaacugauuacacuguagggcacuuguaauuggugaaauaaaacaugaccauuagcuaacuuuucuagguuauuuggauucccuaagaauuuuagcuguuucccucaccguugcugaccuugaucuuauggagaaaugugugugacucacaggaacauaccaguguuuuucucauaguuaaacuggaguuacagguuuugggagagaagauugcaaagacaaagugccauuuuuaucacaugauuuaugaccugaugcgacuguaaccacggugggaaggcaacgccuguuagauuuccacacugugaagugacuuucuugucccaggcucuucucuuuggguggggauagcuguguucagccuggacuagagccauggggagcucugcuccucauuaccccguugaagugucuauagaaguugugugcaauucacuuuuuuucccuguguuuucucccauaaauuauuuugucaucuaua

SEQ ID NO: 2491 - RNA, 2132 nt, Mus musculus
uaggggacaucugugugcacugucugagcuagcugugucugcuuccugggggagagacaggaucucuuuggauugucaaagggaagcagagaagccagcauauuagcaaagggaagagggaguuaggggugguuguggggucugaaaagaaaggugagguagggggcaguuaggagacuggggcaguaauucaggaagaggugacagugacucuaacaaggguuggggacgcggaggugaguagggguggaggaaggggucagauuuuggauauagacuuaaagcagaggcaauaagaucggcugauugguggauguggggugugaaugaaaggguggacucaaggaugaugccggguuuguuugacuuaaagcaacucaagucgagauuguuuaguuugacgggauggaaaggccaucauaacugacugggguggagggagauuugggaaguuaagccgcaugugugucuccuaagagucacuggacuaagugacuacaagacucccacauguucuuagcugugcuuuaguaguuaggcucaacccgaaagaaauggggagugcagcuccaaaaguaccagguauuuaucuggaaaucaaccauugugaacugaguguuaacaaaagcacaaccuauccaaaucgacgagaugacgcuauuguacuauuugaaguuaaaucaggaguucguggggguucaugaccaaggguguuggguucccuugagcugaacccaaccuugagugaugagcugucagauguaaguacuaagaacuacacucagguccucuccaacacagccuucccucaaccccucaaauacacacauuaaaggacaaauguuuaaaaaucagugaucggaaaguucucacugaaaaauacagaucauagauuaaauucaaacuauaaggaagaaaguacucaaaauaacaacaggagacagugaauuuuaagucagcaaagaaaagcaguugcuuucaggaagacuuuucaaauuuauaaccccuuaagcaggcugacugggggcagggccaauaauaaacuaaaagcaguaagcuagugcuaugccugacauucuacagcuuacccuccacccugccuaccagccgcuguccccucugccuugucccuaccgccugccagagaauggcaaacuccccccgccccccauagcauggcaauggaggcuagaggcucccacaggaggcuaucugcagaccugcccaagcuacaagacaguguggcucugccuccuccagcucugaggcaacuccagcuuccauuuucacaaucaucacugggucucaugaccuugcacaaagcccagugagugugagucuaccuuuuagaggguuucauuuacuguugaauucuagguuuugaguuauaaaaggauuucccgaagucaagagugaguucacuggagauguuuaaauguuauuuuuuuccuugaauuaaguaauacauucuuggauagggauaacaccugcccccaauuagugcacaggugacauccugugugguagccacguagcuauucaucuagaaauaaugggugaggggaauucaugacugauuucugccuaggacacacugggcuugggacagcagugaucuugagcaaguuuucuucuuuuuuuuuuccccagaguguuuucucacauacuuagaacuggaauaaauaagauuuauaacaaaguacuuccugccaaaaccagacugccaucccgacgugcaggaaagaugauucagaagauaacagcgcugccugggccugagaaccagaacccacguaaaaaugguauacaacuauaaccccagccuucccgcugauggguuucuggggcuugcugacuagccaggcuuggguucagugacaggccccaucgaggaaguaaagagugauagagcagaauacucagcgcccccuucuggcuuccacaggcacacccgcaugugcaccugcauacacacgugugcauucgugugcaaacaaagaaaacucaugaaucucaaaggaacauucucaaggcuuuuuuuaagugaagauauaaagcauaaaguggaaaauaacaacagcuauuaucauuuugaaugcuuuuaauauaaauuaaacaauuuuuuauaaagu

SEQ ID NO: 2492 - RNA, 23285 nt, Mus musculus
ugacuccaccgauccgccggaacgaaagcgggucccgggacacuggugugugagaaacuauugcuagcacagaggaagcccgguccccaggccauggggguacagcugaggcugccacccggagagcccugccaugaaggugagugucagucccagcggugggacaguugggucacuuggguagcugggagcccagaugcgaggucucaaaacuagacucagaaaaaugugcggauucuuaacgcgccgucuucuaaucauuuaguauuccagucguccagucggcugucccaccaacgggacaguaaauacuuagcugagcccacugcacuccagacucuguggggaagcccaagucggagcaggacagaagugacgcccacuuagucccccggcuggcucaauguugauuacguccuacugaguguguggcagggaaauucaggaugcuugcugagggcagauuccaggguuugauccaggaggagguuuccuggcucagccucaacuccggaguacauggcagagggcgugccggggaucccgugggcuucccacagugcucccugaacacacugugccugagucccacggagagaucgcucagguaugacuuacugggcaauccuuugaguagggugacuacuccaacagggaacugggagugcccuuuuguuaguucuuccucagggcuagacugggauuuccagcccacaccuugccugguaaaaccccugggccccaccccuugaccuuugccagauguuccucacuuccacuggcuucuugcagucucuacacagaaggucagagaaaacugaauggaaguaaggggaaagguggggcaaccuugggaaaugugcauugcaaacgaaauuaucgguuuuuuuuuuaauccccacuggugucaggucauuucuaaccuacuugcuaacgacucaaagaagcugucugguaagaccugugccuuacagugagugcuucccagccuaaugcuacgaccauguaacuacagcuccucguguuguagagauucguguccuugcuucuuggccuuuccagcuuauaacuuaacgagggaauagaaagaaaaggggggagagacagaagaagagagaggacucaucaaaucccagcuaguaagaaaggggaaagguguguaaaagaaaaugugcaacaauucacaaacuauccccacauugagaccgguaucccuaaggcagcugcaucuaggguuguuuccuagacagucaugcgcuuaguggcaguuggucccuuuucuaaauaauucuggagcugccaagucagaucgucacuaaugcacccugcccuuguuuguucaaggaucugagagcagauugcacccacucauuugaccucuggauauuuuuccugcuuugcucaugcauuuaguaacuacaagaaguauuggagcucugugucacccgaugauuaaccgugcaggaagguacugggaaagaugggagaggccaaucuguaauuucaguaguaggagacuagguuuuaggccuaguguauccacuuggcucucuuucuuccucucuaaaguaggaagaaaucuuguugacagaguagguagcacuggguuaccucaggaaaucuacagggcagaacccuggcgggucuuaaauggagucugguuuuccuugauuuguuugaggugaugaacaagaauccugugagccgagcacuggccuagguccuaaaggacugucaucagucuggccuucaaugcuagcacucccaaucuguuuacuacccugaugacaggacauuccgagaagcaaaugacuugagaguguagagcugugacaaagucuaacagucaauguacugaagcuggagguggucugcagauuggguggcccagauccucuagagaaaguuuuuaaucuacccgagaucaaaaugaugagcuaaucauggagucugaggauaaagucguuucauaagaugccccccaaaaguuacaguaguacuuugauuuugacuuuuaaaaccaugacugaauacuucaaaagaucuuauaaucccaaauuaucacaaaauaaaaagacaaacuuaaauacucaaaguuuuuuuuuucuaauuugguuucaguacuauuugcaaguguucuaacagaacucaaaucaacuucaacagccaaaaccgcuuuuauuagcagaggaaacacggcccuggggaaaccgaaugccagacuuaacagccauccccuggaacacacauuuugugucagggaccguggaagugauguuaugaugggcucaagggcagauauccugggcugccaaaaggacauucauaaauucucacgucuaaggagcucuuagcugacuugggguucaaaaagcaagcuucaggcagaggagaaucaaggguuuucaaaguuuucuuucauggagugaagccacuuguccagaccauagcuugacaacagagggaaaaugccugugauauuuaaagcugaccuuuccugucuuccugaccugaaugucuuugguuuuaagaaaagaaaucaggagcuagagagauggcucaguggucaagugcacugacugcccuuucagagggcaugagcuugauuacggcagccacgagacaguucgcacucaucuauaacucuaguuccaggguaucagacaccauuuucugaccucugaggauaccaggcauguauguggugcacagacauacacacaagcaaaacaccuauauacauaagacaaaaauaacuucagaaaaguuuaagaugaggcaauugaggaauagugacucagaauuggcuguauccuuuucuguuucuauacugauauguaugugugugucugugugucuguguguguguguguguguguaucuugaaaauucaaaacauuccuauagaacauauccguucacauuccugcauaacuaaauucuguaguuuugguauccauuuuuacagauacagaaagugaaccagagaacuuaaaauggcuucauaguuaguguucaaugaaacauggcauuccuugggccuguauuucaccuguaggugcauacaguacuuuggauggugcaucuuuucugaauucacauugcagccuuuauuccaguguggcuggagugaggaauggggccucggagaaauaccuuauaagaucaggggccaucgugcaagaaacuacaucccgagcauccuucaugcaaaaugcuuaggaucagaaguauuuuuagauaaaacugaguuuccugauguggacuuguucaguaauguccuaucagugcaccaaagcaucuaucuuguagcauuuggaauuuuuugaugguggaugcuguagugguuauuccugauugucaauuugacuauaucuggagugaacuacaauccagaauuagaaggcucaccugugauccagaucuugaggcuagaagacacaaguuucugaccuagaucuugcccuggagaucuugagguguaguggccaugaaaugcuuuggcccaggcaaaguaguauacgccuuuaaucccaggagacagaggcaaggcuuggagaucucugauuucaagguuagucugggacaaagcaaaucccagauccagguguggugguacacuccuuuaaucugggucacaccuucuacuggagaccuacuuaaggacauugaaagaaggaagauuaucucucuuugccugcuugccuugugagacucagcaacugcuagaucauuggacuuccauucacaguugcugcugaccauuguuggggaguuggacuacagacuguaaaucaacaaccaauucccuuacuauauaaagacuacccauagguucugugacucuagagaacccugacuaauacagauguccaaccugaagucgcuguguaugaaagaggccugaaagcucacccuaagaagacacggggaaggggaggcugucaccaggagcccaacccugaggccaugcugauuucagacucccaguuuccagagcugcuggaauucacugcugcuuacaucaucaaagacacgggacuggcacaacaccccgagucuaccccauggccucugagacaugacaaguuucuuagcauuggacacaucacucuuccaaaaaauacaugugauaggcauuucucaaagucugugaaauggugauaguuuuugcuacuaagacacuuugguuuucuuuguaaacuauaacuguuuaucaaaugcucugaaagauuuccaccaugucuucagacuaaaacacaauguuucuaaguccuaaaagauuucuugcgugccaaaauuaagcacuacuuaaaaaacaucccucuaacuccccaaaacagaauaagauucuccacuaaaagcugaucaggaaacacugguguguacuagcaguagguuguugagccugguauuuaguaggaacuauaaaugauuuuaaaaacuuaaaguaugcaugcaagguuacuggaauguuucuuaaguuccuuuccugcauuuucauuuaaaauuguuuguuuaguuauuuauucacuuuuaggguguuuuguuuuguuuuguuuugagacaaggucucacuacauaguuuuagcuggcuuggaauucacugaggaucaggcuaaccuugaacuuagagacuuaccagccucugcucccagcacuggauucagagugagugccaccuuaccuggcuucccuuuuacuuuucuccaagaggaaaauuugaguaaccuuucuuacagaugguaaagugugaaaacagagacuaguuauggaaacaccagggccagcaguccuuugacacucccugcuccucccacauccucccagcuccucccugcucccucaggcccuuuaaagaaagaagacuuuaaagauaggcccuaaggcuacagagguggcacacaccuuuaauuccagcagguaggaggcagaggcaggcagaucucugaguuugagacuagccugguucacagaguuucaagacaguuacggcuacacagagaaacccuguaaccaaccaaccaagaacaacaaaagauggcagagggguuuaaaccagcaacaucuucaaggugugaagaucugaagcauuuuuugugguuguugcacaggcuaugguggugggaguuuuccauugcaguucacuuggcuuggaaguucuggggaucaaacuaaggccuccccaugccaggcagucgcugugccucugagcuacaccauuggcccucaauucuguuugguuaacugaaauaaugagcaucucugcaugagagcuuacacguacaucuaucugccugcugugauguccaaaggucucauuuuguuccaaaucuguucuaauuuaugucuaacacuuauucggcuccaaaucggcguacacgauguguccuucuucucuguuuauucuagcuugcugugcuuucguuuaaaccaucugcucuguuugccuguccuguugaccugugccucaccaguucccagaggagcugacucuccugugagcaaauaaauagcuuagcuaacaccuugggugguauggguuucaacagcuguuuuguuugagcaaacccauagccauauggaugugcauacgcuauaaaaacauaagcugcaagaagaauugugauugguaggguacacuaaauagggucauuggcugcaagggaauugaagguuucuucugacugggacugcagagagcagcugugugaggaaguaugguggacguguauguacugugcucugccacugagcuacaaccuccacccaggaggaggcuuuucagugccaagaagcagcucacuaugugugucaacacuguaaagggcuaaauaauagccacuguaaaagcgguaaggugaggaggaacgaguuuaacacaacuacggaggagagagcgggacccagaacagaggaagcgggaccacaggucuggagccuguguaugggguggguggacucaccuuuuucugaaaguaaaggaaagccauuguagagcuuugggaaggaggaagacaggauaggaccuuggucuuucuuuuuuuuuuaccagcccaucucacccgaucuugucccaacugagccgugacuacaucuuguuccgucuccuuccugcccuccaccccacugaugacguaccacucacgcguacgucugccuugaauuuugucuuuuauauguaacagagauuucuuccuaauccugcuuucgaauuauguauauguacuguacauguauaaguacauguacauguaugcaggcuuugcugcuucucuuggcauuuaaacgcauuacgugguucacgucucuagcccuuccccauuagaauacagagaguuauuuauguucaccgcugagcccucggugucuaagacauucacggcagccagaagacaguaacuguguggaugaaugaaugaauaaaugaaugaacguguagcuugugcugcuugagggaugaaugagacaagaggagugcagcgaaagguaggucagaggugagcaaguuucugagcgcguuggguuuuaacauuuaggguuggcaggaauugagccuuuauuuaauuggcauggaaaacuacaacggagucaaugagaccaaaccaggaaggugugaccuggucgacagcagcucacagcugcagaaugaauugugauggccagaaagauuuucuaugucaaugaaauagguagcuguacucucuuauuccugucuaugugucuugaggucagcugaggguggacuggacuggguuccugcuucaggcuguauauauaccuauguggugguuuguauuugcuuggcccagagaguggcacuauuaggggguguggacuuguuggaagaagugugucacuguggggaugggcuuucagacccuccuccaaccccccuugggaaccagucuuuuccugguuugccuucauaacaagaugucaaacucuuaaguuccuucuucagcaccaugccugccaaugcacugccaugcuuucugccuugaugauaacagacugaaccucugaaccuguaagccagccgcaauuaaaugcugucaucuuuauuauaagaguugcccuggucauggugucucuucacagcaauggaaacccuaacuaagacagccuaggacuuguuccuaccuguguacccaggucuucucuguguuuucuucgugagugggccucagguugaagggccagcagcagcuugagaguuacagaugugcaagagagcaaacucaggcuagaggcguugcucaucuggcagaguacuuacuaaguacacacacagccaaguaaguacacagaauacaguaucaugguacaugccuguauucucugcuuuuggaaggugggcuauagagagaucagaaguucaaggucacgcuugaucacauggcaaguuuaaagccaaccuggaauguaugggaccucugagggaagaagagguagaaaagccaaccauauaagcauguugaagcuugaauucagaucaccucaucagacuucuugauacuggugagcgagccaaugcaguaagaaaauuaguuuauaaaggaaaaggauacauuguggcucauaauuuuggagguuccagcacagagccuguuacccauugcuuugggguuacagugaggcagcacaucacaguaggacuaaucugcccaccuccacauggaagagggaggaaaaugacagaguucuauaauccuuccgcccacccccaggcaggcacaccuccauugacccaaaggcccuccuaccccaacuagaccccaccucuugacaaugccacuggaaguaccuccuggaaguaccaucuagggaucaggccuuucauggacauuuaacauccaaacuacacggagagaagaacuaugugccaaccacgggaaggaaggcuaagacucaucaagcacagaagacggucagacaaugguguugucuucaaccugggaaggcauugcugcgcuucccuaacuaagaugaagcucugcucaaucacagacuucccagcgaucagaugaucugccauaaacugugcaauuaaacgacacucuguagguguacguagcuuugagagaugaauguuucgccuuucugugagcauuaagacucuaauggcuuauguuauguuuaucauuuucugaaauaaaaagacugacuuggguugcuuagcuacaccaauuuccaauuacccaacuuuggcacuacagccaggaaaucacuuuucuaaggagugaaguguuaaagggaauccagggucagcaucauuuguaaggaguaauauuucuuaaaacgaaugauuauuuuuuuuuuuacaaaugacacauaucugcuauuuuuuuacuucauauuuaaagaacaauagcaacaaagaaguuaagcaagcucucugcugacagaaauacacccuuguauucacuuucaaagugacugucuaguacaaucuuuaaaugacuguuacagacuuucaguguggaguaaagucuagcuucaaguccuuuaauacuuugcuucuugaaaucaugagacacugugacuagagauugcuuugcauccucuaaaacccucuagggucucugcccacacagucugcccugcccuucucuucccugugcccugggucccuccaaacccucauuccuccuccuccagccacagccucugugggcuuuccucccuaauacacucccagagcauaaaacgauuuaaguucuaaggucaauaaccaagcaagguuuuuauuauucuuccugccauaaaacuccuaggcuucaugucggucuugagagaacuugggaaaugcaaacaagaugacuuguguucccuuagcaccgcuguccccacaucccugacguguaggaaauguuuuuugcuucgucagcugcuuagaaggcauauuguuugucuggaaugagguccacccacccugauuucagagaugaagcucuggaaggguuauguuaagcucguagugagggacaaucgugcauucaguggaaaguucaguucaaagcuuucuugggaaugaaugcaaucgagaucguaacuagcaaaacugcucaggcuggcuuuccaucugauuguuguuguugcuuugguuagcgguuuuguuuucuguugucucuuccuguaagucagucugaccucaaaauugggaacuuccuucccaagugacugaauuacaugccuggcucauuucuuggguuuagaugagaugcccacagggaaagguaagaauacugugacuaccucacuacuaugaacauucaugguuguucuuuuaagaugacauuguagagcaugucucaauuuuauuuuauuuuacuuuuuagaaaccccuuagguaauguaauucacuuggcauauuuaaaaguuuugacucagaaucgguucuauaucucucaaguaaagccaauuccucuuuaagugacacagauauaugaaauaagaaauguuugagaucaguuucucagccuuuucaagacaaggugauguccuaacugcauguuauaaaugaugaucgcuucagaacgaugugaagauccccuuaugggauucuccuugcuaaguguuucagacacugucagugauguguuaguauaccuucuuggaaucggagauguuaaaucagagugcuguugcuuguuuuaguuuugauuuuacgguuuuguuuuguuuuguuuuguuuuuuucuuuuccuuuuugauuaguuuugagaauuuccuaugugaguacuauacuggcaguaaccucuccuccuuccaacuuccccucuaucccacaccauuccuucuuaacgucauggccuauucaaauauuauuuuaguuauuauacguauaaauguaugaauacagccugcugggcucccuuaguguugcucuucuggcugaucacuugggacuggcucucccuccaagagacucuucaccacgguggauuuugguuuuuucauugaauuccaugaucuaccuuugucuguuuuuguucuggauaagugauguugggacacuuugacuuuuaagaaaggaaauaagaugagaaaguagagauugagucccaaugccaccuuguugguuagcuguucagguggugggcuaucggaaguuucucgggguguguaacaugucucucauucauguuuuagaguuucgccuaaaaauuccaaugcacagaaagggucuguccuagugcuuuugcauucuugcuaaaaucuuauucuuguuaaagccuacugauguuuaauucauuuuucuacaauaauucugcucauuuaggagcaagucaauuaguuaaacugagaaacgauuuucuuugggcuaagcgguaugcaaaauuaaaguuuaaugaauuuucuggaaugcacaguucauaccccaugacugggccagcuaaaucuccuauaaagggguaauuuauaggccaguggcauugcuguggccuucuccacccgccugucacaagcucugcuuucugagagacaggcagacugaucaugaggagugggguggguggggguggggaugcuauggugacggcagaccuaagcgagcgcucccauuuccagcaggccccuuccuuacugaaaccaagacccacaggcugccagguugcugggcuuaucagaggaccugaacuuucgugugaaaccucuccucuuugaacaaugacaacuaaauaaucuuuaaaucauuuuuuaaaugugggacagcuucguugaaagugucuguuggcccguggaccaucucuuaggcggggguuuccuguuuagaguagaaauguguuuccauccacucaagucucucuuuggcagagaggaguacgcguuugcacagcucccgugcauucucaccauccccuucaucuuucuuuuuuaccaggguauguacugucgcuggucugcuccaacucuucccgggcuucgugcgagaucacaaaugugucagagucgcugccuuauccugucgucuacacgaaccugaauuccucuaaaaccaacuucagcauuucagcaaguguagaaaacaaauacaaucuguaugugggcuugguauuggccauaagcuccagcguuuucauuggcucuaguuucauacucaaaaagaagggucucuugcaacuggccgacaagggcaucaccagagcaggugagggacacauccaacagcgucuucgcuagggcucuugaaauagagcaugcucccuccuacccuaaaagcucuucccuugccacagaaaucucuucccccugcccuucauccagcugacucaucccacugaauccugccgugguccaccacucuagaauggucuccuucaccacuguccuucagugucuaucguuggaccaguuuccugugcuguguguauuguuuagucagcacauuuacuuguuuauugacaguagacuuauaaaccaugcgcucacaguguuuggcacccaccaaauauuuggugagucaaugaguggauaaugauagcaucccgcuuuguauaauggcauuucagacacugaguagccugucucacuguuauuaccuacacauucauauucauuuucaugaagugucauagcauaagaaacucaaguauuuuccuaggucaauaugggaaaagaaauggcuacaaauguaaauaaguuucugaaggaacaauggguagggagauuugcucuaucagaaaauauauggucuuagugaaaacaauucgguacuggaauuuaaauaaaaagggauuauugaagacauacaaguggaaagagauuacauauagcagcuaauauauaacuuuuaaaaguaguauuucagaccagugaaggaaaaugaauuauuaaauuaaaaguguugaggaaaaauaaaauuggggaaagguagagagauaaccagugagaauucuacuuuuuaccgcuuugcaaaacauaugucagauuccuugaacuugaaauaaagucuucuuaagcauaaaucuguucuggguaaaggaagaagguauucuauguaauuuaagagauucugugaauggauggauaggucacacacagacauccucuuuggaaauaacuuacuugaaacuaaacaauuagaugaucuuggugguagagagagcuaugaaguacaggauacagugguauagaauuccuaauauauaaagagcaauugcaggcaauaagaaaaacacccuagcauaauggcaaagcacgcaaaagagaacagaagugagaggugcagacauccggugugacgacugcuguuauaaggagaaacuacuaaggaagggaaauaaacuaccuugcaagaucaucuuuauugcuuauguguccugcuuaguuuaguuaugcaaaacuguccaggucagagucagguuagggacugagaaauuccauugucuauagccagcauauuagcagugauucaggucaccggucgcucacggcgaaaugacugcaggcaguuucagaaaagcuuguucuuuucagucugucaaagugaaagauaagcuaauaaagauaagauaauccaccugucugauucuugcuguacuuucauuggcucucccagagucucaaaggcuuccauguuaguuaucuucuucccucuaggaccagccucagcugcaagcuaugguuuaggcucuaacuucaaacuauggcugaaacaagcuuagaguuuacagugcccugugccuguacugccaacugacaugguuggagaaccugaagauuaaguaaaauuucauacaagucaaaggaacuuuuccauagcugucauagaaaugaaagguagcagaaagcuugaaaagaccuugggaaagaacagagaguagucucacuuagagaagacaggugaccaaaagccuugucuuuccccucaugcuuuaacaccuuuccugggagucugggcuucuacccucaucuccuggggugaaagccugauucucguuuuugguauuucccagggcaagguggacauucuuaccucaaggaaugguuguggugggcaggacugcugucaaguaaguaugaagcacauggcuuuucaugcucaguagcucuucccuccuguggagaauggcccuacaucugcaaaggauuguggugaccuauugcauccaucuaucuacaaagaguuauuucacucucuugacagagcccgcucugugcuuucccagaaugcaagugaaggcguuaguguuucaaauauuauauuuuauaucacaaaccucuccuguuuccccagagaauugagaaaugucuucccuccuggaucuucugaguucucuuuuuccucaucuauuuauuuauguuuuguguugcaugaguguuuugccuguguggcugucuguguacccugugcauguagugcaugcggaggccaggagaggacauccgauggagaacuggaguuacagauugugugagcugcccugugggugcuggaacugaaccccauccucuagaggaacagccagugcucuaaaccacugagccaucucuccagccccucuucugaguucuuacuugacauuuuuggcuauccugacugcacauucucuuggaaaugggugugucuuccuuaucaggaccaagcauggauaaauaaaaaaaacaauucuuuggcuauugauacugggguaaaguggggggggggggaacaaguuuaacaggacucuaggauagaagcagaccuugcagacuggaagcacuuuucaaacgcuacuaugauguccuccuaagaggcaggcugucugcuuugccacucucccugacuuccccaccucucuuaucucccgcaaacuugauucaaugccaaguaaaagucucccaagggcaggacaucaucagguagcuucacauggcuuauagcucagcgcucuguacccagaacccuaaagccucccuauuuuccaaaaccaagucacugauuucaacguuggaaaaaaaaaaauccuauuauaagacaaaaccugggggcuagagagauggcuggacaguuaagaucacuugcugcucuugcaggcuguugggagucccagcacaugccagcucacaaccaucuauaacuccagucccagggggucaaaaaccuuccucugaguaccacaggcaccacgugcgcagacaugcaugugagcacacccaucguaaaauaaagaauucauuuuuuuuuaauuuuuaaaaagaagcaucucgaguaccuuuucccuaauaaauguugggagcuaaaaggguugauauuuaaauuugcagagcccuuucuauuuuuuaagguguuuucauauccauuugcugaauaaaaguugacuggccuacccugggaagguucuaguaaaaaugaucugagugauuuucuuacucuguguucaugucuuacuugcaucuccucagccuucccucauguuuccaaaggaaaauacaggggcuggaaugauggcucuauaguuaagaccacuugaugcucuugcagaggacccaaguucacgucucagcacccacacggaggcucacaacuaucuucaauuccaguuccaggggaccugaccaucucuucuaacuuccaugggcuucagacacccacaaaaugcccagauauacauacaugccaacacuugcauacauggaguaaaaacaaaucuuaaaaugaaaaucuaaggagaaaauuguauggcuauauuuacaaugccauguauaccaagagaaaaaagcuugugaucauauggauaagaacuuacacuggggugcuaucuggcuauuagcauaugaaguuaaaauuuguguagaacaacaucuauaaaaauagaaaccaucucaauauaaugucaccaaaggaaacuaaauagucuagaaaggguaccacagcuugcuugcuugcuugcuugcuuuauuuauuuauuuauuuaugagaguagucuccuaauuugucuguaaauuuagaucugucuuuauggugcucuaaugcuggguauucaaagaaaaggaauauacucuccacuauguguuugcacguugcaguuggacagcguggaauacuacaaucucuggagauguaucccauugcagucucugagaauaagcuggcuuccacacaaaagcuagcucuugaggggagucuccugcacucugaaaguuauuugcaauacaguacuuggugcagaucucaaguuucucagcuaggauuacauguaggcauccguccuuaggacuuucaaacagcuccucggcucuucuugagcuccugagacaccaccaauugccuguaggucaucuccaauucagaaauuccagccuugggccugugguggggauugcuagcuaucugccacccagacaccagauccccuacaaacccucucauuuuauaagaugcugguguuguugcugugguuagauugcaaguggggucauuuccaaucuauuccaaagcuaccucuacuagaugccauuugacugaccaaauacguuuccaacaucuaaguugcucaagucucaaucgaaacuuguauaaagcacacauuuguccaucagcguugauacauuguuaccaccaggcaauuuuaguagaucagcaucccgagacagcaauccuuucucacuggcggugagacuauaagacaaugcuuuccaaugggucucagcagcggcuucuagguagaagucugcugauggcaugagccauuugcuuauuucuuuggaugaaacugugaucccaugugcucauaucucugcuugcuuuccagugggagccggagaggcugcgaacuucgccgcuuaugccuuugcgccugccaccuuggucaccccacugggggcucugagcguucucauaagguaggagaacaacagagagcuugacuucuaaggcaaguucaccaucgucagcagccguaaaccauaagaagcacucugcuaagaaaucacagaacagagagcaacaaugcaaucugagcgccccaagcccagacagccccaaauaaugucuggaacuccugaaaucuuagaggcaagccguuuauaacauagacauaaaaggcaguuucuuaggcuaggaaaccacuuauaugcagaaggccuugaguuugacacccccuccccaucaaagauaaaaucuaaucuugucucuuaaaaaaauuacaaaaauaacuuaagaaagcuacaaaaauaacaauagaaauaggaacuacauugcucaagucucaauugaaacuuguauaaagcacacauuuguccaucagcauugauacauuguuaccaccgggcaauuacaguagaucagcaucccgugauagcaauccuuucacacuggcugcaagacaguaagucaaugcuuguuaauacaaaaaaccaaaacaaacaaacaaaaagaacagcaaacaaacaaaaaacccaaccuaauaagagcacuuggcucacuguucacaaguacucgcaagauaauaacaauuuauguuugugacgauucagagacgccuagccagacaguguguacuccagugcguguguguguguguguguguguguguguauguguguguguuuaaaccucuccgcugaguacauugugaaucuucucugagucuuucuuguugccauagugauuaauggcaacaguuaucaaaagacuuucaaaggcauaguguuuaagcuacauuucaacucuugcuaaaauuccaccauugccugcuagauaccucuguuggguacccuguaguaggauucccuguuuuguaguauguggauguccuaguuugauuuuuguugcuguaauaaacaguguacuagcuggcuuugugugucaacuugacacaaacuggaguuaucaccaagaaaggagccucccuugaggaaaugccuccaugacauucagcuguaaggcauuuucucaauuaauaaacaaggagggagggcccacccacuguggguggugccaucccugggcugggagucuuggguucuacaagaaaacaagcugagcacaccaggggaaucaagccaguaagaggccuacauggccucugcaucagcuccugcuuccugaccugcuugaguuccaguccuaacuuccuuuggugaugaacagcaguauggaaguguaagccgaauaaaaccuuuccuccccaacuugaagcucuaggcaagaacugaagcagaaacuauggagagacagacacugcuaacuggcuugcuccccacaguuugcucagcuuguuuucuuaaacaauccaggagcaccucccuggccuggguugcaacacuccuaguggacugaccucuuccacaucagucauuaaccaagggcaugcccacagguuagucugaaggaggcaacuccucaaucgaggguccaucuccccaacugacucuaguuugugucacgugaacaaaaacccaaccagcacugaauugugucuguauugugugugguuccagugaauguguuugaugaacuaugagcucuuugugugaccuggccaccauuucguugccuuagucuuuuuagagucuauaaaguauauguaucuaguagaaagguucugccuaggucucccuacuucuccuuucugucuuuauagaauagagagaaccaaaagaguuuauguguauaaagcagucaaaauaacuugucuugaguuuucacuggggcugcaaucccacaagugaccacuagaggacagcuccgaaaaagcaccugcugaaagucuuggagucaaauggcaugguaaauugagacuugcaaaggaggcuggugggccggaaccacagccagccucuugauguugcugcagcaugucauacccugguauccacggagauaccaaccuugaauauuuugaaagcaagucgugaagcacaaagcguugggagcuuuagauaggcagaaauauggaggugggguuuuacucuucgacaaccugcaugguugaacaggucuguguuaguuauauaucaacucugcuaucuauguacauaucauguguguguguguguguguguguguguguguguguguaaugaaggccaaaggacagccucaggugucacuccccagacacaggacaccuuuuuauguugauacaagaucucucacugaccuggagcuugacauauaagguagcuuagcuggacagcgagccucugcaacucuuuuaucuccaccuccccagcacugugguuuuaaaacuaugcacaaucaagcuggcuugcuucccccccucccccaaggguccuaguccugagacucagguauugauccauuuguagcaggcacuuuucugaacgguccaucuccccagccuagggcuuguaucuuugaaacauucauaauuggcuguauuuuaaauggacagauugaauaucccuaauucagaacucacaaagccaaaaugcucccaaauuugaaccauguuugagccugcauaggaucccauaagugaaaauuucuugcaugaccucaugugacagacuuccaucaaaacaugagccugucaaacauacuguguaagauuguccucggguaaguuuuucaaguuuacuugaggcauugauaaaucuucaguuuaagcucagguuccugcccuaaaagaucucauauaugcaaauaacccacaucccaaaagaccuccaaucaaagcauuucagagaaagguugccuaggggcgacacugagcuauaaaauaucuuucacuccaguuacuuugcgggagauaaggugauuggaagcuaauuaagcucuaagagguaaugggggaaugucugcagcauagcaugucuauacuaucuccuccugaggcauaaaagugguaaaauauaauuauaaaaccaucacugcugaacgauucagggugucucagcaucacaugacauauucuagucugcuccgugggguacagagugacauacacugcaguguggccucuaagcugcugcgggaauuaaaaggugauugaacagccagugauuuuguuucuuucucucucaacagugcaauauugucuuccuauuuuuuaaaugagcgcuugaauauucacgggaaaauaggcugcauuuuaagcguauuggggucaacugugaugguuauccacgccccacaagagggagaagucacaucuuugcaugaaauggaaaugaaauugagagauccaggucagugauucagccuuaaaaaaagaaaaaaaaaaaaaaggaagaaagaaaaaacacugaagucgugauguauauauaugcuugcuuuugguuugguuugguuugguugguuugguuuauuaaaauaagaccucacuauauagcccaggauggcccugaacuuacaauccucauugccagucucugagugcugacauuuccagcaugcaagucaccagaggaaaucuguggugacacugaggguaucuuacaagcuugcugugggcuguaaacugcaaugggauuuguuccugauaaaggucuggaagaaguaacaaucuguuuuuguguuuguguguccuugcuacacaguaacaagaagagaugaggcauguggguacaaaagauuuauaaugaacccaaaucccuuccccuucuuccuuaagcaaccauguaaaaggcuacacgugccaggccuagcagggauauuguccagauucaaagaguguuuguggaguguucuaugaaaucacuaaggagcagaaugaugcuuauuuagucucgguuguucuaaaaucuuguguuuuucaauuggugacaaacgguaccccgguaaagugagguccuguuagccucuccuaaaucucuuucuuuuuccuccuaauccaacaggguucguuuccuuugcugugaucaucucugugaucucacuggugcugauuuugauuguggcccccaagaaaggacagacuaauauauuagucuauaucgcaaucugcucuuugauuggagcguuuuccgucucuucugucaaaggcuugggaauugccauuaaggaacugcuggaacggaagccuguuuacaaggauccccuguucuucauccuguugaccaugcuugcacuuuccgugaccacccagauuaacuaucucaacaaggcccuggacacuuucaacacaucccuggugacucccauuuauuacguguucuucacauccauggugguaacuuguucugccauccuguuccaggagugguauggcaugaaagcuggagauaucaucgguacccugagcggguucuucaccaucaucaauggcaucuuccuccuacaugcuuuuaaaaacaccaacaucaccuggagugaacucaugucuacugcuaagaaagaagcccuuucuccaaauggcaaucagaacaguuauguuuuacuagagaacgcagacuucucagccucuggguaugaugacgacaucacccuguuuagcaggaccaaugaccaaaguagccauaaacuuugaacuucaaccaagacauccaaagcaauauuuauucuuggaaggucuauuugcacguuagcauguauaacacuguauaaauccucugaaugggaggccaagcaaaaaaaaaaaaaaaaaaaaaaaaaaaaaacuuugcucugcaaagccuccaaauuggaaaaucaaguuuaaucuucuucuagaagauucgugucuuucuuuuauguuuucaaaaccaccgaaacagucccugagcucaacagaagccaaagacauacauuugucucagaauaauucuucugcucaauggauuuggcacugccagguggcgcuucauccccgccuggucuuggacucggcgacucacagaucuguuaacugucuucugaccgagcagagucucagacgccaucgucugaugggucauaaucucaagcuauuaaaucuaagagaugggagcacugguguauugaccucuggucugcaaugccuucuuucuaaacuacacagcagauaggcaaaauguuaaagaucauacuggacuaaaauguuuauggcacauuuuuuuuucuuuuucccaaacacacacaugauuaugucagagaaacuauuaacauggaccuggauaauguaagcaaaacauguuuucuggaaaucccaagugaauuuagcuuuuuacaacagucauuuuguuccuuuuuccuauuguuuuuuugguuuuggcauguuuugcuuuguuuuguuuuuugguguuuuggcggugggauguuuucgaucggcuuguuuucuugcuugcuuaucuuucagacacauucuugcuaugugacccaggcuggccucaaguucagcaccccuuggcuuccaucuccugaguguuuggguucaagguguguaccaucacgccagcuucuuuuugaaaaacuacuguuccaccauagauuucuucuuguugacaucaagguuuuguaaaaacaaucaguacacaaugugauguuccacuuuucucaaaggucuuaucccuaaaaggugggucauccaaaacugagaacaaccaacagauuccuuuuacagcuuuaauguucuuuuuaaauuugcccauuuucaccuuaauaaggaaauuauaaacaguuucuaacuuuucagaauggacacagccuacuguuuucaguaacaggugccuuuuuuuuuccauugauaauuauguagggagagagaaauuccuuuaaaaaagaaaaaaguccgaagacaugcuacaggaagaaucuuuugcucauuuaaauuuugcauuugauuucucugacucauucuagacucaugcucuuagaccuuucagcaagaggcacuguugaaugcaguuaacugugcuguguguuugggagggaggauaauccaugggcaucccaugacuuaauaccucaaggcauauacauguuuacuuccugcccugacccacuuuggguaacagauauagaaacugugaacacguuuguagaaaauuaucuucugaaaugguaggauguuugaaaccuguacaaauucuuuuacuggcuuuccuuguugcuuugauaaucucaccugguucccccgggguaucuucuugguaaggauaucagucauuucucuagacaucuuuccucagguuguggccguuccccguucuagugaucuugauuuuuuuuuagacauuuaugaaauguccuuuguuacuuuacgccuuagcugucaaguuuugcccuugguacguugugcacaggucaaagacuccuggaacacaagaauugauguuuccugguuuggaaaaugaacugguguugacauauacgcccaggagaaagacugagagauuucaucacuugucauauauagagaaacaaaaaaaauugacaaauauuuucaaaucucuggaaagauugcuggugagcauauauguuuaaaaauuaaaaugcuacuauaaaucuaauaccacagcugaaucuuucucgagugggaagaugcugcuggaggaagaguaaacuacugcaucccucugggacguuucgaacugcucgucucuuacucgugugcauuggaauucguauccuugucaucguauagacgugaguuauuugguggauaucagcgaauauguaaagaaaauggcuuugccuuuugaauuauaacuucaccacuaggucaaugguuaaugauuuuuuguccagaguaaaagauauucauaaaauucaaacauuggauuaaauuaacacauuucuuuuuuaaaaaggaagaaaauacuaagcuacauaaauggaaagcuuaaauuaugcccaguaaauaauaggcacuucacuaaaguugguucucauugaaccagacuucuaauccucgcucuucuuacaagggagagagagagagagagagaaccacugagcacaaguuucuucaucguuccucaguuucagucacauuauuaauuuuagacaauccaagugaaggcaaauucaucauuguccacucuccaucacaaugcagaaccauuccaacaaaaauauuuucccuagagaggggggauguagcucacugcucccucugcaugcacacaggcacuggguuugauccucaacacaaggggccgaauaauaaaaccaguagaaccaaaacauaaugucaucuuuaccuucaaaagcuuuggagguggcaggggucgggugggaaggaccauaugaauguuuugaauguucucaaauauuuuugauaaacuguauuggugagaguuuauauuuuucaaauguuuauaaguacuauucauuuuggauaguuuauacaucuguaauguuucuguauauuuccaauaaaauaauauuguuuucuugugccuuuugguacugagguuacaggcauugagaau

SEQ ID NO: 2493 - RNA, 3020 nt, Mus musculus
uggcauacaaacuuuauuauagauagagucagaaagaucaggaguucaagggcauuccagacuccuaguaaguucaaggcuaacuggaacuacaagacaagcuaacaaaugauuaaaccaucaggugcucagaacagaccaucuauuacacacacagaacagaccaucuacuacacacuuaauauuuacuaaauuaaaaacaauguguaguaaggcaacuggguuaaaaaaugucuucuauggauuucucuguaugagcauauucauacuucuauuuuauaaucaugacucaccagaauccuucacuucuugguaauagauuuguuauuagagaucaccuaauuuacacauucggacaaaaggcaaggcccagauuaaagagagagaaauaaaaguucaaggaccacguucaugggaagaggagaccuugccagcggagcggauucugaucaccgaucugcaugaccucuggcucucucaagaccgcugaugcuaacuucauaaugguaacugacuuugucaaggaguaugucuaaagaauucauuagaaauguggcgaacaugggaguuggacuccaugucauaagcugauaauguaaauguauuacugcgaugugugauuucaucuugguggugauuccuucagcaaugagaucagauaugucaggcagugucauaacauuuaaugugcaucacacagauaaugcauuuuguuuuacaaaggcauccuguuaaugggucuguauagcuagggacauaguuauacuugacagcaaacuguagcacccucaaagaauuuaauuuuggugucugucuggggguugggcuaucaaaacauaucuuccguuuaauuucagcacaacaggcacugacugugcacuuugucagccucauaagcaaggaaaauggaaugauuccuuuuaaucagcuguacagaucaagccaaagacuugcuaggaaaaaauguaauuaaaaauuacaaauaucuguagccaacuauugaggugaugucagcacaaagacaguaacuccuucagggguuuuuccaaagaggcaucaaacaugguagguaggguagucgaagcagggaaaauacagcauggaaaggcaggaggguuaagucuuaugugaguccacacccggguguaauaagacugguucggguguaauaagacugguucgaggguggaggaggcaauuggagucaacugcaaacaucagccaaaaauuugagagaccaggcacgguuggcugcuuaccguauaaguaaaccaagcagcucacaacugacaacuguggaagagugagccaacaugacagaaaaaaagcguuuaaguuuuguuugcagucgcuuccaccaguacgcauuauaaacagaugccaccgagggcagaauuuuacauuuaccaccccucaacauucucuauugccugucaacggguugcuugaauacuuuucauguacaaguuaaaaaaaaaaauucaaggagcauaugccuuuaaucccagcuuuugaaaaaaaggcagaggaugaguuuuucgaggucagccuggucuacagagcgugucucaggacagccaggaauacacagagaaaccuugccucaaaaaacccaaaaagucaagacauacuauuaaaaagucuuuugggggcgaagggagaacccaaggaauacaaugcacauuaauuacuaccguugaaagauuaguacagaaguguuuuccaucauccucuugucucuggaccuguaaaccuuaagccaacgaaacaaaacaaccccugcccacguguuuuaaacggaugaaauaaugccuuuaaaagugcuuagcgcagugucuggcuuauaggaaccacucaacaaauuacgguuaucauuuugacuuccgagcucugaaccauucgggauucggguucucauuuucaggggauggaacggacgagccacagauggucucuggggcugcugccagcuccgacagucuccgguuucaagcaggaaccaacucaguauugccaaacaaaccaagggaacgguccaugcgaccaggcggggccguccgaccgcgagucuccgcacagacgccuagggcggggcugaacccgagcccgagcccgagucggagccggagccagaguccgguucugggucucacacccgcccgcgaugagcuuuggggaggguaggcggccagggcaaaacuccagcgauagcuuagcccagcccggccgggcccugcccaccuuugccggcgcccaccacaccccuuccggccggggccccgccccaaacaaugaccacgccccuccgggcccugucccguuucaggccccgccuccagccccgccccaccgcgagccgggcgcuuaguucuuucagcccgcgggcggccacguccucccccgacgcucugaggucaccgaccgggcuggccggcagggggcggagggacggagggaagauggcugccgaggccggauauuggcgccgccucccccagucgcggagccggcgcagaugaggcgguucggcuggggccagcggcgcuucgcaacccgagccggggagacccuggcgguggggccuggcccugcucuaugccggcgccucggcuagcgugagcgguggcgguaacgccucucuuuccccccgaccccgcgcuuccccugcggcuuggggagucggagcgggcggcgcggccggcauggaggacguuaacuccaaugugaacgcggaccaggaggugcggaagcugcaggagcuggugaagaagcuggagaagcagaacgagcagcugaggagccgcucgggagccgugcagggugcaggccuccucgggcccggcagcccagcucgggucggcguguccaccccuucgucgggcgcggcguccccucggggcuucccgcugggccugggcgccaaggccagcggcggggcgggcuccggcccgcgacggaccagcagcgaggaccugcgggacgccaccuccuugcuggcggccggcgagggaggcuugcug

SEQ ID NO: 2494 - RNA, 15043 nt, Mus musculus
cgugacagggcguggccaucgagggugugagccccaccccagugccagagcgcaagcgcgggcugcggcgggccaagauggcggcagcggcggcggcggcggcagcgaccgagcaggucugugagccugcugcggccggccgagggauugggaagccggguggcccgggcgaccccacagagggcggggacgacggagggcgcgagggcugggcuggcggagcgaggcggcagggcggggccgcagggcgggagcuguccgcagccaagaugcuggcgaaggccgggcuggauccugggcagcggcucccggccggccagagagcggagcugucccucugcgggagugacacgggucauggccugcggagccugcgccuggacgugccucuccgcagccagaaaccaugcggauaaaaauaacgucagucggggccgggaggcugaccgaugccagccaagugguggucagcuguugccuggcguggaucguggccaggucuugcuucugccauuccccgcccacugugguuucucggagauucagauacuaauauaaaacugacccgugucuaguggguuuaagauuacuuuuuaagaaaugcguuaucaaguguuuccuggucuucguugugagccuagaauaguuuaaaggcuucccuucagauaucaagcuguaacuuaagcacgcacauaagugugugugcgggugaagugugugaacacaugcucgugcaaguaguugcuaaagugacuuauuauaauaaaaagcuauuuuuguagucacuucuuuauuguuguuucccuuugcaaauaaccaguaagcugguuucucuuuaaaaguuucauuucuucgaaaucacugcggggagaaagugaaugagugaaauugauaugcaacgggggaauaguuucuuaaguggcuaacauuuuagcgacagaccuauuaaauauucgaggacucauucuaggggguaugaaaaacagaccugaaaucugcuaaacaagcacggaaauccucuaugacaauaggcaaguggacuuguugggaaugaagccauuccuugguuuuccuaguuuaccccuuacagccucuggguuagaggggucucaguucuucugugcaugcaucuugaugcucugagcuucuauucuaccggaaaguuacaguggucugcccacuuggcuacccuaaccagagccggccugccugaagagagcuaaggagaaacaagcauugggcuuaaugaccagcuucccucaacuuuauaauucgaacaugaaagguugcuuuuuguguuugggaucccacuaacuuuguaaucuauucuguuugggagucaggguaggccccccgcugugucagucacuggguccuggcacuucugccccuuaaaaaagcuucucccccagcuucaucaacaaaggaagauguugguaucuucuuccccagcuccucuaucccaggucucaguuggagcuugagucugcuucaauguaaauguguucaggaggggcuggcaagauggcuuagugauaaaggugacagccaccaagucugacaacuuagucccugaguuaagucccgagaaccaucuugguaaagugagaggcccaacucccaaagguuguccuuugaccuccacacgcuuauaucaugguguaugugccccucacacacugaauaaaagaaaagaaagaaacgcagaagaggaggaggaagagcuuggggaaggaggauggagaggagauggaggaagaaggggagaaaaauuaggagaauuagggaggaagaggaagaugagggggccaccagcagcagcagcacagcacuugcagaggcacugccccaggaaaaaguucaucucacauauggugacacuuuugccgguuaccacaucuuccacuucacaugucccucaaugugucucucucgcccacccuaguuuaucuccucauuaccucaaaccuccauuaccacauuacaggcaggagccugccgaccucuguaaaguguucaccucguguucaacaugcugaaacacacaguaaccuccagugacgcccaguuaaacagaacauaagauuagaagagccugcacccugcugagaacuggcucagcccggcucuuccuuccacucucccccaguguugccauaucugacccacccacuccucucauuuucccaccaacuccaggguguccccacucucccguuugaccucuguggcaugggcacccugacaugauagagugcacgugccuuguaacacaacgcagguccauaaugucuacagcaaaggaucguguccuccucucucacguccaacuucugugucagugcuuaaguaugaugguucuuaguacauugucuucuacaauaagugcauugccucggagcucugaaaaacgcgugcaacuugggcaguaaccauuccugcaggccccuuuguguuucuauuacauaacacgcuugcuuaaugacacuuacggucaagaucggaaguucucaaguuuuguuuuguuuuuuuuuuaucccagacucuauauauccucuuaacuaucuguugguauuuaccauauuagaaacuaaccugagaaguugugaaaacagaggaaugccugagcaaauacuucauuaacucuuggagugaugaugucacuguaaacgaugacauggccucuggagacaccagcguucauucaaaagagugggggaguaaaaaaaaaaaaaaaaacaaaucuuauuguuguuuuuuaaaaugugucugacauuucagacccugaagagaauucaguugacaucccuccuaaacauacauccuugugcaacugccccugaacacaucaaaaauuacugaucuagaaugauauaggcuuuaacccauugaguuauaaguagcaaucucugucagccauugcaaaaaucuuuucauguaaguaaaaaaauauaugaguaaaaaucuaacaaaucauuaguaaagaugguaucaacugcaauguguguauacaugugugugcauguguguaugcacucauuagucauauuauccacugaaaugugugcaugugugugugcaucaacucugcccagaagugcgcuguacccauauugacaguaggaugaccaaaggcagagagaaagugugcuauaugacaguaacacugaaaccugcaauucagugugacuugcaacuuauugaugggacaucuaccaacaaccaauucagcuuucuuuaauugugaauuugaauuuaauaaacucaugaaaaggagacuagagcuguugcauucuguuuuguuuguagcaaggguccaacgggccagugaagaaauccaugcgggagaaggcuguggagcggaggaauguuaacaaagagcacaacagcaauuucaaagcuggauauauccccaucgaugaggaccggcuccauaagacugggcugagggggcgaaagggcaacuuagccaucugcgugaucguccuccuguuuauccuggccgucaucaaucuacucgugaguaugugacacacuguccucucucuggagguaccuuggaagaaauuuuuaucuuuuugccaugaggucauagauucugcuuacauacucuguuuugggauaguccuaucuucugcucaugugcuguguuuugggacaguuugucaucuccugcuucucaauauguguuuuuuaucucuuguuggacuugaguuagugcuugaacauaaaaaaaccuaauaggcuucucucuccagucccacaaaaauaaguaaacaaagcugaaaaaaaaaacuaguaagauauaucuauauacuaaucucaucuagaaaaaccuugauagauuuuuuuuuccuuuaaaggaguugucuuuuaauaaaggcuauguaaagucaguggaagagaacuucauugugacuucauugcccuuucucacugaggcugaggcccuagcugugccuuucccuggauaguuaaugauuugaagaaguggguuuuuaauauggcauuguaacucugguggcuaacccuggaaccuauggcaccagcuucuccaugaaugauaccgucuguuaaaagagagccggucauccaucucucucucucucucucucucucucucucucucucccucucucucucucucucucucucucucucucucucucucucucucucucaguguucuugagaaggccuuguucucuuccaaaacauuugugccuaaccccucacugagguuagagcugucacacaguuuaaagaagccauaaauagcuuuccuggucauucuaaauuuauugugccuuauacauuugcuuuauuggagacuucuggcaaggaugggugaauuaaggcauuucaauccccuucucuaaaguaacagugucaggaaacagaguuauauuugaagggagugagaaguagccgaaauccuaaggcauaauuuaugaagacaaaagaagagggagaauggcagauaacggaucaggagggaaagugugugugucugugugucugugugugaaggguuacaaccuguauugguaaagugccuuacagaagccagaggacaaggaccuuaccagucagaaucaaaaggaugauugaaauagacucauugugugaaaaaucuguaguuagugaaguuccucgagccuuguucccagcuaagcagacucuccaucuaaccacagcuaaaccaucuauauccaaacacccuggacugcugcaugagugagcuuccauccugaaagcagggcagccugacugagcacagagcucacucccuccaguccuuuaccuuuauccucugccuccagcugccucaagcaggccagagauggaggaccccucccuccagagagagagaauaccaugugacagugacccuugacagggccaguaaaaagccuacuuucagcugggcaugguggcgcacgccuuuaaucccagcacucgggaggcagaggcagaggcagguggauuucugaguucgaggccagccuggucuacaaagugaguuccaggacagccagggcuacagagaaacccugucucgaaaccacccccccccccaaaaaacaaaaacaaaaacaaacaaaaaaaccccaaaagccuacuuucccuccugggaagccuguaggucaggggcccacccacaccggguguccucugugacccugcaagccuggaacccagugcuugggaguuggaagcaggaggauccagaguucagggcaugaaaggccagccugcaguacaugggaucccaucccaggaagcuacaacacaagaacuccuuaaaacuaaaaccagcuucuuuggagaaaaauuauauuccauccaugaaacaaaagugacaugacauucaaauggcauuauucaauuaaauaaugaagucaucgaaauucacuuaugcugcugcugguuuccaacaccugcauggcagcuuacaacugaaaagcuccaaaagaugugaugcccucuucuggccucugagggcacugcaugcaugagaugcacaggaauacacgcaggcagaacacccauacacacaaaaaauauacaaauccuuaaaaagugacauauacacauacacgggugggugagcagguauuggacaaauaaaagaguccuacaaagagacuuccauagaguccuacaaagcuagagcaucguucuggaagcagucucauaaacggagauucggaaaaugagagcagagaaagcaucgaaggaaagaaaucagauaaaaugauuuuaaugaaauucuccaaaucccagugucauggcaacaaucuucuaauuccagcucucaggaggcagaggcaguaucucugaguucaaagcuagccugcucuacagagugaauuccaggacagcuagggcuagaguaagacccugucccagccuugaaaaaagaaagggguggggagagaaaagaaaaaagaaaaauccccuagaaauuuugaaaccagucugggcucaguaugauacauuuuaaaagagaaggcagcagaggaggaagagacaaacagacagaccacacuaucacuguaaaauuuaaggaaauuguaaauaaagaaucuauuuaaaacuuuucuagagcggugauaaacguguuuuaugggaagaauuaaagcacaguguuccuggaccuauugugagcauuggggagagcaaggcagugaagccguggccugcagaggucagaggucagaggucaggucucagguccaggagaaguaacuagaggagaaagcagaacugaccucgucugaguagcuugaguugcagaacauuuauuuuacugagagaguugcagaaauauacaaguguuugagauuuaguucaauuuaucaaauaaaagaaaauauugaacuaugaagacaaauuuuuaaaaaagaauuagaauauaguguuugacgguaugauggugaauaaaacuuacauggucauaaucaguaaaugcugaacauagauuugacggaauguguuuggaguugauagagaaaagacauaauggugagcccagauucccaucugcuaaaauagauaaggcagagaaagccuuacucgguaaaggaagaaacacaaucuacauuauguaugaauauggagacagagucuagauggaauagcuuaaauugcugaacaugguugguuguccuuggggaaccaaugaggggagaagaggaaacagugacacugccauuuaugaugggccuucuggcaugccuagcucucgacugugugcuuagggucuugauaaaaacauccucuaagaagaccaccagguaguguguccaucucacugauuaaacacguccagagaccucacacacucagagagcacugcugguugcuuccgggcgugucuggugcaugccucguaagagcagauaugccugucuuucagauuacacuugucaucugggcggugauccgcauugggccaaaugggugugauagcauggaguuccacgagagcggucugcugagguucaagcaagugucugacaugggcgucauccacccgcuuuauaagagcacggugggaggacggcggaaugaaaaccuggucaucacuggcaacaaccagccaguaaguuuccacacugggggcaguguguggaggaggggggcauagacggcaguucucgagauauccuacagcugaaagcuggaaauuggugucuucucuuuuaaaauaugcauuaacacacaaaguuauccauauucauaaguacucgacagucaguaauauuguuggcuuuauaaccuugcuagaguuagguaugcaauauuccagaucuuuuuuccaggagaaaaacucacugguguaagaauuuguaggucacaguuuucuuuuccagaugacaaagccauuguaagagcugccucccaggucagaaagccuagguucugggaaucagaaagagaaaugcuacucgguggcagacaaggcccggugcugcuaaaacacagcacuuagccaaaugaaaccuccaggguguuccauaccuccgccgugaccgucuuagggcccagccguguucccugugaccugugcuguuauacagggggucaugugugagcaaaggacuguacagaccugcauuuuaaaguuguauaucaugcagagucuuaugaacaggugcagcuaaagggaccugaggucuggcucucacugucgcuucagguucuguccuuacugcucuguaguucucuuaaacccaaucggcuccaucacuuugucugucgcauccuuugagaacagacucacaaugaagcacuuuuccccaagauugucuuccagcaagggacgaccaagcugaguguugaaaagaacaagaccuccaucaccagcgacaucgggaugcaguuuuuugacccaaggacacacaauauccuguucagcacggacuaugagacgcacgaguuucaucugccaaguggggugaaaaguuugaacguucagaaagcaucgacugaaaggguccgguucauucuuuuaucaaugcuaacgggggauuugucagcagcuacucccugggggaggacuuaggccaccugacaaccugacuuucagaccauuggagggcugcagcccuggccuuagccugcacacacacuaauaaguccucucuuuguguuaauccccacaauuauaagccugccuugcauaguccagaguugagacacccccuucucuaugauaacgauucucucauuacccacaagcucgccuuagcaugugcuuucauuuuuagauuaccagcaaugcuaccagugacuuaaacaucaaagucgaugggcgugcaauugugcgaggcaacgaaggcgucuucaucaugggcaaaaccauugaauuucacaugggaggagauguggaguuaaaagcugugaguauuuuuuccugugugaauuuaagauaauuaauuuuggaauaguauauaauuacauguggaguaguauguggaaaaugauuuuuugucaugaugagauguucaaaauggauugugaaaugaaagaaaauuauaaaauaauuuauaagauauuucauuucuuucagagcaugugcaguuuauaaaaucuggaagaauagaguaaaauaauaauguuuagcuaagagugguagaauaacaggugauuugauuuguaagugugcuuguuugcauuuuuauguuauuuuaaaaggagaaaagccauaacccaagcagcccuucugagagagaauucuaggagaucuaaccaugugucccugacgucgcugcuguuguuccacuguagguuauuccuguucguuuccaagcuuugugaccaaagcuguaagaagaauacuugaauggggccacaugcuguuaucugacaccuguuagcugugagggagaaagucugucaucacugugaccccagcuucacaggucuccccaaagcuucagucagccuccuacuucauacagagcagcugcagccugcacccugcuuacuggccuggacuuucagcuagaauggaguuacccgcuugccucugggcaccuugcucaucuugcuucccuagggcugaggaaauuugugcuaccaaagagcauaaggcacuagcagccugagcacuuagaagucauucuccccuaucaaaauaaguucaguguuauaauucguagaaauaauaaaccuuaggaaggaaaguagguguuucacuuuggcaguuccccaacuguuuaaucccaucucgggaugauaagaugagcauaagcuauaacuccugccagaggcgccgcagccgcccugaggagguuuccacggcgcugugguagggcgcucucugaggaaugacaagcagccacgccugaagcuugcaguugacacugaaggucagagaagggaggucugaggccuuuguguagagaacgugugugaguuaccugaaucuuucauucugcccuccagaaaagucuugccccacuccaccuugucaaugugacaggucaugaaauagucugaaguacccauaccuacuaauuucuaauuuguauugaaaaauacucagcuuuguaagucaguugguaucgaucauucgagugcaagcuaaucauuagcaauaauuuugccgcacuacuuccuaaauguuaacuuucacuuuuauuuuaauuggcauguaauauucuuacuucuguggaacauuguauguuuugauguaugugcacaugaucaaauuagaacaggcagcaugcacauuaccucagauaucuucuaaggcucuuagacaaagaacauucaaaccuaucucuccugacucuuagugcacaaauacuguuaacacuggguacugaaugcucggcaagaaauauuuucaagaaaguaaaacuaaaugaccacaagauggcagcauagaaacaaaaucugaaacagcccucaccacugcaucucccacaugcaacuuucagaauaauauugagugcuuuguucugaaaauuugcauguucugccaguaaaauccaugcugguauuccaaauuaaauaagcucuggaauaugaaaugguuccauuccaaacguuccaggcaaacgccuguacauaacagugaccauucuauucugcccucugacagucuuaagccccucccuaaagugacgacccccaugcuuaaaaccucugcguuggccuuuccuguucaggaggguucucuaguccagcugccugccuccuuuccccacuuccacacccacaggcaucugaacuccucaagugugacauccugauguccuggcuccucagcagacgugcauuucuaucugugcucggcccaacugccacuggcaaagcucagcuccaccugaagggcccugcagcccccagcugcuucucgccaaugcagcuucugucugugugcaggcuauugcacuucccagacuguuggagcagccugcuggcucccuuuugcuguucgcccauuagauacgagcugcuucucuacccagaaacuuguagccaccgacauuuucuaugagauggagucucaccugcaccuuaggcuggccugggcucaaauccuccugccucucaagugcuggaucggaacgcugggauauagauuugugccacagcgccugcuucagaccuuuuaaaaagacccaucucuaucacccucuaagugagcuucccuuccagauaaagcccuaagucuaucagcucagcccccacuauuuauaggucugcccccacuauuucuuugucucacauccuucugagccccuuucccuuaacuucugagcguccuguacccugaaccuacauaagacacacccucacuguggccuccacuggcgagccuucccuagugacccacaugccccacucacucacaccuccacuucuguugggaugcaaacgacugucucuggcaccuuguguaaacugcaguccucagccacccacccucuguucacccugcuugucuucccuuguagcauuuaugcccccgcaugcccuagaguuuccugugcugacuuauuaucugccucccuccagugaacagcacucuauaagaacaaacuuggcuguugagcccauguucacugucaucgccccagugccuaggauggcgucuggcaggugacagcauuuagucauuauuuguuaaaugggagagaagaaaggagaggaggagggggggagacaagaagaaacuuacuagucucuugggaggcugagauggcucaguuggagaagugccuccaaacaagcaaggagaccugaguucagaaccauccaucacacacccaaguaaaaagccacgcaugacugugccacgagccuguaauccugcugcuaaggcuguagaggcagacggaucagacagaguagcugacuugccgagcuccagauccagugagagagacagagacagagacagagacagagacagagacagagacagaccuugcaauaaggaguaugauagccacugacaaaggcauacauguucaaccucugagcuccaugugugcacaugcucacacaaaugcuugagagcgcgcgcgcgcgcgcgcacacacacacacacacacacacacacacggucuuaagaguguacagaugagaaugauucuguagcuaugaguuuaaauaagaaacccucaguuuuuuuugaaggccuagucugauaaacuacauaguuuuaauauuuaauugaauuucuacuaacuaaauuuaauuuccuauaagagaaaaauacucuucucccccaaucaauaucaacaucagucaauaaguaaaaauucucuggagucaaaaagugaaacuuacccaagacuuugucacugugcacaggcugugaucuugacucgugcuggcgugcugaguuguagguuuguggauguacaauaugggcugacugggcgaggggucgccuuugaauccuuguguguauugugacuuugcugugccacaguugguuugaucauggcuuuacucucugacugccaacuccuccuccugcuaguuccuaaguccugucuaguuuagugucucucuuucgugcccgcugguggaugugacugaaccauguuacuguguucccauaggaaaacagcaucauccucaacggcacggugauggucagcccuacgcgccugcccaguuccuccagcggggaccagucagggaguggugacugggugcgcuacaagcucugcaugugugcagauggcacacucuucaaaguacaaguaacaggucacaacaugggcugccaggucucagacaacccuugugggaacacucauuagacggugcauccgcagggcucagcgcgcucagaucugacuugaccuuccccuuuuuaagaaugcaugugaaccauguuuguacagcguuugccauaacuuguaauuauuuuaccuggggagcaccacugugucuauuauguacucuccauauuuaagggaucuugagugccuacauucuaauacauuuuaguaaguugcacugauacucaacaguucucuaaaacaaugaugagaaauuaauaaaauaaaauuaaucuuugaaguguuuuuaacauucuacuauaucuuguccuagaggacaaagggcugaagugguugagacacuccaucaguaagccuuggucauucuaagggagagauccacuagagauguuuggagagacagggacacugugcucugucuuugguuuuuaaaagggaaggcacagauuuuuaaugcauuaacccaaagcuacauuuucacaaacaagucauuaaggagcuuuccauauauaagcuuguaagaaacuauguuuccuuaguuuugcacuaaagaaaauacugucaugguauguuuacuugaaauaaugauacauguauuuacgguguguggacguuaaacgcaaucacaguucucacucucgugagcaacagaagccaucaucaucaggccucuucuugcugagcacuguccugggugcgauacacuugaucucucugacucccacugcaccucucuaagcaagggcuucgaucccagcuuuacccaucaggaaacugaaggucagcgagguucaggaugcugccccauacuauacaggguugggagucaaguacaauuccaacccagguaaaccugauuccaaauguguuucugccuuuuuuacuaucuacacugaauuuucaacuauuuaaaacucucaaagaaugggaaaaaccuaauccuaauucaccuaacagguaaaaaaacaagcaugugugcuacucuaguuaaaaugccaaugcuagaaaaacaugaccaaucacugucagacuuuaaacucucuugagccaguucuaagaugucauucaauagacagaccagcuuggucugcuugucaugugggaguaccugaaugaguuauagagaagcuggcauacuuuucccuaaacccuggggaagcucaguggaaaggggggaagcuaggccucaguagguccugcuguccagagguuguuccuccugugucccauaccagcaucacccuuuagaagaauucugugugugccuagaaauuaauauacacgagaauaaagggugcuaacuggaaagaugacgcaggucauuuuagcuagguauaaaaccuugaucucugcuccucaccucagucucauuuuaauuaauuacagcccucaagccaguugauucuuaguacaguuuauacuugauuuaaaaggaauuucuugguauuacuaagaaacaugggauuggggaugaagaauaaugcauagcuccaaagcagacaguagggaggcaccaugggccuagcuacagagaaggauguugguacucugucauggucacuuagaacuguguggguaaaaaaugagcacauaaaacaauucguguucacuguugucacaauucugucaaaugaaaaaaugaaauaccuuauagacugugaacucaggcuaaggugagaguugacuggagaccagacacuaagugcagauuuuagauguaaagaaagagagcaauuuauaccucuggauauauucaaguauuguuuaauaacuaaauaaugcucagaaaaaucacgcuuggaauucucauguccaugcucaguguauuuuuaaauuguacauuuguuucauguucuauuuaaauuuguuuugagaauuucuuuaaauaaauauuuuuacuaaauccacagaacccuauauuacaaaguauuauuuacugaauacaauucaugagaaaaaaguguauuuuuacgucugugggaaacacuuguguuuugauacaucuccauugagcacuuugaaguuugagcauauccugcugcucuguaaagcgcgugguuacuagguaugcuauuuuagacugcauuuuggguagacccucugacacacugaccugaaagcagagaagcggagcuuggugcacagugaagcggcacuguuaaaucuggccaccagggggcguaugccuucucauguguucauuucuucgguuuugaacauagcacacugagaggacuuacugcagcgcuggggaagguaggugcaggaaggacccagggaggaaagcaaacacacauuuaacagacaguauucgagaggugaauaucaaugcaaagagauagaaauaaaaagaagaccccuuccagacuguccagugagagguuggggggugggggauacacaacacaaagcaggagcuaccugccgacucggcaaccuuuuaaaauauucuucgguggcaaucuucuugcacugugacagaagcaaaauaaacuuugugugauaguuuuggugaugaaagguagaauuucuaccuguuuuugaugagugguuuguguuuucuuguuuguuuguuuuuugcuuuuuuaaaggaguuaaaaacuuguuuuuaacuugaugaagaggagaccacuaaagugcugcucaugguaaucuuuugaacgacaucaagaggggcaaaguuuacaaguuaugccacacaaaaauauaccuauguauuucagauugaugaccucuguuuacaauaaagcucugugaacuuggcg

SEQ ID NO: 2495 - RNA, 1997 nt, Mus musculus
ccuuuuuggauggggauaccaugaguacaagauguaaccagaggacaagauguagcuccgagugucucaaaaguuucaaugguggaucugccaggaguagccacuggaggauuuagauuuaauaaggcuuacaagcuuagcauuuuaguuguuguguccagcgauugaguuuccgucguuuuugaacuaaguuuguguuguguuuuccuucacgaggcggcucgucuggguucaagagagaaagguauggcagcaaagcauggguuugccugagguggaccacaaaggcuguaggggauuugaagcauggguuugguaugguagcgaccugcugaguagagagguuuuggaacacugagucagagucuucaugaaauaacaagucagccauugccggccagugaacagucuagccaggcugccagggcagaggguugccugcacuaguaggagaaccugccaguucguggguuuuuuuguuugguugguuuuuuguuuuauuuuguuuuuuguuuuuuuuuuuuuuuccaauauuuccugcaaugucccuguguagcccuggcuggcuuugaacugauucuccugccucuggccuugcuugugcugcgaugauggguauguguugcauuuucaaauccuaguugcucuguaaucuuuccccacuuucuauggccuaccauaaauaucugaaggcuggcacaugacuugaauguugagacaguuguucguuaagauguuaacaguuaaguuugaaguuuacuagagaacuuuugaugaccaugccaugacaccaagcaaagccauggcuguucugugaaguaaggacugagaaacugauauagaucaugaaucgucucguguuggaugaauucugauacuguggaaaugucaggcccaaaugcauaguucuaugcugauggccuagcucccucuuucacaauagagccauaaagcaauuuugauaaaauggaaaauacauaucuugauuccuggcacauggcuccuacaccucuggaugauaucagaaagguuacuucugacuggugguaguacaugccuaugaucccaacacucagaaaguagagucaagggguuucuauaagugugaggccagccuggucuacauacguucuaggacagccagggcuaguggcauagugagacccugucucaaaaaaaaauuucuacaugauaacgagaaaccuguuggaugggugccccccagauagauuuaggacagggacucgucaccagcagguccacagaauaguuuucuuuuaccuccccagugaaccaugcacugcucagauaugagaccauccccucacagcaauugcccuaaggaagcaaagaucugugucuugugcuuauguacuguuuugugguucacagucuaugauuguccuucugauguccugaccaacccuuccacagaggagaauuauacagaaauguuacuacaaggaaguagggcucguuuggacccgucuuggaagucacccacccagagcacucagauauauuuuccgagaagugauggacugcucugaugagucguaagcacugugaacucgguccacuccgucucaucuaccaugagaaccucgguaucuagcaaugccaaauacuuuauaacauuagugcuuucauuccgggggacuguagaugaaaguauucuacuuuuauuguaucucaacucuuaauauggguauuguaaaaugacuaugaaauuaaguaauuuuagaaccacagagaacauguguuacuaaagcucucccacagggucacccccaagcaaaaucaaggagcuaagaaaguuucuuacuucucacacgccccugcaucccuccccugcuccauugcccugugugugcacuauucagcucaauaaggagggacacuugucaugcaggguguacuuuuacauaccuugaaagugccacuuggagauaaugaucauguacaaaugaauaucucauucaaaguuaauaaaagca

SEQ ID NO: 2496 - RNA, 1997 nt, Mus musculus
ugcuuuuauuaacuuugaaugagauauucauuuguacaugaucauuaucuccaaguggcacuuucaagguauguaaaaguacacccugcaugacaagugucccuccuuauugagcugaauagugcacacacagggcaauggagcaggggagggaugcaggggcgugugagaaguaagaaacuuucuuagcuccuugauuuugcuugggggugacccugugggagagcuuuaguaacacauguucucugugguucuaaaauuacuuaauuucauagucauuuuacaauacccauauuaagaguugagauacaauaaaaguagaauacuuucaucuacagucccccggaaugaaagcacuaauguuauaaaguauuuggcauugcuagauaccgagguucucaugguagaugagacggaguggaccgaguucacagugcuuacgacucaucagagcaguccaucacuucucggaaaauauaucugagugcucugggugggugacuuccaagacggguccaaacgagcccuacuuccuuguaguaacauuucuguauaauucuccucuguggaaggguuggucaggacaucagaaggacaaucauagacugugaaccacaaaacaguacauaagcacaagacacagaucuuugcuuccuuagggcaauugcugugaggggauggucucauaucugagcagugcaugguucacuggggagguaaaagaaaacuauucuguggaccugcuggugacgagucccuguccuaaaucuaucuggggggcacccauccaacagguuucucguuaucauguagaaauuuuuuuuugagacagggucucacuaugccacuagcccuggcuguccuagaacguauguagaccaggcuggccucacacuuauagaaaccccuugacucuacuuucugaguguugggaucauaggcauguacuaccaccagucagaaguaaccuuucugauaucauccagagguguaggagccaugugccaggaaucaagauauguauuuuccauuuuaucaaaauugcuuuauggcucuauugugaaagagggagcuaggccaucagcauagaacuaugcauuugggccugacauuuccacaguaucagaauucauccaacacgagacgauucaugaucuauaucaguuucucaguccuuacuucacagaacagccauggcuuugcuuggugucauggcauggucaucaaaaguucucuaguaaacuucaaacuuaacuguuaacaucuuaacgaacaacugucucaacauucaagucaugugccagccuucagauauuuaugguaggccauagaaaguggggaaagauuacagagcaacuaggauuugaaaaugcaacacauacccaucaucgcagcacaagcaaggccagaggcaggagaaucaguucaaagccagccagggcuacacagggacauugcaggaaauauuggaaaaaaaaaaaaaaacaaaaaacaaaauaaaacaaaaaaccaaccaaacaaaaaaacccacgaacuggcagguucuccuacuagugcaggcaacccucugcccuggcagccuggcuagacuguucacuggccggcaauggcugacuuguuauuucaugaagacucugacucaguguuccaaaaccucucuacucagcaggucgcuaccauaccaaacccaugcuucaaauccccuacagccuuugugguccaccucaggcaaacccaugcuuugcugccauaccuuucucucuugaacccagacgagccgccucgugaaggaaaacacaacacaaacuuaguucaaaaacgacggaaacucaaucgcuggacacaacaacuaaaaugcuaagcuuguaagccuuauuaaaucuaaauccuccaguggcuacuccuggcagauccaccauugaaacuuuugagacacucggagcuacaucuuguccucugguuacaucuuguacucaugguauccccauccaaaaagg

SEQ ID NO: 2497 - RNA, 63340 nt, Mus musculus
ccaccuagagacgccgcgccgcuugggugccugcggcgcaugcgcagacggaucggucgcugacucuucagggucgccgccuccaccgagguuggccccagauuugagucucgcgcucuucguucgcuuaccggcggcuucccucccauucucgcgcccugggacggcgaggcuggaaaaagggguugagagagcuguuggccgccgccuuuaacuugugcguggggcggccaugucggccggcgagguggagcgccugguggagcugagcggcgggaccggaggggaugaggaggaagaguggcuguauggcgguacggaacuuccugucugucuccccgguucucucuggccuuccucccagcguuucaggcccaggcguccgaggccucucguauuggcccuaaccggccuugguuaggccgagugcggccugcucccggccuucgcccggacccgcaggcacucaccgcgcgguggacgcgggccaaggaggccgggcagcccugcgucgcccuccuccgcaccgcccgggccuccucgcuucugcgcucucuauucaugcucuuuaucgauucugagccgcuuuggugucucucuugcucaguggcuauggggugccccuccucgucccuuucuuucagaaaccgucauucuguaauagcagcuaaauaaagucagugcaaugaaacuaacgucuuguuucuugauggucaguuuguaugggaugcaccugcaaggguaccuccuugucugaaagucgugcuuuaaaaguauuaauuaaaagaaacagaugaaauacacugugguccauaaagaaaacccugaauuguggccuguauuaaggugaaguguuuuguuuuuguuuuuauuuuuuguuuuuugcuuuuuaaagagcccuguauaguccacgucauaguuguaucucgugacucuucccauaggcuuguauucgguguuuuguguuuguguccccaaauuuaaugcgucauguacuuuguuuuuguaggggacaugucugaugucugaguuuuaacuuuaagucguaaucccccuuggcuguuauaccagauuugaaaguauuuuguucuuuccuagagcauacauucuugacauaaauuucauagauuauauaaaagugaacguuagcgucuuaagcagccuuuuaguaaugaaacuccgauaaacuuguaaaauugauuauuucuuuaguggaaagacagcaucgguacuacccuuaaaaugugaaaugugugggguuucucuuagcaugauguguaaauccccuuguauuucuuuccauaagagaugugucuugcuuaugaagugaucuaacuuuggcuaugcuuguaggcccgugggacgugcaugugcacagugacuuggcaaaggaucuagguuagugcuugugaucuucccuucagauuucuauacuacuuguugcuuaagcuugguuucuuuauuuacuuuauuuuauuuuauuuuauuugguagaugagaaugaaguugaaaggccagaagaagaaaaugccagguuggugaacucucuccuguugaugucuuacacagauugcgauucuagcaaguugucuacuguuugaucauaauccuuggcgaaauugcauuuugaccaaaguugaaggacuguuucuacuuguggaccaauccuguccuguuuucuaguaacguauaggacaauuuuuugaguuauuagguacuugccaacuuuucacuguagaguaacuuucacccuuaauugagcuuagagguguacacaacauaguuggguuuuuguuuuguuuuguuuuucaagacaacguucucuguguagugugcauagcccuggcuguucuggaacucaccuuguagagcgggcuggcaagaagauccaccugccucugccucccacgugcugagauuaaaggcaagagcaacuuuaucuggcugaguguaguuguuaaauuacuaagaaaaaaaauaauuuacuguaagaauuaaaauaacuaaaaauuguugcuuucauaguuuguuaguguuuuuauagugucacuuacuuuugguauaauuucuuauuuuucuuuucuuuucuuuucucuucuuuucuuggaaacaagcucuuacugacaggccuggaauucccuuuguagacuaggccagccuugaacucaaagacaucugucugacugccuccuagagugcugagauuaaagacgcgccacuaugcuugguuuggcuguaaacuagugcuuuauauuuuaaauucauaauggaacuaguuuuugaaaggaaacuaugcuugcuacuauaccaugaacagaauggaugcuauuuuuuuaauguugauuuucuuuguuauuauacaaaacaguauuuuacagaguguccaaggaaccagacauuuacucagaaugucacuacaucuaaugcauauaaguacaugucguguuagcuuuaguuugaucuggugacugucugaaaugaugaggggaggagugaucuugaacagagcaauuaagggccagagaaauggcccaguuggggacauucaugcagcauaagauguggacaugaaugaauacauucuaggagagacuuaagacaguuaguacucacugucuacucuauuguugaacucuagguucagugagagacuggaagagggauuuggaagauaccugaugccuuuggcuuccacauggcuuccacauguauuccccccucuccccccgccccaaacacacacauacacacgaagcauuuaaagaagauuuagguuuucagaguggaggaauuaaugcuucaguccuagcaugauagcucuaauccaaaaggcaaauagcucuaaugaagacauggagaaccugggcuguuuguacacuguugcugcuauuauaaagugaugucuccuugggagcuuccucagauguuuaaacaguuauaaugaauuaagcaguccuacucacuuuaaauuagagaaauaaaaacauacaugaacacaagaauuugaacauuaguguucuuagcaucaaucauagcugguccguaaaauggaaacgaccuaccuguccaccaaaacaaauuaauagguucauugcaauguacccuuauggaaguauuuccugguggaaggaaggaaacugaguauugacuugcuacaguaugagugaacacgugacaugugacaucaguacauaaaguuuccagaauaagcaaauccauagagaagaaaaggccaguauugugggauaggagaaaauggggaugccgggugauguauacuuacuucuuuugggaggcuaucuauguacacagucuaggauuucacaacaugauuguuacacuguguacagagucuaucccuuuaaguauaguguuuaaauggguggaugugaauuaugucuuaauggagcuucuaaaaugaacacaggugauggaaauccauuacaaguaacuuccuuuguaucagaagaaaaagagauuaaaacauaggauacauggaaguaagggagugaaaguagaaauagccuccaaagagcugaaauuuuuaugagcuaauccuuaacucugaguuuuuauuauuuaacuauaauucuaaguucaguuuguaguuuguuguuuuguuuuuaguuuucuguguguuuguguuuugccugcauguauguccaugcuccgcguccaugccuguggagaauagaagaaggcauuggcuccccuggacuguaguuugggacugaugguugugagcugcugugugggugcugggacucaaaccaagguucuggaagggcagcaggagcucugacccucuccuuccucaagguucccuuucaugguacccuuucuugaguucucugggacacagaaugguaguugauuggaguuaacccauuccugccuccucugaguauugcugccuguguuuguuguugauuucauuuggaguucucugugugucucauccccguaggagggcauccauguuuacauuuuuuacuuuuuuagaaaaagcuuauaauuuuauuguucuuggaucuuaauggugaugaggaccuaaaaguucuaacguauuaugucuaauagaucggaaggaguucagacaaaauuaggauacagcuugguacauaccauugcauuacucugccuaggacccugcuguugaaauugccugcccaucgucgucgugacuggcucauugccgaagccucuguccuuaauugcauugcauugcacugaucucagugccaccaugcuuuacuuguccugcuuagcuggguagcugacuagagcaugcucuucugugcaauggagcgcagccugcaggcggcgugcacaacacgagagagcaagacuuguuucuugaucuccgcaaguuuauuuaagcaaaaauauaaauuaagaauuacaguaguacauuuaucuugaguccuguguuauggcaggaaaauuugaaguuucuauuuauaaauaucuguaaaaugucaagaaacugacuaugcuauaguucuggaaguauuuuuuggcuaauggcuugagucacguggaaaugugaauguuguauuguugaacacauuugguuuuguuguuauaaaacaagucaaauuugccuucuaaaagugauuaguuuuaaaauuaaucaaaauuagguuucaggcuccuuauuacuguaaacuagaggacaggcguccaugaagauacacauauauauauaucuugaaguuacguuuuuugauugaauaaagaaccuaucugauuuaguggaacagcaaagcaggcagaaauguguacugagcacuaaaagaguuaauaugaucauaucauagaaucucaugggcaucagggagaaaugaaacuguuauguagcccuugaccauauaacaguaguuccuggcacacagcagauacuaaguaaagacucagagguaaaagugguaugcuaugcauuauauuuuaaaaacaugaaaaacuugaauuauguccuucuaauuguaugucauuaggaaauuauugggcaagccagguagugguggcacguaccuuuaaccacucggaaggcagaagcaagcggaucucuguggguuuaaggccagccagagcuguuauacagagaaacucuguuuccaaaaaaaaaaaaaaaaauacaggaaaaaagaccuauugggcagagagcgguaguacaggccuuuaaagcccagcauuuaggaggcagagacaguuggaucucaguuugaggucagcuuggucuacaugaugaauugaaagacauccagggcuaugcagacugacuaaaaaaacccaaggaagcccaacgcuugcuuccaucugaguauguuuuacacuaacaggaaaaccgacagacuuguuuucaucacccaguagagauaauaacuuuagaaacucuuagcagugauagcuugaaaucauagcauaaucuauguacuugcagcagcagccgucaaccugucugcucgcuuucuuucuuugcagugcuaauccuccaucuggaauugaagaagaagcugcugaaaauggcguggcaaaaccgguaacauacauaucaggcuuugaaauccaguuacucucuguuuaaaaucguuaagaacuucauacuuuauuuacagauaaaaccagcauuuaacauaaccuucagcagcauguaugacuugaccccuaugucaacugauauaucugguaucauggaaagauuauguugaacuuagugaggagaaaaaaugaugggaagaaacucuaggggacauagagcauucacacaagcuugcuguuuaguguuucaaagaacuaaguaguuguagaucacagacuaugauaagugagcuugguuuccaaagccaacacugaguccacaaccuaaagcugacuguaacagugucuuaggaaugcacucugauugugauacucccggacuccgugacaguuaaaaaugguacuuuguuguucccucugauguuuguuuugauuaucuuaguccugaacaggaaaggaaacuugcuuuuuuucauacuuaaacuuauaaucaaaaaagcauuugguuaggugauaugacuaucuaccacuuuauaauuaaaauauaguagccuuuuagauccauacugaaacaguuguaagcagauccacuuguguuugagaagauacaugaugcuucuucagucacuuauguggagaaucucuucauaguauaauugaugaccaugcaaaaugaaucugaggcauuguagugucuauaagauaaaauuauuuaaaaagaacuugagaaauucuuaugaaugaaacauuuguaagauuuaaugucaguauuaaaauuaccaaauaauuagcagaguugaaaacauggagcaugcauuauucucugaaagauggcaauaaaaguucuauuucauaaacuuauaaauuauuguagaccauuaaaguuggauuaauagcuuuauaagcuuguaauuuguauucuaaaauaauuucaaaaccccagaguaauuuuuuauuuaucacuauugaaugcugaauuggauuauuuauugcauuuuauaauuguuuccaucgguguagaaagugacagagacugaagacgacagugauagugacagugacgaugaugaagaugauguucacgucacuauaggagacaucaaaacaggagcaccacaguauggguaaguggcuugcaguguaggucagagaacuuguaagagucacauucuguuugcagucugucauugggcuuggcuguaaaugccuuuagucuguggcaccuugguggccccgaguuauucuuaagugaaugcacaauuauaaagacaccaugcuuugguagucugggugauucuuuaauuuuacauucuuugucuuaacacgauaugaaagaccucacuccgguuucuacugugggugaugacuuucugccugaguuaauuaugaagaacaugaaagcagugucugguugccgcaucuaaaacaucuuugcuagaacauuugcuaguauuaguucuuugauuagaaauguaacacugaaauuguaauuuacaauuugugauaauuuuauuuuauuauacaaaccuuaauuuaggucuuuaauuuuuauuucugaacucaagcuaacauaugucuucuuggccaccaucauuuuauuucuguguuguuuuugaguuaauaauuuacugggccuucuaggucagugugcugguaacaagacugauguuccaugaacuggaccaaauaaauggacuauugccaauucacugagcacagggauauuagagggucgcaagaaaacauauucaaauaggguagaauuaagagauuuuucagauuagcuguauauaagaugacuacuaaaacuuuuaucuuugggagguuuguuuugauaaucacuaaucauuuugaucaggaugaaguggaauuuccguguuguuccugauggcugagaaugcugaacuuuuaaaaauguuugcugacaauaugagaacuguugguucauuguugauuagucugcuuauggaauagguuguaugggguuuugauauuugcuuugcuuuuagaaucuucuuccucuuccuuccuuccuccuucuuuucuccuuccuccuuuuucuucuuccuucuucuuucuucuuguucccagacaggguuucccuguguaacaguccuaacuguccugagauuaggcuagccuugaacucccaaauaucggccugccuuugccuccugagugcugggauuaaagguaugugccaccgugccuuguucuuaagcucuuuaucuauucuguaucugucauugucaugugauuuuuaucuucacucaguuguuugcuuugcuauuggaaagagugaauuucacguaauuccaauuuccauuuuuguuuuuauuuccuaaacuauuggacugguuuuuagguagaacuugcuaaaugccucucgaaauauuuuccauagcauagcaguuugguguuugaucauuuuguauauagacuuuuguugagagugagauaaaagauuuagguucauucuucugcagguggacauuuguugugguguugaugucuuuguggaagcucaagugacuguaacugugugagauuauucugugugaauccugacccauugauccaaugucuguuugugcuggugccgaguuuguucuuggcucuggaauguuucccagucagguauagugaugcuucuggcauuguucuuaguugagauagcuuugguuucugaggcccuucaugcuuucauauaaauguuagcguuauucuucuuuuuaugaggaaugucacuuuuauuuugaugggauaauaucuaucuuucucccgcuucccauuuucuuucccauuucuaaagcuaaaacuuuaggugcuauauugaguacaagaggaaaguguggacaugcuuguuucauaacugacuguagugggaccaucgucgcauacgguauugguugugucugagugccauaccgauuugccagucuaagauaguuuccuugcguuuuuaauuucuuuaggauuuuuauuggagggauguuggacugcaucaaagauuaaaauuguaaaucauaaccuuacagcaauggaggauauugaacucagagcuuuccuuugcccgugcugggcaaauaaaugcuccuucacugcagcccgcaaagaaaagccaagaucauaggucuaauuaguggaaauuuuaagggagaaauuaaauaacaugauucaugaugugaacauaaaucuuugaaguguuucuguucacuauaagucauucuuaccugguccuguguuucuucuucccacccccccaaacauugucaaaggcaauuucugucaacacgaacacuugacuuugaguuuucuacucacuaaaaagagauuuucuuccuguuguuguuguuguuguuguuuugguuuugguuuuaguuuuuuugagauggguuuucuauguaguccugccuguuuuagaacucaucauguagaccaggcagaucucgaacucacagagauccacuugccuuugccuccuggguauuaggauuaaaggugugugccacuaugcccagaaguaaacucacuuuaagaaaaauuauaccaaguccauaguggucugaguaaccugccccgaguugcacaguuaauugcauuugaacaucgguugguuuagcuucaguuauuugucacaugcauacuaauaccuuuacaaugugacuugguuuucucgugugugucuguguagucccagcccagacuaagauggaggguauugcagguguccuagaaguggagccuuuuccccuuuaguuauuaaccuguuaacacucuuuuuccuuagucuccagauuuucuuucacauuucuucuaagugccuucauuuuuaugaauggcgcacugccuguguacugggaugugaggaggcccacaguggggugaugguauuuaguggggcaggaagcuuucacugcugcagauagcuagauguuaaggaacuagggguaccagcaaagaugcuucucagaugugugcuacgauagcguauugaguuuaguaccugggagauuuuugagacggaaaaaugucagaucuuaaaaaaacaaauuaguucuugggacuggaaagauagcuuagcacuuguuuuugcagagaauuuggguucaguucccagcacuaaauuguuaugguggcucauaacaaucuguaauguuaguucuaagggauccagugcccuccuuugaccucuuugggcaccaagcacguuuguaauguacauacauauaggcaaaacagucacauacauaaaauaauauaaaacauuaagaauuauuuuuuuauccuguaauaacuaaauaacaaacuuuaaaaaucaguguaaaaauccguguguaccuguucaaucauuuucugagucgaauauccuccuguuuuuuuacuaauauguuuuugaaguuaauuuuuauucuauuuuuaggaguuauggaacagcaccaguaaaucuuaauaucaaggcagggggaagaguuuauggaaauacagguaaaauuuguauuugcagcuucaucgguaugaaaauagguccugaguagauuauauuagcucuuugcacgagucuuucacugucugcuauacacgagcagacuuccugugaaaggcaucaucucaaacaguguguggcuggcuguguuccugugcuuguuuuagaacuuuaagaagccuuucuuugcucacacguuguauaaaacagcaauguaacacaucggcauuagcagcucuguugauguuaugaccuuuugcuuuuguuuuuugaggucguaucucauguagccaaggcuauccuugaccuagcugugugcuggaaccuugccuggaguuccuggugcuccugucucauuucccaagugcgugcaugcuaggaaugugcugccacucuaggccauaaugucuaagucccaacuuuuucauccuguucaucuugaaaguuugaucaccaaguuugacuuugucuaguuuacagucaggaugggugguagagggugauugaugucuccucuuuuugucuucuagcuucuugcuaaaauagugucuuugcccuuuugcauuucuauaaaauaggaaccaaagucaaaggaguggaccucgaugcaccuggcagcauuaauggaguuccacucuuggaaguagaucuggauucuuuugaagauaaaccauggcggaaaccugguaagauuaugugguucuauuuuaauacccaaaaaguauuugugagcagcacuguaaaauacugucuuuuacagugucuuguuuauuguccuaagcaaauaaugaguacugagacuuauaucauuaaauauuauuugucccuggaauuaacaaauguagacucacauuuauuaugauaacauuucuaaaggaaaucauuuugaucaaaauguuuuuucagucuuugcuucauuguggcaauuuugagaacuagcaaaaauucaaggguguuaugaugaaugucauagaaaauauguuaauguucucuuauauauaaauuauucguaauagugaguuucauuaugacguuuccaugcauguguauaaugucuuucagucauacccacccauguguccccugcaguccagucugucacccuuccucuucggagcucacucuccugcuuucauaugugcacuuuuauauuacgcuauaauuuugaugcugccacagaguuaaaauauuugcauccuaaaaguauguuucaucuuuaggugcugaucuuucugauuauuuuaacuauggcuuuaaugaagauacuuggaaagcuuacugugaaaaacaaaagaggauacgaaugggacuggaaguuauaccuguuacuucaaccacaaacaagauuacgguaauuaggaaaccuuccagaguaacccugccucuucuccuguuccacucugacuccccagauaagucacuuucccccuaacaaggugauaaaugcugcacagcaguuuaauuuuuuuguucucauguuuguguuuauuuauauucccuucacuuugaguuucauguugaugauuacuguauguaaucagcuagcuguaggccacagcuaguuacuauuaauguggccuaucaauuaaaaauugugugguaucuuaauggggaauauguuauuuaacuuaggccgaagacuguacuauggaaguuacaccaggugcagagauccaagauggcagauucaaucuuuuuaaggugaauuuuaguaaauuauccuugguugcucucauuuuucuugagucugcucccaucccacuguucaggggagaaaauugaaguauaggcagcuacauuuuuuccaaaccuucagcuuccuggugacuuacacauuugcuuauuguuuacacuccuuuuccaagcaugugccucuauaaccugucacacuaacauaugccaaguaaagcuguugucugcucugcugugauuauagguggcacacuuguaggaugugacagucauggcugccagugcggcacucacuagauuuugcucuuuuccuuagcaacagaauuggaagcuuuucauuuucccaguucuuaaaaaauggagggauggugacaguuauuaucucugauacuaaaaucauugguauauuagcucacaaugaaggugcuuucaagaauuugagauauucucuaacaaccucucaagaauugagcagagccauugaguuuuaaaauuaauacuuaaaaagacuagguccaugugagugaugugaagccuugcaggguuagggacaucaagucuguccaaagaaaaauaguacauuuucacugcaacuuuuccugaaguuuggucagguaaucucuccuccccuuguuuugaauucuuucgucggggaccuuuucuauaccucauggccuggcuagagaacucuaugucccuuuggggacaccaaaguacugccuuaugcaaugcauaugcuauaucugcagauguagagcuauaucugcagauguagcuuuuaucugaacacaguucuauguaaagacuuuaauuuuaauuuauauccuacuauagguaaguauugguccuuguucuguuuauauuuucaaguacuuggugauauuuacuccauuuuaaaugauuaccaaccuuucaggugucugcucgggcauugaauauuuugugauaaauuauuagaacaaauacauggucaaguuuaaaaaugagcuguuucauuucauuggugguuuuguuuugucuuguuuucuuaagaagaaugagaacuuccauuauaaaccaucagcuaauacauagcuuuguuaaucuuagauuuguagacagugaaauaaguggcuggccucgcuugaaaguuguggguauauaguuuacauucaugcauaugcacacagagagagagggagagggagagagagagaaaauugagaggaagucuguguuuucugauucugguugauggauuuguucugagugaguuuuaugguuguuguucagugguguucuugccuugaucagggguuugaaugcuaguaagucuguuacaggcaaacauuucccccacuuugguuauacuguggucuguaggaaauggcggaaauaaagccauaugaaaagauacucauuuucagccaccaugcaacauugcugugaacagcaggcaaccauuaaaagguucucaagcaguagagauugugcagaucuggauuuuggaaaagaaaaugacagccaaguggaguuaaaaggucagauagggaguugacauaauaaguaguguaccagugaaacaaacagggcugcucaccauggugacgggccaagggauaggggcugcagagucacuguugaaguucuguuccugucucucauaaauauagucaaagucaagugagaaacagcccagcagccuuuugaaggcauucaucccccuuaaguuauguaagcuugaguaacaagucuagugaaugggagaaaccagccuauagaugccuuugucaucaguguuuaucagacucugauagccaggaaggaagagccuuuuaugugccuucaugggaauaggcuuauugguuuucuguuucacuuuguguugagaaggaguugagcuguguaaugcaggauggucuggaacuugcuagguagcccacucugaccucaaagucauaaaucccagagugggugcuaggauaacaggcaagugucacuaugucugucugcuuucaguuuuguuuuuuucccugugccaaguaaaaggugaaagaaacuugaggcaauuuuacccucucgauuggguaaaauaaauugguaauuauagaauuuggguaaggcuuagaagaaaaugaccauuagggaacaaaucaaccauaaccucucuccuuaccuuuuuauuaauucccuuucauuuucucaucuuaugauaucauuuuaugauugauuuuuauuuucuguugagacaggguuucccugaguagcccaagaugaccucacuuugccuaucuuccugcuucacccuccauaaugcuggagugcagauacgugucaccaucuauugguuuugacauuuucucuuuuuuuuuuggcggcggugggggugggguggggugggguggggugggaguuucuguauagcccuggcuguccuggaacucacuuauuuuguagaccaggcuggccucgaacucagaaauccuccuaacucugccucccaagugcugggauuaaagacgugcgccaccaucgcccgcauugacauuuucuuaaaauaguucucgaaccgucauguauagcauggacuguaugaauaugcaugaacuuaagcagcaguguuggaacuuggccuguugccuguggacuucacaucccagagacaguuuugguuucuuuaucucuuacuacugcacugcaucucuuagacuagggcugugaugucugucuucacucugaucuccauuucgucuuucugggagcuuucuuuugacaguuggauucuuuacuugauuuuuauuucugcugcugcuuuucauuuccaagaaaguuuucauuacuuaacaucuuacucuguuuuuuacuaucuuucaguggauuuuaauaauugacauuuuaaauuuuaauuuuugcuauuuuuuucuacauagucucuuuguucuguuaguuuuucauguuuucagcuucugauuuggacuguuuuuucaaauguucuuugacuuuuguaagaguaggcccugcagacuauuggaagcucugucucuaugacaaaagcucacuuacugugggcuuuuccagaggguugcaguuuguuuaugugcuguuaucuugaaguuguuuuccuacaaucaaucuauguuuguuuguuuguuuguuucuuucuuucuuucuuucuuucuuucuuucuuucuuucuuucuuucuuucuuucuuugugggagucugauuuucagaaacaguccagugugacuaaaagccuuggccagugaccucagacaguccuggagcuuggaccgucagcuucucugcuucugccaugagagugugguuuugccuuguucacugacuuaggauucagucugcugaguuaaguuucuucaucugcuuucagaaguaccaggcuuugugacaucuccagugcuuaggucuuauggguugagauguggucauucauuuauugcuugcagguucuccuaucuuuacccuaguauuauuuagagaucaguaauuuauauuuuugucaauuauaauuuuaaacacuuauuauuuguguuacuaaauucuuuaagaaauuaacauuguguauaugccuguguugagcagcauucacauggcacacguaggagaucagaggaccacauucaggaguuguuucucucucuccaucaugugguaccagaguaguagacuuaggucaugaggauugguggcaggagcuguuucccucugagcuucuugccagccauuaacuucucaaguuuguaaauuguaguuaaauuuuguuuagcucuguaggaucugcuguuaacuugguuuuaguaaaucagacacauauguaauuauuucucaaaaugcuagguuuuaugaagugauagccucauguucuggcuaggcagauuuugagucuaucccuuagggcagcaucuggcugugcauauagauaguuaaauucaagguaaugauucaaugugaugaggaagguugcuagauuggggaaagaaaaugaacauaauagacauggacuuuggcugccguaaugggaaagcuagguauucaguaaauaauagugccaacaauuacguauuuagacacuccauguuauuugaaagacugaagaagugacauuaaagcaaggucucaaaaucaauuaaauuuaaaauauauauacauauauauguguauauaucuguauguauauauacguguaugaugcauguguauauauacauauauguuaguccacauccuguuuucuagacauguaggguacagauuuuuauaugaagccagagucuucaaaggucuugcuauagugcaauaagcagauaguaucauacaacaaaauaaucagauaauaagaaauuuuaagaaaauagaaagucacaggagagagacugagaaugauaaaggaagucuauacuauuccaagguauagucugaauggcacaggaguccucuaauggccacugaaauccacgaugggauuccuuguagauacuggaaacugagugguacuaaacccucuguacucuguuuucuacucccacgugcaucugcauaauaaaguguaaauuuaaauuagcuacaguuagugacuagcagcaacagagcaauagacucauaaaaauuaugugacuaugcucaaaauaaagcuuguacagaaggcccuagcaaucuuagcgugugguggcuuuucuuuugaugcuaagucagugauaacuuugcugagaggaaguaauugauggcuugucuucaucgcuacuucaaugcuguuuguuuguuuguuuguuuuuugagacaggguuucucuguauagcccuggcuguccuggaacucacuuuguagaccaggcuggccucgaacucagaaauccgccugccucugccucccaagugcugggauuaaaggugugcgccaccacgcccagcuacuucugugcuuugagaacccuuuuaguaaaggaaggguuagucagaaaucagcauucugcuacccucacaguccuguuaagaucccaaacagccaaaugguuauuaggauauggaagugcacguguggauggauagacagaggggggauucaugucccaggggagaugcaguuggaaaggugaaggaauucauuauacuacugacucagcauggcuuaacuuacaaacugucagcucugggaaguucccauuuaaguuauucuagucuguuuuugauccauaauugaaacuacaaaaagcaauaacauagauugagguuggggaggcuacuguacuuuaauuagaagaaucuaugagacgaucuggagaaaggauaucccaaucaaaaaggauaguaaauucagaaauccugaugagagagacaagacaagaggaaaggcuauccuaacugagugugaugaggaugaguggaggaagaauagaaagaagcaagucuccuaguguacagcaccuucagugcccagaccguguaggccgugcccagaaggccuuccaucucauuuugguugauuugggaggcaguuggagaaccuugagcagagagagacaugagcuggcgugugggagacugcuuucgcucugugcacagguuggaaucuggaguauugagagcaaaaguggaggaggcuaucacaguagcugcuguacgcugaugacuucgaccugccugucagucagcaggaguuagagaacaccuguucgcuuuguucucucugagaagcugggugggggaugccauuuuauuaauauguggacaauguggagaggaucagaauagaggaaauggagagugucaguuugaugugcuaagaaauugaguauaacuugcugguauucaugggaccagcugauaauguuaacuguauucccaauccuucagguagaguaacguguuucuuuuuuguuucguccuuuauuaccccucccccuuuuuaaagaguucaugcuugugugcauguuuguguguuuguguguguucaccugguugacacacagaugccauaaugcauuggugaggggcagaggacagcuuucaggaauugcaucuuuccuuuuucaugggucccaggagcccauuuguaaggcuuggaaguacaagcccuuuacucugaagcgccucacuguuccuuagcccuagguuuucauggcaugaacuguauugugcgcacucuaacuauuguguucgcugagacuuucucuuucaguauucugagcuuuuaguacagaguggauagugaauaaauguuugcuaaaugaacuguuccccucccgucaccacauccuggccguuuaugugucaaaugugcaucaaauccauuuuaaucuuuuuguuuuucuaagugaugauccccauaucccaacaggaucuguauguuuuaaauuaauuugcuuuuaguaagcaguagaacuccuuuuucaauaaccucaggguuuuuuuuuuuccuccagaaaaaagaaguguaaucauuuucuuugagugauauauaaauucauuuaggaaaguacuguagugagcauguuacugaguguguacacguuaaagccauggcguaagaagcaugaugacaaacauguuucagggcaugcauaacucauggacauggaauguauauucaaagguugcaguucagauggaagaaacucuaggcauguucaucaugcaucuuaaagcuguaacugaagauaaauaaaggcugaaaauaaaaaaagguguguuaaaauaggaguuugccccuacaauuccccaccugauaauguuaaugacaccuguuccuccacgccagggcccuuuuuauuucuagacauauccuuucuuguuuccuucuuucuuuauuuauuuauuuuuauuagguauuuucuucauuuacauuucuaaugcuauccccaaaagucccccauacccuccccccccucccccacccacucccacuucuugggccugaccuccccuguacugaggcauauaaaguuugcaagaccaaugagccucucuuuccacugauggccgacuaggccaucuucugauucauaugcagcuaaagacacgagcucuggggguuacugguuaguucauauuguugauaaacgcauuuuuaaggccuaauuaauuauagguaggugccaucggauaaaaaccaauagcuaguuaauagagaucugccucuuuuuaaguuaguaaauacuuagcuuuauuuuauuaaaaauuuauuuaaugauaauuuuuaauaucuugacuuauaauuaauuaauucccccuuuccacucuuuccucuaaccccucccacaauccuuauucucaaauacauggccucuuuuuuaaaaaguuuuguuuuaugcacaacacacacacacacacguuccuaaauauaauccacucuguguguauuacuagugugcauauggccucagagcugauuauuuggcaauggauaacuaguuauggggcucuucuuuauuauuauuugguaauggauaacuaguuauggggcucuuuggaaagaccauuucucccacucagcauuucccaguugcccauaauucuuaggcugaggguugaagcuccuugagcuucuucccuucuguguugacauggccauugggauggucauugguuaagucuuguuugggcagccacgucgauaagccuggcauuucuaggagacauaguuucacuacaaacuuccuguucucuggcucuuucugccccucucuuucccucaaugauccucaagcuuugcgugcaggaauucuauugcuguaucaagugggacugaguaccacgugacuuuugcuuauugcauuugaacuguugugaugucuauaauugcuguugcugaagaaguuucuuugaaagggggugaacuacacuucucucugggcaugagaacaaauaucaguacuauaucaacuauacuacaggucaggccucaugaccagaaguugacuaauacaaaauggucuacauguuuuuuggagcgcauuuuugucuugguauuuuugucuucaggaguuguuuguuugcuuguuuguuuuuguuaggauagaguuagaauguaguuaggaauuaugcuuacuuaguaaagugaaggucuccuccaagacuggcuuuauuuccaguagcagcuguuguuuuccucuuggugaccaggcuuuaacuccaccuggacagcugugggcuacagccaugguuuacgugcugcugcugcaccuuacaguccuccugccaugcagguuguugcugugauacgugggcaucauagcuggccaggacuagucuuugcuucccuccaguggcuuuggaguuagcguaaagagggagagguaguaaggagacuggcgacugauucccagugccuggguacgcagaucuggcaugaugggugcuggcugguucuagugauaaguuauggaugugcaggggcagauuuucuucucauacaauauauaguggaacauauucacucuuccaauuaacuccaagaccauccuacucacccaacuucauguucuguuucuuucuccccuuuaucuuaacaaaugaauaaaacuccuaaagauaaaaaugccaaaacaaaaauguauaccaaagaacauguaauccauguuggucagcuucuggucgugauacacccagugacacuccacuggagaagagugauuuuccuuuucucagcagccgucagcuguagacagcugcuugguuaugggugggacuuuauguucacuuuauguucccuuucugugcugggauuugccugguuugaauuugugcuggucuuaugcaugaucucacauucuccaugaguucaugugcgcaucaguccuguucugucuggaugauguucuuggaaucauuuaugaccuuugacucuuacagagccagcucuuuguguuucuuuuucuucugcauagguuccugagccuugagggaacagguuugauaaagacaucccauuuaaggaugaaugcuccaaagucucuuacucucugcacauuuuucauucgugggucucuguguuaguucccauuuacugcagcaagcuucucugaggaggauuaagugauacucugaacuaugaacauggcagcaguauguuguuaggagugauuuuauugcuauguuccuuuagaaacauaagaguaguaaguuuccccuagaacccaugauauaccuaguucuagguccuuugcaccuuuaauggugucagauauagauuccaucucauggaguaggacuuaaguauaauaaaaaggagcuggcuacuccccuaacauuuacgccacugacacaccaguguaucuuguagguagguagcauugaacauaauaauaaggcuuauagcuuggugguauugaugguuacuuuucuccucuggucgugagcaaguuaccuuuuaugaccauaaauauucgucaguagguaugaagccuuuaguggacacuaguucaauuuccaggagaagagguucuuuacauuggcauuauagcaaaucaccgucugagauaggaaaugguuaggauggcagguaaagguugagaguacagagcagaaaagucuucacggccuucuuugaacucagaggcauggagucauaaccaugggcauccuacacucauuuacuuuacucaugagcaauugaugagucucuaggagucacaguuuauuggagcuucuaagugacaaacugaauauuuuauuuaguaaauggaaaauuuugauccuugaguucauuuuugaugccuuuccccuaaugcuaaacucacauaggucccuuuuaauaaauauccaggcuuggugcauucuucguauuuaacuucagaacagauguuacaggcuuaaaaguucuucaugcuugaugguuucuuaaauuaagcagaauaguaaccccaguuuucuuuuugaagguacagcaagggagaacuggaaauucagagaaagaagcagcacuuccaucuacaaaagcugaguuuacuucuccgccaucauuguucaagacuggucugccaccaagcagguuaguuagacugccaugucccagcguugggcucuuggugcugcaucugugcuguaaugcuauccuaaauaugaaggcucccaguguucuagugcaaaugacaacaguuugcuuuuaguuugaagucauuauugaaaaaacucuucaggaugcuuauuccaccuugaaaacaccacacacccaaguaugagaaaugaagcaugggcuguagucccagcaguccuccauacacacauggugcgcaugcucuucacugugcauagaaccugacaugaagagcccuuggacuuuuaggucgacaucuauggaccuauauauggaccuauauagauauuuuuguaaaagaagugauagaaaugucauccauaaaagucucauggcuuucuuugcuuucacauaacaccaagcuuuguguuuauaaaauacuaaauaggaguaauugugcaggaaaaaaaaaauguucuuuucacucagaugugacauuuguuucuucgugacaauggaaaugugaccaggaaacuaaagaaauccagggugaaguccagggaaggcugagguugcugccagcagcuuagucugguuuagauugagguaacaacacuggaucugaaacacgucaacugagccauuacaaauccuccaccagccuauuuaucuuuucuuacuugcuuaaauuuaaauucaaacuaccucuucauuugcucuauaguuuguuacuauuaugagaaauuauaccucauaggauacuaauggagaaagagccuaauggagaaacauaaggcaucccuaacuaaaauagucauuuguuuguuugugacagagcccuauuguagccuuggcuggccuggaccuuguuacauagacugggcugaccucagagaucugccuggcucugucucccagguguugggauuaauggcuuauguucccaugaccagauaaaacaaagguucuugaagcuuuaauccaaaaggaaacauuuaaaagagagccaaguuuuuuauagauugauacagaaaaauuucaaauguuauuugaacuaaaugaaaugucauaagacauuugauuaacuaguucauagaagcuacuggucucuuaauagauaguauucuauuggauuuggguuuuuuauaaaaggucaacuuuuauucaucaauuuucugugucuucugcuuuagagcuuuugcugugagguuggaaucuugacugagcuuucugggguuuaaguucuaacucagcgguuuaguaguugaguguccuugggcagauucucuuaucuuuguuagaagauuuccuaauugaugaaauguaauaauaauauacuucgauuauacucuagcuaugugugucauacagauuaaguucuuuaaaguguuguacaacaguguugucacaaaaacauucucuagguguuuacuguuagagugaaacuguuuaaaauuugaugaugguguuuuccuuuccuuuugcuuuccccucuuuugugggaggcaugcuggauuguaucagaucuuguagugauauaaaagcuuuguguuuuccuuuauuugaaacgaauggggagccacacugggauuuuuacccgucugauaugauuaucugacugagguuuucacgucucaauuuagcagcucuacguagagaacagcuuacagugugaaccgugauaggaacagggaucagguguaagagauugcaacaaauaucuaggcaagagauaaugguauccuggaccaaggaaaugguagaauaguggucagaauaguuagcuacuggguguaugacaaaggcuuaucaggcaugucaggguugauuagguauagacuauaaaaaaaaguuuuccucaauguauucaaggauuuuugucuugcucagcacaaauguaaugacuggguugucauuuaagagaugagaaggauuacuggaggaaagccuuuuggagagaaaagacaaaacauucaguugaagaaauagaaguugaagugccuguucaguaugaaaauggaaauggaagguuggauauguggcuuugggaugaggagaagaguauuggcucgagacagaaacgugagccagugaucacuguucaaaugguauccagagggaagcugugaaauuuaacuaagccaucaaaaaugguaaucaagaaaugguaagaggacagcgccucuaaaagaaaugaaugggaaucaguaaaagggaccagcgaggcggccuaagaugaaagcuaguguuggagugaggaacugucaaacacuagucaagaagaugaagaccaaauguguauuauagauuuucaggucugaaggucauuggccauccugaccaaaaucauguacauugaaaagguacagguaaauugaaaagacuuuugaauagcuucaguagaaacaagagauccaccuauaauuccagcacucgggaggcagaggcaaguggauuucugugaguucaaagcuagucagcucuauguaaugagcucccggacauagaaaagggcuauuucaaaaacaaaacagauacaugagagaaauuaaaaaguaaaaauaggggcaauuuuaaaaaacuauuuauuuucucugugaggucagaaccagagaaauagaggaguaugaggucagauuuauuuaagguaaaagaaauugcaauauuuucuauaucugagagugaguugacuagaaauccuaaugacugaagaagugaggaagggaacaguuguaaaucagugaagccaaaggccugcauggguagcgaggacucaguaaccugggagaaugugggauacaugggguuuucaagucucaauuuaguuuccuugcuaagaacaccgaggaaagguagaagcggagacccuuguaggaaaucacagcaaguaccuaggcaaaaaaauguaggcaggugggcagaugugagagcagugagaccuucucuuaagauugcuaacauuuuuuuccuagcaaaauaaaauacagauuacuaggagagacugaagauggcacaagaggguguuaauguuugauaagagaagaugcgaaaauagucugcgguagugaauaaacagcaggaaaugagaacaggaucuuuuggcaagaccuggaggacaguagggcacaagggcuuccuucaaaagugugcuuuucuauguugauggaaaugggguaguaaaaugaaaagccagugucugaagagagaagaagcucuuuguuuccauuugauuaaagaugagccaggucagcugugcuugagauguguucaugaagcauagcuacggugguauuccacagugauggguuaugccagguugacugugggguaacuaagggauagaguguguucucagcugauaacagugaugacuguggauucgacaggugaagacauggaagacgugcauaaugagaauugggcugaaaaaagaugguaagggacagaaaaagaaucaugugaaagaaggcugggaaaaugaguaggcucucaguucuuagaagacauggugauggccccugcagcugauggaagcacacuuagugucaucucuaguccucaguggaaaggacagugcacucagaccucacuagggacauuuguuuucuggauuugccuucaguuaaucaaaaauagacuuuuauuauagucauuguaaaauauuucccaaaaaaguauguguggggaucaucauuuuauguauauggagaugagguaaaaucuuuggaaguaauuuuuuauugagucaggggggggaagguaguauugucaggacauaaauaagauauuuaagaauagugaucugugauacuggccuaagcaguagaugucuauugcuaaaguuauagaugauugauauauagauugaugcuggcagagaccuucuuaaauuugguguuaguagaaauggugaguuuguaacuuguguacugcccagcagguuugcauacuuuuuuuucuuuuuuuuuuuuuuuaaagaaaauuucacuuuggcaccgugacugcaaagggauugagaaucucuaauuggcagcaguugcaaccugaaucuaguccccaugguuguagaccuugguguauccacaggaucaucaugcagggucuuaggccugggagacagugcccuggagcucuccauugcagaccacagggccugcagagucaccuggcagggauccuugccucucuaggaagccagcccagcccagugaucuuuccuggauacauggcuuacuuggccugaggcagcaguggggcagccaggcacuggaguaggucugggucauugacaccaaagcugaggguucuguguuuacucugucucauugcuuugcuucaucuuuauaaguuuucauauuauuuauucuuuugaaguacauaucuccagaagacugauaggcguuuacaucuugauaaggcuuuacaaauaaaauauauuauaaacuagcaaguagauuggacacagaacuuuacuacuuccuugauguuuucuuuuuuuacuauuuuguuuugacaagaaugcagacuuuagaguuauaaguaaaguguggagaacuucaccuauacaguucacuagguccuaauguguuguuaguuucuuaacuauuuggaugguaaccauuggauguauuguuuucuuaaccucuaaacacuucaccuuguauuucuuaggaacuuguauuucuuacgcaacugugaauagggcagaguuaccaaagucaggaaagucuaauacugaaucaguacuuuuauuuaaugcaccccaggucaucaguuuugccagcuauuccaauauuguccuuuauugaaguuuucuucuucuugaccuugaacucaguccagggucauuccuuugagcucucuccuuagcuguuuaucaucuagagaagccucuggccuuguguuguguuuuuggacauggugugauccaguuguuuuauagauggcuccucggucugacugccagcuccugcuuauuacucucugugcuuugagaguacugugugaaugaggcugggucuuccucagugcuccagccucaagauaaguaauccuagucugccccacuuuauugaugaugguacauguagucaguuauuaugcugaugccuuucuggcucuacagccaguucuggguccccuuuguauuuaauagguaauuuuugcauugggauguugcuccauuugagaaacacugcuugcccuagcaugcacgagguccugagucugaucccuaguaccacuuuagaaaaauacuuuugaacagaaacaaauguccuaacccuccaagaaauucagcgccugcuggugauuuuuauaauaaccaaauugcuacuuugucuguaaaucagugcuuaacuuuaaaguuuuucuuucuaguguguacggguguuuguccauauguaagucuguguacuaccugugugcgugaugcccacagaggccggaagaaaguguuggauguucuggaacugaccagguugugugcugccaugugggugcugagacucgaaccuacaucuccuacaaaagcauucaguacucuuaacuacccagucuuacuugcuuuuauuuuaugaguauuuugccagcauguguguacauguaccacauguguaucugguuccagaggaaguaggaagagggguuggaugccuugggaugaaguuauaggcgguaguuaagcagccauguggaugcuagggacuaaaccuggguuaucugaaagagcaguuagccuuaaacucgguccuucuaccucauccucucuagugcugguauugccaacaugccuaacuaacuauuacuauaugugaaagaacguguguguguguguguguguguguguguguguguguguguguguguguuucgaccuuuacuuuuuggcauuaguaagaaguuccaagcuuauguuauacuuucuugguuucuucucaagacauuuauuccuuuuaggagaaaauacugauuuaaaaugaagaugaggcugguggcugugcucauguuaaugggaugccaguuuuuauuucuagggccuccguagcauuauacagcuagggggaaagauagcaauuucaguauaaaguuuugauuaugaaacuucuuuauagccaauuugauaucacauagugcuuucuuucucagaacuaggccauaauaugucuucuuuuuucucauaaugagaaucuagcuuccaguagcuucagaauaauauucauuugaucgauaaucaaauacuaucuuaauugauuuggaauuucugcuuagccucuaaagcacacgcaugcaauuagaguucaggauuuguuugcaguucuuucuauucugcuuuagacuggggaagaacggcaagagcuuucacucgugugcuuucugugcaguagacuuauuaguuaguuauagauuccuggguuccuuuggucuguucacuuugagcauuucucuuccuccaugagaacugauccagguucucuuuuuguauguauaaaauaucgaacgcagagccaaaggcaggucuacccugugcuauauauggagcuguaacugggacuucuuuaguguuagugcagucacuucaguucccuuuguauucauucuuccuguuuccuguguaucuguugccagaaguagacuuagaaacagguagacuuuuuuuaguagcuuugaaagaauacugaucuuuuacaggauuggcaagaauauaaguagaugaacuuauuuguggcaggaucuuucuauguacccaacuugugaucucccugccucagccuucugagugcuaggcuuacaagcuuauggcaucgugccucccugaacuucauauggaccuuguuccuggagauaagguagcuuugggaaauuacuuggaaagaacuguuacuuugaaaauaaauuuuaucauaguuuuuuuguuuguuuguuuguuuuuaagaaacauaucaagaguccuccuguuaacuaguuguauggacaauacuuucauaugguuuugagaagcauaggagaaaguaguucuaguuuugagugagauuuuuaugaaauggcagaaauucuuauuaauucauaaagguauagaaaucuguuccuugauacuuauuuagacauacccuugguucuuuuuucauuucugcaacuugacuccauacuauguugauaaguauuucuaaaaauauccuagaguuauuaagauguuaauaacacaucuaaguugaagugccucuagcagucagguucacagcuagugguuaggccuggaaacagugguccuagucguaggcacaugucagcgcaugguagaaaagcaugccaaggaaaaauaaacagaagggguggguagagacaauaggauguaagaaaaaacacagaaaauuuaucucaccagaaacagcaccucuucucagucucagacaaguacugccuccagaaaagccaguucaagcguugggaaguggcaggaucgauaugggagggccgagucaccugaucuaagguaaggcuauuucaaaccuuggcuacuuccucauguuuagaucacugguauuauuugucucuuaguauauaauaagguaacagguuuugagacuauaccauacuuccccccagugcuuuuucagagugcacuuugaggcaucuugcagaccuagcaugugucuuauucauccuuuuggccuuuaguaugugauuguuacauugaaccacacucaugggugcucuaaaccuauuuuucccccuugguugcauguuaauuguuucuaugcauccuuuuaugauguuuuucacugcuuaugcaugaaauguaacuuuucugaacuaguuuuggggacuuccaaaauuuaacuccauagaaucuuucuaauccuguccagcuacagggucuaaguaagccugcuccuuuaguaaguaggucuaucagcuuguaguguuucccuuacuaauggguuggcccaugaucccaccauuuugauuuuuguacucacaguguguacaaugacagacacacacuauaauuucucugaaccuaugaaaugggacuaaugucauucccggaggauauggugagcagugcuauacacauagcaugcguugccaaaaguaguaugagagacgacauucuaaugcaugacuuggaaguauagaacaggauaacuuuaacaugcccuuugagauuuuaaauaauuacaaccaaacuagggaugguugugguuguuuuauguuguuacugaauuuuaugcuuucuuccuaugucuaaaucaugugcuaaugaucuugugguucgcuuuuaaucauuuaauugaaaauuuuuuagauacacaaauuauggcagaugcuuuugauuguaguauuuuaugaaaagcaaaggggguaaugcuaucaaaagaaaguuugauuugaauuuuuuuuuuuuuuuuuuuacccuguagaggcuuaauuauauauucuuagucaauuguaagacuuuuuaguugauuugagguuuacuauauuagaaaagaauaaguuauucaagucaaagaaaaaaguagccauucauaucaaagacaguauuuugacucuuuuuuuuuuuuugaaauuuuaucaguuuaguaacuauaauaagguaaaauuuucagaacaguuuuuguuuuuguagguuaagaauuguagggaaaaaaagagaagaggugaagagauggcucagugguuaaguuguugaagaccuggauuuaauuuccagcacacaaaguuaccuguaacuucaguuucaggcauuggaugccuucguccaugggcaccaggcaugcaugugguacacaaaacacucauacacauuaaguaaauacauaaagcccauuaccagcaaaauacaccauagcuuuuuacaaaaugaaaaaaaguaucuugauagccuugauuggcagauuuugauuauacuuaaaugagaccaaaaguuuauauguagcaucaagagaaaguugaaaauauuuuaaguaaagaaaauuagaucugauauguugagucaaauagaaugaauuuuuucauauuagcaauuacauguaauucagaauuguaauacuugugucaaugguacuucuguauaaaaauaaucuaagugaauaagcaucgaauuuauauuuauccugaccagcagcauugcuauccaacuugaccuagaggcuuaauucuggguuagcugaaagauucaaaucaaaugcuagcuugucauggaguuuuauaguagaacuauagauguagcuauacugagaacuggcauugguuaacauuuauagccucagaguccuauauacaauauuuaaaauucauuuaauuuacacuuucugccuuuugauugauuaccagccacuuugagaaggauuuucugcauuuucguuucuaagcugaaugauaaaugagucuccaguaggcauccuauacaaugcuucaucuacaugccuucccuugguuugugcccgucacaccauuuaagaugucccuuguucccauucauguacuuaaguugaucuugucuauugguucauucuuuccuacagcagcuuaggagagguuacacccauauuccugcaugaccagcuaguucugucuuuaauuugagaauaugaaaauuuguaaaagcuggggguugaagagauggcucaguggcugagcucauucauuacucuugcagaggauucaggcucugcucucagcacccacuuggaagcucacaacucuaguuccagggggucagacccccccucuugugaccauuagagacaucagaaugcacaugauguacagacaagcaugcagaaaaaauuucauacauguaaaguaaauauuuaauuuuuuaauauaaaaaauucaagugcuuuuguuuuggagacuaaaucuuugaaauguuugcuuuucuauuauuauuagaagcuguauuaugaaaaaaaaccucagcgauauaaagcuagaaaaauguucuggauuuucuuugcagaaauaacucauuugcacaguggucucuugucugcauuauacauauguacacauauauuugcuuauguuugggaccucguaguccuuccuagauagccgugcaugugcuaguuaagaacacuugcucuuccuuagugaagccucaccacuguugggcucccugauuugauccacucacgcuguuguacuucacacggcguuggauguuugaggaugggucuuugaagucccuucuguuuuuguuguagagauacugcaaguuucaucuggguuuagcgcuuucaaagcgcaugguuguaauuucugaguuacagucaauuugguaguucuaaguagccuuguugauuuuuugucguuuauuaugcuuuuuauaaugaaucacgucugauuuuaauaauuguacuuuuccuuuauaguaagcaucauuuccauuuuuaauauaauauguauguucuggguugcuuaggcaaaacauauucuuguguggguuuauuuauaauacaauuuaauaauuacuaucuaucauauuuucucccaaaaaagaauucacaggguuuugcuccauauucucauauguaaaaauguggauaauaauaguuacugugucauacauaaguuaugaguaaacguaaguaacgugcccaguuaauacaaguuuuagaauuaccagcaagcaaucugcaagcuaagguuuuguuguuaucauaugccauaaagagcugugcacuuggaauaccucugccuugccugcuaaacguggguaccuuauacauaaaauucugacagugauuagcaaacaaccuuugaccccugguugccaguaagaaauuccgauuguaucuuuguuagccuuuucaguucuuucugggacauuggaaucaucaaaauacgacauuuuaauuugauucuagagauguuuucauauuuguagaauauuuccaagauggauacugcuuaugaacaagagccuguuuaagcuagaaaacucagauauccauagugguuaguuucugucucuguuuuuuuacaauauuggugagucuaauguuaagaauugagaauggcaguagccggcucagccuucugaggagguuuggaagcccaguuagcuagccuagcuguacuguguugacaucugaggugacagcagcuccuguguagugaagugcugcugaguguucccaagcagcagccuagcauacaugaggcccuaggguuaguccucaguauggugguaggaacuugguggggacacauuucaggacuaaugugauucaguauauuuccauaauguggaucaggacuaauggaguuuuaacuuaucucauuguguuuuauguuagguacuauuguuuacuuugguacaccuaugaauaugucauaauccacuuaugaacacuauggcaaauuuauucugauugauaugagagaauuaguugguaugguuuuuuuugguuuuuuguuuguuuguuuuuugagaaaaaccuaggcgcaaagagucuuagcaauggaagugacugcuguguucuggacuuccuucugagauguguugugaagacugauucucagcugcauaguuucauaaacaugguguaugccaucuugcaucuuuugugauuauuccacuuaaagcugagaaaacuaaucugugcuccuccuuuaagguaaaguugaaagagcugcaaaccuccugucccagaaguuuaaaaaacguuuugaucaauuuugaaacagucuauuuuagacaucuuccucacugcagaaaaguuagucuuagauugagcuucuuuuuuagugagugccuuuauugagucagaucauuugcaaucuaagcugcagauccaaacaaaugcagcuuagagguuguuuguuuguuugguugguugguugguugguugguuuugguuuuucaagacaggguuucucuguguagcccuggcuguccuggaacucauuuuguacaccaggcuggccucgaacucagaaaucugccugccuaugccuuccaauugcugggauuaaaagugugugccaccacgcccggcuugcaggugagaguuuuugaugggaauaagcauuaaaacuggggaagggaaccaagucugcaguggagaauagagaguagauuuugauguugagguuuuggugccuguaaauggugaggguaguaagcauucuguuaggggguguuagaguaugugucuugguaggaagcagugauccucguaguuuuggauuagaguacaaauuggaggacuguuugcuuccccauaugugaucuuucuccucuauuugggguauuuccccaguuauacuggaggauucuguguaucacuggcuggaaagcuggcuccauggcuaagaagguuugcugcucuugcagaguacugguguuugauuacauucuguggcugugagcagccuuuaaccccagcucacugggagccaauagucucaucuguccuccaugggcaccugcacacacuugacuaaaaaugaaaauaaaucuucaaacagaacauauaucuaaguugugugcaucauucuugccgauggcuuuuugaaggauaguaggaagugaauggucugcauaaaauuagaaaggcuuaaacaguguuuuuuuguauuaaaaguguacaaaagcgaguuaguaagaaaacaugguuauuguugacauugguuuguaucugaguuuuuugcuagguugucgagucugguauagaagacaaugaaggauaucagcuuguacuugggugacaucucugguauuuuuguauacuuuuagugaugggcucuuuauuuuuaugguauaaaguaaugauuacuggaaacaaacuugcuaaugcauuauauccagaaaaguccuagugcuuucaaaagugaauuaauuaccuuguuacaaggaaguucauggaauuaauuuccuuguuugaaguccauagcucauggaguuaggagguuuuaggcaugaaaauugguuuugcgguccaauuauuaugucaauuagcugcacucugcacuuugaucuuacuguauacaaaccauauacacuuguuuuguuugcuuuguuggguuuuuuuuuuuuuugaagcuuuaauggauuucuuugaaggaguuggggauggcuuaggcauagcacuauaagcgucuuaaaaaauagcaagcauuguuauucauauguucaucauuucagaucuugacuugguagcuggaaacguuauauuccauuauuuuacgucuaugacauuuuaaacuuugaauuguuaggacuggaaggugaaaugauucuuauauuuacuuuucauagccuuuuucuguaaguggguccucuuucuugucaguuuggacauauaagaggcuuuuaaaaguccuucugcaacuacauaauagugcuuauugaaaaaacaaaacaaacagaaguaaccuacuaagugcuccggcuaagucuuuagagugcuuuaugguagaccauuuaucuuuaccuucuccagcguugggagguuauaaacaccaagugcagguaaggcaggcuauccguguuuaucaggagucacuagagacgaaaaacuuggcuuccguuuuuuuuuuuuucuuugauguuuuaaagccugaacuacaucacuaaagagaauggcguaugugguauauuugaguagaaaaauaacuguuauuucuucucaagccuuuuuugagaacuuuaagugaggacuagaauuauauuuguuggaaugguagugacuaacaaaauuuuauuucagcucgucuagcagucacuacuaucugauucuaguccaugaagauaaaaguguuuacaaacuacuuuaauaaaauauuuuuuaaaaaaaugauaaaguagugagacucuacuucagagaaauucuuuugauacauuuuuauuuuaaaaauacaucacagagaguguuuguuucuuaauguuuuuauuauuuuucagucaucuaguuagaggaaacagaauugauucagcuuuuguguuucaggagauuaccuggagcaauugaugucauuggucaaacaauaaccaucagccgaguggaaggaagacggcgugcaaaugagaacagcaauauacagguuuccuaucugaaaaccaacuguucugcagagagagagagagagagagagagagagagagagagagagagagagagugugugugugugugcgugugcgugugcgcgcgcguguguacccccuaccgcuaggcuaugucaguugcuuucagugcuacagauagauuucaaauuauuuguauuaguuagaaaaauuuccuauaaucgcuuaacuucugcaagugaaguuuuccuuugcuuguuuuaaacauacuauauaagcucauugaaaaguaagagaaaaaucaccuagaguucuaccaccuagauguugucaauaaaguacacaaaaugugcuuuuuaacacuuuuaugcuuaacacaaaaaaaaucuaucuuagaauaaauuaucuuuaaagguagguuuuuuguaaaaauagaacauauuucuuuuucuuccuaccauuacaaugucauaacuuuuuaaaaucaauuccaauguuaauagguuaugaguagaacacucaaaacuuuguuuacucaaauguagaaaaaucuuaguuaaaggaauuauauauuuaaauacuauguuuuuaguaagaauucaagacucucaugcacaucagaauccgucaggugaccaguagaacuccguuuguggaagccacauuccuguauuggcuuuaguaagcuugagccguccugguguuuguucucagccagucacacaggcaacacuggacucuuuuccaggagaacuucugcucuuagcagaggcucucgugaaaaguuauuuaccuuucauaacuacuuguucuccaccugcuaccacauacguaacacuuuacuagguggugaaauuagguccucagauaccuagccuguaggcaugugauugucucagaguuagaucucuacuuaugagugcuguaccuaacuccuguacuuuuacuuugucugcgaugaccugcuuuguuguguuuguuucuaacuugaaauguuuugauuacuucuuacuggaaaucuugugguagucuaguucuuucuccuaggcuuugaauaugaacauuuuuaacaguaggugugugagucuauacucauauaaugcacuuacaagcacaaucacauaaaaauauuaccccuaaaagugugaggauuaaaaccauuuuauuugacuuuuuagguuagaguaagugaacaagauucaauuagauuagagcauuuacuuaucuuucuaauuaauuaugcuuuaauuuuagguccuuucugacagaucugccacugaaguagacaacaauuucagcaaaccaccuccauuuuucccuccaggggcuccuccuacucaccuuccuccuccuccauuucucccaccaccuccaacugucagcaccgccccaccucucauuccaccaccagguaagacgugggagaggccuuugcuuaacuagaguuucuuaaacuuggagcugaaaggugaacauauauauuuggaaguacuauuaugauuaauuauacugcauuaaaaguagcauuuuaucuucaguagauucacagugaaucuuauuuauucuuauauuuguuuuuuauuauuguaucuuguuauuuuagccuagcagaaauaauauuuuaaaguagagaagaauaaacagaugauaauauugaccucaaaauauaauaguaacuacaaacugguuugcuagucauauguggagaaauccuuacugaauuauaaacuauauguagacuuguauuuaaaaaaagauuuuaaagucacuuuucgccgggcaugguggcgcauaccuuuaaucccagcacuugggaggcagaggcagacggauuugaguucgaggccagccuggucuacaaagugaguuccaggacagccggggcuauacagagaaacccugucucgaaaaaccaaaaaaaauaaauuauuaauaaagucacuuuucgaauuagaauagaucagaacaaugauaccucgugaaauugggaucagucuggucauuguuuccuugcgaugguuucuguuucagagauggccauugagugcuggguauuuaaugugucuucuuuuaaacaagaagaauaaaucuuaucacauuuuucacuacuaaggauaguuagaaaccaaagcaguagugauaaaaaaaacgucugcaaguagacuccacagcucuccuggcggucuuucucagcucuugcggcaaguuuucagugcuucucgccucuaaccagcuuuuuacaacacuggcagguugauggagauacagauuccauucuuccucgggagagugccaacaguaaauggugaacauuagcuucagguucuugucuaauuauauggaaacaugcuucagaauuuuccuucucauagugaaauuuacuccuuucugaagacccagggcucccgcucugggauugggagugagaugucccccuguaaggugcaggugugaucacagaguccagggccagauugcuucuuccccaauauuuguucugacuuacaaaugccaccuacuccaucugcccugugaguccuuuacugucacuucaacucucaaguaagcugagcaauggucuguggcuuuagaaaagucuguuaucuuggaauagaaggcagugcaguaugacagauauuccugucucagauguugucuguagacagauggagcacagaacagucccaaguccaguuccacuggaccuguaacucuugagucuuguugagaauuaaucaggugaaagggacuugggugauucauagugaagacacaaaagugguuccuuagucucugaaaaaauaaaguaagauguaaaaauaguuaauuuguuaauaugcucagcuuuacugguacuaaaguucuugauguuucuuuuugaaacuuuaaaaaucuuuuuaaaaguuuacuuuuaaucaacaaauauuauauauguuuaugggguacaaugugcuuucauuuauguauuuauauuauggaaugauuuuaaguuuauuaacauacuuuaaucguuucacauacugaacauauuuuauggugggacuucuuaaaaucuauccauucuuuaaagauuuuaaguuuaauuauguguaugagugugugugugcgugugcauauguguucagauaugcacagugauaagagguaccugcuggagcuggaguuacaugcuauugugaacugccugaugucagugcugggagcuagacugagaucuuguggaagagcaguauguccucuuuacagcugaaguaucacucuagccucaaagucuauucuuguagcuauuuugaaauaaguaguucugauaggcuguagucacugcucuccaggaagugucuaagacagaaacucugcacccuaguauauagcauuuuccauuuccaguucucaucccagggcugcugacuuccauucugcucugcauuucugaguuugucuccuagguuucuccugugaguucuuucauucaguguuugacuccuugugccuguuugauucuccuagcaugauguuuuccagaugcacgcaaauuuuuucaagaaaacaaaauaaaaaguucuuauccuccuaaggcuaacauuguuuauguaguuggccaaugaaagcaauaaggggaaaaaguaugaguugugaagaauacuuuguuguuacaaaauacuaggagacuguaggcuauugcugauaggcaauggcauuauauggaaauuuauuuuuuauaaaacagcagaauuucucucauuucuuugcuauagugcccucguuuauaaauuaauaauaauaagucuuagccuggaaggauggcucacuguguggaggcgcuuguuacuaauacuaagcccgaugaccugaauuugguucucaugaucuacauuugaaaggagagaacuuggaccacugaccuccacaugacuauuacccugucccauucacaaaauguaaaacacacacguauuuauguaauuuucauaaaaauaacaaguccuugaaucugucacauuguaauauauaguaucauuuauuuuucugaagauuagucuaauuauauacuaaaugcuccguucccugcuuuuuauuuaauuaguaucuaaccaugguguguuugcugucuagaguuaucaaucuauccuagaguauuuguuaguugagaccaucugaauucccccuuauuuuuacuguguguguuagugugaggaguauaaugcgugucagucugugucucucucacacagugcucggcuuguguacacuuggcauuccuucccugagcaugguagcugauuaaacuauaaacuagcuacauuuauguuugcauuccacaggagaugacuuucugcuugccagguaauucacucccucagccuugcaccaccuaugccaucagauguguagguacauagcagcuaaaguggagcuguauuucaguugcuguuugcuguagaccauggaggcacuggccuguccccacuaauuuaaaggacuguaggaucacaggcaccucaggaaggaagcugugugggguaggggcucuuuagguaucaccuguugaaagauacuauguauuucuuacacacuguuuuuaugcuuucuuuagaaauuuugaaauauaaaggggaaagcccuuuugagacuuucuuuaaauauauuuuaauguuaacuuuucuuaaaauuauuuuuuuuaaauauaaugaaacagagaaacugaauauguccauauuuuuugguuguuaauaauaguuuuucuuuuuuuuucuuuuuuuuuuuuuuuuuugguuuuuugagacaggguuucucucuguagcccuggcuguagaccaggcugaccucgaacucagaaaucggccugccucugccucccgagugcugggauuaaaggcaggcgccaccacgcccgacuaguuuuucuucuuaagauaauagaaagauugcauaucuagauuuacuuugaacagaccuaacuuacaccuuuuaucacuacauaacuauuauucuugcuuuggaaguuaauauuuguagucauuucuguguggagguuuauagauaggauucauauaagugaauauucuuaaauaguucuuaaaauuaugagcugaaaaggucuggagagaugggucagcaguugagaacacuggcugcucuugcagaagaccugguuuuguuucccagcaccuaugugguggcucacaaccaucugugacuccuguaucugguacucucuucugaccuccaggggcacuggguaugcaugugguaugcauacauauauuuagaugaaacacccauacagauaaauaaaucugaauuuuuuucagaaaauauaagcugacaggaacaguucuaagacauagucaaauaguugacaggaaguguauuguuccucuuuuccucaaaacauucaucugaacacauguaugaaccucauucauugaaugaagaguagaggaggcuacuucagacaaagacagaagagaccucugagaaugcuaauguuuuuaauauaaucacauuaguaguaacaugaaaacaaauagugauuagucauggcuucuguaauuaaagaucugcucacugucuaacgaaucaaaauucuauucuguaagguuguuacaggaacacauuaguauaauuccgugcucuuccaaguaauaguggaacacuaacuaguaucuaauauguugacugcuucuuuucuuaaggcacugguaugaguacagcccgucaacaaccuaacccuguaaacuuauuuuagaaugacacuugaaguggauacuagugagguuucaaaauuuauccaguuaacuugaaaauagcagaauagagaaugccagauacuuuucuggccugauuucuuuguuaaccacauugaaguggguauguaccuacuaagaaggcugucauaggauuguguacaugcauagcagcaucuuagaagacuuuuucuguccucagugucaaguucagagaucugggagcuuguaagagcagaauuagguguucuuucauccauucaacuaaggugucauauccacuggaauugcauuaucuuaugcuuaacugacagguuugaaauaauugaaaauuagaauaaaauacuauaaaauuacaaugauugguguuauugacuaguuuauuuuguauggcaguuauuggugucacacauaugaaugagcucauuauucuaaccgguugugacucauuuaucuaguagcaucacuaccuaaaaccuucccagcuccccauuucuaccuguucaagaguaacuacauucacccccagauguuggccaucucuguucuacuuucuuucucugaguuugccuucucuaggcaaauuuugacucuauagaggagucaccuuagaauucauccaguggggcuuagccuaauuuguuucuaaaacagaagaauuugauaguggugaacuaauuuuagggaaggaucauaauuuacacuuuuaaauguuaauuagcuuuaauguuauauuuuuguuuuauguauauuucaaagcuuaagauggguuuuuaauguccuuuuuuuauaugaaugcucaaaucauaauaucuguauguagggguagguacacacuugccugcuuguaauacuguggaagugaaagguuaacuucaggucucuuucuguuguccucugccuuauucucugagacagugucucaccucuuacugaaugaaccuggagcuugagcucugcuaggcuggcuggccaguaagccccagggaucugccuguauggucuucuccuaccccagccucgacuacaguugcagccuuugugcuccacuuuuucauggcuguaaucucaggucaucaugcuugcacagcaagcacuuuaaucaccaacccuugcccauaacaacguuuggaaggaucucuagucgauguuagccucagacuccuggcaauccuccugccucagccuccccagguguugagauuuuaggugugugugaguuccacaacuaauugguuuuuuuguuugcuugcuugcuugguugggguuuuuuuguuuccuuuuaaaguggggccuaaguagcaaagggugacuuuaagcuucagacccucuuguuuccaccuugagagugcugagauuucagauauacugaaccucacucccaguuuaugggauucuggggaccacauccaagcuuugugcaaguacuagaccaagugagcuauguccucagccuaaauuguuacguucacuguucaguuggcacugcaguuuguagaguuuagguuacgguuuuaguaucugccuuucuuuuauucugcuguuccaguaacaucaugaguauagaagagcugauaaaaaucagcuauaaguuuucuuuaaaguauugacauuugcaggauggugguguuacguuuaaucacagcaauuagaagggagaggcaggcggcucucugaauuccaggcuagccuuguccaagacguccagggcuacauggaaacccuguugcaaaauccaaaaucaauaaauuaaauauuggcauuucuaucaaauaugcuugaguuggagauagaacuuuauuuucugcaggaauuaaauuuuaugaguuugaugauugagugauccuaaaaaauagagguuuuuggauaagauaugcuggaaacucgaucauuuacauuuuguuguuauagcauuuuauuacauuuauuuuaccaugacuuuucuuaugcaauuuaguugguuuacucauuaaaaacaaauaguagcucauaacauucuguaauguucaguauauguuuguauauguucauauucuaauuuguaaagcauuucuguuaaauauuauucaaaaaaucugcacauucacuuauugucuuuauccaagccucugacuuuggcuuaaaguagaaacaggaaaccuaaguuuugauuuucuagccuuauguuauacuacugaugggauuuggaauuagugagaaacaggaagcagaacucauauaaugcugccggguuuuuaucuuuguuuuggacuuaauaaaagauagguaugcauuauguuuucuuaaagauuuuauuuauuuaugcauauuuaauuuauuccaaauaaauauuuaaugcguauuuaaaauguauuacacauaaaugcauagacauacauaauuuaaaauacauggauuuagauuugucuuagggcuauacuguaugagguaggcacuuuaaguaugcuauuuuauagaggaaacaucuacucaggaucuauauaaacaauccuggguguuccauuuuauaugaagaaugagcucaucauuuuauauuaagaccaugaguggucagagcuggugcagacaccaugaccaaugcaacucuguuuauuuguagaacaugauuuuaauauuuuuaacuguuaauauucaaaagacagaauaauuauuuuaagauauauuucauuauuagggcucccuuuucauuucugauuuuauuauuuuggauacugucucugcccuuugguuaaucuggcuaagaguuuaucuaucuuguugauuuuucucaaagaaccagcuccugguuuuguugauucuuuguauaguucuuuuuguuuuuauuugguugauuucagcccugaguuugauuauuuugcgccuucuacuccucuuggguguauuugcuucuuuuuguucuagaguuuucaggugugcuguuaagcugcuaguguaagcucucuuaaguuucuuuuuggaggcacuuagagcuaugaguuuuccucuuaccacuguuuucauuguguccuauacguuuugguaugaugugucuucauuuucauuaaauucuaaaaagccuuaaacuucuuuauuucuuccuugaccaaauuaucauugaguagaguauuguucagcuuccauguauaugugugcuuuccauuguuuuuguugguauuuaagacuagccugaucugauagggugcaugggauaauuucaaucuucuuguaucuguugaggccuguuuugugaccaguuauauggucaguuuuggaguggguaccauaaggugcugagaagaagguauauucuuuugcuuuaggaugaaauguucuauaauaucuguuagauccauuugguucauaacuucuguuaguuucauugugucucuguuuaguuucuguuuccaugaucuguccuuugcuguagucucugaagucucccauuauuauugugugggauucaauguguuuuuugagcuuuaguaguuucuuuuaugaaugugggugcccuugcauuuagagcauagauguucagaauugagaguucaccaugguagguuuuuccuuugaccaguaugaaguguccuuccuuaucuuuuuuugauaacuuuugguugaagguugauuuuauucgauauuagaauggcuacuccagcuuguuucuugggaccauuugcuugggaaauuauuuuccaaccuuuuacucugagguagugucugccuuugucacugagguguuuccuguaugcagcaaaaugcuggguccuguuuacauagccagucuguuagucuuugucuuuuuauuggggaauugaguccauugauguuaagagauaguaaggaaaauugauuguugcuuccuguuauuuuuguuguuagagguagaauuauguuuguguggcuaucuucuuuuggguuuauugaaagauuacuuucuugcuuuuucuaggguguaauuucccuccuuguguugguauuuuccaucuauuaucuuuuguaggguuggauuuauggaaagauauuguauaaauuugguuuugucaugguauauuuuguuuucuccgucuaugguaauugugaguuuugcugguuauaguagccugggucuggcuguuugacaucugaccaggaucucuaaacugcugaggccuccuucucuagcccuuucuucucuguuggguugugggcuagaguuccucacuggcugugguucucaacaucuaagguacuaauagaaagagugccagcagaugucucuuucugccuuuguagccuacucauggcuuuggccuuggggggggggggugucuuuuuucuuucuuucuuuuuuuuuuuuuuuucuuuuuugcugguguugugaugucuguguaaugaagucccucuuacuuaaaagaggauucaaaugccagaagugugcgaaggcauuuguaccaggagaaaggaauugugggacugugccagaagcugccuagcauguuucuacaaauuccuggugaaaaugaauuuacuuacaaucuucucuucucuucucuucucuucucuucucuucucuucucuucucuucucuucucuucucuucucuucucuucucuucucuucucccuuccccuccccuucccuccccuccccuccccuuuucuuucuuaccuuuuuuuuuuuuuuuuuuuuuaaaugugugucuucagaguauuuuguggaaauuccugauacaggucauauuugucuuucucuuuugcuauuuagcaggaauaccgccucuuuguuugccucaguucccuagguggaauuuuagguccuucccugacucucuuuuacauuuaggaauagucaugacauauuggaaaagcuacuacauagcuacuaaauacucuuucugugugucuguaugucuuuauccuguuuacaaccucccccuuuucuguugucugacaguaguauaaauugucauuauacuuuacugucaugugucaaugccuuuguuucauaaaaguuugaaguugauuuuaauuuucagcuguauaccugagucucucaaaaguuaagauuaguagaaguguggguuauaauccggagucuggucucagcauaacaaccucaucugaggauuucuuuggaaugcaguuuuguguuuugcuuuguuuuuugccuuggccauuuugaaugagaaagucuagaaugucucagcagucacacuguaggugauucugaugcaaggaaguucaugaauguggauggaugaucacuuugugagguuuuuaauagacuacuguuacagacggcuuuccaggcaagucaucauuuuuucagauaauuaaaucuagggcuagagguggugucaccaccuuuagucucagcacuuagaagucaaauacagguagguaucuaugacuuccaggccagccuguuucccuagagaguuucaggcuagccagggcuacauugucucaaagcaaaauaagacagacagacacaugcaacuauguauacauacauacaugcauacauacaaacauacauacauacacacauacaaacauacauauacauauauaacagaagcaaaguacuugauuuguauguuuaagucuguuggaguuguccagggaaggaaagaaagggaguuuuggaaggaauuuucugucacuuguuuuuguuuuuuaaaaaguuaaauacuagagaucuuuaaguuaaaauguggauuucuauuguagacaaaaagggauuuuugucacuuauuuuguuuuuguuuuuuaagaaguuaaauacuagagaucuuuacauugaaauguggauuucuauuguauuaguuauuaaacuuccuuaauuauugcuuggaacuguaucugguuugccaaggaguaucuucaucugcuuucuaguccuuuuccacaaccaguuguuuacacugaaguaaaaccuuacauaaauaaagaucucccuuggaaaagcccuuucuagcauacaagcuuucuauuguagaggcaccaguuggaaagacaacuggauauagcguguuuuugguuuuuuuuuuaacucuguucuuaguuccagaugguuaaaaaucuuuuguaggauauuacuauaguaggauuaaaauuaaaggcagauaauaauuguuuuagguaagguuucuaaugcugugauaaaguacugugaccaaaagcaacaggaggaggaaagggcuuauuuggcuuauaauuccacaucauauucuaucaccaaaggaagucagggcaggaacucaaggcaggagcugaaguagacuuuacuggcuugugccuccugguuugcucagccuuuuuucugacacaacucugggcccucuucaggguccccaccaugagccaagaucugcccacagcaaucauuguuuaggaaacuguuggacagauuugccaguccuauggagacauuuuuucaguugagacugucuucucaagugauaccagcuugugucacuuuggcauaaagcuaaccaacugcuucuggagaaaaggucauguggccacguaccuucugcacuuguucucaccacuuaacgugcuuuugaggaagacccuugacuagcaaguguuucuccccaccccccaacacaaacacacaaauucuccuuuuaguagguuugguuaaaguacugcuugcuacucauaaacauguuuugguaacguuacucaguugauaguagcacagagagggaacuggucuagcacugggcuacacauuaaaaacagcauagguacauucauguauugaaugugaaaacaaacucaguaagguucaauagaguuauuuguaccauuguaaagaauauauauacacucuucucucucccuucuaccuucucucauuuaacuuugcauuugggauucuugguucucuguuagauccuuagauuucaaugacaugagaagcaucaagauaaaaccuugggguagaugaaauuguguuugcuguggguuggcuuuguagguugcgauugccauagcugccuuccauaucuuuucaugguguuugaucagguacuugugucuguggugcaagaccaugugcugucuuaagcucuuacucaugaaagccucacuccaauaaaacaugucugccagagcaauuuaaacaagcuagcagcagacuucucugcucaugaaaacauuugaaaaugcuucuguucacuugcauacagcuaguaagugaauuugauugcccccuccucugagcuauuuugacgcagguuuaaagauaggauuuaauaaaacugaacaauggaguuuaucuauaauauaaaacuuuuaaugagaagguuguuucaaauuuuuucuuguuuuguuauuugagaucauuauuuuuuucaacuaaaaguaguuccaguuugcauguuggcuuucauguauuucuuaaauuuuggacuuaauuuuagaugcuuauuacuuaucaggaacauuugaccaguguaaauuuagaauguucauguauaauuuauuucuuaauguuucuaauguuuacacauaguggagaauacucaaauuuuauuuugcuaacaccucuaaaaggcagucaucugucuaugcuuacauuaguguauguuuguguaugugugugugcgucugucugucugucugcccauauaaguuuccuguacccuuucuacuuccacaaaucaaagaaagcauugacuguuggcuccugguuacagcaguaaaacagguuucacacuugaguagcccacacuggccuuuucaaaaguggaugauagccugaaucuuucuuucccugcaggauuuccacuaaaauguuaagcuaacaaaacagaauucccgugaccaaauuuaguaagcuuuucaacguuauggaguuugauuuuguguaucacaagugugcuuuuuuuaagugaugugccuucuaacuucauuugugauuccaacuagugggacaauccuguuauggaguuguuagacugguuuuucaucaggaaaguuggaugcuguauuugaauuguugguucacaagaaaacggagcgccucucuugagugcuaagccaggacccggagucggggguuuuauuucaaaguuuguuuuggugauggcauaaaaacauaacagguucugaaauccaguuacuauauuaaauuucaucacuuguuuuuuagguauuccaauaacuguaccaccuccagguaaaaccuuuuucaugucuucuccaucauuguuaaugaacaugaaauuucaagcuuauaguuacaggagugccgguguugaugugguuagaauguacacuagcucaccgggaucucaagguccuauuuucagcucugccuuugcuucauuccagcacuaagacaguuuaguuuucguaaacuugucuuacccaugucuauagaguuugaaauucucaccuuaacaaucugugaggaaaaugguagaugauguaaaguaaaauugcuguuugaaaagccuuuuagaucauugacuuuuauuauauguaaaagugauucaaaaagaaaagaaaaaauuuaucuugacuuuaucaugguuucugguuguuuacccacuguuauaauuucauugucaugagaaaauacguuuuagagcacacagcaauuguauggcuuaaaaacuagcugagcacuuguucuuagaguggugaauacugggccuugggaugguguagucagugggagcguuuguguagcccagccuuguccuuuccauuucugucaguuacuucuuacaguguaaugguggaaagauuaguuacggaguucaguguaaaaaccaaggagugugaagaaagucaguagugauuuugcugaggagagugggucucaauucagaaugaccuggaugagcagaaaaugaaguuuagauugcaaagguuaguuccaugccuagccaggacacagucacugacuggauguggcugagaaaaggcugagcagaggaaggcuaagggacuguuguaucuguagucugaaagacagucuggcugugaccugugcugugcaugacguggacucgaggacuccugcuguaacugccaagccugggcucgauugauguuaguagaagagggacagagugacaagcauaguaaacuuaacauagucugaaaaggggcuaaagagugauuuacugaagucugagaagaaugagagaacugagauuuguguccccagagagcacugagaaggaagcauugaguuaucaggaaaguugccaguaaguagaagauaauugggguauaguaauggacuugucuccaucaggacgugaaccugagggcaaaggauugaaacuguugaauuugaugcauuuccuaauaguggagguuguuaaaaccuggggaaaaaauaggucucuugaguuguggaacugugaagucuugcuugggcuguggugcugugucauacucugaaaguauagaggagaugacaugcugagugaggccccuuuuagccguguuguucugugccauuucauguagcuaugcaagugauuuagggugcugaccacacaagacaaaaguacagauuauuugccuccagacuaaucaaaaaauuccguuaugugccuugcuuuguaaaguagucuguuggguuguguuauuuaaagaacauuucaugucagauuuuauugcuaugaacacauauauuuacuggcuagauuuuauuuacaaauuacaugcuuuaaagaaauuucuauaaaucugaaacucugaauacuuuuaaaugagguaaaugcuauuuuauuuguguuucuucaaaacauaaucugauggcaacacugcuacuguauauuuuauguggaaaagguaaggcucugaaacuaacuuucuuagacagacaaaaugggcuguguguggugcugaaaauaagaccggguguccugacaguuugugcucuguguguuagaccagacuguuaauuaacaacguuauugcucuaaaaaacuguuuauaaguuucagcuuuauguuuuccuguucguuaugacguagugaagcacguuuguguccucagaaaauauuagugauacucagcaacuguguuucacucuuaauauuacauaugcguccuguuaauaucuuacuuuugcuugaauguuucagguuuccccccuccaccaggcgccccaccuccaucucuuauaccaacaauagaaagguaaagcaguguggugcucugacuuguugaucacugacagccuugcagcagaaccuuacaaauaugccuuugcuugcauuuucuaauagauauagcaccugucuauacauaaguuuaaucuguauuaauuacuuuuaugaaacuauauccuaauaucaaaacagggaaaagaaaaugaaaaauaguuuguuaaaaauuauuaauaauaaauguuuaucuauuggaaagaggaaagaacaacuguuacuguacuguaauaaaaagaaaagcugguuucuucccacuacccugcugcaucucugcuuccuuauggacugaccgagcuguccccuaaggcaguagccuuauuuucuccugucuuguacuuaguuuucuuagccuccuguauugaagaguauuccccccgacaguuuguauuuaccccuuaggauuucucaucagugucgcuagcuuacugucucucuagacuucauugugaggacuagaauggcgcacagcucagcaggcagaacucacuagugaacggcagcuauuccauuacuucacucuugaguguagauagucuaaaaagucauagucaaauuauguaaaagcaaaggaaaauuggcuucacuuagucugguggcaucuagccauccguguaguuuucaaagugcugcuccaggaagcaaauugugagaggugaggauuuaguuuucaccauguucuuauuaaacacacacuuguuucucagucagaauguucuaucuaauguacuaauuacugaggauuuauaacuuagagucauuaaacccaguuuuuuaagauuaaauuuuaaaccucaaacauuucuuuagucucugauugucccugucuaucucacugagccagcugacauugauugcaugaguuaggcugaacaguaccagcaaguagcuacugggucuaagguuuugagguaaaaaaagucuaugcuauauuaaaaauaacaagaccuuguaacagauuuucagacuuaauuuugccuggcucuccuuuuguuuccacugaauuauuaagauugaauacauauuugcauuagauauaaagauaguucuuuccuccacaguggccauuccuccggguaugacagccguucugcacgagcguuucccuauggcaaugguaaguuucucaccacccagauccacugccaaucagcagaauacaucuugguacugaaauagaaacauguuuuuauggcuuaaguuagcagagucacuaagaaauaguaguugaaagaauuaagucuguagaucugacagacugcuucagaagccuggucuacaaagugaguuccaggacagccagggcuacacagagaaacccugucucaaaaaaccaaaaaacaaaaagaaagaaaaaaaauuguggcacaauagguauugcgagcucagcucauccugaagcuguuuuggauuuaucucagucucauauauguacacauacaugaauuuuuguuguugcuguugcuaaaaaugcuagugaugacucgagcccuuuggugaguccgucuuuuugauugugaagggucuugcuuccaucggggugguagcuguuagcuguggcaauaucuuaauauuauaguggaguuuccuguauguugcaucuuuuaugaaggauucuccuguaucaaugcgaugcuacuugaugguaccuuucucccagaguaggaugacuucaaccucucauagacugccacugccucaggaacuaagguuauaaugcuauucuagcuccacuugaguucucuugccauauuccuuucugcggguucuuucuccaaugagguccugagucccugcaguggauacugagcaggucaacaggugggagaacaacccuguacacaguuuuuaggugaaacccacucccaaagacagacacgagcaucgugagcuugucucaccguguggcaugaaagagagagaggcuuacaagagucuggauuagauggugucugcagcaaagaugguaaaugagagauccaaaacuacucguugggugcccauuccuaaauggacaucugagucaccccuggaagggucagacgagguugggggagguaggguggaaugagcaaagaugguaaaugagagauccaaaacuacccguugggugcccauuccuaaauggacaucugagucaccccuggaagggucagacgagguugggggagguaggguggaaugcuguaaagcaccgccugacauggccauugcacucacacaugaacuuugaucaaagcgaauaaccaggcccaucagcauuccauaagaggccccaccuuacccuagggguauggaugcagcuggucacucagcuagggggaggcauuucauagccagcaguaaauuauccacuugccugugugccuguaaauaauaccccauccaugcuacuguaagaaauucuaguuaagccgggcagugguggcgcacgccuuuaaccccagcacuugggagguagaggcagacgaauuucugaguuugagacaagccuggucuacagagugaguuucaggauagccagggcuacacagagaaacccugucucgagggaaaaaaaaaaaauucuaguuaaacucauagguucugacuaauugagcucaggcugugguuccgugauagaacauaugaguguaugagugggggccuggguucaguccccacugcugaaaggauaaugaaauaaagccaauaauaaugaaaagacuuagugguaggucuccaggcuaaugaucuguaaugaauuuccauucuucuuaguaaagaaagcaagagauguaccugagccuuuguggacuugacuuccugcuuguggcguaugggaacggguagagagcuuuucuuaguuauguggcuucucaaaugccuuuaccucaucaucauucaugggaccuguguuucagaguagcauggcuagucucucuacagcacucaucaggagguggacauuaugauggccuauuuccaccauugaagguggaagaaauauuaauggacuuagaaagcauuucugugguagaaucuguccugcugccaugcuuagucauuagacugaaagucaaacaucccccuaaggcuguguguuuaccucgaggcaccuguccugcucuuuucuaagugucccaguguuagccaccauuuucacaaucucuaccgucuccagcaggguaccagaucccucccucuucuguaacccuguagcaauacaaaauaauuguugaaucaugagcucugugguugccugugcuuggaucuuggguccaacuuaccuuagauaaccuuggaugaauuagaauauuuuccucuuguaaacuggagcuagaguugaaguuuagcacaguaucuaugauauguaagcauucccuaagcaucacucauugaguuugucuauuuggguuuuaccuuuuugauggcauugggaguuucugucacucuguccuauguguuugcuucaguacaggugagacagugacuagcccauauuagaaagucauaccugauaguacugacccagccuuggagaauuuuuuuaaauggauaauuaagaacucaacucuuucucagagugacagauguuuguuuuuccugucaggaaguaggaguuucccacuuacugucuguauagcuacuaacuuuccuuccagggacaagccuuuaaguaaaagcuaauuguaaaaaugagggaaggaaaggaagggauucuccuaaucuuagccaaauggagcuuuacaauaaagacaacagacagagcuucuuugcuguucuguuuuuaccuucguuuuauuuauuuuagauuuuauaauucauccuuguaccccugagcaacauaaaauaauaucuucucuggauaugaucugaagacugcuuaugaagugagaccuaguuuaaaaauaaguuuuuuaagaauauuaggagacaggcuuuuuuuaaucauuauuuugguucacagauuaaagguucacacccauaacuuagcccaugacucuuaagccucguguggugaugguguauaaugaagccacaccauucaacugaugacaggacagaaaugaaucaaagaagaagagauuugugacccacaguccuccugaagagcauguucccuguaacccaaaguuucauauagauaggcccaguuucucuguuuaaagaaauauuuaaaauuuauuuuauuuuuugaguaugaguauuuugccuauaugucaaccacaagcauccuuggugcccauggaaacagaagaauagucagauacccuggaacuggaguuaggaugguugugagcugcccuguggguguugggaaucaaacuuggauccucuggaauagaagucagugcucggaaccccuuuaucuucaugaagccauuccucucaaaucccuuucccagguguuuuauaucauguagucauguacucagaauauggauuuauaaaagaucacacacacacacacacauacacgggugcuuugcuuacauguauaucuaugcgccauguguaugcagugcccauggauaccagaaggugucaucugacuccccgggaacuggaauuauagacagcuguaagcugcccugugagugcuggggaaugaacagugucuucuuguuucuguuuuugauauuggaaaguaaguagaguauaauacugaaucccauaaccugugcuuuuaaugugcuuuuuccuuuagucgccuuuccccaccuuaccaguucugcucccucauggccgagccuuguggacaccaccaagcagugggacuauuaugcaaggagagaaaaagaccgagaccgagaccgggagagagaccgagacagagagcgagagcgggaccgggacagagaaagggagcgcacccgggagcgggagcgagagcgcgaccacagccccaccccaaguguuuucaacagguuuguugggugugcggggccuugagcgcacuucauuuuuacucaguuuuauuugaugugaggagaugaauuccaguucaccugggaaaggaguauucaaggugugguuagaaaagccauuuugaaaucauacucauuuuguucuugaggauuccaaguacuguaagcagcaauuuucacaccauguuguucacuuggccuuuaaaggaaguuuauauccccucacagguuuccuucuuaucaccuaaacaugauuucucagugauugcuuauaguuaggccacaugaagaaucgaguaccugcagagccauguacucuucaagcuaguuucgauccuguguuagauaaguuuaauuaguugguaauucauauacaguccuaauauauauuguuuucaaauaaaauuuccacuuuauguauugugaguuaaaaaauacugauuuacugauugucccauuuauuuguuuuuuaauguuucauucaugugagugacauuuugaguccuguucugagccagaaauagugcuguuuccuaaaauacauaaauauucauacauugucuuuacacauuaaauucauagaacuguuaagcugacucagucaaagaguguaugacaaaggacuagaaaagaugaugaaaauacuuuucucccacccuguuuucucaugacuugacacauaguagauauuuaauacaacuuuauugaucaaauagguaaaugacaguauggcauguacauguaagugggacagacagugcuggcuacagccaccgacacgcaccguucugcuuauguucaagggcaggaguuuuuucaggaaguugucuaguuuccaaugugguugaaauguaccucugaaguagcauauugucuguaaaauguaugugucacagucaaggaucuuagugcagaaaugcauuggaagaagaucuugcaucgcacaccggaugcacacacgcacaggggcugcugacuuucugcugaauuggaaaauguuagugguuaaaccauguguucauuuucagguugcugaguuuuaaggcauuacuuaaauuuaagaaaaagcuugaggccagaaaagcagaaaguagaggaguucucuguucugacuuguccuaggaaaauuguacuaggaaauacucaugggaaguaaaagcuguuucuaaagacugacaaaaauauucuaaaagcaaaacauacauaguaugugucgcauuacaaauuacagggucacuguuuugaaaauuagagagcaguuuuaacaucuguuuuuaaggcaguuuaauugagggccagaaagaagacugguugcuauaggauguuagaaaauguguucuaaugaguuccaggccuggagugaccuuugcacuauggcguguaucagaagggauggggcgcggcugcuguuuucaugaagggccgacuccccagcacgugacggccuacagcauucaaggaaaagaggggcuacacauaaugaguugugcaguaacuggccuuccguauuuuaugcaagcuuaguuggagucauuacaaagaaaaccucauuuguugauggacuuaguuauaauauccacuugucucuguacugguuuuuguuuuuuguuuuuaccuuggagagaauuauuagagccccagaaaccuuuauaggaaauacucugcuucugaaaauguaagcacuaaacuccuugaagaauuccaugucuuuauacugugcugugugcacaugcucauccccuggagccccugagagcccagaggacaacucgcaggggucaauucuauccucuacaauaugaagacugaggaucaaacuugggugccaccugcagcaaguaccguuccccacugauguccuuucagggcaagaauuccaaccacugacugcuuacucucacaccacgcacuuuauaaacauuccuguuggucucaaggaaaccuugaaaagauugacaguuacagaugagaagccuugaggucuaaaggagugaaguucagcauuccuggggcucagccuuaggucaugcugcacauguaugugcacacugccgcuuugcacugccugucaauaguauggcuguacagucuuaauauaucccagucauuauuugggcagcaguguguucuggcacuguaaauaucauuacugaccacuccuuuugcuagguggucacaggcagguuuguucuucucuacagcguaugcuuuccccugagccuguuauucccaggcagauucuugaacaucuuguagcugcauacaaauuccuaauuauuuuuuaaaacuaaagcuuuugacaguauucuaaaagauguuuauuuuaaauaacagaauugucuaauacuggguuuuaaaaucuugaauuuugugucaggaacaaaaaagggaaaagccccgcaugguaguacauguguguaauccccagaaaauaagcuguaauuuguaugcaugcauuugaaguuuuuagccacaugucaucauuaauguacauaguaggcagggacagagacaggugcgggugagguagcugagauauacagguuguauggucuguguggggaugcaggugucgauggcuugcuuuccuucauguuuauuauucugcacgugaugcaaguuguacugugucugcugguaaaaagcaaacacuuaaaaaaauuauuaaccucuuuugucugccuucuacuguagaagcuacugugagcuauauauucuuggaaucuuuacuacauagccaaugcuuuacagauuuucccccauauauccaagauauauaauauauacauguaauuauaaaaaugagagcaaaaagaaauaucuguugauuaaaauuuaaaucaacuacaggucacuuuuuucccagaaguaaaauguaacauauccucugucauuaaaacagaucucacaggaugccauuauuuuaggucacugccuucuuaauuuaggugugacacugaucugugacuuggcccagcaaauacaaguuaaugugcuggcuucugucggacuugaggaguucuuccuguucagucagcuaaaucauaguccuggugucagcaucuguacuuccauugcagugacgaagagcgauacagauacagggaguaugcagagagaggcuaugagcgccauagagcuagucgggagaaagaagagcggcacagagaacgacgucacagagagaaggaggaaacaagacacaaguccucucgcagguuuguucuuuaguagugacccggcuccaaauagcuaacuguagacuguuccuaagggaaagaccaagagcagcccagugcagcuccuuccuuaggagcaucaaaaacaguuuuuaaaucuagcaagguugcauuucuuuuaauaucuuccagacaaaauuagcauggaauaaaaaugagaugucugggugguuuuuguuuguuguacauuaucugcuugauagaggggaauuuggguauaugacccaaucuuuauaauaaaguauuaaaaugcuguuuggcuuaaggaaaaaaaaauuggggccugugguuuuaaauuagaaucaauuuuaauuaaugcccauuguuuugggaaauuuacccuauaagaugguauuuuccauuccaguuguaaagacuuuuagaaaaagacuugccuaaagucuucaagaacaaaguaauggauacuagaaaucugggacgguaugggugaagauaacccccaaauguaaucuacguguaaaaucucaugcagaauaagucccccaaaucagaaaacaggauuuuuaucugaaauccaggcuuacauuaauugguuagaccagauugauugucuccauuguuaaaacacaauuccuuuuucugcaguaauaguagacgucgccaugaaagugaagaaggggacagucacagaagacacaagcacaaaaagucuaaaagaagcaaagaaggaaaagaggcuggcagcgagccggucccagaacaggagagcaccgaagccgccccugccgaguaggcuccaccucuucuguacgucagucccagaaauagaugcuauaaaucuccuuauuuuucuggauaauguuuaagaaauauaccuuuaaucuuguucuguuagaaugaaacguuaacuuuuuucuuuuccaaaauaaaagugugcauuuuuuuguguuaaguuaaaaagcuuugucuuguaauauuuaaagaauaaaagacagaagugacuuuauaucuaagaaaguaaugugaauuaagucaucaggggauuuagagcuaagguugaccaugugaucacgggauggugaaggccaaggccucauccuggcuagcuuucugguuagugggauaguguugcagaagaggugcugcccugcagacucccucuugacaugaagucaggcuucaucuuacugcugggacacuccugcaucuucaagaacuuggacccagucuugauaucacaguuuuugauagcagguuuucaguguucugaauuugaguccauaguaacuaaguggacuauuuguauaucuaaauucauaaaugguaugaggcacuuggguaccccugugaugaaacuugugugcuuccuagcaggcacaugaaccugacuggcagagcaucagaccaguccauggccaucugagcaaggaucaaggugcucuggcugcuguuaguauguuuuccaaggaucaacgguagcguaggacgugggggauuuuuuuuuuuauaucguuuccauauuaagaauaaaaauaaaaauagacucagcgacaguaguguuagaucagucauuucuuauuaaaaccagagcacagguuaaacucuggacuaaccccaagaggcauucuagagcagcgauggggcuaggagccuagugugugaaagauggggcaguuagagccaccaguaagaggacugcucucacuuagaagauacucauuucucauugaaauccuccgccauuuagcuuaaaugcccauaauauacucugucuucaacucuaccacauuuggaacugacuugaauuaaguguggcauacaaaccauguaaaucuucaugggcuuuuuuauugaauuaaaaauauauaaacuuaaaagacuuggaguaauaagaaauccucuacaccaaauaaaaauuaucacuaguuuuuauuuuugagaacagucucugagguguaacuuuucauaauaucauacuuuucuggcauuuuuuacaauauauucuuuaaauauaaaaauugacaagauaaauacaauuuuaccuagccuaucugugguuuuucuaagauccaucauugauuuuauaaaaaaguaccaggccaagaagcaauggucagaguaauucucccuuuaaguuccuugagcauccuggccaggcaagcguguaucauacccgauguacuucuaccguugacagcgagaagaaugucaccacaucuaaaaagaacacagcacugagaucagaaccacuucaugguugaagcuccucaaagggacuugagugguccuaggguuugccauauugguccauuuuaauucugaucugaucuucccucuucacguaaauucuucaagcucuacucggcuugcauuagaagguauaguaguauauaggaacuugagagguaggaccaaggccgguuauaauuuuggguuucuuacuaccuaacuaguacacucauguuuucauuucucacucuucaggaaaguauaaucuaugcuuuuucuuucaaguggggccaaguuuuuacauguagaaaacaaaaauacuugaauauuauuuuuugcuaaguaaucauuaccugauucuuccgucauuguaugcagguguuccuucaacaauggacuugauaaaaaaagguuuguucccacuguauucuucauaaccucccacaaugcagaagcccaggcuuccagcuguguuccuucgcaguaucacaucuuuacaguuacauaaguaccugaaauagaauguaauuaaugucuauuuaaaugaguuuuuagcugugacuucucucauucauuuuuuggggacacuuuuaaaaugaaaaaauacugcgucagcuuuuguauuuugaucucuuuuuuccauagcugaauacccuuucaacaaaaggacuuaguauuauuuucuauuugugucucugcugagaaagauggccacauuuuuuuggcuaaggacaaaauaaugcaugagccagaaguaggauaugucucgauacuucuaaugauaacccacaguggaacauauugaggggguauaauuuuauauacuugggggcucauauaauuuguaaagaagacaaacauucucagaauuagcgauuaauugcaaggacaauaauuuuaacuuaugcuaaugaacuucacuaaguuguaagcuuucuauugacccuuggaaaauacuaguuuauacucacacaaacugaagacuguagacaaagugaauggaaacuuggccaaaaauaguggagugguuguuguaggaaaauaacauggcauagcugcagcaaagaguacagaggggagggaggagcacagcuggccugagaaccaauaccaccuucaacuaggagagucgcggcugucagaccuaagugcaaacagcugcauuagaguagacagugugucggaagauggggguggcucuaggaucaagggaucuaccacauguguaucuauggucuaggaacugcuuuugacuggaagauaguguuuuuauguugguagaaaugaagauguuuuguuuauagacuguaccuuaaaauaaucaguugcuuuuugauaaucaauaaaaaugaucuugugaaauau

SEQ ID NO: 2498 - RNA, 2936 nt, Mus musculus
cuaaguuguuuuuggaaucucuuuccaaagucaaaggaaaaaaaaaauguuaugguccacuaagauaauuugcuugcagcaaucguuauugaacaagguucaguugcaucaugggggcuguggcguagcucuuguaaaguuucucaagcagccugaagagaaaaaaauugaucugcaucagaagcgagacaauacagucaugaugggagcuuuuuagccacagugcuuacaccauacacgucugucuacacgguguucaccuuucacaaccuggugugguuguagcacacacugcauggcucuguccuuaggacaccguaaaguaggcaucacuauuucucaaaggccaaugguuggaacauacacccugaucuuaugugccacccagaaagaaaacagaacacugcccauuaaacagcaguacagugacaauuauaaaaucaagccaagccaaacaugcagcuucagagauacagcgaaauaauggcugcccugcuguguugaaacacagacuuucccuuuugcagaugagaacauuuuugcuguguuccagagccggugacagauggaguuccggccacuauuggaccuuuugacuuuagcccaaauggaauccacucaagcagaccuagcaaucuugaagaugaucuuggaagcaagacgcaaggcuaccaccacauauuccuaaagcaagcacugccaaagagaaucuuugucauggauuauggaaacauccugguagugucuuuaacacagauauaagcacuagcuuuccaugggaauauucauaugcauauuaaguagaccaaaacaagccccuugacuagaucugggaggagacaaggggcggcagugauggguggcggugaugacauugugaacacacacgguuucuugucaugggcacuucuugugggauuuaugaggcugaaacaaauggucaauaaggaagaggcuuacgcccaagacagcaguaacucucugccuucuaucgucucgauaacauugcaugaauacaacagagguacuuuguagacuucauaguuguaaauuuuccugcuuagguaaaacaucauaaucaaaaaucaaaaccuacuggugcuucugugugcaucuguagacauagacaugcacagaacagggaacacuccaggaggcaggugcauuuguucccagcgaaggcuggaugagaccacguuugucuucuuguuccagcucucacacugcagacaagugcccuuuaagcugucgucaagugccucguugcccucauuuggugcuuuccccuguuucuagccgcccuuaagcacagcucuaagcggcugucuaguguucucaacuugagaagguggcgugugauggaggaaaugcuugcguuagguaagccucauucaugcuugaguaggacaugaguugaauguuaaagaaucaacaguauguguuaaauuagaucucuuuaaacaaaaacacacaggagacaaaguuacaugugaucaggagaugaaaaugugaccgcaggcuuacagaguaaccugaccuaauucucacuaauaagaacucacugcuuugaggugcuaacgugucgaaaggaccauuccuucuauugacagcauccuugccauuccuaucccauaacugcaugcccugugaggaggucaaaucggagaacaaccagaagucugggggcugaagcgauggcucaguggguaagagcaccugcuacauaagaacagggguggggcucaaauccucaguccccacuuuaaaaagcugggcuugcuugagugauggagcaggacagugacauucagcugccuccacccuccacgugggagcacacauguguguaugcaucucucucucucucucucucucucucucucucucucucucucucacacacacacacacacacacacacacacacacaaacacaccuauaauccuagaacucuggaggaggcugaguuugaaagaggaccaguuugaauucauaugcauauuaaauagaccaaaacaagccccuugacuagaucugggaggagacaaggggcggcagugauggguggcggugaugacacugugaacacacaugguuucuugucaugagcacuucuugugggauuuaugaggcugaaacaaauggucaauaaggaaggagcuuacgcccaagacagcagguuuuggaaaaguaaccuaacccagagagccugagagccagagagguggcugugccuuuauggccaagggacagaaguaagggggaaucugugagugacagagcccgcucugagaagucaguggggggaaaggagaaaagaggugcagagagagggagagaagggaagaugggaagagggggagagggagagagggggagagggggagagggggagagggagcgcccagggucucugugcacuccugcagaacaugaagugucagcaggcucaucagccgcacaucccuucacgaaagcacaggugccuuguuuccagccuggaugugguguuagcaauaaugagcccccaguuaccaucacccuguaaaacacaucagggcaaggggagccauugucuacugugaaaacagccaucaagucugcacuguuggaaaaacaccugccccuguuuugcaagguguuuggcuuccuuggggccacucacuaaguucccacaaagcugugcacuggacaguuuucacaagagguuuggaaaaccaaguuggauuucagguuugacucacacaagcaaucuuugggcaggcuuuguucuccgcagucggcucuccuuccgggaccuuccuccaucccaggcuguagcuguuguucaggaugaaaagguacaggagcuggcugcuguaauuggagccugcaccugcagacccugggccugggaggaggcuccguguggcugcucugugugcaaguguuuaug

SEQ ID NO: 2499 - RNA, 1595 nt, Mus musculus
gaugagauggaaagccuuggucaggggaaaauccgagccuaagagagguuauguaaacuccagugcgacggcagaagaggugcgcccgaggagcgcccugagccccgagccucuucugagacuuuggguguuaaaucuggggcuguacagcugcagaccacaguguggguuuacacuagaggccuccuccggcuccucaaggcugccuaagacugauccgaaaccauucaggagaagcaauucaguccaaaacauugagcaauuccgccacgaagccaaaaagccguuucccacaccgcccagccuggggcuuuucugggcagcucuguccgacgcugggcagcccagacuuuuaaaagugccacccacgcccccuccccagcuuggguucccccaugcacacccuccgggucuucuagaggucuuagcagaccugggaguuucuaagcgcggguucugcaaggacuccccacagcagacaaacaggccaacacuuccuuucucgccaaggcuggucgccaagucacuggcaacuccugcacaccuggcugcgaggcucuggcuugguccugcugcagaccagggccgagucauacugccuuacucugcagacugccccacacgccuuccaaacagaaagaaucgccgaccucagaagcuucaaagccaagagaucgcuuccugcuuucccggcccugcucgagggaaguuaaucucacauguauaaacugauuuccaagggaauaacggugaaggagggaaggcugcgcggagaccgccccugaguuuugcaggauacugagcguugggaggaaaguuggggggggggggcacuggaaagguugcguucaggcgaccagugccucgcauccaucaucccagggcagagaagcacccagaguuccguaggcaggaggcgagggugguuggccucuuacauuucugcuuaccugcacccacgucuguccuuucagagauguccugacuucuucacaagaggucagcuccuagccagggaucuugccucuuugcugccugcggccaggacuaagcaagagccaggcccccccaacccccggccgugcagaaaagacuccacuggagacgcaagugagccgaguggggguggggacuacggagcacaaugagggccccucggagugcaguuugaaauuccucaaaucccaguugcuggaaugcgaggccaggacgacuucuucacucgaggccaaauguguuugucauuauuccagaucgcucguccgcgccgccgcugccgccgcugccuccgucgcuggagugagaggcgcacgaucccagcgcacugcggauuccgcccgaggcuucuagcacccaaguaauucgcuccaaucucuccggaacccuuggagcugcgccccucgcccgcgcgccccucucacggugcugcagccgccaccgccgcgcucaagucuggccccagauguuuccaacagcagcgccguccaguaauuacgagggcucgacuggcgccgagugugcccggccggcauccgagguccgaccuccuccagccgagcccuucacaccucccuuuuuucuuagcgcuuucccgc

SEQ ID NO: 2500 - RNA, 452 nt, Mus musculus
cgucuuccuucuccuccuucuccuucuccuccucaaugcugaugccuccggccaacccaaccaucagcggccagacugucgcugagccucucaccuuugagucaccuauccagcuuuccagucagcaaccuuuaaccuggaugcuacucacugaaggcccgagggggaucccaccccucgaggucaccaggcagaaggauggucaccacguccccaggucccgcgcagccuagguccuguccccaggaggcagaaaucccgcccgccagcuucggcgccugacgcguuugcagccugaagccccucccccugcaucucuccccagcccgcgcccaggaagaaaguagaagccccugggcccagaagugggaggccagguucugagucugaacccugcgggucugcagacuccagcaaaagaagggauccggggcaauaaacaguggaguugg

SEQ ID NO: 2501 - RNA, 2326 nt, Mus musculus
cagaacaaagucuugcauuuauuaggagagaguauaaauaccacuuucucuucccaggaggggaaacacuggaccaaaaugaaauacccuccacguauaaauuuauagaaauguaaacuuagcacaugucggagcacaggugagaaacacgaccucaguguugaaagagagacgagaaaacagaaaugaaagaccccuuuuugcuuucuuuuucauuaaacaauuagcugggggaaggauacuaagugucuucuaaaugaauguguuuauaggaagaaaugaaaacauuugaauaauuugauuaacgcacauaaaugacaaaugauaaaagcccgugagcgauuugaaguucugaaauuggagucuuuaagggacaaauauucucacccccuaaugucaucacugagccagagcuggugugagccgugcugucuaagcugauugcuauggagucgcuauuacccaaugccuuugccggguggaaucucacuugccuccugcuucaugggacaugaaagaagggggacuuuucuuaaagauguuaacacugagacuggaugagaagggcgggccugggagccagcaccacuguugucuuuaaagugguuucccagguggcacacccucggacaguaugacaucuuuggcucccuguggcugcccacagaggacaauggcgggacccacccuggggcaggaugcggcuuacuccggugccaaggcucauuacuaaaagugccuuugugaagacggaguugccagaagacuucuucccagagcacauggccauguuuuguggucuuuggaauucucuaaaggaaauggacugaaaggauaguagaguagugagaggcgguuaugaucacaauuaauuucccuuauugcgucugcguugauucgcaggagcugucauaaccaaguggcacaggcucgggguauaaagggcagaaauauguugccuuacacgucuacagguuaaaacuuugagauucgcucuccccagauccauuacucccgaggacugucuccuuggcuuacagaugcuuagagucuccacuaccccgcgugcguggguacaggcacuucugugcugcucucacugucuugccaggccucagugggagaggaugugccuaguccugcugagacuugaugugucagggcuggcugguacccauggggggcuuccucuucucugaggagaaggggaggggucggugaggagaggggcugcugagggauggacugggaggcgaggagggaggcggucugcaaucaggauguaaagugaauaaauuaauuaaugaaugaaaauggagaaaaaaaaaaaccccacagacccauuagauuaagaagcacucagaugaccccaccauaacccgauuaccuuuggaaggccccugucuccaaacacacuugcauauuuagguccuggugguuagggcuuuaguaugugaauuuggaaaagcaacucagcuucaaaguccuuugaaguuguuuuaaagcuggaauggcacaguaggagcucccugacccaauccaagaggcaugcaguaagauccccccccacacacacacacacacagcggacccugcagaccaugccaaagcuuacagaguaucuuuuccuacuguacacacagcccaagagaagucaguugugagacagaggcagcuagagauucacaacagugauguuggacaauuguaacaguuuccugccaucaacagaauuuaaaacuuuauacauuuuuuucuuuuguuucuuuuugcuucuggaguuuucaguuuaacauuuucaaaucaggguugaagccaugcgaaggcaaaccauggguacaguguguauaauuccuccugaggccaggccugcuuaggaagaguagaaggcucugguauacuucacaaugguccauuuuccuccccuggcuaggagaauacuucuccaguguuccuugugaggaugugucuaggccgacagaggcauggccucuaagugcggagcccugugucugggcccucugggauguuaacucugguuaauccacacugaguuucaggccacucuuuccuucuugggcacugacuccaagggaggcuucugucauggggucacucuggcaaauucuuacuccggauuagucugccuugccugacccucugucugucccuccaaguuugaggcagcacucagcucugugagcucgcuucucugaaggaagugagaaggcuccaugaucuuccucuuuguucggcuugaaacuagaggcccauucuuacaggaugacugucuggggaugacgcccccgggauuuuguuugauuag

SEQ ID NO: 2502 - RNA, 1417 nt, Mus musculus
ggaggguggcaacgcauaaucucuagacacuguaucuggcaagaaccacagggugugccgagcugaauucgggugagcaucucugguuggguugcuucaacaauggcugauacuuccaacaaugugaugcuacuucgagagagacaagucucccagcggcucuguacuaaaaacuuucuacuugggaugaugauuuccagucuuuucaguauggcccaugugaucagcagaaggcagaauccagagcaagccugucgguaccagggaucuagaggaccucuggggagccccgguuggggcccucacuuucccuucccccaagcagccaggccaggccaggccgcgccuaagaaagccgucuugucacccuccucccagcgagcggagcaggggccggcuccccucccccagccucuucggaaagagggcggcgccgccagcgcgggagccugguacccgacugcgggcuccgcggccucagcccgccccauccccaccagcccgggcucucaccucggcccgggccggcucgaggcccugcaccgccgcgggcugcggcugcagcugcugggcgggcgccggcggcuccugguuccgauggcucaggucuuccuccgggccggcgcggaccccggccggggcccagagcaacugaagcagcaagagcacgagcagccuucgcgucggcgcccggccgcucccccgggccgcggccgccaucccgcccgcccagccggcaccgcgcugcggcaggaagaagugcaggcgaagggaagcgucgagcccggcgugccggcaggcgccuccgucaggccuggcugccgcucagggggcagcccugcagcacgcgggacgcggggaccggaccgggacggaccggcggcgggagcuccggagcagcugggcagcagaagccacacacuccuccaacugccuccgcggcccaacuccuccggcccgcccccuggccaacacgaccucccauuggcccgacgucagcccggcgucgugacguuuccggcagguugaggugcggcucgcucacugguccuauuggacccggcgcgccgggccagguagcuggagcugcuugauggacucucccugcguccucucgggucccaccagagacccccuuauuggcccuggagaggucaggcugccaggcuccuaccaguacuuccucaagagccuuaggucuuuaaggccuaagccgccgccaccuccacuucuauuaaaugucaagugagucccagccccgcuaccuacguggcaggaacugccacaccuuuaaguuacgauccacccacccucaccacgucccuggaccgccuacacagaauguucuuuggggguccauaugcugggguuuuuugaagguucugaaguaagauucggaaguaaaagaugagaacgu

SEQ ID NO: 2503 - RNA, 25368 nt, Mus musculus
caaugggaggucguguuggccagggggcgggccggaggaguugggccgcggaggcaguuggaggaguguguggcuucugcugcccagcugcuccggagcucccgccgccgguccgucccgguccgguccccgcgucccgcgugcugcagggcugcccccugagcggcagccaggccugacggaggcgccugccggcacgccgggcucgacgcuucccuucgccugcacuucuuccugccgcagcgcggugccggcugggcgggcgggauggcggccgcggcccgggggagcggccgggcgccgacgcgaaggcugcucgugcucuugcugcuucaguugcucugggccccggccgggguccgcgccggcccggaggaagaccugagccaucggaaccaggagccgccggcgcccgcccagcagcugcagccgcagcccgcggcggugcagggccucgagccggcccgggccgaggugagagcccgggcugguggggauggggcgggcugaggccgcggagcccgcagucggguaccaggcucccgcgcuggcggcgccgcccucuuuccgaagaggcugggggaggggagccggccccugcuccgcucgcugggaggagggugacaagacggcuuucuuaggcgcggccuggccuggccuggcugcuugggggaagggaaagugagggccccaaccggggcuccccagagguccucuagaucccugguaccgacaggcuugcucuggauucugccuucugcugaucacaugggccauacugaaaagacuggaaaucaucaucccaaguagaaaguuuuuaguacagagccgcugggagacuugucucucucgaaguagcaucacauuguuggaaguaucagccauuguugaagcaacccaaccagagaugcucacccgaauucagcucggcacacccugugguucuugccagauacagugucuagagauuaugcguugccacccucccuuaaaaaaaaaaaaaaaacaaaaaaacguguuuuggcaugaaggaaguugcccuugaaugcagagacuugugcccaaagguagagcgcucuauagugagggauuccaaaacuccauuuauagguaaacuagagccucauaaguuucuuuaaccauuaccagauagauagaaauuaaccuuuuaaucuauguucguagaauuucuccuuucuauguuacuuuccucugaguuggacucucuauuuccaauuuugacuccuacauucuggaguuuuuuuagucucuuaguaggguccauuuuggcauucccuuuccuacuucugucuuuaucugcccuccaagagaauggcuguccugacuugaguacagaucagggugaccgcaggauagauauucauuuucccaucaccaugccguuccagcuaaaccccaggucuuuuagggacccaccacugccucgcuguguucuaaaccaguggcuuccagaacugaaaccugaccucugcucacugccauuuuccccugagcaaagaccuuagaacagaauccaggcauggggccugugguucaggacccuucccaucuucaagagccagcagaaccuuccggagcccuucccaggaugcccugguuagaagagcacucccugaguccugggcgcuuuccuuucuucacaguucauguuacccuuuggccuuuccaguauuuuguuuuucuauguaguaucaggagaugggaauuucugugauucugaguuugguuuuacacagcaaguacuuucuaagaaucaccugucccgaauguagcaauggucuugaggagaacuaaggaaaaauucuccuuacuggaaguacucaggaagaggucaggucagucagcaccuguuaggagauuuaguuauagugacgguaagauuuagugagagcuguuaagcgggcagagcaggugacauuuccugcuuguggauggggcagugcaggucugagaagaguggugguucggaaaaccugauucuuggcagacccagagcuggaaaccagaucccugcuucucacccugccaggugcugucugcaguccuugaguuugcuugaaaacccaccccccugcuagccauuuguuguaauggguuuaguguugauggcuaacacauugauguaagccuuuucucgugaugcccagcccacuccucuuuugaggguuuuuauguuuaucuauuuuuacacucuugcuucugacuugguuucugucugcucuucaguguguugaagcccugagaacauuguuauagcauacucuuuuuuuuuaucucuuuccuaagaccguguauguuuuggcauuugcuaaguaauuuuucuucuuuuuuuuugagacagguuucucuguauaacccuggcuguccuggaacucacuuuguagaccaggcuggccucaaacucagaaauccgccugccucugccucccgagugcugggauuaaaggcgugcaaccaccacgcccggcugaauuuucuaugagaaaauucuaagauuuuuacauuucaguuccuaucagguuuuaaauacuuuuauggaaaaaacuauaaaaugaacucaagcagggaaaaaacuuuuuuuaagaguauauauccagccgccuuuuacuugcuaaaggauuuacuagaugaagaaaaacucagcuuuuauuaucugcuaccugugauuuuguucauuuauugauuuuagcuuagaaaauugaacugcaacugauuauuuaguuguuaauucuagaacucuuguaaaguuugacacacacacacacacacacacacacacacacacacauggugugugugggggcagaucagaccuguuucacuagagagauaaauggccaucugaugguagugcagaccagguggcacaugugaagcaggagccauucaccaucagaucccagggcucuagauuuuuggcguagaggcauuggguggacggggcuucucugcccauucucccucugucaacccuugcugccauucaggcauggucugucucugcucugaacugcugaguugucauugagcaacucccacauagcucugcaucagaagguugcuuuaaaacagucaccacugggagugaaacagcccuaggggccagagugcaguuuacgaguauauaacuuuuuaggcauuucauagggguuguagucauauuguaauuuuugagacagaaauacugguagauacagcuagauuugcaguccuuucugggaugcuggagaaaauguaaccauguuaaguaaacgucccagugguuaagacaguauguguggccucagugaagugucuuacagauucuuaucuuuacaauuaagggguuggaggacuugcuggugcagacacuaugguuuuuuguuuuaauauuuucauauauuuugaugguucuuuuccauuaggaauugacaguuuacacuuaauagcaaaacacuguaaauaaaaacauuuuauguuuuuguauaacuuuucacaaagugaaaaaaguuuuacagugaaaaaaauuuuuucuuccauguuucuuaaaccacuuaauaaaaauaucucguuucuauguagugauauacauaaauuuuuuuucuuccguguuucuuaaaccacuuaauaaaaauaucucuuguuucuaugcauugauauacaugaucaaaauacaguuuaacaacaauauaaagugauucggauuuguugaguaucuggguuucagcugacuuugcaacuaugagcaguggaugguuuaaaaggaugggauaucuaaauuuagccuuuggaggccaccgcauugagagugaacugugaaacuaaagggggauccugcuuucaucaacaggcaucugguagaagagacagugcagacaagugguuauaucuuacuggguuaaggagguggcugaauuuucagacagggcucgcuguguguugaguguucuucgucuuuauaaucuaguuacaaagaaggccgguggugauguacaguugucccaguccuugggaauuugaggcaggagcaguggcauuuccuuugaacauacagucaugaguaaacuacaguuuuuaugcugcagauggugaccugaguuuggucuuguuuuuuuccuauuucuucccugggcagaauauagauccuauauauucugacguuagagcuaaucuggccgaggagcaguguugguaggccugcccaguccuguuaucugguccugccgagguucuaguucucacucuccucuugcugcuguucuuggcuuacucacugugaggcaccgccacagaagccaucguguucccauuuucauuaaacugcauuaaacacagaaggugucuucuucagcacccagaucucagccuuuugugauugugauugaugcuuugagcuguaaagaccucugcaugaaaugaagcuuuugguacuccauuuauuugguguuaucaugucaucaaaagaacacuuaagaaaaaucaguaaaauuaaguaaucugcuuuaaauauguaaauauauagaaugguaaaguucauaaaacagaguugcuaaauguuaaucgaaaauagucuuaugaauauguacuuguuacauauuuacucuaauaggagucaaauguaauauuaguaaaaauaaaauaauauguuaggucagugaaaucacccaggaggacuuagacauuguaaugaaaacuuguaguaaaaugcuuuaucaggucaugguggcauacaccuauaaccacgggccugagucuuauguuaaccugggcuauguugguacuuagaacuuuauuauagacccaguuccauagcaagaugcuacuuuugccucagucucuaaucacugugaucuuuuaaaacuggguuugucugcagggccauuguuguaaguuagauggcuucuuguuuuguuuucuccuuuuuugcauauuucaauauuuucugaaaagacuuguucugacuuugccaauacuguugaggcuuggcuaauucuaagcauuguuucaaauuuuauauuuacgaacaugaugauaccuuuugcuuuauaaucucuuauuaagcaacauauacauuuugagggggauggaaucagucuauugguggcaagcuauagauuuuguuucaaagcaagcauccuuccugguuucaucaugaguaaggggagaauacagugaguuuguguuccuuaaacuauacagcuagaugggaauugcaucuuucuuuguugucauuucuucuugauaaugguguggugggugacacacacuacaaucucagcacaggaggcuucaaauugagugcauccaaggcuauguagugagaccuggucuccaagaaacaguuuccuaaaugaggacuuacguguaggagugugugugugugugugugucuguguauauaauaugagagaaugggcacaagugugucaugauauguguauggagugagagggcaacuguuguuugucuuggguccccaccauccaccuuuugaggcagggucucucguuuuaugcugugugugguaugcugguuguccugcaggcuucuggggguucuccugucuacuugccaucuuguuggaagaacacugaggcucuaggcuuaggcugcagcaaagacugcggacugagccaucuccucagcccucugcaaagaguuuuuguuaaguacagguugcugauccuguucuccaaaugcaguuuguguguuacauauuaacauacugacauaguggugguucugggauacucugagcagacccucuaggaucucgugucuuuuugugguauaauuuguaacugaguugaaacugcacuccuuccagcguauuggcuucugugcucauucugucuuuuucacguuucggaucaaacugucauccuuuccauuccuccuccuccuccucuuccucuuccucuucuuccuccuccuccuccuccuccuccucuuuguuuuugguaggaggggcaguguuguggacuaagccagagucguugagccacaaucccagcccuucccuccucugcucuccucugaccuccagugcauucugccuuugcuucuuccuucucuccccgcccauugcuuccuuuaguuccacauagaguuucuccuaguuuuggaagggaaagaauaaaugagggcuguauuaauacuacuuggcccaguuaguuucgguucugcugcuuuaaaacccacuccuacugcagaguuaccuguuagcuaaucuuugcuuuaaucuuccgucaucugaguucccuccuugcucuuguguccuuuuugagacuuauuuaucuguaaagaacucuaagcagcuaggacucuuaccugcggagccuucucuacaggccuccagcccaucaguuugaagcacacuuguaaccugaccaauaucuaaguccagagcucuuuuucugucuucauuugacaugacuaccugcucucuuaaaauuuuaagccaaacaccucagguucaauuaggaucacagccucuaggguucugccaaucaagugaaauuaugugaaaaugacuggcaucuacuuaguaacucagggacccacuuaguaacugacguuuaguauaauaaucaacagucuacugucacagcucagucagccuuuuccuuucugucugcuuuccucccuucuuccuuuaccccccaccacuaacuaggcuuucuaagguaucauauuauaucccaaguuccucucuuaaagagggauuugacaguuguggagacugaccugcuaaguuaguuaucuucucucaggcauggccucaacauccuuuggccaguguacuuugugcuuuguaagaaagccuccaccuuggccuuauggccuuuugaaugauugcaugugcugcuuacguuaucucagguaaucuguuacuuaaggcagcugguuauaaaugauaaccacaucugaaaaucgccuguguugcaacaccauacuuagugugcacagguggggagacugagcccagcuaaagauauccauaaaacucacaaucucaugagcucguccgcuggcuauagaaaccaagacaacaguggugcauuggagagcuguggggagagcuguacaguuauuuucacuggaccagaaaauagcuucacuaagcaaaccaguccauuagagcauggcuguauggcuguuacauucuacaaaguaacauccugugucucuaggaacccagaagcaugcagcuaauacugcgggauggauuucugaaaauauuccucuucuucaggcuucuuagcucugaggcgccucccaaccccaggguuuguauaaaaaagaauaugacuguaauuuaacuugaacaguaagacaacucaaccuucuucuagcuuuguauaugguuaggguagcaaggaaaagcuauaggaauaagauauuucuauuagauuaugcauaguugggcaagcaugaugcccuagauguuugagagaagagcuagagauuugggaaaagauuuauacuuccauauuuuaaauauugugguuucaggugcaaauuuguagaccaguaggugaauaccaugaggcauccuuaagugagcuaccuccuuuugaacacucagcagcauugccacucaaggguuaaaaguauagccugucuuaggguucugcugugaacagacaccaugaccaaggcagcucuuaccauuaaauuguggcugacuuacagguucacagguucaguccguuaucaucaaggagggaauggugacauggggcaagaggagcugagaguucugcaucuugaucugaaggcuguuagcagaauucuacuuccaggcagcuaggacuaggguauuaaagcccacagccacagugacacauccacuccaacaaggcuacaccuacuagugccacucccuggcccaagcacauacaaaccaucaaauagccauucucagaacaaagagaaaagcaccugggaauagaaaugaaaaggcaggugaguccacgacucuagguaugcugugaaagaggcagagggaaggaccuagcuagaacuuuccccugaguguagacuggagucaaguucaggggcaugaacuuugcaaguccuggguaaccuggggauggggcaguguugagauuuucuguugugcucucuccauuucugguucacagcugucagguuaauuuuuugugagcuuuaacuguuugccuucuccccugggacucucauccacuugcaaacagccuuggcuaauuuaggcuacuggcaccaggucuguacccagagucugaccuagccacaucugugaaccacuucugacacuugucuuagaaaccuucauaugaaacuacuugucaccucugauugaacauguuuagaacacacuccuugcuuugauuuuucuuuuccccauagcuuuuaggagcaugacguuaucaggcagccagacuccccaacccacccucccccaaaagucuuaccacaauccuuaagugaacccugcacuuccuaagaucuauugacuuuuuuuuuuucuuucugucaugugcauguauuuuccuucugguuaguuucaccauugcucuucggcaguucaacuuuugauaggcccagaagcagauaucccccacugcccugguuguuagcuacagugccucaucgauguuuaucuuccauucagaaucuuuuaggggcuuucuucuugaguuagguuaucauuagcagguacacuuucaauuugcgguacaguuuuucaguccacaagcauucauccaguggcuuacugucugagacaaacaagcucuaugugucauuguuggucaggaucaggcagaaagcacacacuguguaaaacuuucugguuagccauucuaguccuggauccuuuggaucuugagaaagaaccucacagcgcacacugcauuuguucaggcaaaggcugugugccgcagguaugagcucccugaccuuugagugagugaacgcagagcauagacuucuuggugggaugccacgaggaacugaucugcuguuagagcagcaggucaggucggcaggcaugggauggggcuagagagaugacucagguguuaagagaaggugaagaauucaaguuugguucuaagcacccauguaggguagcucacagcuacuuguaacuuuagcuccaagggauccaacacucucuucuggauccugugggcaccuucucucauaagaaugugcacacacaagagaaaaaaaauuuguucacagaagucuuugaaggauacaagguauccauacuugggugcaugauggcaaaaaucuagaaggaacagaauucugacugugugaugggaaguacugcuuugccaucucuuauccuaauuuguggccccacacaccagaauaccacugguuggcugguguuuuaaguaaaguuccuuuggaacagagccaugcuguuucauaaaguauuugacagcugcuucucugaaguuauagcagcagaguuguaauuaccacaggaacuaugcagucuacagagcuggaauguaguugguucuuaagggaaaguggcucaucuaaccugauuuugauccuuucucuggaaauguccacuguuucagggugcauuuagaaucacauauauaacuuccuuccccccauauauaugauaauaucauauauaaguauuuuaucuaaagcauuuuaauaguuuuucaauauuaguauuuguagaacuuuuuucugguuuuucuagacaggguuucucuguguagcccuggcuguccuggaacucacuuuguagaccaggcuggccucgaacucagaaauccgccugccucugccucccaagugcugggauuaaaggugugcgccaccacgcccagcucgaacauucuuauucuuauuuuuauaacuccauaaucuugaguuuuuaaaauuacauuuauuugucuguguguuuaugugugccucaggacacauguggugaucaaaggacaccguguggaagucaguucuauuuucacugugagggaccuaggguuaaaacucagguugguagauuuggaagucagugccuucacugcugagcugccucuccagccagcauguuuuauaugaauguuaacagguccuggucccagucgguuagacauuccauugcuuugucucuucauuauuagcauuucauugauauauguuucuaccacagaacugucagcuucccggugucccuguccucaccuuuguugcucucaacccuucuaugacacauuaucaugguguccaugcggcuagaugucaagggcugaggauaaaaaggguuugaggagucugggcaaauggagcauaauggagaacgcugggaagggaauucugacuggcugaggcuguggucagcagaagcuccgugaguucucaagcugcacugcccuugacugagccacgggggaggaaucagcguauaacaugccacuucaaagauaguaugaagaagaugguauuucuuggcaauuuuuaaaaaugcugcuuacauauuaauguugcauccuugcuuucucaaauaauuuugccaguuuuuuauuuuuuaaaaugggaaauuuaaacuaucaugagguucuuucuuccuuucuuucuuccuuuuuuuuuagcuucugguguuuuacauuaaguucuguucugcuggcuucuuugggagaaagaagaucuauuuuaggaacuagugugauuagauagaaaguauugaaauugaguagauagaaguaaggguuuaucuagacauagcauauucucucuccaguuccucaguggaguaacaugaaguaguucauuaccgaaagucuagugagcugguucgguuguguguuacaggaucugaguguugcuauauauagaccccggccugaggacuugacucaccugaaacgcuuuaacaguuugggggcguggcugccuuuguuggcagaugauggaggaaggguguauugguaaugcuuuggaugugaacccggacagucugauuccagagcuguggauuuagccacucuccugagucagugaagcuuuaccagaccaaggagccaguccuuccauggugaucaguagauaaaugcuaacguucuuuucugaucuaaucaacauuucauuuuuuuaaagauugagaauuucauguaggaguagucaguguuuuauuguugugaagagacaccacuaccaaggaaacucuuuuuuuuuuuuuuuuuuuuggcuuuucaugacaggguuucucuguguagcccuggcuguccugaaauucaacucuguagaccaggcuguccucaaacucagaaauccaccuaccucugccuuugagugcugggauuaaaggcaugcgccaccacugcccgucuuaccaaggcaacucuuauaaacaaacacauuuaauugggacugguguacaguuucaaggguucaguccauugucaucauuguggaagcauggcagcguccaggcauacguggugccagagaaggagcugaaggcaacagaaggagacuguccuccacaggcagucagaaggggucucucaucuacacuguguggagucugaguauaagagaccucaaagcucgccuacacaaugacacacucccuucaagaaggccacacuuucucuaauaaggccauaccuccuaauagugucacucccuguggccaagaauuaaaauaggaauuuuucggugcaaagccuauuuuaacuaccacacagaaguauacuguauuugcauaauuucccccucccgcuuuaccccuucugacuccacuaggguccucucaaauuuauacauuguuauauguacauuauguauguguauacacacacacacacacaacacacauauguaugauuauacacggaaccugcugaguccaguuagugucguuggucuguacuugucagugcucacccugucaucuguaguuaagugcagcucaguacucguaaggaaacauuccccagaagucagaggccacuacagguauccgaaccagucagaauuagugacuguggguggcucagucccaaaugggacaguuacaaugcuuaauucuuaaacaucucugucuucacaaaauccugauacuuuguuuuuauccacccaggacuggcuuaauaaguggaaagagcuauagaugugguuuuucuugucuucuauauggaaaguuuugagacuauggaggauugugcuugcuuuauuucguugcauucuuuuguuuucacuuguuauuuuguguguguguguauagacaugcaaauauauacagagaucagaagguggcuuguaggaguugguucucuccuuccaccaugaaucuugagcaucaaacuuagguaaucaaguguggcagcgaguaccuuuaacucagugagccaucugcuggacuuacccuuagaaugcuuguguguguguguguguguguguguguguguguaucuaucuauaucuaugugguugugagugugugccgcaugcgugccuguggaagccaggagaggguaugugaugguuuauauguguuuggccuagggagugcacuaugaggagguguggccuuauuggagaaaguguguuacugugaggaugggcuuugagaccuuccuccuagccacaugggaggcagucuguuccuggcuuccuuuggaugaagacauagaacucugacaucuucuggugccaugucugucuggacacuaccaugcucugaccuugaagaucauggacugaaccucugaaccuguaagccaaccccaauuaaauguuguccuuguaagaguugccuugguggaaaacaaagugugggcaauggcaguccuguguaaacugugggucuggaaaacugucugaacuccuuuauucagguagaggccccagaacagaaaggaacugaggcaaaaccagacagaguaacccugucccugcagcagagacuggugggacguguauagcaggguguaccccuuucaguucuaguugcuccagcaaacacaguucaccuagugggacuguugcugccagagugacaccuuuuaauuacaacccuagcccuaggaaaagccgcgaagacagcacuucagcccggcugucucagaucccuacgccagugagcagcaacacagagaagagagauucaaagacugacagcacagaauccaguggagcccaaaguccuaaacgccauuccgggucuucccucgugacgucuguuuaaaagagcuggaaggaaaaauauaggaaaagcugguguuaaacacuacugcuguauagggacuuuauuucaaagaaaacuuuaaagguugaaaaauuuuguaaauuugauucuuguuagagggguuuuguucuggaaaccauauuugauaguacacuuuguccucacugaucauuuugggaggcacucuuguuauguacgaauaaaugguaaagccaaguauauuuguacaguguguuuuacauguauuuaaguagcauccaucccauuguccuuuaauuaucgccugucuuaaaauaacacuacagauagaaacuauaugauauauugcuguuuucaaucaguuuuacauuauaaaauaaacagggagaaauugguauuuaugcaaaacauuaguucuuaugaauccaucuaaugucauaauuaaucauguggcugugaaauucacaguaauaugguugccaaugaauauguuuacccagccugcuuugcuuuacugcaugagugaaacugucaguucaauuucagaaguaaccauuaaugauucugugaucacauggugugcagagagauagcuacaguguaacaauucacauaguguacucaaaucuguauaacuguaaagaaugaaugaaacuauuuuaacuaaacuagauuuuaucaaaaguagguagaauuuuuacuaugcuguaacuguuguacauucugguauuugaggugagauggcugaccuuuuacuaaugagacaugaguugugucucaaacuaaaugaacauuucagaauacauuauugcuguauguaaacuauuacuggaaaaaaaaaagaguugccuuggucauggugucuguucacagaaguaaagcccuaagucagacaggguaucuacuguuuuaugccuuguguagaugcugaggacccagcuugaguucucaucaagaacacugagccaucucuuccacgucuuucuuuacuguauucuucaggcauacuucauucuugauuucuuagaauaguaguguuugaagucaaguuuaugucauguuaaugaauuccuguaguguuugaagucaaguuuaugucauguuaaugaauaauauacacaauaaaaauugaagauguuaccuauauuauaaggaaagccacauaacuuucccaguuaugaaacauauaccccaccaccuugcuggugucuccucugaccuuagaguuccagccagugagguuucuuaguaaugagccaggagcuaaguauauuagauuucacaggucacaucuguccucgccacagaaaaucuuugcuauacagucuucuuuguggcuuuuuccucuuccacucucucuuccccccuucuuuuauuuuuuauaaucucuuuaaauuauaaacuugcuggauuggccucugcuagcuugccaauccauauuuuagaaucucuucauuucagaugauuuucagagaucagugccuucuuacagggcagagcuucagaacguuccagugaacuuuggggaggccaguuaaguuuugucauauuuucauguuaauacccaccaagacugguuugccuuuuuaccaaaugacauuucaggauauuuuuagaguucaucauagagcaucugcacauguagcuauauuaaaccuugucuuagcuaaagccgccucuguagccucugagagcucccuggauucuacuuaguccccccccccccuuuuuuuuaagauuuaaaaaaaauuaaagauacauauuuaauuauuguauguauaugaguacacugucgcugucuucagacacaccagaagagggcaucagaucccauuacagaugguucugagccaccaugugguugcugggaauugaacucaggaccucuagaagaacagucaguguucuauuaacugcugagccaucucuccagcccccuacuuaguccuuuauagugucagugaaugcuugauaaacacaccaagucuucuaccuaaauuacuagugaaacuugaaugagagaacaaugaauugauuguaacacgagcuuaggcuaucuagauguaauacacucuucugaauuacuuuguauagagagcugaauuacucuggacuacuguaauuacuaauggcaucuagauaaagcaguaaaucacuggaaagaccacuacuaccaccaauaauaauaauaauaauaauaaaaacuauuauuuaaaauaaaagaauauuaauuaaaugaguuaaaauuuguauuugguuuuugauuuucagaaaggauugacaccagucgccccaguucauaccaacaaagaagaugcagcugcccagacgaaucugggauuuauccaugcguuuguggcugccauaucagucaucauaguguccgaacucggcgacaagacguuuuucauagcugccaucauggcgaugcgcuauaaccggcugacugugcuggccggggccaugcuggccuuggccuugaugacaugcuugucggguaagggcacuugaccgggagcacagugauugggggaaagcauaugugugguuugaaucauccauccagguacauuggaaacugcuuauccacagaauuaaguaaacaacagcaagugguuucaggguaucacauuauuaaaacccagauuuuacuuagguggaauuuuuaguuauucagagccagaaccaaauacauauucucaucauuuauucacugguaguuuuuauccuuaauuuuuguauguuggauugauuuauucuguguaugaguguuuugccugcuuguauguaggugcaucauauauuaugccugguaccugcagaguacagaaagaggauuucagaugguagugagccaucagcugggguggggacugaaaccaggccucugcaagagcagcaagugccugcaagagcagcaagugcucuuagccacugagccagcucuagcuuugauucuuaaguccuuaauuuuauucuccuucagugguuuuuguuuuuguuuucuuuuucuucaguccagauaagcuuauuuauauuugcaauuuuagaaauaguauucaacaggccauagcaaauugcauguuuucuuccugaaaggcaagagguagcagcagagaaucagcuuucaguuuuugucauuaagcuuuuucuuacccugcuuauguggaauacagcauccuuuagucuucuuaauuguauuacuauuugccuuaauuaaagcuuguguuuuuauaaacauaaaaguauuuuagauauuuagaauaauuugaaacuaauuuucucuuuauaaguaauguguuacagagaggggauuaaagauuguacgagccugaggucuucuuacaguagaguguuuccuggauaugacagaccccugcacucaugagcacacagcagcuugguggccaggcaagaucaaaucugucaguauucacucauguaaaccaggaaggggcucgucguccucccgaucccaaacucaggaccuguggagagagaggccauuuucucuaagaguguagcuuuugguaggucagccauuuucuaggagagggcuuucuaccuaggaguauauggucuugaugauucuuuaacuaaaacaaaaaaugaaguuggggguguagagagggugugagugacuugggagaaguuaacaguggccccuucauauauacuuauauuucauauaaagauauacauuuuuauuuauguaucauauauuuaaaagaaguaauauuauaagaaaaagagucaaaacuggugauuucacgugggaugugcuguuugaccgcugucaggagggcacugcugaugcugcuggugauuucacaucagcacgucagaaugccccuguucugugcugcacaaugcagcaucacugcuccacugcuccaucaguucucccagcugaugugaugugugccugguccuucgccucacucugcucucugcuguucuucucuugcccucucccauucuacuggccaugggcagggucugauugcccuauuaggaccuccgcaucuuuguauacuuuaucugauguuaucuuaaguuauguaaacuuaaggaguugaaaauaucucauuucugguauacuguauaaaagcaaaaacacuuuuaaaaauaauuuacgccgggcgugguggcgcacuccuuuaauuccagcacuugggaggcagaggcaggcggauuucugaguuugaggcuagccuggucuacagagugaguuccaggacagccagggcuacacagagaaacccugucucgaaaaaaacaaaaaccaaaccaaaccaaaaagaaugaugggaugaaaguugccuuuacugaccuauggagugacugccagcucaguaaggugguuguguuacucuuguuaaccaucaaguguaucaaacagagcuuuacugaaauguaucaaguuacugcuuugaugcaugguagucuuaauacauaauuuuaaguacccuaacuguuauauuuaacaaugguggagaaaacugaaauauuaauauuaacuugaguaaacugcugugacuuaaguguuugagcgccaggaaagguuuuauuuauuuacuuuuugucuuuuuuuuuucuuuucuuuuucuuuuuuuuugagauagggcugcucagcugucugcagccagcugcauacuauaguaccaaaugggaagccccagggcaacacaguuccuaaguuuauaccacacacuggccucgguaugguggaaucgcucucauuucaucucccugaacacaaaugauccuuguucagugggaccuccauuauaugcugcaccaucacuuaguagucaccuugauguucagggcuggcaugguaacacaguuguguuucaguaacauugcuacacuuaaccacuggcaccuggagagcaagugugcaaaggauguagaugcggauuccugaggcaggaaccuaaagcagauuguaugugugccucugugcucugggccucaagacagaagugucaugggcuuggagguaucuggguauucaggcacuuacuggagggcuucagcauagguucuguguggguugggaggauaguguaucugaagagaaaaagaauaaauuuaggggauuucaaaaggcuuucuacauugaauuccaacgcuuaauuuuuuaaggcaguaguuuuauuuccuuuuucuauuguauaugugugggcuugugugaguggacagugccugugugcaggucuagaggacuuguuggucuuugccuuucacuugagagagggucucuuuuuuaccacuguguauauauaugaucccagcuagccauucuccugccucugacucccauuccccuugucccauaugggcgcuaagauuauagaugugugcagcuauggcugcuucuugaguuuauucgaauucagauccucaugcuugcaauaauauguuacccauugagccauuucccccaaacuucuauggaaguaauuuuaaauacauaaagccauacagauaaaaaaguauaaugaauacuguauaccuuucuugcuagaugcaccuacuauuacuaccuucccugacuccuuuagcauuuggguuacaaucuguguaaaaaauuugaguauguuuauauauuauuucuguaucuagguaaauaauguguacuuauacacauauaauuuauaucuauauuaggaagugauagacagacagacagacagacugacuaccauacuuuucuuuuuuggggacuuuguggucccuguuuccaccuguacaauguccauacaagaucagauguuugauuuucuauuuuuaaaucugaaauacuacuuagacuuuuauuaugcuuuaugauagccacauguuuuagagaauaaugucaugcccucucucauaucccauggccuuccccuuuucguguggaauguuucugcaugggugagcucaaguuaccuaaucuuggcuaggcgcugcaauggugucaugucugcagaagaauaucccaugaaaucauguggcauucauauuucuuuuccucauucauguggcuuacccaguacagaauuuucuuacuuagucuucuccugcagcuaauauccugccugugaggagauacugaaauacaguauauaccuugcucuuuaccaacauuuccccagagauuuaguguaauucuugcauauuuucccuugaugcauucaaaauucuagcuuccuaauucuggcauguguuccagaccuaagugaccgcuggccuuguccacuccuuccucucgcucuuaugcgcaugagcuuucuccagcuguuuguugacuacauuguccagaccacucugugggauccugucuggcuggcugccuuguucuuguggcagguucuuguucugcucaacuucuaguaauaagauccuguagguacauucugugcuugcuucauggcuuuuagaaaguucaccauaaugcucuuuguuaguaaaaugucuguuucuuggcccuuucagaagauaagagauagaaaauauaugucauauuggugcgucuacacauaccuauaaggaauuuuuaguauuguuucauaaaauguacuaaauuuacauaguuaaaaaggaggagugugaauuauguugucccccuugaucuuuugauaucugugacaaagaaacaucuacuuauggaguagaguguggcuuccaguuuauaaaauguuggcauucuuagaggacaucacagucugucuagcucaaguguugugccuagcacagauguaagggaagccagccauuaguugaguuugaguggagaaccagucagcauauuaagaaauguccuauagcagaugcauauaccauggaaaugaggccaugccugucuuggaaugccauucuaaaguugguguggaaagaaagagccagaaguauuucaggucauuacauauuugaugugucuaauaugaaccaguuuuccuucaacacuguaaauuaugauuucuuacuguaacucucuuuggucugugguagaagcacuguuaacacuguuggcauuuccuuacaguuuuguuuggcuaugccacaacagucauccccaggguguauacauacuauguuucaacugcacucuucgccauuuuuggcauuagaaugcuucgggaagguuugaagaugagcccagaugagggucaggaggagcuagaagaaguccaagcagaguuaaagaagaaggaugaagaaguaaguuguaaaguguugugugcaugcggauagcuuaguuacuuuccacuccuacuguacuguggcugaguguggguuacugugacuggcagggagggagguguccaccagauagucagcuuuuuagguugauggcagauguuggaaucgugggaacuauucugcauguuucugaagcauccaaauacuauuugccgaugagugggaaaauugacaguguaugaggcugguggcuaaagggcagucggaggauacaguguauuuucuuuggagaauaugccauauguuuuaaaagugacuuuaugcuauauucauaggcuuacuuggguuaaugguauuuuucauuuguuucaguuccaacgaaccaaacucuuaaaugggccagauguugaaacugguacaagcacagcaauaccucagaaaaagugguuacauuuuauuucacccauuuuuguucaagcgcucacauuaacguucuuggcagaauggggcgaucgcucucaacucacuaccauuguccuggcagcuagagaggugaguguauuggaccacgucuauaucaagaccagaguuucaguugcucccuuccaggggucggucaggggccacaggacacaucuguucauuuuaugaccuagaauuagccuccugcguuuucucugugucucuaguucuugaacccaaauuuaauuuuucuuuucguuuuuuugucuuguugaguucuuuuacuguguuuugcuguagcuggugucuuuguugcuuacuuuucugcucaugacuucugcaugcuuauugggaauauaaauuaguauaucacauuauccuagcacuggggagucuuguaaaugcugaucucauacuaagacugucuuaaaaacaaagaaaaaaaaaacccacaaaaacaaaaacaaaaaacccagcagcagauuuugugucacgggggauuuguucaucauuacaucugagcagcucuuggaucacucauuugucaacacugcuuuaauggugcagagaggguuuccaaguccuuuuaccugcuaaguucucacugaccuagaggguugcucacagaaaaaccaaggacaucagagugcucaccuugggacugcuccaagucuugcuuuuggagagcauuucugguccaccgcagcucuagcacugaugcagcaguuuaaguuagaggacacuguccagcccugauugagcagauaagagcuuagagagguggggugccuuauguuagggcccgaagugagcuugucucucccuugccuuuggguacauggauuuaaaagauucucuugguuugcuguugggguggggauggaucgccguccucuccugagagcugucaggucauuuucacagaugccaguguccugaggaacugcacgcucuugaucuuaagucugugucaguuauauuagugcacagacauuuaaauccuuggagaaguuccucacauaguucuacaguuuaaaauaggaagcauuucaggcaaguuauagggaaagguuuugucggagaaccuuaaaaaugcuuuauuuggagauggaaaaaauaaaaaaagcgggggggggugggugggugugguacucucuacucucccauuugauucucauaaaacaaacuugaaaaauucuccuuaauggcugugcccugccuucauuucuguuuuuccauuagaauuccagaauuggaccuugaaaaugaggcccugugguggaggagguccugccagggucagcggguggggcacugcccugcaguuccccauuuugugaguuucugucugcagaugggaugcagcagugcacaggccuguccagcccccagcccagcacucaugggcuaggcacccuuccaugccaccgacacuagcagagcuuaaagaccucuuaaacugucugguucuguuccuuuaacauuaaucuuuuuaugaaucaugcuguuuugcuuuugaaggaucuuuauuaaaauaacuuuauuuaacccagugaauuuuuuuuucuaguaccauuuauuuucagauggaaugaagcaucuucugaaguagcaguuuguggcaguaguacagucucagguucagacuguauauauguugccuuugaacuucccagcagcuggcugcugaccugcugcucagccgccuucuucccaguuagccacacugcacuccuggaucccagcaucuacccucagcccuuauaacaugcgucuuugccuugcucccaguucaguuuucuggggauuuucugcauugcuaccuccacucugacuuuaagggggaaaugaaauuccuugcuugguccuucugucccaaacucuuaacuucccaaaguucagaaacauuauugugguugguaaaaagaacugcucuaccgcccaguugccuaccuuacagaguaggguucaacuugagaucuaugcugacuagguuaugguagagaucucacuuaugugcugggggcaccauccccuggccuaggacccuggacuguauacaggugagcucaacacaagcauucauuaccaucugcucccuaacuggaugccaguggccagcggccccaaguuccuguuuucauggcucuuccucggugaugaacuguacucuugagcugugaacccaagcacaccuaaccuuuaugugccuuuuccaguuuuaccacagcaccaggaaagauaggacaucagagacguuuaucagugcugagacuuauugaggccaacuaccugguaguugguccccaucuuuuuuauaacaucuucucgguuacuugguugucacaccugauagcuuucacaguaucccaugucccuccccauccaucugcuuuucucuugucuucaucuccuccuaccccaguccagucagcacgauuucuuaccagaguuguuauuucuccuugggcuuacucccaacuaguucauugucuccauuaaacuuugaaagcaggaaucggcuugugcuaaaaccagccaaugggggguggggggguccuguagguagacauugaaccuuggccucuggcacaggaguuaaguggcagccuacagcccuacaccuccaucccgggcuccuaccuuuccugacuuacuacucuucaaggacuccucuccagggccuccuugucucucuguagaaacuuugaaacguucuguuguucuuccuucccaaauauacguggggucuuagcuacccuuaagggucaucuucuucugugaaggcuccuuguuuauuuuagcaguauuuaguccucacccucagcuaaaagcucgagggucaaggguuaggauuccugcucucaggaagcacagcaguucugugccacacgagacuuauaacucagguccauccugugcuguccacauucccugaagcagccaucuucuguguaauaaacucaacaguaugccuggaugguucagagcccauagcuaguucuauuuaacacuggccauucucaaacaccaucuccaacuuaacaagcuaacacaagcuacaucugcuuccaggacccuuaugguguagcaguggguggcacagugggacacugcuuauguacuggauuggcaguaauuggaggaaggaugauagcgcaaaagaucucuguccgaacugguaaggucucauuuuuuuuucccaugaaaaugcaaguaucaucuguucuaaugcuugaaaaucauggaggguaauagaaugcuagcucuuaucauuuuuccagagaccacuugaucucugugccugaucuaggccuugucaauauuugacacauuguuacugugcacugacuucuuuuccuauguguacaaaugagaaaaucacaagcuuaucuaaaauauggucacacuuguuuguuuuguaagccagugaaaaacuuguagaaguuuggccugaaguauuugauaagcagacccugugugaggcuugaacauuuucaacauuuaaaaugggcugggguccgagcuugugggcacugauagcaggcuuggccacagcacuuuuuccaugcugugccaucuccgggcccucgagagaccgggguggggggguuaaggugaugacugcuacaguccaacugcugcuugccaacuuugcuuuaacuucucuuucuacaagcagugcccagagaaaaggucuguuauaagggaagaggaaagcuucgggaacuguugaugucacaguggaagcaacacugacucccuucucucucucuuuuccagugacaaucaucggaggcaucguauuuuuggcguuugcauuuucugcccuguuuauaaguccagagucugguuuuuaacaagcuguucuucaguauucagcuuaagauaggcaacucuuuucuguacauaguguacauuacaacuaaaaguaaugggaaacacuguauuuuguagcauugauuuguaaguuugacccacuuaauuauuaugcccaaaagauauaaucauugauuuuauuuguaaagauuuuuaaaaagguuugacuccuaaguguggguucucucuagcuuaauuauguugacaccucagccuccacuucugcuugauauacgcguccacugaagugaggcugaccauugaguuuucuuguagcaugacccccuuauaaacacguuuucuccuuggucacuggggguuuaauguauaccuuaagcauuuccuuggggaaaagaaugaaugacuuccacuuuuaaaaccauauuccugagccaguaaucagcaauuuuaucuugucuuugggaauuaggauuguaucaauaacaaaugauaagaguugcuggcuaggcccauucucccucuuauuuuuuuuaauuggguaggacacccaauauaaaaauagucaauauuugacaacauggacuuaccaaauuaaaagagaauacuaugaauguauucauauuuuucuauauugaauaagcauuguaacaaacaauguaaauaaaagguauaacuaguac

SEQ ID NO: 2504 - RNA, 25368 nt, Mus musculus
guacuaguuauaccuuuuauuuacauuguuuguuacaaugcuuauucaauauagaaaaauaugaauacauucauaguauucucuuuuaauuugguaaguccauguugucaaauauugacuauuuuuauauuggguguccuacccaauuaaaaaaaauaagagggagaaugggccuagccagcaacucuuaucauuuguuauugauacaauccuaauucccaaagacaagauaaaauugcugauuacuggcucaggaauaugguuuuaaaaguggaagucauucauucuuuuccccaaggaaaugcuuaagguauacauuaaacccccagugaccaaggagaaaacguguuuauaagggggucaugcuacaagaaaacucaauggucagccucacuucaguggacgcguauaucaagcagaaguggaggcugaggugucaacauaauuaagcuagagagaacccacacuuaggagucaaaccuuuuuaaaaaucuuuacaaauaaaaucaaugauuauaucuuuugggcauaauaauuaagugggucaaacuuacaaaucaaugcuacaaaauacaguguuucccauuacuuuuaguuguaauguacacuauguacagaaaagaguugccuaucuuaagcugaauacugaagaacagcuuguuaaaaaccagacucuggacuuauaaacagggcagaaaaugcaaacgccaaaaauacgaugccuccgaugauugucacuggaaaagagagagagaagggagucaguguugcuuccacugugacaucaacaguucccgaagcuuuccucuucccuuauaacagaccuuuucucugggcacugcuuguagaaagagaaguuaaagcaaaguuggcaagcagcaguuggacuguagcagucaucaccuuaacccccccaccccggucucucgagggcccggagauggcacagcauggaaaaagugcuguggccaagccugcuaucagugcccacaagcucggaccccagcccauuuuaaauguugaaaauguucaagccucacacagggucugcuuaucaaauacuucaggccaaacuucuacaaguuuuucacuggcuuacaaaacaaacaagugugaccauauuuuagauaagcuugugauuuucucauuuguacacauaggaaaagaagucagugcacaguaacaaugugucaaauauugacaaggccuagaucaggcacagagaucaaguggucucuggaaaaaugauaagagcuagcauucuauuacccuccaugauuuucaagcauuagaacagaugauacuugcauuuucaugggaaaaaaaaaugagaccuuaccaguucggacagagaucuuuugcgcuaucauccuuccuccaauuacugccaauccaguacauaagcagugucccacugugccacccacugcuacaccauaaggguccuggaagcagauguagcuuguguuagcuuguuaaguuggagaugguguuugagaauggccaguguuaaauagaacuagcuaugggcucugaaccauccaggcauacuguugaguuuauuacacagaagauggcugcuucagggaauguggacagcacaggauggaccugaguuauaagucucguguggcacagaacugcugugcuuccugagagcaggaauccuaacccuugacccucgagcuuuuagcugagggugaggacuaaauacugcuaaaauaaacaaggagccuucacagaagaagaugacccuuaaggguagcuaagaccccacguauauuugggaaggaagaacaacagaacguuucaaaguuucuacagagagacaaggaggcccuggagaggaguccuugaagaguaguaagucaggaaagguaggagcccgggauggagguguagggcuguaggcugccacuuaacuccugugccagaggccaagguucaaugucuaccuacaggacccccccaccccccauuggcugguuuuagcacaagccgauuccugcuuucaaaguuuaauggagacaaugaacuaguugggaguaagcccaaggagaaauaacaacucugguaagaaaucgugcugacuggacugggguaggaggagaugaagacaagagaaaagcagauggauggggagggacaugggauacugugaaagcuaucaggugugacaaccaaguaaccgagaagauguuauaaaaaagauggggaccaacuaccagguaguuggccucaauaagucucagcacugauaaacgucucugauguccuaucuuuccuggugcugugguaaaacuggaaaaggcacauaaagguuaggugugcuuggguucacagcucaagaguacaguucaucaccgaggaagagccaugaaaacaggaacuuggggccgcuggccacuggcauccaguuagggagcagaugguaaugaaugcuuguguugagcucaccuguauacaguccaggguccuaggccaggggauggugcccccagcacauaagugagaucucuaccauaaccuagucagcauagaucucaaguugaacccuacucuguaagguaggcaacugggcgguagagcaguucuuuuuaccaaccacaauaauguuucugaacuuugggaaguuaagaguuugggacagaaggaccaagcaaggaauuucauuucccccuuaaagucagaguggagguagcaaugcagaaaauccccagaaaacugaacugggagcaaggcaaagacgcauguuauaagggcugaggguagaugcugggauccaggagugcaguguggcuaacugggaagaaggcggcugagcagcaggucagcagccagcugcugggaaguucaaaggcaacauauauacagucugaaccugagacuguacuacugccacaaacugcuacuucagaagaugcuucauuccaucugaaaauaaaugguacuagaaaaaaaaauucacuggguuaaauaaaguuauuuuaauaaagauccuucaaaagcaaaacagcaugauucauaaaaagauuaauguuaaaggaacagaaccagacaguuuaagaggucuuuaagcucugcuagugucgguggcauggaagggugccuagcccaugagugcugggcugggggcuggacaggccugugcacugcugcaucccaucugcagacagaaacucacaaaauggggaacugcagggcagugccccacccgcugacccuggcaggaccuccuccaccacagggccucauuuucaagguccaauucuggaauucuaauggaaaaacagaaaugaaggcagggcacagccauuaaggagaauuuuucaaguuuguuuuaugagaaucaaaugggagaguagagaguaccacacccacccacccccccccgcuuuuuuuauuuuuuccaucuccaaauaaagcauuuuuaagguucuccgacaaaaccuuucccuauaacuugccugaaaugcuuccuauuuuaaacuguagaacuaugugaggaacuucuccaaggauuuaaaugucugugcacuaauauaacugacacagacuuaagaucaagagcgugcaguuccucaggacacuggcaucugugaaaaugaccugacagcucucaggagaggacggcgauccauccccaccccaacagcaaaccaagagaaucuuuuaaauccauguacccaaaggcaagggagagacaagcucacuucgggcccuaacauaaggcaccccaccucucuaagcucuuaucugcucaaucagggcuggacaguguccucuaacuuaaacugcugcaucagugcuagagcugcgguggaccagaaaugcucuccaaaagcaagacuuggagcagucccaaggugagcacucugauguccuugguuuuucugugagcaacccucuaggucagugagaacuuagcagguaaaaggacuuggaaacccucucugcaccauuaaagcaguguugacaaaugagugauccaagagcugcucagauguaaugaugaacaaaucccccgugacacaaaaucugcugcuggguuuuuuguuuuuguuuuuguggguuuuuuuuuucuuuguuuuuaagacagucuuaguaugagaucagcauuuacaagacuccccagugcuaggauaaugugauauacuaauuuauauucccaauaagcaugcagaagucaugagcagaaaaguaagcaacaaagacaccagcuacagcaaaacacaguaaaagaacucaacaagacaaaaaaacgaaaagaaaaauuaaauuuggguucaagaacuagagacacagagaaaacgcaggaggcuaauucuaggucauaaaaugaacagauguguccuguggccccugaccgaccccuggaagggagcaacugaaacucuggucuugauauagacgugguccaauacacucaccucucuagcugccaggacaaugguagugaguugagagcgaucgccccauucugccaagaacguuaaugugagcgcuugaacaaaaaugggugaaauaaaauguaaccacuuuuucugagguauugcugugcuuguaccaguuucaacaucuggcccauuuaagaguuugguucguuggaacugaaacaaaugaaaaauaccauuaacccaaguaagccuaugaauauagcauaaagucacuuuuaaaacauauggcauauucuccaaagaaaauacacuguauccuccgacugcccuuuagccaccagccucauacacugucaauuuucccacucaucggcaaauaguauuuggaugcuucagaaacaugcagaauaguucccacgauuccaacaucugccaucaaccuaaaaagcugacuaucugguggacaccucccucccugccagucacaguaacccacacucagccacaguacaguaggaguggaaaguaacuaagcuauccgcaugcacacaacacuuuacaacuuacuucuucauccuucuucuuuaacucugcuuggacuucuucuagcuccuccugacccucaucugggcucaucuucaaaccuucccgaagcauucuaaugccaaaaauggcgaagagugcaguugaaacauaguauguauacacccuggggaugacuguuguggcauagccaaacaaaacuguaaggaaaugccaacaguguuaacagugcuucuaccacagaccaaagagaguuacaguaagaaaucauaauuuacaguguugaaggaaaacugguucauauuagacacaucaaauauguaaugaccugaaauacuucuggcucuuucuuuccacaccaacuuuagaauggcauuccaagacaggcauggccucauuuccaugguauaugcaucugcuauaggacauuucuuaauaugcugacugguucuccacucaaacucaacuaauggcuggcuucccuuacaucugugcuaggcacaacacuugagcuagacagacugugauguccucuaagaaugccaacauuuuauaaacuggaagccacacucuacuccauaaguagauguuucuuugucacagauaucaaaagaucaagggggacaacauaauucacacuccuccuuuuuaacuauguaaauuuaguacauuuuaugaaacaauacuaaaaauuccuuauagguauguguagacgcaccaauaugacauauauuuucuaucucuuaucuucugaaagggccaagaaacagacauuuuacuaacaaagagcauuauggugaacuuucuaaaagccaugaagcaagcacagaauguaccuacaggaucuuauuacuagaaguugagcagaacaagaaccugccacaagaacaaggcagccagccagacaggaucccacagaguggucuggacaauguagucaacaaacagcuggagaaagcucaugcgcauaagagcgagaggaaggaguggacaaggccagcggucacuuaggucuggaacacaugccagaauuaggaagcuagaauuuugaaugcaucaagggaaaauaugcaagaauuacacuaaaucucuggggaaauguugguaaagagcaagguauauacuguauuucaguaucuccucacaggcaggauauuagcugcaggagaagacuaaguaagaaaauucuguacuggguaagccacaugaaugaggaaaagaaauaugaaugccacaugauuucaugggauauucuucugcagacaugacaccauugcagcgccuagccaagauuagguaacuugagcucacccaugcagaaacauuccacacgaaaaggggaaggccaugggauaugagagagggcaugacauuauucucuaaaacauguggcuaucauaaagcauaauaaaagucuaaguaguauuucagauuuaaaaauagaaaaucaaacaucugaucuuguauggacauuguacagguggaaacagggaccacaaaguccccaaaaaagaaaaguaugguagucagucugucugucugucugucuaucacuuccuaauauagauauaaauuauauguguauaaguacacauuauuuaccuagauacagaaauaauauauaaacauacucaaauuuuuuacacagauuguaacccaaaugcuaaaggagucagggaagguaguaauaguaggugcaucuagcaagaaagguauacaguauucauuauacuuuuuuaucuguauggcuuuauguauuuaaaauuacuuccauagaaguuugggggaaauggcucaauggguaacauauuauugcaagcaugaggaucugaauucgaauaaacucaagaagcagccauagcugcacacaucuauaaucuuagcgcccauaugggacaaggggaaugggagucagaggcaggagaauggcuagcugggaucauauauauacacagugguaaaaaagagacccucucucaagugaaaggcaaagaccaacaaguccucuagaccugcacacaggcacuguccacucacacaagcccacacauauacaauagaaaaaggaaauaaaacuacugccuuaaaaaauuaagcguuggaauucaauguagaaagccuuuugaaauccccuaaauuuauucuuuuucucuucagauacacuauccucccaacccacacagaaccuaugcugaagcccuccaguaagugccugaauacccagauaccuccaagcccaugacacuucugucuugaggcccagagcacagaggcacacauacaaucugcuuuagguuccugccucaggaauccgcaucuacauccuuugcacacuugcucuccaggugccagugguuaaguguagcaauguuacugaaacacaacuguguuaccaugccagcccugaacaucaaggugacuacuaagugauggugcagcauauaauggaggucccacugaacaaggaucauuuguguucagggagaugaaaugagagcgauuccaccauaccgaggccagugugugguauaaacuuaggaacuguguugcccuggggcuucccauuugguacuauaguaugcagcuggcugcagacagcugagcagcccuaucucaaaaaaaaagaaaaagaaaagaaaaaaaaaagacaaaaaguaaauaaauaaaaccuuuccuggcgcucaaacacuuaagucacagcaguuuacucaaguuaauauuaauauuucaguuuucuccaccauuguuaaauauaacaguuaggguacuuaaaauuauguauuaagacuaccaugcaucaaagcaguaacuugauacauuucaguaaagcucuguuugauacacuugaugguuaacaagaguaacacaaccaccuuacugagcuggcagucacuccauaggucaguaaaggcaacuuucaucccaucauucuuuuugguuugguuugguuuuuguuuuuuucgagacaggguuucucuguguagcccuggcuguccuggaacucacucuguagaccaggcuagccucaaacucagaaauccgccugccucugccucccaagugcuggaauuaaaggagugcgccaccacgcccggcguaaauuauuuuuaaaaguguuuuugcuuuuauacaguauaccagaaaugagauauuuucaacuccuuaaguuuacauaacuuaagauaacaucagauaaaguauacaaagaugcggagguccuaauagggcaaucagacccugcccauggccaguagaaugggagagggcaagagaagaacagcagagagcagagugaggcgaaggaccaggcacacaucacaucagcugggagaacugauggagcaguggagcagugaugcugcauugugcagcacagaacaggggcauucugacgugcugaugugaaaucaccagcagcaucagcagugcccuccugacagcggucaaacagcacaucccacgugaaaucaccaguuuugacucuuuuucuuauaauauuacuucuuuuaaauauaugauacauaaauaaaaauguauaucuuuauaugaaauauaaguauauaugaaggggccacuguuaacuucucccaagucacucacacccucucuacacccccaacuucauuuuuuguuuuaguuaaagaaucaucaagaccauauacuccuagguagaaagcccucuccuagaaaauggcugaccuaccaaaagcuacacucuuagagaaaauggccucucucuccacagguccugaguuugggaucgggaggacgacgagccccuuccugguuuacaugagugaauacugacagauuugaucuugccuggccaccaagcugcugugugcucaugagugcaggggucugucauauccaggaaacacucuacuguaagaagaccucaggcucguacaaucuuuaauccccucucuguaacacauuacuuauaaagagaaaauuaguuucaaauuauucuaaauaucuaaaauacuuuuauguuuauaaaaacacaagcuuuaauuaaggcaaauaguaauacaauuaagaagacuaaaggaugcuguauuccacauaagcaggguaagaaaaagcuuaaugacaaaaacugaaagcugauucucugcugcuaccucuugccuuucaggaagaaaacaugcaauuugcuauggccuguugaauacuauuucuaaaauugcaaauauaaauaagcuuaucuggacugaagaaaaagaaaacaaaaacaaaaaccacugaaggagaauaaaauuaaggacuuaagaaucaaagcuagagcuggcucaguggcuaagagcacuugcugcucuugcaggcacuugcugcucuugcagaggccugguuucaguccccaccccagcugauggcucacuaccaucugaaauccucuuucuguacucugcagguaccaggcauaauauaugaugcaccuacauacaagcaggcaaaacacucauacacagaauaaaucaauccaacauacaaaaauuaaggauaaaaacuaccagugaauaaaugaugagaauauguauuugguucuggcucugaauaacuaaaaauuccaccuaaguaaaaucuggguuuuaauaaugugauacccugaaaccacuugcuguuguuuacuuaauucuguggauaagcaguuuccaauguaccuggauggaugauucaaaccacacauaugcuuucccccaaucacugugcucccggucaagugcccuuacccgacaagcaugucaucaaggccaaggccagcauggccccggccagcacagucagccgguuauagcgcaucgccaugauggcagcuaugaaaaacgucuugucgccgaguucggacacuaugaugacugauauggcagccacaaacgcauggauaaaucccagauucgucugggcagcugcaucuucuuuguugguaugaacuggggcgacuggugucaauccuuucugaaaaucaaaaaccaaauacaaauuuuaacucauuuaauuaauauucuuuuauuuuaaauaauaguuuuuauuauuauuauuauuauuauuggugguaguaguggucuuuccagugauuuacugcuuuaucuagaugccauuaguaauuacaguaguccagaguaauucagcucucuauacaaaguaauucagaagaguguauuacaucuagauagccuaagcucguguuacaaucaauucauuguucucucauucaaguuucacuaguaauuuagguagaagacuugguguguuuaucaagcauucacugacacuauaaaggacuaaguagggggcuggagagauggcucagcaguuaauagaacacugacuguucuucuagagguccugaguucaauucccagcaaccacaugguggcucagaaccaucuguaaugggaucugaugcccucuucuggugugucugaagacagcgacaguguacucauauacauacaauaauuaaauauguaucuuuaauuuuuuuuaaaucuuaaaaaaaaggggggggggggacuaaguagaauccagggagcucucagaggcuacagaggcggcuuuagcuaagacaagguuuaauauagcuacaugugcagaugcucuaugaugaacucuaaaaauauccugaaaugucauuugguaaaaaggcaaaccagucuugguggguauuaacaugaaaauaugacaaaacuuaacuggccuccccaaaguucacuggaacguucugaagcucugcccuguaagaaggcacugaucucugaaaaucaucugaaaugaagagauucuaaaauauggauuggcaagcuagcagaggccaauccagcaaguuuauaauuuaaagagauuauaaaaaauaaaagaaggggggaagagagaguggaagaggaaaaagccacaaagaagacuguauagcaaagauuuucuguggcgaggacagaugugaccugugaaaucuaauauacuuagcuccuggcucauuacuaagaaaccucacuggcuggaacucuaaggucagaggagacaccagcaagguggugggguauauguuucauaacugggaaaguuauguggcuuuccuuauaauauagguaacaucuucaauuuuuauuguguauauuauucauuaacaugacauaaacuugacuucaaacacuacaggaauucauuaacaugacauaaacuugacuucaaacacuacuauucuaagaaaucaagaaugaaguaugccugaagaauacaguaaagaaagacguggaagagauggcucaguguucuugaugagaacucaagcuggguccucagcaucuacacaaggcauaaaacaguagauacccugucugacuuagggcuuuacuucugugaacagacaccaugaccaaggcaacucuuuuuuuuuuccaguaauaguuuacauacagcaauaauguauucugaaauguucauuuaguuugagacacaacucaugucucauuaguaaaaggucagccaucucaccucaaauaccagaauguacaacaguuacagcauaguaaaaauucuaccuacuuuugauaaaaucuaguuuaguuaaaauaguuucauucauucuuuacaguuauacagauuugaguacacuaugugaauuguuacacuguagcuaucucucugcacaccaugugaucacagaaucauuaaugguuacuucugaaauugaacugacaguuucacucaugcaguaaagcaaagcaggcuggguaaacauauucauuggcaaccauauuacugugaauuucacagccacaugauuaauuaugacauuagauggauucauaagaacuaauguuuugcauaaauaccaauuucucccuguuuauuuuauaauguaaaacugauugaaaacagcaauauaucauauaguuucuaucuguaguguuauuuuaagacaggcgauaauuaaaggacaaugggauggaugcuacuuaaauacauguaaaacacacuguacaaauauacuuggcuuuaccauuuauucguacauaacaagagugccucccaaaaugaucagugaggacaaaguguacuaucaaauaugguuuccagaacaaaaccccucuaacaagaaucaaauuuacaaaauuuuucaaccuuuaaaguuuucuuugaaauaaagucccuauacagcaguaguguuuaacaccagcuuuuccuauauuuuuccuuccagcucuuuuaaacagacgucacgagggaagacccggaauggcguuuaggacuuugggcuccacuggauucugugcugucagucuuugaaucucucuucucuguguugcugcucacuggcguagggaucugagacagccgggcugaagugcugucuucgcggcuuuuccuagggcuaggguuguaauuaaaaggugucacucuggcagcaacagucccacuaggugaacuguguuugcuggagcaacuagaacugaaagggguacacccugcuauacacgucccaccagucucugcugcagggacaggguuacucugucugguuuugccucaguuccuuucuguucuggggccucuaccugaauaaaggaguucagacaguuuuccagacccacaguuuacacaggacugccauugcccacacuuuguuuuccaccaaggcaacucuuacaaggacaacauuuaauugggguuggcuuacagguucagagguucaguccaugaucuucaaggucagagcaugguaguguccagacagacauggcaccagaagaugucagaguucuaugucuucauccaaaggaagccaggaacagacugccucccauguggcuaggaggaaggucucaaagcccauccucacaguaacacacuuucuccaauaaggccacaccuccucauagugcacucccuaggccaaacacauauaaaccaucacauacccucuccuggcuuccacaggcacgcaugcggcacacacucacaaccacauagauauagauagauacacacacacacacacacacacacacacacacaagcauucuaaggguaaguccagcagauggcucacugaguuaaagguacucgcugccacacuugauuaccuaaguuugaugcucaagauucaugguggaaggagagaaccaacuccuacaagccaccuucugaucucuguauauauuugcaugucuauacacacacacacaaaauaacaagugaaaacaaaagaaugcaacgaaauaaagcaagcacaauccuccauagucucaaaacuuuccauauagaagacaagaaaaaccacaucuauagcucuuuccacuuauuaagccaguccuggguggauaaaaacaaaguaucaggauuuugugaagacagagauguuuaagaauuaagcauuguaacugucccauuugggacugagccacccacagucacuaauucugacugguucggauaccuguaguggccucugacuucuggggaauguuuccuuacgaguacugagcugcacuuaacuacagaugacagggugagcacugacaaguacagaccaacgacacuaacuggacucagcagguuccguguauaaucauacauauguguguuguguguguguguguguauacacauacauaauguacauauaacaauguauaaauuugagaggacccuaguggagucagaagggguaaagcgggagggggaaauuaugcaaauacaguauacuucugugugguaguuaaaauaggcuuugcaccgaaaaauuccuauuuuaauucuuggccacagggagugacacuauuaggagguauggccuuauuagagaaaguguggccuucuugaagggagugugucauuguguaggcgagcuuugaggucucuuauacucagacuccacacaguguagaugagagaccccuucugacugccuguggaggacagucuccuucuguugccuucagcuccuucucuggcaccacguaugccuggacgcugccaugcuuccacaaugaugacaauggacugaacccuugaaacuguacaccagucccaauuaaauguguuuguuuauaagaguugccuugguaagacgggcagugguggcgcaugccuuuaaucccagcacucaaaggcagagguagguggauuucugaguuugaggacagccuggucuacagaguugaauuucaggacagccagggcuacacagagaaacccugucaugaaaagccaaaaaaaaaaaaaaaaaaaagaguuuccuugguaguggugucucuucacaacaauaaaacacugacuacuccuacaugaaauucucaaucuuuaaaaaaaugaaauguugauuagaucagaaaagaacguuagcauuuaucuacugaucaccauggaaggacuggcuccuuggucugguaaagcuucacugacucaggagaguggcuaaauccacagcucuggaaucagacuguccggguucacauccaaagcauuaccaauacacccuuccuccaucaucugccaacaaaggcagccacgcccccaaacuguuaaagcguuucaggugagucaaguccucaggccggggucuauauauagcaacacucagauccuguaacacacaaccgaaccagcucacuagacuuucgguaaugaacuacuucauguuacuccacugaggaacuggagagagaauaugcuaugucuagauaaacccuuacuucuaucuacucaauuucaauacuuucuaucuaaucacacuaguuccuaaaauagaucuucuuucucccaaagaagccagcagaacagaacuuaauguaaaacaccagaagcuaaaaaaaaaggaagaaagaaaggaagaaagaaccucaugauaguuuaaauuucccauuuuaaaaaauaaaaaacuggcaaaauuauuugagaaagcaaggaugcaacauuaauauguaagcagcauuuuuaaaaauugccaagaaauaccaucuucuucauacuaucuuugaaguggcauguuauacgcugauuccucccccguggcucagucaagggcagugcagcuugagaacucacggagcuucugcugaccacagccucagccagucagaauucccuucccagcguucuccauuaugcuccauuugcccagacuccucaaacccuuuuuauccucagcccuugacaucuagccgcauggacaccaugauaaugugucauagaaggguugagagcaacaaaggugaggacagggacaccgggaagcugacaguucugugguagaaacauauaucaaugaaaugcuaauaaugaagagacaaagcaauggaaugucuaaccgacugggaccaggaccuguuaacauucauauaaaacaugcuggcuggagaggcagcucagcagugaaggcacugacuuccaaaucuaccaaccugaguuuuaacccuaggucccucacagugaaaauagaacugacuuccacacgguguccuuugaucaccacauguguccugaggcacacauaaacacacagacaaauaaauguaauuuuaaaaacucaagauuauggaguuauaaaaauaagaauaagaauguucgagcugggcgugguggcgcacaccuuuaaucccagcacuugggaggcagaggcaggcggauuucugaguucgaggccagccuggucuacaaagugaguuccaggacagccagggcuacacagagaaacccugucuagaaaaaccagaaaaaaguucuacaaauacuaauauugaaaaacuauuaaaaugcuuuagauaaaauacuuauauaugauauuaucauauauauggggggaaggaaguuauauaugugauucuaaaugcacccugaaacaguggacauuuccagagaaaggaucaaaaucagguuagaugagccacuuucccuuaagaaccaacuacauuccagcucuguagacugcauaguuccugugguaauuacaacucugcugcuauaacuucagagaagcagcugucaaauacuuuaugaaacagcauggcucuguuccaaaggaacuuuacuuaaaacaccagccaaccagugguauucugguguguggggccacaaauuaggauaagagauggcaaagcaguacuucccaucacacagucagaauucuguuccuucuagauuuuugccaucaugcacccaaguauggauaccuuguauccuucaaagacuucugugaacaaauuuuuuuucucuugugugugcacauucuuaugagagaaggugcccacaggauccagaagagaguguuggaucccuuggagcuaaaguuacaaguagcugugagcuacccuacaugggugcuuagaaccaaacuugaauucuucaccuucucuuaacaccugagucaucucucuagccccaucccaugccugccgaccugaccugcugcucuaacagcagaucaguuccucguggcaucccaccaagaagucuaugcucugcguucacucacucaaaggucagggagcucauaccugcggcacacagccuuugccugaacaaaugcagugugcgcugugagguucuuucucaagauccaaaggauccaggacuagaauggcuaaccagaaaguuuuacacagugugugcuuucugccugauccugaccaacaaugacacauagagcuuguuugucucagacaguaagccacuggaugaaugcuuguggacugaaaaacuguaccgcaaauugaaaguguaccugcuaaugauaaccuaacucaagaagaaagccccuaaaagauucugaauggaagauaaacaucgaugaggcacuguagcuaacaaccagggcagugggggauaucugcuucugggccuaucaaaaguugaacugccgaagagcaauggugaaacuaaccagaaggaaaauacaugcacaugacagaaagaaaaaaaaaaagucaauagaucuuaggaagugcaggguucacuuaaggauugugguaagacuuuugggggaggguggguuggggagucuggcugccugauaacgucaugcuccuaaaagcuauggggaaaagaaaaaucaaagcaaggaguguguucuaaacauguucaaucagaggugacaaguaguuucauaugaagguuucuaagacaagugucagaagugguucacagauguggcuaggucagacucuggguacagaccuggugccaguagccuaaauuagccaaggcuguuugcaaguggaugagagucccaggggagaaggcaaacaguuaaagcucacaaaaaauuaaccugacagcugugaaccagaaauggagagagcacaacagaaaaucucaacacugccccauccccagguuacccaggacuugcaaaguucaugccccugaacuugacuccagucuacacucaggggaaaguucuagcuagguccuucccucugccucuuucacagcauaccuagagucguggacucaccugccuuuucauuucuauucccaggugcuuuucucuuuguucugagaauggcuauuugaugguuuguaugugcuugggccagggaguggcacuaguagguguagccuuguuggaguggaugugucacuguggcugugggcuuuaauacccuaguccuagcugccuggaaguagaauucugcuaacagccuucagaucaagaugcagaacucucagcuccucuugccccaugucaccauucccuccuugaugauaacggacugaaccugugaaccuguaagucagccacaauuuaaugguaagagcugccuuggucauggugucuguucacagcagaacccuaagacaggcuauacuuuuaacccuugaguggcaaugcugcugaguguucaaaaggagguagcucacuuaaggaugccucaugguauucaccuacuggucuacaaauuugcaccugaaaccacaauauuuaaaauauggaaguauaaaucuuuucccaaaucucuagcucuucucucaaacaucuagggcaucaugcuugcccaacuaugcauaaucuaauagaaauaucuuauuccuauagcuuuuccuugcuacccuaaccauauacaaagcuagaagaagguugaguugucuuacuguucaaguuaaauuacagucauauucuuuuuuauacaaacccugggguugggaggcgccucagagcuaagaagccugaagaagaggaauauuuucagaaauccaucccgcaguauuagcugcaugcuucuggguuccuagagacacaggauguuacuuuguagaauguaacagccauacagccaugcucuaauggacugguuugcuuagugaagcuauuuucugguccagugaaaauaacuguacagcucuccccacagcucuccaaugcaccacuguugucuugguuucuauagccagcggacgagcucaugagauugugaguuuuauggauaucuuuagcugggcucagucuccccaccugugcacacuaaguaugguguugcaacacaggcgauuuucagaugugguuaucauuuauaaccagcugccuuaaguaacagauuaccugagauaacguaagcagcacaugcaaucauucaaaaggccauaaggccaagguggaggcuuucuuacaaagcacaaaguacacuggccaaaggauguugaggccaugccugagagaagauaacuaacuuagcaggucagucuccacaacugucaaaucccucuuuaagagaggaacuugggauauaauaugauaccuuagaaagccuaguuaguggugggggguaaaggaagaagggaggaaagcagacagaaaggaaaaggcugacugagcugugacaguagacuguugauuauuauacuaaacgucaguuacuaagugggucccugaguuacuaaguagaugccagucauuuucacauaauuucacuugauuggcagaacccuagaggcugugauccuaauugaaccugagguguuuggcuuaaaauuuuaagagagcagguagucaugucaaaugaagacagaaaaagagcucuggacuuagauauuggucagguuacaagugugcuucaaacugaugggcuggaggccuguagagaaggcuccgcagguaagaguccuagcugcuuagaguucuuuacagauaaauaagucucaaaaaggacacaagagcaaggagggaacucagaugacggaagauuaaagcaaagauuagcuaacagguaacucugcaguaggaguggguuuuaaagcagcagaaccgaaacuaacugggccaaguaguauuaauacagcccucauuuauucuuucccuuccaaaacuaggagaaacucuauguggaacuaaaggaagcaaugggcggggagagaaggaagaagcaaaggcagaaugcacuggaggucagaggagagcagaggagggaagggcugggauuguggcucaacgacucuggcuuaguccacaacacugccccuccuaccaaaaacaaagaggaggaggaggaggaggaggaggaagaagaggaagaggaagaggaggaggaggaggaauggaaaggaugacaguuugauccgaaacgugaaaaagacagaaugagcacagaagccaauacgcuggaaggagugcaguuucaacucaguuacaaauuauaccacaaaaagacacgagauccuagagggucugcucagaguaucccagaaccaccacuaugucaguauguuaauauguaacacacaaacugcauuuggagaacaggaucagcaaccuguacuuaacaaaaacucuuugcagagggcugaggagauggcucaguccgcagucuuugcugcagccuaagccuagagccucaguguucuuccaacaagauggcaaguagacaggagaacccccagaagccugcaggacaaccagcauaccacacacagcauaaaacgagagacccugccucaaaagguggaugguggggacccaagacaaacaacaguugcccucucacuccauacacauaucaugacacacuugugcccauucucucauauuauauacacagacacacacacacacacacacuccuacacguaaguccucauuuaggaaacuguuucuuggagaccaggucucacuacauagccuuggaugcacucaauuugaagccuccugugcugagauuguagugugugucacccaccacaccauuaucaagaagaaaugacaacaaagaaagaugcaauucccaucuagcuguauaguuuaaggaacacaaacucacuguauucuccccuuacucaugaugaaaccaggaaggaugcuugcuuugaaacaaaaucuauagcuugccaccaauagacugauuccaucccccucaaaauguauauguugcuuaauaagagauuauaaagcaaaagguaucaucauguucguaaauauaaaauuugaaacaaugcuuagaauuagccaagccucaacaguauuggcaaagucagaacaagucuuuucagaaaauauugaaauaugcaaaaaaggagaaaacaaaacaagaagccaucuaacuuacaacaauggcccugcagacaaacccaguuuuaaaagaucacagugauuagagacugaggcaaaaguagcaucuugcuauggaacugggucuauaauaaaguucuaaguaccaacauagcccagguuaacauaagacucaggcccgugguuauagguguaugccaccaugaccugauaaagcauuuuacuacaaguuuucauuacaaugucuaaguccuccugggugauuucacugaccuaacauauuauuuuauuuuuacuaauauuacauuugacuccuauuagaguaaauauguaacaaguacauauucauaagacuauuuucgauuaacauuuagcaacucuguuuuaugaacuuuaccauucuauauauuuacauauuuaaagcagauuacuuaauuuuacugauuuuucuuaaguguucuuuugaugacaugauaacaccaaauaaauggaguaccaaaagcuucauuucaugcagaggucuuuacagcucaaagcaucaaucacaaucacaaaaggcugagaucugggugcugaagaagacaccuucuguguuuaaugcaguuuaaugaaaaugggaacacgauggcuucuguggcggugccucacagugaguaagccaagaacagcagcaagaggagagugagaacuagaaccucggcaggaccagauaacaggacugggcaggccuaccaacacugcuccucggccagauuagcucuaacgucagaauauauaggaucuauauucugcccagggaagaaauaggaaaaaaacaagaccaaacucaggucaccaucugcagcauaaaaacuguaguuuacucaugacuguauguucaaaggaaaugccacugcuccugccucaaauucccaaggacugggacaacuguacaucaccaccggccuucuuuguaacuagauuauaaagacgaagaacacucaacacacagcgagcccugucugaaaauucagccaccuccuuaacccaguaagauauaaccacuugucugcacugucucuucuaccagaugccuguugaugaaagcaggaucccccuuuaguuucacaguucacucucaaugcgguggccuccaaaggcuaaauuuagauaucccauccuuuuaaaccauccacugcucauaguugcaaagucagcugaaacccagauacucaacaaauccgaaucacuuuauauuguuguuaaacuguauuuugaucauguauaucaaugcauagaaacaagagauauuuuuauuaagugguuuaagaaacacggaagaaaaaaaauuuauguauaucacuacauagaaacgagauauuuuuauuaagugguuuaagaaacauggaagaaaaaauuuuuuucacuguaaaacuuuuuucacuuugugaaaaguuauacaaaaacauaaaauguuuuuauuuacaguguuuugcuauuaaguguaaacugucaauuccuaauggaaaagaaccaucaaaauauaugaaaauauuaaaacaaaaaaccauagugucugcaccagcaaguccuccaaccccuuaauuguaaagauaagaaucuguaagacacuucacugaggccacacauacugucuuaaccacugggacguuuacuuaacaugguuacauuuucuccagcaucccagaaaggacugcaaaucuagcuguaucuaccaguauuucugucucaaaaauuacaauaugacuacaaccccuaugaaaugccuaaaaaguuauauacucguaaacugcacucuggccccuagggcuguuucacucccaguggugacuguuuuaaagcaaccuucugaugcagagcuaugugggaguugcucaaugacaacucagcaguucagagcagagacagaccaugccugaauggcagcaaggguugacagagggagaaugggcagagaagccccguccacccaaugccucuacgccaaaaaucuagagcccugggaucugauggugaauggcuccugcuucacaugugccaccuggucugcacuaccaucagauggccauuuaucucucuagugaaacaggucugaucugcccccacacacaccaugugugugugugugugugugugugugugugugugugucaaacuuuacaagaguucuagaauuaacaacuaaauaaucaguugcaguucaauuuucuaagcuaaaaucaauaaaugaacaaaaucacagguagcagauaauaaaagcugaguuuuucuucaucuaguaaauccuuuagcaaguaaaaggcggcuggauauauacucuuaaaaaaaguuuuuucccugcuugaguucauuuuauaguuuuuuccauaaaaguauuuaaaaccugauaggaacugaaauguaaaaaucuuagaauuuucucauagaaaauucagccgggcguggugguugcacgccuuuaaucccagcacucgggaggcagaggcaggcggauuucugaguuugaggccagccuggucuacaaagugaguuccaggacagccaggguuauacagagaaaccugucucaaaaaaaaagaagaaaaauuacuuagcaaaugccaaaacauacacggucuuaggaaagagauaaaaaaaaagaguaugcuauaacaauguucucagggcuucaacacacugaagagcagacagaaaccaagucagaagcaagaguguaaaaauagauaaacauaaaaacccucaaaagaggagugggcugggcaucacgagaaaaggcuuacaucaauguguuagccaucaacacuaaacccauuacaacaaauggcuagcagggggguggguuuucaagcaaacucaaggacugcagacagcaccuggcagggugagaagcagggaucugguuuccagcucugggucugccaagaaucagguuuuccgaaccaccacucuucucagaccugcacugccccauccacaagcaggaaaugucaccugcucugcccgcuuaacagcucucacuaaaucuuaccgucacuauaacuaaaucuccuaacaggugcugacugaccugaccucuuccugaguacuuccaguaaggagaauuuuuccuuaguucuccucaagaccauugcuacauucgggacaggugauucuuagaaaguacuugcuguguaaaaccaaacucagaaucacagaaauucccaucuccugauacuacauagaaaaacaaaauacuggaaaggccaaaggguaacaugaacugugaagaaaggaaagcgcccaggacucagggagugcucuucuaaccagggcauccugggaagggcuccggaagguucugcuggcucuugaagaugggaaggguccugaaccacaggccccaugccuggauucuguucuaaggucuuugcucaggggaaaauggcagugagcagaggucagguuucaguucuggaagccacugguuuagaacacagcgaggcaguggugggucccuaaaagaccugggguuuagcuggaacggcauggugaugggaaaaugaauaucuauccugcggucacccugaucuguacucaagucaggacagccauucucuuggagggcagauaaagacagaaguaggaaagggaaugccaaaauggacccuacuaagagacuaaaaaaacuccagaauguaggagucaaaauuggaaauagagaguccaacucagaggaaaguaacauagaaaggagaaauucuacgaacauagauuaaaagguuaauuucuaucuaucugguaaugguuaaagaaacuuaugaggcucuaguuuaccuauaaauggaguuuuggaaucccucacuauagagcgcucuaccuuugggcacaagucucugcauucaagggcaacuuccuucaugccaaaacacguuuuuuuguuuuuuuuuuuuuuuuaagggaggguggcaacgcauaaucucuagacacuguaucuggcaagaaccacagggugugccgagcugaauucgggugagcaucucugguuggguugcuucaacaauggcugauacuuccaacaaugugaugcuacuucgagagagacaagucucccagcggcucuguacuaaaaacuuucuacuugggaugaugauuuccagucuuuucaguauggcccaugugaucagcagaaggcagaauccagagcaagccugucgguaccagggaucuagaggaccucuggggagccccgguuggggcccucacuuucccuucccccaagcagccaggccaggccaggccgcgccuaagaaagccgucuugucacccuccucccagcgagcggagcaggggccggcuccccucccccagccucuucggaaagagggcggcgccgccagcgcgggagccugguacccgacugcgggcuccgcggccucagcccgccccauccccaccagcccgggcucucaccucggcccgggccggcucgaggcccugcaccgccgcgggcugcggcugcagcugcugggcgggcgccggcggcuccugguuccgauggcucaggucuuccuccgggccggcgcggaccccggccggggcccagagcaacugaagcagcaagagcacgagcagccuucgcgucggcgcccggccgcucccccgggccgcggccgccaucccgcccgcccagccggcaccgcgcugcggcaggaagaagugcaggcgaagggaagcgucgagcccggcgugccggcaggcgccuccgucaggccuggcugccgcucagggggcagcccugcagcacgcgggacgcggggaccggaccgggacggaccggcggcgggagcuccggagcagcugggcagcagaagccacacacuccuccaacugccuccgcggcccaacuccuccggcccgcccccuggccaacacgaccucccauug

SEQ ID NO: 2505 - RNA, 2740 nt, Mus musculus
caaguggagcaaggggaacacgcauuuauugcuggugggaaugcaaacacguacaaguuauguggaaaucaguguggcagauccucaggauggugggaauggaucuaucccaauauccagcaacagaacucuuaaguguacacccaaaugaugcuucauccuaccacagagacacuugcugucccguggucauugcugcucuauuuauaacagccagaaacuggaaaugauguaggugucuuucaacaaaaggauaaagaaaaugugauacauuuacacaagggaggauuaaaaggcagaaccaugaagcugcagguaaguggaugaauuaaaaaaaaaaaacccacacacccugaaugagguaacccagauucugaaaauaauuaugggauguauucacugauauguggauguuagcuuuuaagucaaugauaaccaaaccacgauccacagaaccacagagguuugauaaagaguaagaugagggugaugaggagaugaugguucuuucucccaaggaaaaagaaauagagauaguuauggaugagguggggcagagacugggaugagaggaucaaauggagagagggaaggaggaggaggaucaaaggggaugcuacagggagaggcagcuaaaaguaaggaccaugguggguggacaguauggaaaccucaucaguagaagcuuucuaaaacaugcacauauaugaagguaauuuaaauuaaaucaucaaauaauggggagauggacccccagcuggccaucucuugucacuaaauaaagcuuccaguacuagauucaguuacaucaaauugauuuguuagccagagggaucccaugggaauccucaaacaacccaggcuauugacaaaacuauagauuacuccccacaacugauggcaaggacccauugcuaaaaacaacacucacacaacucuuugaauauggagaagcugagcuggugccuacacagagccuuugcuccuauuuuguagugucuuuguuauaggaaggugcuccgcaugcuaccaaagaagaauuguaaccaccaacccagccacaaacccuuggaucuacagugguguccuggcugcaagauaagcuagggcaaugguggcacugagucugugggaaugaccaaccaaugucuggucugacuuaaggccaacuccacaguauggaaccuguaccuaacgcuguuagggugaccaagaaccugagauuagguaaauaauauaaauagauaaauagauugagguaaaacucaauauuauuguucaaaacaacaaacaaacaaaaaauacaaaaacaaaacaaaaaaacaacccaacccaaccaaccaaacaacaaaacaacccaaacuuaguaaugagaugacucuuaaugauaucuugcuauagucauagaucagucuugcucagcccuaaaugggugucuuggucaaauccuuuccuucagggcuuggguaacucugaggaagagagguguaaaaaguguuaagagccaaagagggcagagacaccaagaagacaaggcccucugggucagcacgaugacgucacagacugggcagcacgcauggcucagcaccagagccaaaaggacagucuccaauugauaaccauacuauagaaaauuugguuucccccaagggagucucacuggggaagaagcuacucuuaaggguaggcugcaugcccagcaguagacggccaacaggagacaaacucaauagcaucuuuggagguuccuggucucauaauauagugcuagggcucuuccuguuuuuuuuuuaauuaauucuuacuauauuaauauaauuaauuauauaucaaguuuauaauuaaugauauaauaauauauuaauuauauaauuacauauauguuucuucuuaguguuuucaugggguuccugagugugcaaaugagugagucucucuuuucuugugccuucucuugggcuuuuuucccccuuucuguuuauuuauuuugaccaauucugauguguuaguuuuguuuuuaaucuuagauaauuuuuuuacuuuauuauuaucccacagaagccuguuuguuuucuagugagagacagaaagggggggugaguuuggaugagaggggaggagaggaaggacugggaggaguagaggcgggaaacuguaaucaggauauaguguaugagggaaaaaccaucuauuuucaauuaaaggaaaagaaaaaguaaacagaaccaacauugguacaugcaugucuuuucauuuuuacaaauaaaaugucauaaaaguaguuggcaaguuuucccaguacauuuuagaauauagguaaggacagaagaggagagaaaacucagcugcagcauucucggggaccuaauaugucucucccuguguggauuaagaagugggcccugcaugccauuuuggaggaaacacagaauagcuaauuuacccuuugguuuguacuguucaccaacgugauaacuuugaaguuaacaauguggaauaagcuuuggcagaggaacgagacccaucaaauccuuugacugauauggacaaaaccccuaaaacugagguagcucaugcuguuucuagugauuuuuuuuuuggauuauguguuaaaacaaugacaaucccugcuguuuguaauaaaaaacacuuugugguaguguccaaaaugcauuuccauuuacaaaauacauuauugcccagcuucuaacuagccuggagggcaaagaguuuaaga

SEQ ID NO: 2506 - RNA, 31858 nt, Mus musculus
cgggcgcccgaagaugacgcagagguccguuuuacggcugcugagcgucugcggcugggcuaggaagugcacgccacgcgcugucgugagaagguggggcgggagagcgcgggcgacccggggagacuuugugagcugccggaccccagcuuggagcggcugugugggucaccucggucaccugcugcgccaccucuuagcgugguuccgagagccaacgagaggcuuuugugauuguaauuaagguggcugcgugagaaguauaagaugcagacggauaauuuaccuauauauauaaugcccaguauagggagaacccuuaagaucaggaucuguuggugauuaaauggcuuuauuuacaguuguacauuaccgagcugcuaaucuuaaggcuauaacacgaaauuugcuugcuaggucaucccuuuucauggcucacuuguuuuucuuuccuuuucuuuuuuuuuuuuuuaauuuaaaauugugcgugugugcgcgugcagcauggugaagaaacaaaaaggaccuuucggaaguggguucucuccuuccauuaugugagucccgugaucacacuuagguuuucuggugugauggcaaguuaguuucuccacugacccaucucgauggcccaagucagucugaagggaggggagggggacaaagacagggacagagacauaaaauucaauggcugacaugaauaucuggacaagacugaauuuugccacugggagcuuuuaaauucaaaguagaaaaacuccuuaauuauagauuuuguguggugaguuuuguagcuaguuauaaaaaugacauuuuaagaacuaaguuauagccgggcguguuggcgcacgccuuugaucccagcacucaggaggcagaggcaagcagauuucugaguucgaggccagccugaucuacaaagugaguuccaggacagcaagggcuacagagaaacccugucucgaaaaaacaaaacaaacaaaaaaaaccuaaguuauagucuuguuauucuacugcugugaauuauguuaguagauuauauuuucuugugagaaaauagcaguuacacgugcuugcuuuuuagagaaaaggcagcuuuuaaacagacuuuuuuuuuuuuuuuuaauuuuagguauagcaguguuuuaccugcauguauguaagugcaccauguucgugccuggugucuucaaaggcugugggaucagccagaacuggaacuauggacuguauugagcuccccaguugggugcugguauggaaucugugucuucugaaagaacaaggacgguuuaacuccugagguacauccccagguucaaacuagauuuuuguaaaaauauguauaauacauuaauguggaaaauugggcgcuuaacaaaauuuauuuggguauucuguggucuucuguaggcaaaaauagcaggagauacucuacugcaauagccuuuuuuuuuucuuuuucuuucuuucuuuuucuuuucuucucuuuuuuuuuuuuuuuuuuuuuuuaaagauuuauuuauuuauuagauguaaguacacuguaguugucuucagacacuccagaagagggcaucagaucuuguuacagaugguugugagccaccaugugguugcugggauuugaacuccggaccuucggaagagcagucgggugcucuuacccacugagccaucucaccagccccuuuuuuuuuuuugagacagguuucucuguguagcccuggcuguccuggaacucacuuuguagaccagaccaggcuagccucgaacucagaaaucugucugccucugccucccgagugcugggacuaaaggugugugccaccacgccuggcuacacuuauaucccaaaauaaacucauccccuauauccuguagaacauacuauauguagaucauaugauuuguuuaauggccauuuguggaaaaucaucuuuuguguacauaaaaguuagauuuauggaaauauuuguuuaaaaauacccuaaguaucaaaauagucuuguucuuuaaaauuuaauaguuaggaaucacauuucaguuuuuuuguauccuuuuuugacuuuauggguuuaagaaggccuuuucuuuaacucaguuggauaguaauuaaaugacaaauugaagaguaauucuauucugaaucaguaaguaaaccgcuuaaguaugaacagguaaagaauuggaauaauaugacacuugauaaaucuuauuuuucucugauauauguuaauaggauucagaggaaagucuccuuugccuucaaggaaacuaggaguuaccauauuuuuguuagcauugaucccuagugguuuuuuuguuugcaguuuuuuugagacagaaucucuguguguaacccuggcuguucagguacucuuuauauagaccagguuggucuuacagagguccaccugccucugcugggauuaaaggugugcuccaucaugccuguuuuguuuuguuuuguuuuuuuuggggggggguucuuuuuuuuuuucuuuuaugugaaugucacauccuucccacauauuuaagugugauccaguguucauugacuguugucaaauugcuuuuuuuuaaugucauugcuuucagcaaaguugccacagguauuuuguaaguuuagagcuucaguuauauaucuaugcuacagauuuuguuuguuuuagugacacaacguacugcuguuaccaaagguacaauaggagaucauuuauucugagccaaauaugagugaucagguuucaggaccacagauuuagguuacccuaaaaaucauaucccaagguagaagcaggucuaugaacuuguacaguugaaagacaaaggacaguaaaauaucaaggcuuuucaaauacauuggugagaauuagguggauuccagcaaaucaagggaaguuuucuuauagguuuggggugggaucagaugauguuuguagcucugggcguggugggagcuaaggugcuuauccucacagaugcuucaggugacagccacaaggacauuggguggacacagguaggcaguaagccugcuuucaggagaauccaagguaguugaucuuugaguaugcaauauccccaauaccuagucucccgcacuuucaccagucagcugugcagaaccuuaaauagacagcucuuaucugggcacuuccuuucaguucauuguuuugcaaugcuggggacuggacucggguacacuggcaaacgaucugucacugaccuaguuacccagcugauggucauuuuugcuaguagacaaguucccuccucaccuccugacaacuccccuaacguuugacuuuucuuucuguguagauuucucagccaccaauguuuagacaaaccucaauaaaaugacucuucaggaguuggugcuucggacugccucugucuauauggauagaacagcuguauguuuugacgaaggcaauaaccagccuccagugugcuauuccuacaaggcucuguugagcgcggcuucagaauuaucccauuuucugauagcacacugugacuuuggaggaauucgggaaauuggucucuauugucaaccugggauaaacuuacccuccuggauuuuaggguaauauuucuaguauaaacugauauuacucuaaaccaauuuaauaguuuuaauauguaguauacuuuguaagcuauuguuuuauuugcuguacacauuuccuaugguauuaauuuuugaucauguacauuaguuaauuugagcuuauuaaggacagacuaaaaguuuuuaguaauacaauauuuaaauaugucaaaaguauaaaggccuuauuugucugucaaagaaaacagguaaagcauuuuauaauugucuucagguaaaacaaaacaaaaaccaaaaaccaaacaaaccauugagcugucauuccagaacuuguuaacucucuuaaaauguuaucuuucuguauauuaagugcuaagagcucuuucuuuuuuucaauacugaguacugaacccuugaacaugcuaaacaaacucuguacaauugagcugcauccccaucccgggugggauaagaagugaaaauagaauuuuuacaauacccuagguagucauugggcacaagauaaaauaacuacaaccaaggcucagcccuaaacuuugugaaauucuaaugaacagugaagcucauagagacaucaagugcucaugggagcacuguaguccuuguccuaaccuuguauucgcucugcaggauucuucagguccccgcagcguaugcgcccauugauccagacuccccaccguccuuaucaacuuacuuuaugaaaaaaugugaccuaaaguauguucucguugaaaaacagcagcuuaguguaagucuggguguuuaagugcauggcggggggcggggguuuguaugacguggggagggagggggggcaggcagacagaguuauugacugacuucaauuuaagaguucuugcaucugucuugacuucugaauucacuaacucuggcauugcuucucacccuagugaugucauuuuucugguugagugugugcugugggagguucccacaccauauaagaugguuaguaccauuaccaucuccugcccauuaaauaccaguagcaccuuuuagcugugguacacaaaaaugcccagaucuucccuaguguucccuggcucccuccccagugccugcuacauugagaacuaccacuuuaugauauggaagugucuucuagucuuacgaugguucucuauuuuuccuuccugcuggaacgugccauaguccuuggagagauuacuuuuaugucaauuacagcgggccacugugucaaagaauuauaacugagcuuacauuuugaaaaagggauaagcucuuagaccacacauucguggugaauuuguuuuuuaaaaaguuuuaaguauggagccgagagaugccucagaggugaagagcgcuuggugcucuugcggaggguguggggucaguuccagcacccauagaggauggcuuaggaaagccuguaacagccguuccaggguauucgauacccucgucuagacgcugcacccacugccuucacacggugcacaaacagauaugcaggcacacagauacauauaaaacaaaucuuaacaaaaaaguuuuaaguaucugccaaucaaugcuguaucuaagaaacacugcuuuagaggcaggaguugacacuggguguucagcaagagggagucuauguuguauuacuauuuaauuauuguuuguuuagaaaacccugccuaauggaugaagaauauuauagaaguucuuuucaguuucguuuucuuuuucccauucucuaugugaaccaguuuauacuugagcagagccuaaaugcauuguauguguuugaguaccagacauaugaacugugaagcuguagaaaggcuuccuagacgcucaugaguauuaaagugcagugaauacaaagaaguuuggaagauucauuugguuaaugcguguuuuugaaguaaaugucagcgucuaccuggagccuucccuugcacuucugaaagugcccaguccuuugucccugcgaauacaguaaacucaaagagcaauaccaagaaaggcuuuccugucuugcucuuuucuuguuuguuugguuguuguuguuguuuugguuuuugaaauagggucucacuaugugguuauccugaaaccaaauauguagauccaguuuguccuugaacucacagagaucugccugccucugcuucccaacugacaggauuagaugcuugugccaccacaccuggcaugcuuauuuuucuuacgucuuguuggaaguuuuauaaaagacgguuaggugugagaauuaauugucaauaucaggaugcuuugugaagguauauaauaagggguuguuaugcaaauccccauagcuaggaccuugccuuccuuggccaugauuucugugaucugugagcauucuugcuucacuuaaugaagaagcagugagcaguccauugagcauccacuguuuucccaccagaccaguuacucuuaucuaggaagaguucugccucccgggaguacuauccaaugucuagagauauuucucauuguccugauaaaaacaagcugcugccgggugugguggcacaugccuuuaaucccagcagggauuaaucucaggcggauuucugaguucgaggccagccuggucuacaaagugaguuccaggacagccagggcuauacagagaaacccugucuccagaaacaaaaacaagacaaaaagcugcuauuggcaucuguagguaguagauggugauaaaauuccuacacuguacaaggcaggcucccacauagaauuguacugcccaaaugucagcgguguagagcccugauacuagauagagagaagggauuuagaaggauuuugguauauaaagcccucuaacuuuaugcccuguuggggaaaaaagaagagccgguccucuagagccucccaggucugcagugggguggggccuaaggggcaggacucagcagaguuuuaauggaaaauaaugauuuugagcuaggucuuaagaauguauggguccugaacuauuuuuguuguugugucuuuuuguuugaaacaaacauccuguuguuaaaagccuguuuuuuuaaaaaacaggcuggcuucaaacuagauauuaaagcgaugaccuuggacuucuguuuuugguuguuuugagucuuuuuuuuuuuuuuuuucuuuugagauagggucccucucuaugcggcccuggcugucuuggaacucacuauguagaccagguuagcuucaaacucacagaggucugccugucucugccuccugaguacugagauuaaaggcgugcaccaccaccccugaauaacuuugaguuuccauaggugaauccugcugccuccaccucugaccaagcuagcuuagucagucaacauaggucucgagggaaggagugaggguugacacgaaagggugauuagacaacaguauaacaugacugcagccagugcugaggcugaagcggguuuauuuuucuccaaccugcuuuuauaccauuuuaaguacauguaaauaauaauaaugucaguucuaggucaaggaacaaucaaggcgauaaacagagaccccuaaccacugucucugggggcuuaccagaacgaucaguaccacaucuuccucagcugagugugccuugagcuuacguccauguccuggcccaaugucaaauuccugccacguuuuuuacaaggcggccccaaaagcucucugcacaccuacucugugcugagacuacagauggguacaguuugccuuuagcuuuaguuguuguuuuagcauuaugggcuguauaugccucauccuacuucugacacacacauaugcaacaaacacacacgcaagcauuacaagcugcuagguuugaccuuuuguuauuuauguuuauuuaauaugaaaucucagauucuuucaauuaagcaguuuuuagaaaccagcccaagaagcuguaaucagaagacccccauuuuaacuguguccaggucagguguggcugugcacucugucauccuagcaaccagaagcugaugccugaaguuugaggucuuauggucuacauagugaauuccaggcuagccagggccacauagcaagaacuuguucccaaaaguccaaacccaaauaaacuaagcauagcacuguuucuuccagcuuauuuuguguauaaguacacugucuucagacacaccagaagagggcaucggaucccacugcagaugguugugagccaccaugugguugcugggacuugaacucagguccucuggaagagcagucagugcucuuaaccgcugagccaucucuccagcccccauccagcuuauuccaaaucacacaaaagcagccaaguuagaacccugcagucguuggcucaauaggcagacaggcacaaugucugucagcucugcucccagaugcuugguguccccuccuagugcaagacuagccaagccccacuguagaggaaggguucaggaaguggcugucauuuaacaguggaguccuguguuuuucccacuggcgucaauugaaucccaucacauacagguuaagggccaaacuccuuuuugcugaugaugcaaaguaauugaggauucucauuucaucucuugucgauaccagaccucauccucuccuucauuuuugcacauuuuuaaagugcuuaguguucuccagugucagcuuuccuagauccugugcucuguaucagugacugccugaaccacccaucuucucauuuggagaauaaugaacauugccuaugaagucucugaccuuuugcguggaguuaagcuccgcuuucuccgcuaacauuucagucaugugccauuauuacuuuuaccauguuccauuguaaguaugugcuuuucuacaugucugcuuuggaggugaauuugaaaguaagaacauuuaacucuugaguuaauaagcgagacaugucucauuucugucuucauaccaggauacaaguuaguacuuggauccucgguuaagccacauucguggguaaauagcuauuuuacauucuccauaaaauaacuauuuuuaacauguuaauuuuauuuauuuguuuguuuuuugagacaggguuucucuuuguggagcucuggcugcccuggaacucacucuguagcccaggcuggccucaaacucagaaauuggccugcauugccucccaagaacuggaauuaaaggcuuguaccaccaucaccugguuuaccacgcuaauauuuguaauuuuuuucucuaacagaaauucaaaucuucacaugagacaguucugaacuaugacacaguuuccguggaacacaaggaccuggcacucuucagacugcauugggaagauggucgggugagcacagugcuuggugacagagcagaucagcacaaggugacggauagagaagacagagugagugcugagagcaggaccccagagaaggagcacauggacaugcggcaugacgguugcuuggcuuauguccuccauaccucagggaccacggggacaccgaagauugucagagugccccaugcaugcauacugccuaauauccagcacuuccgguagguccuguccuuggaauccuuccuggaguuuguguuuuaagcugggugucaugggacugagaggcuagagacagaaagagaccaaguuugaugccaguuuguucuauggagagagacucaggaaaacaaagcaaaauaaaaaucuuauauuuuaaagaagaauaaauuuaaguauguguucuauuguaaaucuuaaucuaaauguauaauucuaaguaacugagcaauuagauccaggcaaauuacagaauaaacaaaugauuggacagaagcuguguguguguguguauguguguguguaugaguguguguguguguguauguguguguguguguaugugugugugaguauguguaugugugugugagugaguauguguguguguguguguguguguguguguaugucugugugagugugugugagcucagggccucacacacgauggguaaaggcucaccugugaguugugucuagcccccguuugcuuuugacacuggaucucacugaguugccuaggauggccgugaacuugcucugcagcuaggcuggcccuaggcuuguuauucugcugccauagucguccaagucacugggacuacaggccugggccaccaacuucacuuuuugacuuuuauuuauuuauuugaaaauuuuauuuauuuauuuuauguauaugagugcacuguagauauacagaugguugugagccaucaugugguuguugggaauugaacucaggaccucugcucacuccugcccaaagauuuauuuauuauuauaucuaaguacacugaaacuguuuucagacacaccagaagagggcgucagaucucauuaaggaugguugugagccaccauguaguugcugggauuugaacucaggaccuuuggaagagcagucagugcucuuacccauugagccaucucaccaaucuccacuuuuugauuuuuuuuuuuuuguuguuguuguuuuguuuuguuuuuucaagacaggguuucucuguauagcccugguuguccuggaacucacuuuguagacuaggcuggccuugaacucagaaaucugccugccucugccucccaagugcugggauuaaaggcgugugccaccaugcccggcccauuuaaauuuuuaaauauuuauaccaagaaagacacagaagguagaaacugagguagaaaccugguagcucaguaagguagcuuuguuuuccuaacuauauagaaaauaucuauucacaagccugauccuacaacuaaacugcuagcucuuuaggaaucucuuuccaucugugucauucucugagcuagcccccuuucucuugagcaccaacaaacucaagagggcucuuagcuugcuuuccuagaauacuguuuaccugugccccgccagcugcuucucuguuguuucugaaggcccaaagagaaaaucccuaucucuuaccuggagguccucccauaaaagcucuuccaagccaagagacagggagagagcgugcaugcucuagcaaagguccagaugaaaaagaacucuauaaagccuccuauacaaccuugccaggcugaaccauagucauggugguguggcuccaagucacuaggugcugaaccauuucaucuucauggugagguagcuccagaccacccaacugacuuugccugagcuagggccauaaaaccucuucuaagcaacuugccuuaaaauaggcaggaccuuuccauucuuuagcauucuuaucgauggaggcuuuuagaggcacacccaaacugcaucucuucaggacacaccuaacugcaucugacaaaugcuauaucuacuuaggcuuuuauauuuugcuaacaauuaaguuuucuauguacaauaaucaaacauccuguaacacacaguauauaagcaugcuuccuacacagagggaucccaaguucaagguucauagugagacccugucuaaaacagaaggauuggagggaugaaagaaaguuugcugacuucgaacaucucaccaggaaaccagacgguauauaugaagaacaauuccauuaaaaaugaaguuugggccauccauuaugagagucacagguauaccauauuuagauuuuuaaagauuuuuuuuuaaacuccaaguucuuuuuuaagcuuuaaaaaaagaugauuuauuuauuuuuaugugcuuuauuguuuaccugcauauauguuuauggaaggguaucagauccccuggaacuggaguuaagaaagcugugagcugccaugggggugcugggaauuaaacggggguccucuagaggaguagcuaaagcucuuaaccgcugagcuaucucucuagccuccuuuuuuuuuuuuuaaugguuuuucuaaagacaggguuucucuguauagcccuggcuguccuggaacucacuccguagaccaggcuggccucaaacucagaaauccaccugccaccacgcccggcuuuaaagauguuuuuaaguugagagucagcuuucuuagggagugauuuguguguucaguuuaaaagcagcaguguagacuaaacaaacccaugcuuugauauccuaacuuaaacucuccugcucucuuuguucucaugcaagagaaauuucuaaauaauagaaaaaggaaagacugggucuaucuuaacaucagugaguacccuugacuuguauccgagcauucaggagguugagacaggaggauuaagacuuccugcccagccugggauacauuguaaggccuucuuucaaaacauacacaugagggguagagagaggacacaaggauuaaaagggcuugcugcaaguucaugcugagugaagugggauuccaagacccacguaacuggugggcacccgacacauguucuauaacaccagcucagaggaaucccaugcuauuaucuggccucuagcauccuccacacacacacacacacacacacacacacacacacacacacagucuuaagaaauaaaaaugaaaaaucaauccaacagaagcaagagucuacugaaaggaaaccagaauguaagaguagauuauuauuaggaacugacucacacgcacagugugacugagaaaguagagagggcaugcauggguaggcagcuaggaggcaaucagcagcaagcugcaaccccaaaggcaucggcacaguuagagcacagucagguuggguggaaauuaacugcagauccugcugcugcugcugcugcugcugcugcugcugcugcugcugcugcugcugcugauuuuuaaggcauaguuuauuuuaauuugucuuuauuauauguauaucugcuugugaguauguuaugugcaugcagaggccagagacuucgguucccucucaagcuggaguuagcucaacuaaacugcccggccucugaguaggugcugggagcagcagcuugcccuggaccacuaagccaucucuccagccuuguuggguuuucauuaaggaagaaauccagccagcucaggacugauaaacucagcucuuugcagacuggaauguuuaaccaaacaaccgacacagagagagaggugugcuuuacuaaguggcagccacuauccuucuagucucucacuuccuccuuaaaggaagccuguuuaacugguggugcaaaucugaaacccuagcuauugaaaggcugagacaggaggacugcugggaguuugaggagagucuggacaacauaaugaguucuaggccaggcagaguugcauagcaagacaaugccuguuuaaaaaugaaagaaaaacagaaaaagaaaaccaaacaaauaaaaaccaaaaugaaagcauaguagaaagagaauucuggggguuguaauucccucugucuaaacugacauaucaggaaguggucacacaugauaaaaccuguggcaaaagaaaaaaguauuauuuguuuaguuuuaaguugagacagggucuuacuauacagccauggcuguccuggaacucacuguguacaccagcuagccucaaacucacgaagaucugccugccucugccucccaagugcugggauuauaggagugcaccaccacaccuaacuaaagggcuuucugucccaccuuuuauaagggguuuccacuagcaacagcgccauuuugcauaaucugaagaaugaagucugaaccaugaaaacuuuucgucuccaugauggcacugcuggugcugcugcugccuuuuccucuuccucuuccucuuccuccuccuccuccucuuccuccucuucuucuucuuccucuaccuccuccucuuccugcucuuccucuuccucaucuccuuuuauacuuaucucuccuuauuucaugugugugaauauuuuccuugcauauaugucaaugugacguugugucagagaggguacgaauccccuguccaagaauuuuaaauggugauaaacuacccaccauguggaugcugggaacugaaccuggguccuuuacaagagcaggagguguucuuacccacugagccaucccuccagucccuacuugggguucuuuccauacccaagcuuaggccuuccucaugacaacugugcucuguuugccuuuaggucacuuuuugacaucacucaagaagacauuuuguuucuggcuucuccucugaccuucgauccaucuguuguggagauauuuguuucucuguccaguggggccugccugcuuaucgugccaacuucugucaaagugcuaccaucaaaauuagcugacauucucuuuucccgccacagagugacuguuuuacagguacacuucagucgcaacagcaauguuuucuucugcauucuucuaguguuccguguuuuagaggguccuuuauacuucaguaguuccucccagugcauuagugauaguguaauugugauggcacaugcuuauuuuaaaauggaagagaaaucgguuaaucaugucuauaguauugcauguacuacagguaccacagcacucaccuguaguacaauaccgggaggaacuugacuuugacuguggaugugcuguuggggugccuucugucauaacauucgagcauauugugcuuccuacaaaaagcuaguauauuacccuuuuacaaaugggcccagaaccagauguguuagcaucuaccuagugaucucaaagacagccugaccuacauagaaaccugucuuuaaaaagcaaacaacaacaacaaaaaauuggaacuggagagguggcuuagugugcaagagugcuuuuuaugaaagcacaaggacaugaguucaaguccccagcacccacauaaaagccagguaugucacauaugccugaaucucagugcugugggcagaggcagguggcucccagaggcucaccuaccugcuagcucagcugcaauggccagcuccagguucagugagagacccugucugaaaaggaauagaguggagacggauagagggcuuucacuggauauccucuggccuccgcaugugcacucucccucccucccuccucccucucccccucccucccacucucccucccuuaguuugugccuuuuuuccccccucaucaaggcagcccaaauuguuuugggucugucgucuuccccuggcacaugggcggcuugccagggcuacaccuuuuaagagaaaccugacccuuucucagcuguugacuagggaugggacauuuugcccaguccccucuccaugcugggaccuggucuguccuggcuuacauagacuucgugcgugcguguugccacacgcauugcaaacucaucugcuguucuugcaaaggaccugggcucaguuucucgcacucacaugguggcucauaguugucuguaacucucguucuagaggaucugacaccaucgucugaccucugaggacaccaggcacacguggugcacacacccacacaggugaaccacucacacacauauaguaaacagcaagauuauaaaauaagacuauguagaauacaaguguuaagauacuacauuggaaaugguuaaaaguacugaagagauggugccggagcgaugagcacuugcugcucucgcggaggacuuuaguuugguucucagcacccacgugguggcuccugaguuccagggaucugucauccugaggcacccacauacaagcauggaagcccaacacucagauaaaauaaucuaaauuuuuaaaaagauacuacauuauaagugguuaaagauacugaagcugacuggacguauccagcucacgccuuuaauucuagcaacugaggcagaugcugcaggaggauccaagacuaaguugucugacccuaucacaaaaggcaaaaaauaaaaaaacccugaagacauggugcugaagagauggcucaguggccaggagggucagaguucaguucucagcacacacaucgggugacugcuguaacuccagcccucgggaaucugacacccuuuuauggccuuaaugggcacuggcacauauaugcacauacccacacauaaucacacacuaaacagucuuaaagaaaaauugaaccccgugugguuguguguacguuaaauuccagcgcucuggcagaucugugaagaaacccugagugguuucaccagaaagauaaagaugggccuucugcugcuuugucuuaagggcagaaggaaggggaaaggaagaggaggaagagaagaaaguggaaaagaagaaaaaggaggagacagaggaggaaggcgcuaagacuccuaagcauuuagcaacauacacacuugauguagaaaucaucuguacuuauauguauaaauacauguacauacucauaugcauuucuauauauguauauuucuacuaaggaaaugccaaaaguacaacuagaaacauauuucguuacaauagcauaaaaaugaugaaauaggaauaaguuuaaagaguagcaagacucauccacuaaaaacuguauaauguugauagaaauuaaagaccuaccugugcaaauaggcuucugacauuuauguagcaacugcagcauugucaagagugcaguaacauaauuugcauguacuguucuaccaaaaucccagaaaacacuguagaaauucacaaguugauccuagauuuuguauggaaaaaggccuaauuuauauaguggaaaccacuugauaaaaaggcagugagcuguuuauauguacaacaacauggaugcacugugaaauauuuacucagggcuuuuuauaaaaagccaguugaaaauuagccuuggggcuagaaagaugacccagugggucagaguauuuccugcucucucauagggcaggguucaguucccagcaccugugucuguuuguuaccaaaugccuacaacuccaguucuaaggcauaugaugcucuucuggcuucugcaggcacacacacauacaaacauaccacaaaauaaacaaguaaauaauuaaauuaaaaaaaaaaaaaagaaaaacacagccuuaauguccacaugggcuccaaaugcagaauuugaauuaauuaggaggaaacuaagugguguguuugcauuuccaggcaacgccaacauugcugagaagauuuggaucugagcucaucaaguccacuguccugucagcgcauacgucucugagaguccuggcccucgguggggaagccuuccccucgcugaccauccucaaaagcuggcgaggcaaaggcaacagaacccagauauuuaacaucuaugguaucacagagguauccagcugggccacuuuuuacaggaucccagaggagauucuuaauucugccgugaaguaagggcuuuaguuaugcucaguagaggggugcaaggauaggggcugucccuuucugagaccuuagcacuaaugcuggggggagugacuuuuguuugggguggcaguugagcaugguggcuguacaagucauguccuugcguaggaagcacacucuugccugggagccgugcuccuaacccggcuaauggguuugucaggcgcuguccugauauuuuaucuagugguacaaguuaagaaucuaaaucuuuccuguaacucaucucgagauccuggcagacccucuugggacugaauugguaacacaucccuuucugccagacuuguuccucaugcagucuuugaauuguacgguaaacuguuuugucuuuauuugcuauaguauaauuuuaauacacugggaaaucgccugcucaaaugaaaaucuuaaacuugcucuggguguguuuuuugcagacaugaauccccugugcagcuggggucgccacuacuuggaacggugauugaagucagagaccaaaaugguucuccaguucucgaaggcacuggccaaguauuuuuagguuggcuuguauuuguuguuuguuuguuuuccaaaaagaaaaaucagcuucguuuuuuauucauuuuaugauuuuuuuauguggaauguacuuuucagugauaaguuuuaaucuuuucauaaucuugaaauauuuagaguuuaccugaauuauuuuacaugcaguuucuaauaauuuagaaaguuaacuugaaauguuagcauuuguagauaaaacuaugucuagcagcaguauucuaaggauauauuuaaaaucauacauaguuuuauaaauaaauuuauuuuuaucucuuuacuagcuccguaaguuacugcgccuaauuuuaucagguagcauuuuuuuuguuuugguuuuuuuuuguuguuguuuuuuguuuuauguuuuuuuucgagacaggguuucucuguguagcccuggcuguccuggaacucacuuuguagaccaggcuggccucgaacucagaaaucugccugccucugucucccaagugcugggauuaaaggcuugcgccaccaccgcccgguucagguaucauuuaaaagucaccucauuuuaauacaaauaaucaagguuugagucuuaguuacugaaauuuagagguucuuugauuuugauauugguaaaucaauuucccauggauuuuaugacauucaacuuugucuuugaaaggugggaagaacagaguguguuuucuugaugaugaaaugacagugccccuuggcaccaugagagccacaggagacuuugugacugugaaagauggagagauauuuuucuugggaagaaaggacagccagaucaagcgccauggcaaacgucuuaacauugcacuugugcaacagguagagccacuuacauauuaaaucuuaaucuauuuuaauaaaacuaaaucuaccuguauguaagucaguagaggcagcugucaccagauuucuaugccagauuuuuuauuggcauugucuaaagcugacaccuuuguauuuguaauuaaucagagcaaaaaacauggagcuggguguggugacgcaugccugcgaacgucacucaggaggcugaagguuucggcucaaguccagccugagcuauagcagaagccuaucuuaaagaaaaaaaaaucaacgacaacaaaaauugcaauaaaaggcaggaguaauucacuguuucucuuuuuccaucaggaggauguuuguuuguuuugaggcagucucuauauguagucuaggcgaggcugaaauuccaaggcucccugccucgagcuuccuaguguugggauuacagguguguguuuccaagccuggcuugagguggccauuuuaaaaucaauaaugggcuggagagacagcuccaagguuagcagugcucacugcucuuucagaggacccggguugguuuuguagcacccacaucagauggcucccaaccuuguguaacuccagcugcaggggauccagcaugcucuggucucccccagcaccugcacucacauggugcacacagcucacacaggcacacaugcacgcauaagaauaaguauagugacaacauagauuuugagaugcaugaaaauacauugguuuauuugcuuuagcguuaauuaugguagacccuuguaacuuuaucaguacugaguuuagacagcacaucugagccuucaggaguucauuucaagaugguuccaugaguaagugauggugaucucucuuacagguugcugaagaacuucgccagguggaguccugcgcggucacuugguauaaucaggaaagauugauucucuucaucguauccaaaguugacuuaguaaaggacugcaucuuuaaagaauugcagaaacaccuuccagcacacgcccugccugaugacauggugcugaucgauacccugccauuuacaugccaugguaaagcgacaaagcgguguggggugcucagugcuggagagcacuaauggugcucguuggucaauggcugcagaaggacuauugugagugauacuggcguuaauuaugguagacccugguaacuagcucccgugagcugauagucuucuucugacgugugguuugcagaugggcaauuucuccccagguuauuuugcuuaguauuaauuacacgugcauuccugugacaguaccugacaggggaggagagauuugggcucacagucucagggugugucuguucaccaugaugggauggcucagugagcagcucagaucaugugaugauggaccagggacagagagaaggacgaagacaggcuuugucaggcugucuccucgauucuugcuaugccuacagcccacuuccaggaaugguccuucccaguucgauuauccucugaacauccucacagacacagccagggauaucugucagcuuuuuaggugacucuggaugcaguuagguugaccuucaagucagccaucacagcuagucagugccuguauuccucagagaucacuagagaaacagaucuaguguuuagauagauacauaaaaauaugacagggaacugacagagcucucaugcuaugacugcaggcuggacagggccuaagaaagcgggacugugguuuucaguguugagaccugagagccagcagagccagugguuuaagccccaugagcaggcaucauacacggccaggcugaagcugaggcuaacucccuucuucuggcuuuuguuuuguucaggccuccaagggcugggcugaucaccagccaguuugggaacacugcuuucaguacugaguccagugauugacaugcuaaucugauccuguaauaucaauuuagaugcacacagaaacaguguuuaaucaguguuaaacagugggccaaccccaagacucagacagguugacagaaaaaugaaccaucacacugggagaacugcuguucugccuagugcugcuuagcuucgaacuauauaccuuuuuuggcaacaggaccuugauagcuauuucaggguagccuugauuucaguuuguagcccaagcuacauacacuccuauauaucagacacagagccacauaccuguaaucccaacacuauggaggcugagguaggauaauuacaaagcuugacgcuagcucgagcugcauaguaagacccgcuuaauaaaagaaaauguggggccagagagguggcucagcugguaaaagugguugcucaguaaguaugucuaguggcuugaugacuuaaugguaugauaggagacacucaaguccugaaagcuguacugacuuacacaccaagcacauacacacagacacuuuuuuuuuuuuuuuuuuuuuuuuuuugguuuuuucaagacaggguuucucuguguagccuuggcuguccuggaaaucacuuuguagaccaagcuggccuugaacucagaaaucugccugccucugccucccaagugcugggauuaaaggcaugcgccaccacugcuccuccuguuauaacguuuucauacaagguaaauuucauuccuuguguuucacuuguaugcaguaccccccaccccacucacuaccacaucuugcacucuuuaacuuagauaaauggccuguuuuccucuuccauguuacucacuacagucuuuguagccuuggccacaaacugcuuaucuguucuccaugauuucugagcuuuacagugaagagugugaccaacaaacacaauggcucuggggcuaaauggacucaguugcuuauuuuauggggugagucaccuaggaucuuguacacucaacacauacucuacuacguagcugcaaacccugguuaaaguucaaaugcuauuuuaauguuuguuuuuucucuucauauuaaggcaaaguugauguuucugaguuaaacaagauauauuuagacuacauaagcucacagccuaggaaugaacuccauggaaaagaggaacuuuggggaaaauuacaguauuuauggaagguacaacuuuuuaaaugcaaauucauuucuguaauucauucauuauaaggaauuuuagugucuccaguaagccaguaaaaguauuuuaagaauguuauugcuguuauuguauaugccaauuagcauaccucccuuaauccaguuuguccauaauaaagguuaguguuuaauuaaaugucuuccaaagccauucacuggaagaaagguaguuuaaaaggugccggugucuaccuacugccugacuuacuuuccccugcgaggggcggcucggcgccugcugcucuugcaguguuacaaccaugcucuuccgagugggcuagccuuacgcgugggcuucucucacuagucuugcaguagcugcauacuucugcucaaggcauuauuaaugugugccuuaaugguaagcaggccuucuuagauaugauacagauuuuagccaggcagugguggcaugcgccuuuaaucccagcauuccggagacagaggcaggcauaucacugagugagacaccaaccuggucuauaguacuaguuccagguuagccggggcugugcagagaaacccugucucaaaaaacaaacaaaaagguccugugaagugugugcauuuggcuaguaggucuuaggaacugagggcuacguucuuaucacuccacuuguaaagcuguuugacuuacgggacguggaucgauguuauuuccauguugggaauaucagcugugagggcuaguugguaaagcagauguuucugugaguuuauuccuuauuuuauagauaggauaccuacucuaagcggaauuguauuuagcaauuauacagcgaccccuugacagaguugguagugccgugaugaccauuagucuagagaaaaucauuuuuaauugaauuguuagcaucccccugccuuuaaagugaugcuaucugugaaacaggcacuguagcucuguaucacuugcuacauugucaaguccuuugguuuggugguuuggaccgcuuaccauccuugccguucucuccucuguagucuauucugugucucccugaggauccagaggauacucugaagguucccgccaacuccgucuuuuuagauagugguggggauucccucaaguccaugcggcuccucagugagauugagaggcucaccgggacagccaucccuggccuucuggaaguuauccucagcaguucccucuuagacguuuacaaccacaucguucaagccguguucacaccggaggacaggaaagccaacaggaguuacaccacaaaaaggaaauucagugaugcugauccagaggaagccagcgggaagccugcacgucuggagucugccuggccuucgaaccaugccggcgagaccaacuccgugaucgcucugagcagagggagucagguuuugucucuuggcgcugggaggcuuuuaacucaguuaggacucugccugccagucuguucucuggauuuaaucccacagacuaacacucagauauuaaaaagccuaaguccuccagcuccugaugaaaacuuggaaaagcccccacuuuuucagcaggggagccccgugguuggggcuauggcgauggcauugcgggagagguggcggucagacacaggcaaaugcguugaugccuccccucugcuggugagagcggcuguacaggauaagcccuccacaaccguguauauuggcucgcacucgcacacagugaaggcugucgaccuguccucuggggagacgaggugggaacagcuucugggagaucgaauugaauccucagcgugugugucuaaauguggaaacuuuauuguaguggguaaguuucugaaucugggguucguagaguuaaauugugugugugugugugugugugugugugugugugugugugugugucugggggggggguuguuugguuguugucacaggucagugguuaguuaacucuguccugcuuagcagcacggcuuggaguuaagagucccuggauauaaaccuagcucuguauugcuaaacucugacucuggcaggauguugcacuuccaccuucacuuuucucauggauaaacuggaaacaauaacaaaacacauugcucuguauaacgcguuguauugaagccuccuagcccacagcagaucccuugggucaggaaucuuggagccugacgaucaaaaucucacgaugccucuguaggcaucugaggcuuuaugggccggaagacaggcuuccaggauggcucaugggcagcauugucagcguggggcuccggccuuaggcucgcucuucccucacuuuuugcugagaauauuccagcugugugccacaugagccucucuguagcugucugaauguuugcauggcauagcaucugacuucccucagagugggugaucccaaagagaaagccacaggagccacauggugccuuuaagaccuacucgcuaaaacuggagacuaccauuuuugcuuaauuuuguucacugaacauaaaucaucaaguccaguccaugcccuggggagagaauuggucuccaggucuugaaggucaucuaagaauuuauggguguauuuuaaacccauggcaacuaucagaguuaugagcaggguuaagugagccauuaguacaccagggagccauaaguacacugcaaggcacaaaugaagcucucagugagugauggccacacagagagugucguggaaauugaauccugggugggagcagaaccauguauagcguaggcagugagacuccuaaauggcugcccucacauuccauccacuuggucugauuucuaugugcccaaguguuuguagugacuucauuuguagguuuuuuuuugggggggggguuguuuguauuuuuuuuaccuucuucccucccuccccacccaccaccccccagacaggguuucucuguguagcccuggcugucuuggaacucacucuguaaaccaggcuggccucgaacucagaaauccgccugcuucugccucccaagugcugggauuaaaggcgugcaccaccaccgcccggcuuuuuuuuuuuuuuuuuuuuuuuuuuuuuuuuuuuuuuaccauuuuuacucaacuguaccaaggucugggaucucugcuaccuucucauccacagccaccacuugggaaaagaaguucaguguaguugcuaagaauacaggcgcuuagauuuauuaaauccugacacugccagccacaugguaacuuugaaaguuugcccugcugguuaaucugcuuccuugcugucauccaugaguguggacacaauuaugcuaaaauguuugaaaaaguaggccagggauguggcucagauggcagaaugcugcccuacaugcucaaggcucaguccccagcacugcacaaaccaggugguaggugaugcacaccuggaaucccagcccucaagaaguagggcaggaggaucagaaggucuauccuccccuaauaggauaacugaggcuagccugggcuaaagacccuguccccaaaagaagcccccaguacauaggaaaugcccagcagacauugguuguuacuaguguuagcuuuucuaaaacaguccugagcaccuuucuuccuuguguggcuacaauaacugucggauggaaggagaguaacuugaugcucugugaugcuggucauuuauccagcaacagccagaauagauuggaauccaguucugucaguguggguguguacgugaacuccugaaaucagaggacaacuuguaggaguuguagugguguucacugucgcuucagcacaggaggggaaggcccagagcuggacugaggacaugugccagcgcaccagcacugaguaaggguuuuacacaaaugacuguaguucaguuucuccuuuauguuuacugaaaucucaaucagauggugagcauaaauagaugagaagagugugaauagaaauugucauuauuuaaauauuuuauaucaauguaucucagucucaucuuuuacauuuuguuucucuguaggcuguuauaauggauuagucuauguccuaaaaaguaauaguggagaaaaauauuggacauuuacuacugaagaugcugucaaaagcucaccagccguggauccaaccacaggacucauuuaugucggaucucaugaccagcacgcauaugcuuuagacauuuauguaagaauucacuucaucacuguuuaucauaaacacagaaauggacgugacuguuacgugcucugugucugggagcaggaguuagugauagcccaagcauaacacugggucuggaaagaagugauuaguuaaauuuuaacaucuuuagacauuuuuagcuucuuuucaaauaauuucaguaauauaaaaaauuuagaaugaucauaacagaaaaaaaaucaaaguaagauaucaguaagcucuuuuaagggcccauuauaugaaaauaaaaacuacaagaaauaggcuaagacaguuuuggaaauaagugaaucaaagcucacuuauugguauaaauagaaauagagaguaaauauaaguuaauuagaaagacccagauagaagacaaaaacaagggacauaaauacacaagaucccaggaagaagccgcugaggacauaaguaucucaggccuuuagucuucaaagccacgagaaugagacucugagaucccaaagcacauagcuccccaugcuacaaugauugacagccaguguccaugagagaaauaccagcugggaagacauuugaggggcuguggauaaagcccaguugguaccuugccuaggaugcacaaaguacuuaagaggaucgguaguggaagaccauccuuggcuacaugcgaguuugaggucagcuuugcuacaugcauuaaaaaugacauuaauuaaaaaagaucacacacacacacacacgcauaggaaguuuaauuaagaagcaguguggaugaguaacguucauguccuuugaccgaagaaauuuuuuuucuaugaaucuauucuggcaaaauaaucagaagcagacaaauauauacauaaaguuguuuauaagauugagcaaguaguuucuaauaguuuuuagaucaggaagagacaucauuuuauuuugcauacaacguauuaaaauuauuuuuaagucauuuuauaaagucaguggaagaagcauaccaaguuguauauucagaaugaguauauguaugugugggcacgggcacacacacacacacacacacacacacacacacacacacacacgagcguguguacauguugccuuugcacuaacuuaccuggcauggugguacauaccugcaaucccuacaccgaggaggcaaaggcaggaggauuccgagugagugaacggggagggcagaggagaaggggaaaucugcaucccccuggacugugacaacugcuucacaggacaacaugcacaaggcucuggggucaaugcuagcaccaggaggagcgacacauggaguugcgcccagccaaacuucagcuguccuguaggccggcugauuaaccacagcaccacacaguuaauuccgacucuuauuugcaggaaaagaaaugugucuggaagcuaaacugugaaggcgcucucuuuuccucuccgugugugagccugaguccacaccaucuguacugugcuacgcuagggggacucuuacuggcccuaaauccuguagguauaaagugacacauguugcuuguuuuaccuaucuuuauuuuuaauuuugauguugagaagucagaaacuuuucaguuaaauauaauacauguauuaaugagcuagaauucacuuaaaaugauugaaauuaguuggaaaaaggaguaaaugggaguuuauguuuuuauuguuacuuguuucuucagcuaguuuuaacuguuaaaagauugaguuuuacauuuguaaguagugagugugugugugugugucacgggucugguaccugacgaggucagaagaggcaugggcuccccuggaacuggaguuacacugauguucuaggucuauguguagcucugcuuugcacugugcucugggcugauguucucugcguccgaguucugcucaguaagcacugauuuucugacaguguguggaugccagauucaucaaagcaccagugggucacugucacugucacugucacucuggcuuugaagaguuuucguuuguuguaaaauggcugugcauguaaaggcacuugcugcuaagccugacaacuugaguucagcuccuucccgugugauggaaggugagaaucaguucaccuacguuguccuccagccuccacgugugccucguggcacguacuuacacacgugcaugugcacacacacaguaaguaagugaauguaacuuuaaauggcaaagguccgagguuaguaauuuccagugcuaucgacugcuuuggccacgacaggcuucugggagcacgguguggaagcgcuccuguggaaagccacucuucucuuccccacggugcuaccagcaauacaucugcaucggcugcguggacggcaguuugcucuguuucacacacucaggggagcagguaggaagaucaggggagcagguaggaagaucaaguucuguucuguguaacccuuccuaacccccagccauggagacugaacccagggacuugaccagugacuguucuguuauugagcuguauucucagcccuuggcggacuagucucucucucucucucucucucucucucucucucucucucucucucucuguggaucugaguauguaugugugugugcguguguguguguguguguguguguguguauauauauauauauauauauauauauauaauuuuuauuucuuuugauucagggucuuacuagcuauccuggaacucacuguguagaccaggcuagccuagaacugaaaucugccugccuuugccucuugaguguuuguauuaaaggugugcaccauuugacgauguauagauuuuuuuuuaaauuuuuuauuaagauuguauguauguauguauguauguauguauguauguauguauguauguaugugagugcacugucguugucuucagacacaccagaagagggcaucagaucacguuacugaugguugugagucacugugugguugcugggaauugaacucaggacuucuggaagagcaaucagugcccuuaaccuccagcccccagacuguuguuuaaagcuuuaaaauuugaguaaaacauaguuuuuuuuagggguuuuuguguguguguuuguucuuccuguuuuuuguuuuguuuuguuuuuguugguuuuuuuccuagagcuggaguuggaaccaaguuccacccccuguccgagacuguuuuugauaacauauauugaagaccugcugcgguuuuuuccguuaaacagugucucugaacauaccaggaugaaccaaguaugcucaagguucauuguagucaugcucugcugugccugauccuggcuuuuaccacuggagcaguuccgugugagagcgcuacuucccagagagggcgccauuucuggugugugaguuaccgagcgcucuccaucucaccucugccaucuggaugaagagaccccguuggacucaagaguugcggucaggugagugggugacccuuauuccuguucuccuuuacaggucuggcgcuuugcugcuggagggccaaucuucucauccccaugcgucucggcagcagaacaagaaauauuuuuugguucccaugacugcuuuaucuacugcuguagcaaggaaggucaccuccgguggaaauuugagacgacagccaggguguaugcaacgcccuuugcuuucaguaaccacccccguagcgaugaugcacugcuggcagcggcauccacugacgggaaacuguggguccucgagucucggagcggagagcugcgaaguguguaugaacuccccggagaagucuucuccucuccuguggucugggaaucaaugcuuguuauugggugcagaaacaauuauauuuacugucuggauuuauuguguggugauaaaaauaaccagguguaguccuuguaaguaugucagugagaggguuggaaaugucauuguaaagccuauggauggguuuauauuaaagauucuauuuugguuaggaauuugucugugguccuuuccauagagagcagccauguuucuuuccuuuggaagcagcagaagcgucuaagauaaagauaaagcacccgauugaugcauuuguagcacuuuuaauucugugggauggugugcuggcuuguuuucugucaacuugacauacgcuagaguuaccugaaaggaaggagucucaccugagaaaauuccuccguaagacugggcuguaggcaggccugccuggagagcauuuucuuaaccagugguugaugggggagggcccagcccauugugaguagagccauccuuaagcugguguuucugacuucuauaagaugaagccaugaagagcaagccaguaaguagcauuucuccauggccucugcaucagcuccugccuccaagucccugcccugcuugaguuacuguccugacuucccucagugaugaacuaugcugcugaaguguaagcugaauaaauuacucuuuccccaucuugcuuuugguugugguguuucaucacagcaaugguaacccuaauuaggacagguggguaauuguauguaguagauuuacauuugcucuacuuugucaaaagaacacugcucugucucccaucaagucacccccacuguguguauuaagaaagugggagcauaacaccucugugguccuuggggugguaccuuugagagaggauuaagguuauuugaggccaugcauguggggguugcugcugagggacuggagguguguuuguaagauagaccaggguggucugcacugcugugugacgcuagcaucaccaucacugggacucugcaggucucugcagauguggucaauggaucucgaacuccuaggauuucagaacugagagcugaauaaaccuuuauuuauagacagucugugauguucagucauaggcaagugcacaaagacagguagugaucaccauuccuuggugaggaugugagguuguuuauaaacugguuagcaucugaaguugagccacugaccgagauccgucugucuucucuggugugccauuacaggugggcauuacuggugggugccugaauagaaggcaggggaaggaaaacugucuuuuucagcugggcucccauauuuucgugcccuuggauaccagaauuccuagacugagacguagcaccaccuaccguaucucucugccccucugcaggugacaccauugguucccuggucuugagaauuuggccuuuaucugaauugcacuauaccauagguucuuugggucucuagugugcaaacagcacauggcacuuccagucuccacacccucaccaaucgaugccuaggucucuucuuuuguagugguuucuccagagaaaucauauuagagucuacauuuugcaguaaauaaauaaccuuucauuucucucuccaccuagguaaaucuaucuugucaguuauguuucuguagagaacccugcuucauuaagguaguuuaguagguuucagggguuugaagaucuccuugaaaaagaaaggaucagaauguauauugugagucauaaacagaauacuccacuuacuauguauucugaaaucuguuuaucuuuuguguuuugccugcauguguguaagaagugcaccacacgugccuucccuccagagaccagaggagcacgugggguccucuggggcuggagugagcaccauggagaugccaccagcugagccuguguccucugaaggaagcaagagcucucaauaaaccaucccucuagacugagguaaagguuuuuaaagguaggaucuguuuaucaacuuagguuccuucuucugguggggagaagggggguagaaaaccaguacaugcauugcugggacuugaacccagggcuuuguucaugcuaggcaaacacuccacuacuggacuagguucaugccauuucuaagcaaugccuauguuaaugccuauguucgugccuauguuaaucacacacucaggucaucauuccuucuaugcagcccacacugacuuugaguuuuucaccaaguuauucuugaaggucacaugcucagaugggccaagguguagccuggugguagccgguccucagcugcacugcucacaaguccccggcugagacuacaguaaggagacugcaagaucauuuuaaccaagacucagaucucuaucuuccaguuuggaauugauauaaauauuugccauccuuaucauauauucuuccacugggauuuuugggugaaaaaaauaaaguagcguuaaaaacaac

SEQ ID NO: 2507 - RNA, 38468 nt, Mus musculus
cgcugacgcgaccccgcuuccgggcggccccuccccgcaggcagccaaaaaguggcgcgcaugcugcaaggcccccgcuggccggagagguuucuggguuggagcggaccaaguccugacggccgggggacggcgugagaccagggggcacgaacggcucagguuuucugagggacccacgcgaucagcugcgccacucucaucaccuacuccuugggcgcgggaaaauaacggagccucccacgugcagagaaaguagcgauccugaccucggccuccuccccaccucuuugacuccguagccccgccccucucuuugcccuagcugauuggcggagagcgggaggcagaacuggucacgccccuucuaugaagcgcgccgccgcaguagcgagaaccuagcccgcccgggaaggaggcagucaguagcgcgagccucuugaggcguucgauagcggagcggacagcugguuggugcuuggaccacgccgcggcagcaggucccuccacgugcuuuccgaggcgccauggagcuggaggaguuggggauccgcgaggaaugugguguguuugggugcaucgcuucuggagacuggcccacgcagcuagaugugccgcaugugaucacucugggacucguggggcuacagcaccggugagcaacaggauggagggguggggguggaauggcaaguauuugcacaguuccacgagccgcuucccagcucugugcuacggggaacgcaagacaaugaggguggaucaugacugggaaggggggaucagggcuaggagggugaaucucgagaaucaagucaaguaccuacucaggauauugaccaagugggggugggguacacuuugccugcauagacuuuaacuuaggcugucgcguugcucccgagugcucuuuacagguuagcucccaagaaugugcaucucucgucgcggguuaguuacucuggaguuugcuuucacuagccagguugggaagggaccguucagaucuccuugaaacuagaacuguucuagagauaagcuucuguagggugguggugcugaagguccugcaacacuugaagguuuuucuauuuguuguuguuuugcacggggccuccugcuugcaagagcuuuguuugcaagggcagagcuacugagcagauuugucagccugaaagcaguuagagguuuggagaucgugaguuuaaaaguaguuauagcuaugagaaauugggagaugccuuuggggcaaacaaagaaaaaaagaccuuugccuccauaauuuguuucuugacuucacugacaguauuauggaaauaauacaaacuaggguuuugucucucuucaaaaacuauucuaucacggaguuuuacaauacaguagcaacaaugucuagaccagagcugggcaguaacccuuuuuaucaaugugggugcuacaugcaucacuaaugauuauucuuaccagacuuagccuagaaguuguccuuuugcagagucuuauuugacauucuacauacuccgcauacauuuauuuaaaaaaaagcaucuggggccacccugugguggcgcaugccuuuaaucccagcaacuggaaggcaggggcagguggauuucugaguucugaggccaaccaggucuaaagagugaguuacaggacagcccgggcuauauauacagagaaacccugucuugaaccccccuccccccaaaaaaauuguuuugagaauguguguauguauaugguguaggggacuauguuuuuuguuguuuuguuuuguuuuuuaaauuaguuacaacuugcugggugcagugacuagcucaaagcacuggagaggucugcagaggcaaacugaucuggagcuuuugaggcuacauagcaaauccuaggccugccauagcuacaaugaggcccugucucgauaaacaaacaaacuacaacuuauucuuagugacuugucacuauguuauuauguuuccuauacuuacuuuuuuuguuuuguuuguuuuuuugagacaguuucucugugacuggcuguccuggaacugaguuggccuugaacucagaaauccgccugccucugccuccccagugcugggauuaaaggcgugcgccaccacugaccaacccuauacuugcuuuuauaugagaaagcuauaagauuagauaagguaaggacaauaaagauaagauguguuagugaauggauuguauuuuauaguagaguucauaauaucagcccuggcaaacauagcaagacuagucuaccaaaagagauugacuuuauuaggauaacuuaacuaaaccaagcaagccuuugguaggagacuaguguugaaaauaugacuguggguuguuuuguuuuuuucuuuuucucuuuuuguuuguuuguuucuuuuuuuguuguuguuguuuuuguuuauugagacaggguuucucuguguagcccuagcuuuccuggaacucacucuguagaccaggcuggccuugugcucagaaauccacccgccucugccucccaaacucuaggauuaaagccgugugccaccccugcugggauuguauuuuucuuuugaauagcagugauaagcuaguuucuugggaacaaacaugcuaccuagcaacauaagaaugccauuaagauuugcuuagaucucaguauaaauccgggcaaugcaacauuuuaaauuagagagacuucuuuaucuuuaguagaauuaguuuuaacuggggaaccaguagaacaccauaccaugaugcuuagggaauauaauaagugcuuguuacccuaaaacaguagaucagggccaaagaaggguaagaacacauuuugaggggugaugugcucaggguggcacaggggccucacauggaguaagcacacacugucuaccaaguaacacccaagaacuaaugaacuaaugaauguauacugcacugaugaauguaaacaugggaauauuaaaaccugaaaccuagagaggugaucauaggugaguauauaguagcauuauagacaccaaccuggagaaaccaaugcagagagguguggcuuauuguagaagccuccauuuuucacaucucacaugaagaugcacucauauaagagucauaaaaaucaccagauacugugugggcuuagacaucgggucuagucauuugcagaguucugaacaaaguaggcuucuccaaucacacacuuugaucuuuaaaucaccaucacaucuuauggagcacagagcaguuuggaccuauuuauuuaaaauuccucuuuaaaaaggaauuacuagacacaucccaugaaccagccgccugaagguucuuuguguaguguggauauggcuuauucuccaaaggugggcaugggggcaguguuacucaguguggcaauacucuagugguaucuucagagauggaguuuauaggaagcugagcgguugggcauuguggauuaacaguggucucacuaaguuagcucucagauagcaagcugcuauaaaagggugagccugacccuggaauucuagcuaugcucucucucucucccucccucaccacuacacuugaccuuuacggugaggccacacacacugagguucucaccagaagcugggcugaagggacuucccccaaacaugaauuuucagccucccagacugaccaaaauaaccuuuuaaaagagaaaagguaccuaggcugggcauggugaugaugcacaccacugaucccagcgcucgggaggcagaggcaggugaaugucuugaauggagguccauuuggucugcagggcaaguuccaggccagccagccagccagagaaacgcugucucagaaacagaaagaaaaccaaaaccaaagaaaguacaaagugccuagcuucucuuguauuuuguuacaguaagggaaagaagaugauagauuuguuguuaauuaggaaaugagcauguccucugucggugaguggucccguucagaaacagaaauuaaagccaauggcuaaugcuacauauuuuuauacuucucaacacgugugaaacugaccugguggaggugaggguccugauggaagaaacauccuguagaaccuuccaguucuguuaagcuuugaggaaaccaguuugcaguggucucaggagauguuuucuugacagguguagaccuuguuucuguaaggaaacaccaccaggaaagcacucaguagggaggggugcacccagacagccuccaaggcaagcauccaaggccucuuccugaaguguugaggaacgcagugcaauaggaaguugaacuuuuggggugccaagauuaaggcuguugguguuaacaaggccgcuaaaacaccagcuuagucuuggcagcccucguaaacgucuggaucuguuuugauaucuuuuaggcuacagguaaguacuguuguguacuaagccaguagcaaucucuuugcaugaccuucacuggagguuaaaggugggucaacucaucugacuacauuuuauaaauuaaaaaaaauggugcuacaagauuuucaccuuacuugaauuacaagaguuggggguugaguugaguuuccuuuacccuccaaugcuguuacaggucaccuaaguacagggauauguauuacaagaaaugcaucauuaggccauuuuguugcuaugcaggucagucacucaacaagguaucuugguucaauccagagacucgguaaacauuugauguaggaggcugcugccaggguaacacagcacaguuguuucacgucauggagccucuauaaauagugacacacuaaaaugaugaugaaaaggacagucuagcaaauacagaauccacuagcaggcgccugcuaccauuaucaucaagugccaugugcugcuccgugauugugcugugcuuuucaaugacuggcaguguggccuucuuuucuccuacaugaucaaauggguaggauuuugucccggggugcuuuaugguaaacgccacuaagcuguagcuuucugcugcucuguaaucuuccaggauuccucuagcauauacaauccauguccucuguuguccugcagcacaagacugaaauuccaugagcucuuccuaggugcaaacaagacacuuugaauagggaacaggaggcaagcauggccucuauauaaacuguuuagaacagugcccagaauagaaguauggccuacgguuccaacccauacucggggaugcacucaguagaauugcaugcagauguucaucgacacacaugcaguuacucauaauggcuggaaagaagcuggaauaauauauauaguagaauggagugggguguguguguguguguguguguguguggugaggugcauacucguacaauagauguuccagaguaauacacacaauguuccuaccacaagcacagcuagagauggaucucauaagcacugauacaagagaagaacuugacauuuaaaguucacacuaaggaaaaaaaaaagcaugaaccuuagguuauuccaugauugauugcugauggucuuuuaugggaugggguuaaaagcuagcagguuuggggggauugugggauccagaaugauaauuuuguuggucucuuuuuauuuuuugucguuuuacauacuuuugcuguguaccgcaggcuggcuuugaaguuuuuauccuucuuagccuccugaguauugauuugagugcuggucacaugagcuugcugucuaauuaggagcagagacuagaacuucauuugucuaucuucagucuugugcacauuccuguauacagucagccaucugucuacaugcauucuguauccaugguuucaauccauaaauacugagguuuuuuuuuuuuuuaacuagcucuacugaacaacaaaaaagacuuucuugccauugcucuuuaaacaauagugugacuuuauagcaguuacauuauauuagcuauuaacagcaauuaagagaugguuuaaaauauccaggaggauauauguagcuuauauacagauacugagccuuuuuauauaaggaacuugaauauuuggguuucuuuauauugcguugaacuuccucuucugguaucuggugggcucacguuucacucuaucccauuguuggcauggagcucuauuacuauccuaugaugaccucugcuucacuguggucucccccuccccucagccucgcaaguacaaggaaaugaguuguaauaucuggauuuuaauuuauauaauucuaaaaagacuucagagcuuggcuaucuucauaguuauuaaaacagcauacuuauuaccuacccuuugagaaaaccacauuuuauagcuuuuuaauuugugggccccauuccuuuucuguaagugcacuuugaagggcaugguuauugcaguuaccugacggggaaugcagccagugacuuuugaguuccgcuuacuuuuaaugagcugugaacucauuucccagcauucucuacucucaguucacaaacauuguauuuaguguaguuugucagggauagggcuaaauaccaauguuaucaggaaaaugcaacaaaaguuuuucacaggaaaaaaauaaaagcccuagcacuuuccaggcucuuacagucuuccugaucuuccuguguuuuucucuuguugcucccagcuccacggcuuccaaaaugaccuucagguaauucuuaaaccuaaggucagugugugaccccuugugguauguguuaguuuucaaguauauuaaaugagaaauacugaagugauuaggaaaauuaaugaguugaagaauuaggaguauuuuggucagggcuuagaaagaaacugaaguuagaaauauauuuuucuaauaauaauuauagucagucgaauaaauaauggugguguguggacuuuauuuuuacaagacuuuuuuucuugguauaaaagaggaaaguucuuagaggaaagucguugccaggguuaccauguuugcauuugggaacuccaggaguccugcuuuuuaguuaggaugcagucaguuucaucaugaaaucuuuguuuucucugauggcuaucauuugucuuuuguaaaacucuguauucauguuuuggauuuuuauauguaguggcaugacauuguuuccagucucuuucuaucccaaacuggauaggucucugggcaguuuccuccagugucuuuguuucuggcggucuccucaaacaucugcuugauuuuuuuuuuuuuuuuaaaucaggucaaauuuguaucagugcucugaccucguuuucagaccagugcuuuccaacucccuggaucaugugucguuaagguguaugugugacuuucagcaucuucuaagggaauaugauuaccuguaaauuaacaggacccuuuugguuauucaaacacauuagcaauucuuguguuuugaauauaauucacuuaacacaccaggauugucauaaaucacugagaauuagaauaauuucaguagggagggagucaaacuuuuuuauaacuauucaaucagaaaauaagucagacugcugccugauauagcugcuuucaaucaguagcuuuucauuggcuauuuacaaauauagaaagcuauauuaguaauuucuuuugguaagaaaugggaauagacauuuuucuuccuccuccuauacucuguaccaaauuagauauaauaagaaagcucugagguaauauacaauagaguucuagcuuucaacuacuuaaggcugaaauaucaaauacuuaagauggaaaauaucaaaagaacacuuaaaaucuagccaccuagaccauggccugggguagcauccacgguguuuucuucuguuagaaaacagaguagcagcuuaaucuguucuuuaguugaagguugugcugagccccacuauggggcaaaauucucucuuccaaaacauaaccuuggacugagaacauguaugugucaaccacauuuuaaggcagccauguuggaacugccuccuucagcgucuuuaaguauucugcauuaaacugcaaagcagugugcugagcuuggaacuggaaugguauuuucagaccaagucuguuuguuuagcaccuaagaacuuucucauuugaucuuuaccgugaacaaggaugcuccuuaguguaguuuguaugaaggcaggagaucacuuuaguagcuuuagcaguuuucauguugaaacaguagucuguauucccccagaagagcccuggguguccugcgauucaguuagucuaggcuaaacucaaauucaccugcuuaugcaucucgagagcuggaauuaaaggcauguaagugugugcaauaauggauaugaggagagcuucuucaggccugagugcagagccuuguuaaggacauauuugcacagugagaccaagaugaugcguagguugugacaacaucagaccucaaaugauagauagacugcauucuggagucauguggagcuauucaauaagacccaguuaguccuucucuguucccuuugaggcagcgucucucuacauagccuuggcuggccuggaacucaagacauccgacuugcuucugucuccugaguguuggaaggaaaagcaugugucacccacacccugcaauucucauuuuuagucauuccacugggaauauacaguuaggcuccuggaagacugguuaggauaccuuuugccauagaucaauauauaacuuuugugcauuucugcuuaauguagauucauuagcauugaauucacugccaacagugacuguaaggcaugcccgaaugaagguuaucugaugucuucucaacaaagcaccuaaccuuuagaaacucuagauagcaugguagcacugcaaucaggguguuguucaaauaaaagucaccuccaagcaaguguacaaaaaugugggaaaacaucguugugcauacccuguggguaaugagauggauccaaaguccaaagucauccccagcuacauggguggcuagagagaggcccgucugagcuacgugagaccucuauaaacaaacacauuuaauuaggcccucuauuaauuaacuagagcugggacacuggaaaaugcacuuguuuuuuaguguuaauaaaguaaccuuaccacaagagcuuagcuuauaaauuauaaaguacaucaauuucucacauauauucaacuguuucuuaaauguuuuuccagcuuagguacauggcauuucauuuuuauucucuuaaaucucuugggaaggcaaauauuugaggaaggauuucucugcauauguauuuggguguucauuuuccagcucgaaauuuaaaaaaaacaaaccaccaaucuuguucacauuauaaaauaaaggcaaugguguugcguuaucugagcugaccugggcaaaccugagcaugccuuugucaggauacugcagauuuccgugcugccuuuugcauagcaaaugucccuuggaaccaccucaaggacugauuuucuuauugcgaaacauuaaguuauggccagcuguaccugguuacuguaccagagccucccucauaugcuaggagaguagguuguugccacaggcuuuugaagagagauaaauaacuucucauucaugaaacacuugauuuuaaaauuuucuuauauauagaagcucagacaagaaggagagcaugauuauucucagguacuuuaaugaaaucaauguguggggagguuaucuugauaagcuaauaaguggccuuaaccauuacugguguagagcagccaaagggagggaggggaggaguuacucggcaguguugaguaguggguacucaaaucaaaauuggcuagguuuuagugccaagugauuuccacgcauagugcaagccugggcaucuguuucugucccuguaacucgggagacuuucaagauuauaguagaacgauaaugguucaguaacugcaaugcuuuucuaccccagaguugagcacagguucaccauagagucagguacuugcucuggguaaacaguauaugcaaguucccuuauaaaccuuaaacacauuaccgugaccuaggaguuuccgcucucugcuccucuuccccccccccccccccaccccccuauaagaauugaagcuggaaccaaggcuuuuguguuguuuuguucuucauuguagcauuguucaaaauagccaaaaggcagaacccaaaugcucacugacaggugaauuaccaugaagauuagagcacggauuuguccugccacacacaggaaccugagggcuugaugcuaaauaagagauaaaucaucugugauacugcaugccugaauaaucacauugagacauuacugagaacagaaacaaagcagugguuauccuacagugaggagauuugggagugccuacuugauggacucggauguuucaguuugagauaacaagaaaaugcuaucgcgguuucucucucucucucucucuuuuuuuuuuuuuuuuuuguuuuuuuuuuuuguuuuuuguuuuuuguuuuucgagacaggguuucucuguauagcccuggcuguccuggaacucacuuuguagaccaggcuggccuccgaaauccaccugccucugcugggauuaaaggcaugcgccaccacgccuggcuaacaucucuuuuguaaguagccagucaggcauucuaauucugaacucuagucucagcuccaacugcaccugaucuuccccccaugggacuuuugcuugcuaagaaguguagucugaguguuaaguauucccauccucaaaccuaugaagcacagaaggucuugucugguaaggcagagaagaaaggcuccuagauuguaggcucuacuugcaagucaucacuggccuuucucccgcagccccgugcuuugaguggaagaggugagccaucagguagaaagcuggcucucuccaccuuccuauccuuuaaccacagggcagugguucucacagucaacaggcaucgccucaccccggggauuuguccugucuccugaucuuagcauuucuggugcuggagaccaaugauuuaaauuuuaagucaguugacacaguucccucuacauuuuuagaacagccaacagaaagcuaccuuauucuuuccccuuccauucauauaguucauaaauauaaguguuacucaacauuuuacacaaucuuacaucuuaaguagcaucuuggguucuuguaaaacaucaugagggucccccuccucccaugaccucaucuaagcacaguuguucucgacagacauucccacaaauaccaugggagucggggcuucaauacaagaauuuucugggaacugagguagaauaauuaaauuuauuuuuggcaguacccuauaauaacaucuuauuuugucuuacacuuguaaacagagcauuuuacuuuaccugugucaagacauuguuuuacaucugaaaagcuguguucugauauguugcuuacugaauccucucuagugacuucuccagcaguggcuguaggaacauaaggagaucuguaguguucauuuuauuuuauucccuuucaggguugacuuuaaagucacuaguacucugugggauccuuugcuuuuagauuccucgacuuugagcaccuuuugccuuaggucccugguagguauugauccuagguaaauuucugucuucccauggagguugcacccaccccuccgggcagugacuccgacugugggcaacuuuaucuguagauagcuaacuucccuuugaauggaaauagcugcagaaauaccuaacauacuuguucuacuuccuugaaaguuucaguccuaacugcuuuucccucuuggcauuugugucauuuaagccacaaguaaacccuuuaggaaaguaggguuuagaggucgucagggccgccuugcccaguccucgcauuuuaggcaaaaaucguguguacucggcugcuucaggcucccaccacagaggcugacuuagaacuuagauuccuggugaacugguucagcuccuuucaaaucuuaccugcuuguguguauugugucucuauccauugaacuacauuuauuuuuaaaggacuuggugauauuucacagaagaccucacccaccucuagggauuucuugacugccacuuucagauggacuauuuuaugccguuggugugaaagacccccgacguggguagucaaucaaucugaggagacccucucaaggaccagcgagaccacgauucggaugcaaacagcaagaggcuuuauugggagcacggguacccgggcgacgcagucuaucggaggacuggcgcgccgaguguggaguuuuuacccuuuuuauagggcuggggcuggggagcaaaaagcgcgguuacagaagcgagaagcgagcugguugguuaguucgaauaaggcuugggguauuucucggucauuuggggaaacugaggugggacuuuuuaguucuaaacaaugucuauuuucaagaaauggguaugggagggguacgaggaaagggucuaaugaagguucaacaaugggcacacaccuggucagaacauuggcagacacacagguucaaggaguggccagagcacugugcaccucuauuuuucuaaaucagugaagcuaguucugcuaacacugacgucugagagccaucuguucuuggcccugagccggggcccaggugcuugaccaccgauauuuggccccugucccaguauuauucagccuuaaucuuuaacuguuaaucuuuaacugaacuuucuuguaacuuuugagaacucagcucugguacuuuuucaugccuugcaaaauggcguuacugcagcuagcuugcuaagccugaugguggggucuuucauuccccccucuuucuggaaacugaauaaaaucuuuuauucacgugauuccacuucuucuggaucuauugauuugaguuggugauacuguugggucaaaaccagggccugcacuaccgaaauucugucuuuuacaaacuggaccaagcgguugagaauacaggguccgaagaguaggauuaauaaaaguauuaucaaggggcccauaaugguagauauuaaggucgugaaccauggggaccuguuaaacagucccucaaaccacccuuguccugauucgaacaauuuuugucucugguucaaccuuucucuuagcuuugccaugcuaucucuuacuacgccagugugguccgcguagaaacagcauucuucuuuuagggcagcacauaauccuccuucuuuuaggaacaguagaucuaauccccuccgguucuguaggaccaccucagacaacgaggucagagacuuuucuagggcacugacugacuuuucuaaagccccaaggucuguauguauggcugccuggagcugcucgaauuguuugguggccacuagggcuguagucccgguuccuacuccugcagcuaugccgcccauaguaaguccucccaacagcagggccagaguuaaugacaccggcucucuuuuauauuugguuuuuuucucaaacuggccauaaacauaaccaggggagugguaggucaccuuuggccagagcucaaccaggacacaguaaucgguggugaggucgaguacagugguagauaggcagggagugagcccgguguugcaagcccaaauggucccggcgggagcagccagauaguaggacccgucgcucgucuucugggugguauuacacagggccugauggguuuugggaacugcuccuacgcagagucccuguccggucacuucggacagggucagcuuguguugggaggccacggagcaguuagcuggggcagagguaugguuggaauaaguaccuaggacggcaaccccuucguaguaggggggucccgcuaccagacacaaccagcacucuuggguuuugucaggacuggugagguugagagcuugguaggcuccaucuaccagguuuagcagccugucucccgucccagguuguugagaagguggggcagucucagggacuauagaggcugcgccuggaggaggaggcugaggaggccuggggagcaugaucugcacgggucgggagggggguaacuggucagugaucacgggauuaggcccaauggggacgcggggcccuauauugaggaccuggcgggucaaagagaaccgggucaccgggucggucccuguggaucgguacagucuuaguccccauacuuuggggccaucccagcuggccuuuuugcccgcgucagugaauuccaggacuaggggauugcaucgaccccccgguguggcgcccuugaugucacuggagaccgcugaggaaucauaacaggggcccugauuccgagggguguuuccucgcuuaagggaaauuaggucccaugaugaugauggcuuccaguaugccuguccaguggucucacagccccauuugccacaguagcccucucucggcccuccacacccuguugguacaguaugcccggggcaaacauagaagucaaauguucuugcccuuuuucuucccccgggagugcgacacccgaguccagucucaucccagucguccccuauuaaaucgcacaagucaaaguacaguuuaggaaaggcaucggucauuguccccaggagggagguagcauuagcuguuuguccugucauuaaguugguaacucuccaaguaacauugaagaccugaugagggcugucauguuguacugauacuccugcucuuauuaagauccccaggauuauuagggggccccacggguuaaucuuaucuuuaagggguuuugagaacgcuggaccuuccaugucgguccugaugcuguuccggccggagggguugucgccgcuuuuacgugagcggcguggauccacgcagcgaugccgucuacuuugagagcgguggggguggucagcaggacgguguaggguccuuuccagcgagguuccaaguucuuagucuggugccggcguacccacacggugucgccgacacggaaggggugugguaucacuggcugguccagcugguccugauaggcagcggccaguggcuuccagaccucucguuguacugcuuggagggccuguaagugagcuuggagagaggggcuauuaguaaacuuugacauuucaggaucauggaaauuaacaaggggcgggggcgccccauacaggauuucauacggagugaguccaugggggcccggaguguugcgggcucgguagagggcuaagggaaguaggaguacccagucucuagugccaguugcaagcguuaauuuggucaaagucuccuugauuguccuauucauucuuucuaccugaccugaacucuggggucuguaagcacaauguaguuuccaaucaauccccaguagcuuggccaccgacugacuuaccugggagacgaaggcaggcccauuaucaguccccaacacuuggggcauuccaaaccuuggaaauauuucuuccagaaguuucuuggucacuauuuuggcagucucauguuugguugggaaggcuucaacccagccagagaacguguccacgaauaccaggagauacuuguacccauacaguccgggcuucacuucaguaaagucaauuucccaaugggugccuggucgauguccucuuacucguguuccggcccugaucuuagucuuacuggcauuuacuuggacacaggcuuggcaugauuccgccaccucguggaggaucuuaucuuuauuuagcauguaauaggggcuuucuuuccugucuagaagugcccucaucuucugauagcuaaggugggugagcuggugaaggaagucuaauaauucaaaggugaacuggucaggcaucacagguuuaccuugcaggacccaauauuuuuucucucuaucauauguggcucccaacucuuguagguucuuuauaucugucucaguauaauggaagaagucuggaguguacgggguugaggucucuaugagaagugaggaggccuuugugucaguccccauggccgcuucccgggcugccugguccgccauucgguugccuuuagcuucagcacuauugccuuucugauguccugggcagugaauuauacugagucuuuugggcagaaagagagcuuucaguaaggccaagauuucgcccuuguucuugaucuccuugccuucugaggugagcaacccacgucuccuauauauuucuccauggauaugggcgguagcaaaggcauagcggcuaucaguauaaacauuuagcuucuuaccuucugccaucuuuagggccugggugagugcuauuaguucagcucgcugggcggaugucccggcuggcaacgccuuggcccagauuaccucggucucgguggucaccgcugcuccagcccuacguugucccucuugcaggaagcugcuuccaucuguauaccagguguggucggcgucugggaggggcugguccgugaggucuggucugguuccgugugucucggccaagaucucgaggcagucauggugaggcucuuuccccgguagggggagcaacguagccggguuuagggcuaccaccgguccgaacuggacccgguccguaucuaggagcaucgccugauagugggucaugcgggcguuggauagccagcggucaggggguugcuugacuagugccucuacugcauggggggccaggaugacuagcggcugucccaugguuagcuugccugcaucuuuugucagaacggcaauggcugcuaccauccguaggcaagggggccacccagcugccacugggucuagcuuuuuggacagguaggccaccggccgacgccaaggucccaguuuuugcguuaggacgccuuuggcguagcccugcuucucgucaacaaagaguucaaagggcuuagucaaaucuggcaaucccagggcuggggcaguuagaagagccuguuugauuucuugauaggccuuuugcuggucugggccccaauuaaacagaguccccguuuuggugagaggguacaagggggcugccauuucugcaaacccagggauccagaggcgacagaagccugccgucccuaggaacucccuuaguugucgaggggucuucggaguaggcugccccaucacagucucuuuucuggccucagucagccaucucugacccucuuuuagaagauaccccagauacuugaccuguuucuggcaaauuugggcuuucuuggccgaggcccgauacccgagguccccuaggguuuguaacagggcccgaguaccuuguuggcagucgagcucagaaguggcggccagcaguaagucauccacguacuguagcaggaucaagucugggugcuggauccggaagucugcuaggucucugugcagugccucaucaaacagggugggacuguuuuugaaacccugugggagucugguccaggucaauuguccugagauucccaucucuggaucucuccacucaaaggcgaagagaggcugacuggugggguggagucucaggcagaaaaaggcauccuuuaaaucaagcacaguguaccacuggugggacggugggagcccgcucaagagguuguaaggguugggcacggugggguggaugucuuccacccgcuuguugacuucucucagauccuggacaggccuauaaucauuagucccugguuucuuaacggguagcaggggcguguuccagggggacuggcaggguaccaguauucccugguccaacagucucuguauguggggcuugauccccagucuggcuucuugugacaugggguauuguuuuauggacacggggguagagguugccuucagagguaugaucagaggagcuuggcgaacugccagucccaugcccccgguuuccgcccagaccuggggaaaaucagaaagccagguggacccuagagaaacauccggcucuuuugaggucucauguagccgauacucaucuucuauguuuagggucagcacuugcaggggcagucccauuggucccauaaccugagcuccugaucccucgaaguggauuugggcuuuuaguuuagucagcaagucucuuccuagcagaggauaggggcagucugguacauggaggaaagagugggugaccuuaccgguagcuagauguacuuugcgauccgugguccagcgauaccgcuuuccuccaguagccccuuggacccaggcagccuugucacuuagggguccaggauuuugggucagcacggaguguugggccccaguaucuaccaggaaggugacggguugccccccgacuuugaggguuauccuggguucaggggggggcuccugacccugaccucccuagucaccuaagguuaggagggaggucuggggccucaguccucggggcccucguggcuucuuugggcaguccuuagcccagugucccuuuucuuugcaguaggcgcauugguccuuaucaaguuggggccuccuccgcucuccccccugucuauccugucucugaccaauaacuacaguggccaagagcuugcucaucucucuaugucuucugcggucccuuucuuucucucucugcucauccucugcccuacggcguucuucuuuuuccucuguuucucucuugauacguuccucucuuucuuccgggguuucucgcuuauuaaagaucuuuucagcuucccucacuaagucuccuaaggucuugcucuuuaaaucuucuaaccgcucuaacuuucgcccgauauccggggcagacugccagaugaaugacauagacacauugguuucuugcccuggguccucagggucauaaggaguguaccugcgauaggccucuuugagucucucuaaaaaggcugagggagacucauuaggucccuggguuaucccuuuuaccuuggccaaauuggugggacuucugcccgcguucuggagacccgcuaagagcaacuggcgauagaggacuaggugguuccuaccuucuguagugguguaaucccaaccggggcguucaaggggaaaagcagcauugacuucauuaggcaacugaguggggcguccaucauugccccggacugccuuucuagccucuaggagcacccgcugcuuuucuucuccggucagcaggguccccaacaacugcugacagucgucccaggugggcuggugggugaugaggacggacucaaucaaggccgucaauuuaccuggaucuucagaaaaggaaggguuauuauuuuuccaauuguauaaauccgaagaggaaaacggccaauacugaagcuggccaucuccccccaugcggaguggaaaugccugggaggugguggaguccacugcgggagggucucuccuuccccgcagucgagacaccaugggagaagggggggaaaccucggaggugguggccgccucuucuucgucguucucccuggcagaggaggaggguugugcucuguacggcgggggguccucugugagaaggucaaugagggguccgccgcuaucagggagaaccuggggcuuaggagguuuggacuuuauagaggggguaagggcaggguaaagggcagaucgggacggagguugcgcagaaggaccgggcgggaggacgggagcugucggcaagggaggaaguuuaggagacacaaacgguuugacccacggaggggggucauaggcaagugccucccaggugacgauauaugggaccugauccggguguccguggggaccaggacaaaacacucuagacuuaaccugagagauaauacuuaaauugaaaguaccauccugaggccaucccacauugaaaguuggccauucagcggaacagaagguaauccagcgccucuucuugacauccacagacugguuggaugcaaugcgcuggacaucuccccagugcugcaagguuaaacucagagggguaguuacggucugucccaugaucucgaaaacacuuaaagacagaagaaaacuaacgaagaacaaaagaacaacaaacaaaucagacgcgcggcgcggcuucggcguaaaaccgaaagcaaaaauucagacgggggcgggaagugucucugucucucgucccccaacaaagccacguacaguggcggagcuccaaaaaguccgacucggguagguuaacugauacagaaugggccacaaaacgggcccccgaggccgcugggacgucucccaggggcugcggccgggaauacgaacucgucaguucuuccgcggaaccgccagauacagaucuaguuagcuaacuaguacagacgcaggcgcaaacauuggaugccggcacaaacacgcacgaagacagagacagacacgaaacgaccgcuggccagcuuaccucccggcgggggggucgguggucccugggcaggggucuccaaaucucggugggaccuccaaaugaaagacccccgacguggguagucaaucaaucugaggagacccucucaaggaccagcgagaccacgauucggaugcaaacagcaagaggcuuuauugggagcacggguacccgggcgacgcagucuaucggaggacuggcgcgccgaguguggaguuuuuacccuuuuuauagggcuggggcuggggagcaaaaagcgcgguuacagaagcgagaagcgagcugguugguuaguucgaauaaggcuugggguauuucucggucauuuggggaaacugaggugggacuuuuuaguucuaaacaaugucuauuuucaagaaauggguaugggagggguacgaggaaagggucuaaugaagguucaacaaugggcacacaccuggucagaacauuggcagacacacagguucaaggaguggccagagcacugugcaccucuauuuuucuaaaucagugaagcuaguucugcuaacacugacgucugagagccaucuguucuuggcccugagccggggcccaggugcuugaccaccgauauuuggccccugucccaguauuauucagccuuaaucuuuaacuguuaaucuuuaacugaacuuucuuguaacuuuugagaacucagcucugguacuuuuucaugccuugcaaaauggcguuacugcagcuagcuugcuaagccugaugguggggucuuucagguguggaaccuuaccuucugcgaucugagauugcauauuggcuuuuugaaaacuucaucuauuuuaagaaauccuacuuuacuucuuucuuacuuuguaauuauguaacuuuuuuuguuuuaacauuuuggagaacaaacauccauuaaaucuuucguuaucucucucucucucucucucuuuuuuuuuuuuuuuuugguuuuuccagacaggguuucucuguguagcccuggcuguccuggaacucacuuuguagaccaggcuggccucgaacucagaaauccgccugucucugccucccaaguucugggcuuaaaggugugugccaccacugccuggcuguuuaguuaucucuucaggaacuggucuauuaacuaacauuuaaggggcccagcugaugguucagugggaaaguagcacacaugccgacaaccuagagguguuaagcuggcaccucuacugcucaggguacguuuguauaaagcaaggagagacagagagugggguccuggccacggugggaauaggguccaggugccuucuguuaggagggcaugggccuugugugagacgccacuuucaguuaggagggcaugagccuugugugagacgccacuuucaguuaggagggcaugagccuugugugagacgccacugaccugaguugucguuuacagaaguggauaggugaaaaagugucaguggggcagucaggaguggagaguugauuucuagcacuuggaaagagaaaagggcgggggugggggggagaagaaagggaagggaaccaucuuaucuacacuuaaaaacuagaauauccaacuggcuagagcuaacaggaagggcugugggggugugguagcacuuggucagcaagcccaaggccuuucauuccucagaacugcauaaggugggggaugggguggucgguuauagaaguuaauuuuuccuuaaaaaaaaucaaaauagaagcaagcagguggcaaaaggcuaaagggaaaaagagaacugucagagcagcacugcagaaucacugucacuaaagauggcgccagcuacugucccuggcugcuucaccaaguucucuuaauggaucuccaggcagagagccuggcugugugugcagcugcuugucuguccugagacagugaugaaaugggaaauaggcgugguuaguccugccggaagcuggagggaaaucuccaucuauugaccuugccuguggaguugacacauugauggggaagaggaagggcuuugucacacaagguccuccaggcagccuguuuucauuccuagcauacaauuuccuggaagagcccuacuuccugggggcuccauuacagauuuggggggggggucuuuucaucuauuuaagagguggggauauucgaugagaaauuuggucuuuuuugaaacugugaauaacagcagcuggacagcauuauuugauauuuucccuucugauaaggguauaaaaauaaaucauuaaguauucaaaccugucuauguuucagccguaguuagcagagcaguuuagugcuguuuuuaaugugucuuugcuguguugggauguaagaagugaugguuuggaaauucauaccuugugccaaauaguauguuguuuuuuuuguuuucuguuuuuguuguuguuguguguuuuguuuuuaaucuugauaguucaggcuacauuuaucguauguauucagaaacuguaaacacagugacagacaaaagaauggagauuuucuuuuuuaccuucggugaucucuggggcuguaacugggcucaggguugccaggcacuugcugcagcaaccauccuccucugcuaaccgugcggucgguucagacugcaggauugcguccagagcguggaagaacuucaucguccucgagcugucuccugaccugugggcaugcuuaacuguccuguauucguacuugagguuuuuauacuuugcccggcacugcuuccagucucuguauacuccuaguguuugcagccuuuuagcgacguaaauaaagauuucuuuauuucucaguguucgguaaaguuguuuucguauauuucuuucugcccagacacuuaguaaagccuugaccuccuccuccguccaguguuucccagguccacucuccauguuuaaagugaccuggaagugauuugcuauuucuagcucauguuuuuguuuccuaggaaaccagagggcugguuguccaugagcucugaagagcuugagaggguguaguuuaacugguucaagcugccuaagggaguaacuugaggaucugccaaauaagcaggcucuugugguuaaagaagccuggaccuaaaugauugcuaaucuuauuugggcuucaggggaaaauuaaccuugggacaaaagggaugaaaacuacuuuguggggggcagggagucucuuuccuuuauaauuuuuggcuucauugaauguguuauuuuuguuuuuuguuuuuuuaauuacuuggaaaugguuggcaguagcuguggggauuuuuuuuuaaagguuuauagcaaauaugaauagcuauguauuuaaaaagcauugaauuugaaccuaauugauagcucagugguuaagagcacuugcucuugugggggggggggguggggacaugacacccagguucuguucccagcguccguguagcagcuuacagaugucuguauguaacuccagcucuaugggaucugacacccuauucuggccucuuuggggauacccagcacccacaugguacauauacauacauguauacaaaacacccaaacacagaaaagcaaaaggaaaaacacuugcaaaagcauuacauuuugacugagguuuauagcuaauaaucacuugaaggcuuauaucaugcugggggugauggugcucgccuuugaucccagcauuagggagguaggggcgggcagauuucucugaguuugaggccacccugguuuacguagcaagcuccaggacagcaaggcuacauggagaaaccuguuaccacacaaggagggugggauugauuuguuggaggaaguuuggaaaguauaaaaagcaagacaaaaaaacuguuagccggguguggugaugggcacccguuaucccagcacacuugauguuagagcaaggggcgcccaugaugugguauacugagaccuugccucagaaaauuuuacuugaugucauguccaguuuuaguauaugcagcuaaguauucuugccuucucugauauugauaucuacauacuucacugcuugaggcuuuauucagaggcagauuauaggcauuagauauccagauucuggaguuggguuaucuguucugaacacacaguacaaccggucaucugcacaauuguuguguuacuucauuuucuuugcauuucucucugaauccuaaucauagcucccguuucacaggauugcuaugaaagccagaucagaugauauacguaaauacuggugaccgaagggccuggcguaucaauuagaauuagaugacacuacccuguugucacaguccagagaugucccgagccucucagcuuauggguuccuuugggaaggggaugcgugacgaagcucugcaggaaauguaucaaguggccugauuuaacaggugauguguuuauuuuguucacagaggucaggagagcgcugguauugugaccagugaugggagugcagugccuaaauucagggugcauaagguaagucugaacaugaaagacugaugcuggagaugacugcugccagcugggcaguaaugucugcgguggaggcugggcacgguggugggggccuuuaauguugugugugugugugcgcgcgcgcacgcagaaacagguggaucuaucugaguuugaggcuaguuuggucuguguaguaagacccuguuucuaaguaagcaagcaaguaaauaaacagacaugggaguguaaauaaauuuauaacuagaagccauauuggauaaaucugcuuccaauggcgugucuucacauuugucaaaguaggaugcauuucuuuccaggugaucuuuugcuaggcuggcucaugcaagccaggaggucuauuuaaauguuuuaagaugccuuauuuuuuuuuaaugccaauuucaguuuauauuugacagauuucauugccuaguaauaaaaucuuauugcuaacuaucugucauaagauagaaguguuucaguguugugacaacccuaaacuaaugaagggaauauccugagugcauuuuagaaagugaauccacgggccgggccaggcggugguggcucacgccuuuaaucccagcacuugggaggcagaggcaggcggauuucucagguccaggacagccagggcuacacagagaaacccugucucaccuggggugugguggcacucacuccccccacccccaagaacucggaagagggaggcagaggcaagcuaaucucugaggacggucaaggcuacauagagaaacuuccacauuccaaaguuaauucauucacauucuggagcacagagacagauugugucuaauuuggguugcccagggaaggucuuguuucuucccgguccuaguuucuguuuuuucccuaaaaucuacuuuuacuuugacuucucaagggaaugggucuuguaaaccauguuuuuaccgaagacaauuugaagaaauuguaugacucaaaccuuggaaucggacauacgagguacgccaccacgggaaagugugagcuggaaaacugccagccauucguaguugagacgcuucacggaaaaauagcuguggcccauaacggggaacuggugaacgccgcucgguugcggaagaagguaaguugguuuuuaagagcuccuuuuugaaaggaaaaaaggaaaggaaguugaagaucuccgacaaaaggcaucuucuaguuacugccacuguuaccucccugcacgaagccauugcaucagaauugccuggccugcuugcucuaaauccagauucuuguacuccccaagugaucggagcagugccacuuugugauuuggaauguugguguaugguuacugucaacagcacaaagcgcuacuguaaacagcuccuuaugacuguuccuaugcucagaaucugugacagaggaaaacugaagcacuguugccuacguccagacucggcucggccauguugcugugaccaaacgugggguuuucuuaaacccaccaguuaguguccugugcuucccauccucccugcggucuccuaccucgggaccccuguguuaauuccaugagacugucucucagaugcccaucccguguguaggccuugagcacuuaagggccacagcugaaccuugauuuuccuacauuccuccuugauuucacucauuugggagcacagcgguucacagaacuuuaggaaaauguuuaauuugugcauguugguguauuuuaagagacauuaugaaggauucggaacaggugaugaggggggggaugggcuugugggaggaggcauggggcugcugccuuuugcacaucacucuccacucuccacuguuucagcacccagaagauccaugaagccaguccuuuuaggucuucuggacacaaacauacaugucugccuaaaugauuagccuuugguggucaucuugaccuuugaccccuguacucucuuugcagguuuggucuaaggcugaauguagcccucuggucacgugauuauuuuucacaguagcuucccucuauccugaagcugucaggaaguaucuagccaccaguccuguccuuauuauauuacuguucaaaauacacuuauuucaguggauugugugccaggaaagauuaggcugagaucauuauggacuuuuuggcucuccagaucucucaauuguagauaaaaagaacuguguuuggaaguagaaaacagugucuauucugaacaugcauagccuccuucuuuguuauguccuaaauaaccuguaagugguuugcauuguguuaguuacuguaagaaauaaagaggcuggguggggguggugcauuccuuuaaucccaacaucugggaggcaaagacaggcagaucucugaguuugagggcagccagggcagccagagaaacccugucuuggagggaaaauaauauaaagaggauuuaagcaccuuuuguuuguuagagguuuuggacguugaacccaagaccuuaagugugcuagcuagucaagcagugugcuacugagcgccauacccguuucuguaagggccgugagcaucugaggaggcugguuuugcaagagacuggcgcuaucccacauagguaucaagggcagugauguguuucuuuucuuuuuuuugugaccaagucuuauuguagcccagaucagagugccagcucuagcuagccucaaacggcaguccuccugccucagucucccaagcgcugggauuguaggcauuuccccuaucugaacaauaucaugaaaguggaggacaggcugaguauuccuugucugaaaugcuuaggugagaggccagccguucagauauugaaguauuuaugugcccaugugagaugccaagucagcauugaagguuauauuucauggcacaaauaaaacacaucggcuagauaaagaugguuuugugugauuuucuuuuuuaagcugagggauucuuugcuccauaaacauagaaauugcaaagacacaaagugcagcucucuuucugucacaaguuuugagccuacggugucagggcucucuucugcuaguguuacugcucugggcuuuccgugccagggacccagcgucuaguguuacaggccugagcucgggguguuggguagccagagccagugagcuguggcagcguuuuuuggaaccccuccagcgcaggucuuggcagcuucuccacagcucuugcugucucuuuccuucucgguacuuugcacgguucuuucuggugugugugugcgcgugugcgcgcgugugccugugccugccugaguguguguuuuggacaaugugcaugaugguguccuuggagacaagaagagugcauuagaucccuagcuacuggaguugcagggguuguguuugagcugccauguuaguguugggaaucggaccucugagcagcuggugcuuguagcuacugagccaucucuucugcccuuucccacaguucuuuauaguucucuggagucuucuggagccuaugauccugaccacccccuuagaacucuaucuuucuucuagauguuccugggugucccugggaugagaagccccaagggacucuuguguucuucauucaguuaacccagccugcuggacccguaaugaaagguccuaaauggaccacagagcuaaucaaaugagccagcugauccaauugauagcugugcugcaccauagggacagcgugcaggaaggauggcuccuagacagcuguccagagagugagaggagccuugcucauauauuuggacuagcugacgugguucagagaggagcugucccugaggggguuauuaaauaucuccuacauuagucauuuaaaaugcugauuccuggcuucucucccuggucagaaguguggauguucauuuacccaccagcauuggcgcucuuugcuacuguuaaggaaggaaugugcccuauuuaucaggaucaggaagguagaaaaggcugcaggucaagccauuugcaaaucugcucacccucaaacuuaaguucugcuuuauaucugcuaagguacuuuuucuguuuagcucuggaaacuucccauugcuccuaaccguggacugcugccacgaguauacacauacccuuagugggacacggggguuguaacuggguauuuguagaaugccugguuucuauuacugugugcuuuuggauggggagugggacaucucauggucuaaugaugaaacuucucucuccuguagcuucugcggcaggguauugggcuuuccacguccucugauagugaaaugauuacccaguuacucgcauacaccccuccucaagaaaaagaugaugcuccagacuggguagcaagguaacuauaggacuggacuauagcugcagcucuggccaugagagcuuugcuugucuguguuuauagccagugauucauucaguuccuuguaauuccagaauuaagaacuuaaugaaagaagcgcccgcagcauacucccugguuauaaugcacagggacuucauuuacgcggugcgagauccauauggaaaucguccucucugcaucgggcgucuuaugccagucucugauguaaaugacaaagguaaugagcuucagaaggaauuugauuuucguaaugcuuuucagaguuacuuucuuccuauugucgagucuuaagauccuugccuuuccucccguuuuucuuauaugagcccccaaaacugguuacaguaagccuauagauaggaagaaauagggaagaaagaauuuaugugaguguauccaugcuuuguauguggcugugugcucuuaugcugcuuaaggcagcuagaagggagugggagucuggcgucauccucugucagucucuaccuacgcucaugaagcagggucuugccugaacuuggggauugcaggaugccaggcuuacuauguggguccugggaucugaacucugguccucaugauuucacagcccgcucuuuagcuuuauuguauguaggggguggggguauguacacauguauguaugcauacagguugauuagaggucagaggucaacuucaauuauugacuucuguugcuuuuuauccacuggccuaaacaccucuuuuaaaaaaaaaauuacuugaggggucuggggauacauacagcuggcaguacuugccuggguuguacaggcuccugccuucuguccccaggacuaagaagcaaacacuaaacaaggagcccugaaccauuuccuaaguugauugucuuuuaacuuacagagaaaaaauccucagaaacugaaggaugggugguguccucagagucuugcagcuuuuuauccaucggugccagguaaguuguauccuauucuuauuucccucuacauuuaugagaaaaaauucccaccaauauuccuauauuccuagccugaauucuuagcaugaauaugagacagugagguuauaacuuugagaaaaaccugaauuuuguaugcauauauggaggacacugugucucauuuuccuucccuacccccaccccacccccaaggauggcuggugagagagaggaaagaacagacucucugugaggcauggugacauacaccuaaugcccagagcuggguaguggggaacuugaaaaguauuugaacuugaaacucuuggaacucacucuguagaccaggcugcccuugaacucauagagauccuccugccgagagcacucccucccaagugcugggauuaaaggcuugugccaccacugcccaucugaauauuauuuuuccaugccuuuuucuuugcuguaagaaagcauuuaugaauguguuuuguuauuuauggugugcauggcaaucguaccgacuuuaauguuccugugcuaccuucugauccugaaaaugcuaucagucuuuaaaaugucacuacucacuugauuuuuuugauuucccucguguguauguguuugguuuugauccuaggucucacucuaacccaggccacccugcaaccugugguacucugcuuccucuuccucccgagagcugaaauuacagacagagacacugcgcagcucacacccuuuaguuuuacuuuaugauugcauuuauuuauuuuuguagggaggggcagaugcgacaucaaaggauagcuuguaggaguuaguucucuuuuuccacccuguauccuagagaucaaacuaaggucuuuaggcuuagcagcaaacgucucuacccacugagccaucucacuggccacagacuggcuuuaggaaguaggaacucaggagcuggagagauggcucagaugguaaagcgcuugcugugugagcaugcaguccugagcuuggaucucuagcacccaaguaagcuauaaccccagccccuggggagcacccgaggagaggugucugucucuucuauauucauuuuguguugugaaggugugugugugugcuacuaugcaccuauaaagcgguaagaggacaacuugugagacuguuauuuucuucugccauggggcuccagagaucaaaucuuagauugucaaguguccuuacccacugaacaauucgccagcuccuuaaagucaagcuaguaaaaauuaauuaaaauacccucuccucccuuucucucaaaaaugggcagaguaacuuucaaaagugaaaugauaauauagauuguagagagaaugugugcacugucaagacuugacagugggcacauggaggagaguacuuaccgaccucuuuauuuuucaaaaaucaauaaaauauaggucccuugcauuacauuuuaaaagcaacagagaaauuaaaaaucuuuuccuuuugccuuuuaaaaauuaguauauauucauuguauaaaaugauaagcuucacaaaugucuucugguuguuuguguguuuuuccuaagauauugccaugaagucaaacccggagaaauuguagaaauauccagacaugguaucagaacucuugauauaauuccaaggucuaacggagacccaguggcuuuuuguauuuuugaauauguuuauuuugcaagaccagauaguauguuugaagguaaguauauuucuucccucugacuguuuaaauaaugucauuuaucuuauugaaacaugagagcccuuggcccaaaggcuuauguggcucuggggaggaacauggcugugagucuguuacugaguuacaagucauaacuguuccccuuugcaaccguuagguuuuguuuuucuuuaaguaauaaagauugucucauacauauuaaggugaaauuagacaaaguuaagacaguuugguuuccuuuccaaacauuccagaccaaaugguuuauacaguaagguaccgguguggucagcagcuggcaauugaagcacccguggaggcggacuugguuagcacaguuccagagucugcuacgccugcagcgcugggauaugcaacaaagguauuuacuuuuuuuuuuuuuuuuuuugagacaagguuucucuguauagcccuggcuauccuggaacucacuuuguagaccaggcuggccuggaacucaaaaaucugccugccucugccucccaagugcugggauuaaagaugugcaccaccaccaccuggcagguauuuacuuuuaauuauuaccugugaguuggucaccuggcagugaaauaaaaaaaugugaccuaauggaaucuaauguugacuccugugcgugaguuauuagacauuucuuucaagaaagagugggcugagccaugagcgcaugcaauaaguaguuuuugaucacccaaagauuagaauauuggcucuaauuuuaaaugauuaacagcacacagacuaugugacauugccaugugagugucauuuacaguguuuuuauucauaucccccccccacccgcucugcacgcuugcuuccccacaguagcucuccucugcuuucuugucacgugccuuccggcguccuuuauuucucccuucccuggggauggacgucuuccucucuugcgcgggguguguccccgucgcccacccccaccagcgcagaucuuggguuggcuggcuccuguuuugggggugugcucauccuuuucucccgcuuuuggaaccagcuguugugcuaaccuuugugaguuuccaccacacuucuuccuuuccuugguuuacagucuauuuucucuuguucugacucuucggggggucacacagaggaagccucugguccagcgucuuacuugaaaguaauugugaccuccaguuuuuaaaaagauaaaaaggcuguuuugugguagcauaggcuuucaaccccagugauagagaaaccaaggcagaagcauugcuuugagguggaggccagccuaggccacguagugaagcacuucucacaccaagauggcauuaugaaugcaagcagaauucgugguaauauagaggagcaugcguacuuagcuucuaaauguacaugugcuacagacaguuaccuugaggaauggcugaauaccuuuugucucuaaaaggaagucauuuuuaggccaauauugcuacuaaugugcauugauuuccccuccaucagugugggcugccuuauguggaagugcuguguaagaaccgguauguaggaagaaccuucauucaaccaaacaugagguuaagacaacucgguguugcaaagaaguuuggcguguugucugacaacuuuaaaggcaaaagaaucguucucauagaugauucgauugugaggggcaauacuaucucacccaucauaaaacuccucaaagaauccggugcaaaagagguaaguguuuuaaaacaucuguguagcaccaauaauuaaccauaugauguuggcauaaaaagugcuguauccgugaaacucugccuaucagauugcucuaugauaguugggcagcaauagggaaaacaugugcuaacuacucuuuuuuugguuugguguugguuugguuugguuuuuuucgagacaggguuucucuguauagcccuggccauccuggaacuuacuuuguagaccaggcuggccucaaacucagaaauccaccugccucugccucccaagugcugggauuaaaggugugcaccaccaucgccuggcugugcuaacuacucuuaacacuauaccaaguuuaaucuuuaauagauugaaaagcuaaacauagaagguuuaggacuugggaggcagcggcagaggaucaaguguuuaaggccggcuguggcuguugauaauccuaucucaaaaacaacaaucaaaaagcccaaacauuuuucucaauauaauauuucugaauuaauguuauauauuguuccuuuagacaucaugugucuuagucuauugcugcgaugcaacaccacaaccaaaaaaugaguuggagaugaaaggguuacacuuccauaucacaguucaucauugaaggaagucaggacaggaaccuggaggcaggagcugaugcagaggccauggagggugcuguuuacuggcuugcuugcucauauagagcaagcuuucuuauagaacccaggaccaccagcccagggauggcaucauccacaacaggcuggcccccucccaucaaucacuaauuaagaaaaauaccuuacaggguugccuccagcuggaacuauggaggcauuuacauccucuccccuucuuuuuuuuuuuuuucuuauuuauuuauuuauuuauuuacuuucuuacucacuuuacauccuacucacugccaucagucaccuuugccuccaaacuuuccuaccccucucccccuauuccuuugagcaggugccccaccccacccccacacgcaucaccccacccuggcacuuccagucucugugaggccagcugcuuccucugauggaggcauuuucuugauugagguucccuccucucggaugacuugacguugacagaacacuaggcagcccgucauguuacuguaccuuuaauagacaaaaaauaguauaaaauauuuuaaguucuuugaaaaacccagggaaugugugacucaguucauugcaguguuuguucucuuuuagcaauuugaauuaacaucuccaagaugcacauuuaccuuauauacgguuguauuuuuaaauuuuaaaccuuauucuaacuuuaaauauuucagucccuuaaauuauagaagaugccauauauauuuaauaguugaaugaauuugaaaauugugauggaaagcaauaaggauggccuauauuuagaacauuucaagaauacuaggguuuuccagguuuuuuaugacugauuaugguucugcuaaucucacuguugaaacugugaaaguuagaguagaaaccagggaauauaguaaauucugcaucuguuggcuauaguuaaaaagaauugcuagccacguacauugcaaauggauuaaguauauaaagugacacuccugccuguaugaugcaauauaguguugccauuuaaaucuguauguagauuuauaauauggaagauuaaaauuaaaauggagcuacugguuauaaccauguaaauggaccaaacagaaaggauaaaaaaaacaauaguagacagagggagcuguguuaugauuaguaagauuuucauuauaaccuagcagauuuuauuuuuuacuauggcagaauaaaggucgacaaaguaccaucuaggcauuugaacaaaacaaaaguagcacuaggaauguacagccauucaacaggaaugcauaaucuagacuaugagaauaugaugugauuuuuuuucucccccaaggugcacauucgagucgcuucaccaccaauaaaauauccgugcuucaugggaauaaacauuccuacaaaagaagagcucauagccaauaagccagaauuugauugucuugcagaguaccucgguaggaauuaacauuucuguaaacaguuaacugcuuuaaauuuuaaguauacuuuuguauaaaacagcagucagugggaagauaaauuugagcgcuggguuauagugguuaugguucuggcuaugcaaguuuugggggaccaggguugaguuuguaguguucugugggguaguuaugucuguaauuacugaguucagcguguggagacuguauacccagaauaagcauaacauuaaacacuguugcaaagaguaaaggggauugggacacuuuauauuagaaccguagcaaagcaagaucagaagacagaggaucuaucacaugcauucccaguuuccuucuccuuuaaaaguuugaaucguccugguuggcuugaacuuagcaccgucuucuugccucagcugacaaagcagcagguacugcaggcuaugucaucaugucgggcuuccuuuuuuuuaggaaggcuaagagaaguuuucauccugacuuagacgauguagcuguguuguggugagacauguuuucccuuccuccugcaggagcaaacagcguuguguaucugucaguggaaggacugguuucaucugugcaacaagaaauaaaauuuaagaagcagaaagugaaaaaacaugauauugcaauucaagaaaauggaaaugguuuggaauauuuugaaaagacgggacacuguacagcuugccucacugggcaguacccuguggagcuggaaugguagcugccuggacagauguguugcuuccagacuguagggucaucaagaaguggucuacauacuguuguuacucaggugguaccaaguggauaccacaugcuuauguauguauacuuuaagcuuugagauuuucugagguuauuauuaaauugcuauauugaaccugaagauuacauggaaugcagcaucugaggauucauuuuguacaaggacugacuuuucacucgagagaaggcaggggguuaguggcaguucccagaaccaugcuugagggguuuaaaagaggcuagaguauagggcuguuauguacaggggcuuuauaaaguuucaugaagaauuugaguucauugugccccauagguaucuagucuguacagucaagccuguaauuauggccuugaccuuaagauucuuccaccccauacacguguggcucugaggaccaguguacaauucuuaaaaaaugaaaaccuacgucggaagcugaggcagaauccugaguucaaggcgaaccugggcuuuccugucucaagauaaaaagccucuccugugccgggaccccccauccaucugucguucauacacuuaguacauaguaggaaugugcgugccugucauaggucguuuagagcugccgucucaccccugugcauggccauuagcaucucagaagcuagugauaauuaccuuuugcuaaauuacuuuucgguuucauugugauggagggaaauggacagcuuugcaguccuuucccaucucucuuggggauguaccagaaugacuaaaaauauaucuggagccuuuuuguuuuccuacacuugaggagaaaauacuuagucuagcaaauaacuuaguacauuggaaagagaaaguuuuaauuucaaauaagacuuuauccuagguugauuaaaccuggcuuuuugaauugagugcuugaucauucacagaaauguauacuuguauacauauuauacauaugauuuaaacagagcaaauagaugcauaaucgggcugauuuucuuaaaggccaguguuuugggaauuagauugccuguacccaaguguuagcucgcaaucauguuuguucugcuuuauguuguuaggcaggccuggugacauuuuauuuuuaguuuuuuuaugaugcagauuuaguggauugagaugauuuacuaacuccuguuuguguaagauuuuuucacauggaaaaauaacuauuucuauauuguugccaaaauuugcuauauacuuuccaaacccacuuagaaauauaauauuuauuaauaacugaaauuauuagucuacauuuggucuauaguaucauguguuacauaauggcaggucaagauaaaauguuaauacuuuaaggucaugugcugcagugccugagguuaucguauggcauagacacaggcggauuggcauuucacagccccagagccauuucagugggugcagccucuuauguuaaaugcauuucccguggcagugaggagggguaacguaacgccuuuaggucaacuuuuaaauggccuuuuuaaaauuugauguuuuacacagaaacucagggaagguucuacaaccaaaaucucuaauuugacuuuuguguuuuucauaguuuuuauuuuguuuuauuggauuacuuuuauaaagcgaaauaauaaccaaggucguuuguacaacuuucuuaauuauuucuucauuauaugcuuuuauuuuacaaguuucugaauauggauuaaauuaacuuuuuuuuuuuuuuaccaguuucaagccuuguuuucucugcuuuaaauguauauaacuagaguacuauaugcucaaaagaugaaaaauguguuugaacacaacaucccaaacuaauauaaaccuacuuucuuuuuugguuuuugcaucugauuuuuuagggguggggggcggcaaauauauguaauaaauguguuuaugugugcauuuuaaaaacaguacuaacagcaccacguuccauaccuggcaccagcuggugagauccuauuucucugauucaggaauuuuaauaaauaguccaucucuugugagcugggcaaacaca

SEQ ID NO: 2508 - RNA, 60276 nt, Mus musculus
ugcucacucgcgcgcucgcauccagccaccuuaugauggagcggccgccgcgcgcccugcugcugggugcagccggacugcugcuccugcuccugccccucuccucuuccuccucuucggaugccugcggcccgugcgugccggccuccugccccgcgcugccccggcucggcugcccgcugggugagacccgcgacgcgugcgggugcugcccggugugugcucgcggcgagggugagccgugcgggggcggcgcggccggcagggggcacugcgcgccgggcauggagugcgugaagagccgcaagaggcggaaggguaaagccggggcagcagccggcggucccgcgacccucgccgugugcgugugcaagagccgcuacccggugugcggcagcaacggcaucaccuaccccagcggcugccagcugcgcgcugccagccugcgcgccgagagccgcggggagaaggccaucacccaggucagcaagggcaccugcgagcaaggugggcaccagcgccuuccccgcccacuccuuccuccucccccgccgccgcagagcauuccuggagacccgcgggagggaggaguugauggcuaacccggugucccgagccaggagaaacgccucccugguucucuuggcaugguuuuauuuggaguugccugugugcgccaagaaagugagaaaucgcaguaacggguguaaauauagaaaagauuuuccgagacuccgaggcacaguuuacccaacuagccugcagggcaaguuucaaacgccuccacacucuuaaaaaccuuucucgucguucuuucuuucuuuuggguguguacagaaagauggguagacaggguuagcagaaaaaugcaaaggaaagauguucagaaagucgauuuacuaacaagauaauucuuuaaguugaaguucauauuaauauucaaguacuggcguuuccaauucucaagcgguaaccuagcuagaacauuauacuugaggguuaaaagaaacacaaacgcuuugauguugugaauccucugaccauguuguuuuucuucucgggccuugguuauguuuuuucauaauuuguccacaggaugcaagguuccgcuggaauggcuuugacauuggguuugucuauuguaucccauacuaauccaaacuugcacaaaugaaguuggaaaaaagucugagguuggggggaagaaagaaaucagaaacuuuaacuccuagugccugaaauaacauuuuccaugagcagucguuucgagggaaaguuagaguccugcucuggcagcugcugccccggcuucagccaagguaggaggggaggggaggaaugucagcuguugcaucuugaacacaguucaggcuuucuccagccuuuccaaggaacaguucuuucuugacaguuuuucccagaaaucccuaugcaaauaggcugugugccauucgcuucaaaguucaccauugaaagccuuaagugguauaacucacaguuacccauguaggauauuaccaccguuuauaaaaucacagaccaaauaucccuguuuccaacagaaaccuccauuuucccccuuuagcucuugcacaacagucacaucaugaggggaaaugaacauuacaaauucauuacaaauauugagaguuucuuauaaacaucccaaggggaaacuucuuucccagagucucagaggcagacaucuuuccccuaucagagcagauuagccuggugacuucccaagugguguuuccucaucuguggcgaguuuauuuuguuaauuuuuaucauuuuauauguuuauacuauuuuauauuuugauauauacuuauuacauauauaauacuauauacuuguauguguuguauauuauuuauguauuacauauuuauaaaacaggauaauuuauauuauuuuauaaugaauaaaaauaauuuauuaauuauacaaaaugauagcuuuuguuaugauauuucauaaauguacuuuuauuauauuuagccucaucauuauccucuccacuccucuucccaggcuacuucuucaucccaaguugugccccuccauucuccugucuuuuuuuggagauauagaguuuuaucaguuucucucuugcuacuuccuucucuugacacucacacaguaugaugaagaaauaagaaggcaccggucuggucugccucguugccagggacacccagcucuuuggucccucucuaggcugcaauccacuuuaaggguauggccuggcuuccucuuuaugcucaggaagauggagauaaauagcaucuaaaauuggaaaccuugacauaagucagucugucaucucuccaucucacccugacacacauggggaccggcuucuaaggcucugguaggagggugccaggaagaacaggaggggcuagggagccgacagagagccuccagaauaccuuuccaaagcagaggagagugggugaucauguacucaucugggguccuagggacagucuaacagcgauaaaagcuaaauagacaguacugcuuccuuauguaccauuuagcacugggucuuuguagagaguaaaaauguauuuccucccucuucuggccauuccuuuccccccaaaagaaacuugcauuguguuugcauugagggagagaagguguauuuuugcagaacucagcccaggugaaauaagccaucuacauucuguuccucuguuuucauuaagcauaauauuuauugagcagcuagccagcuucagcuguguauagccggggacgcacggagcaaaucugggcuugacgaugaaggaaguguguauugguuacaaauuaccgagcacuuucccuggaucccuggagccccuccugguguugcucuucacugagauuaccauuuaaugccuuccagcgagagaccuugcccugcuugguucuauauuccugcagugaaagagcuaauaaucucaagucuuggagccgucacugugaacugagugccaguagaauucacugagguccuuggcuaacuggacgggggggggggggggggcggggaugacugacaauucaguuuaauaaaaagaaucaggacaaagaugaugagggucgugaugaauagccauggcgccaggacagaagauguugcucuucuaucccaguucucagaccuuucgcuuacaguccuuuacaucugaguuccuugguacccauguaguuacucugauauauuugaguaccauuuucucacccuucagaaauguuacuuguggacccuagaauaccaccacucagucucucuucuuaguccuuccauggcucaguucaaacugccacucaggcaauaggagggucuucacagugcgauuccaucagaucucuucccuccagucuuccuguauuccugcuagacuauauggcugcuguucuacaugccuuuggaacuaccuucugccuagagugccuccugccuacauccugcacacacacacacacacacacacacacacacacacacauggacacggacacggacacacggacacagacauggacaugcacacaaagauacauacacagggacacacagagagacagacauacagccuuccuuggaauucuugucacuuucucagugagaccugacuuuccccugcuccauuaugauguuacuauucuccuaguacuguucaacaucaagaaagucuuaccggauccaugcuguguguuuauacaaagguccuguagcugacagucagcuguagaccugacucccggaauaugaauguuaacucuaccaugaaccaccagcuuuguucccucauggccucucuguccauagaguuccucaccuguagcaugggguuacaguuauaucacaggguuuuaugaugauugaaugacaugccaauuaacugaggagacuacuggaugaagauugguguccuugcucaaucaaaaaguuggcuuuagaugagaagagaaucuuuguugcccaaagagcccaaaucuccaagggcccagaucaguacuugaauggacugaugaaugaaagacuuccccuaacacucauuuagccucaggguaagcaacuuugaaugaauagacacaaguucuuacuugcagaguucgguguaagcuuuagacagaaauaaacaauauuuuuacauaguuguguguacccugaagaauguacaacggggaaaugguaucgaggcuaggggugagugaggcagugaaugagugggguggguggggcacuuccaugagccagagagcacagaugugagggggagcggggcuguauaagcugugcuguaugaaccaucccgccaucuccuuaaaugucuguguuucuccuagaauaaagggcagccucugucuuauagugccuuucaaacgcagugucuggcuaacaaagcuugguauauguuuguuagucagacagaggagacccuaggggaagugccuuccucugggaauguagacagugggcuccuugcuguguguccuuacacacacagagagagagagagagagacacacacacagacacacacaugccucugauuuauucuucugccuuccugacgucuaagcagggaauuuaucugacucucugcacucagccaucuugaguucugauacuauggucacuuuccaccaaauccucagacucacagcauguugcuagcuauagucagguccaggagcuguguuguaaguuagaaacaaaacaaaacuucagugaaguuuauuuagcacauuuaaaacccuuucuuuaaggaguucauuuuaaacuuauuuucagguugguaacaugucauguaaaugcuacugugccauuccuguccuugaaugaacccaggaacuccacuggaagcugaaacagaggagguccaacagccaaugaacuugucaggcgacugguuuaucuugagaccggacauguccauguaauguuuuguuaagauagcucugucuugcaaaaagagcagauuuaugcugggggaaugguguccagauguagggagaaagagccaauaaugacuucuugggggagugauauccugguugagacagagaaguaaauaaauagauaaauaaauaaaacagcuaaagaagaucgaauacgggagcgggaauggagucagaagggagaggacauggaacauuauuuagccuuacaaaagaagggaaucuugucauuugugacagcauggaugaacuuggaagacuauguuaaauaaguuauauucaaagagacaaauaucacaugaucuuguuccuacauggaaacuuaaaaaugucaaacucacaggagcagagagcagaaggucuucuacagagguggaaggugacguugguauaggaagaauugaagagagguuagucaaagaacacaaaagacaauuagaaaaaagucuaagaacugacagucccaagacccuaacuugccaggccaggcuguguuuaccugugcccgguguuccuuauacuucugaacacugucuuacuaaguucagucuuagauugcuugcauaucagccaguacagccccugaauuacagccccaccauuacucucuguccuugcugucagaucagagaaacagagagaagggggaaaguugccuccaagagagucaacgacugcagacucacaguugagaaagagacauacacaagacuucuaugacagccccuuccccacccccuaguaaccgccuaggcagaaagccaggaagagaacacuuucaaacugugacaaggaugcugacgugaagcucuccacaacucguggcuucugguggggaugcaggagggaaggacccaguuuucuuuaaguggcugaccacugggaguuugcccgugcuccaguacauauaugggcaacauaaacugggcuugucuucuccucaucuuccuccuccuccuccuccucuucuuccucuucuccucuucuuccuccuccuuugugggaguuagggggagcagcaauggugggggagcagaccugagagaacuggaaagugagugugauccaggugucgguaauucccaaauaaucgauaaaaaauauuauguuggaaaaaaccugccccaacccaauaauaaugccucuauaguuuuauaacuuucuuggcccuguuugcccuuguuaaacauagacgcuucuagaacagugagcagaucacuaauucuuccuuauugauugauccugucucagucaccaaguuguagggaagcucugagcuccuggaguagcuuuagaaaggggacaggcaacuuugaagaggggguaagggacucaggcagggucccuuuagagcagcgguucucggccuuccuaaugcugugacucucuaauacaguuccucauguuguggugauccccaggcauagucacuucaucacuacuucauaaccguaauuuugcuacuguuauuaaucauaauguauguaugugauaugcagggucucugauaugggacacccaaccagcccaaaggagucacaacccacagguugagaaccgcuguuuuagagacaagcacuccagagaacaagguacaguaacagucuaccuaguuugggaauugguuauuaaauggcaagugcccguuccagaguucuucaaggaaagcgaauuuaaaagccuaaaugaaauagccacgggcacauucagguuacacaccagggggaaaaaaccuguggcaugaaaacuguagcgcaguugugugggagucgagaaagccccccauuagagcugagaagggaccucaguuaggagggcagaguagaagagaccgucaccauuuuccccucccucacacuggucagcucugagauggaaugauggagcugagcaggcaguaacuggcauccuuagugugauuucuguccuaucccuagaaggguucacuagagacuugccuucuagaagaaacugccuuauacgggguguucuuuuggacagcucgccgacacagugcccuugguuggaguccaagggcagcuggcuucucuaagucuggguaggguccaagggcagugggccucccaggggauuggacugugagcuuucucugccuccagcugccccguguggguucugacuuugccucuacgccuuuaacuauagcacaaacaucuuaggaaccaguagaaaggaaagacugaauucuugucaaaagaguuaaaccagggggacccacgaaugucccucccuuugggaguuuaugagugacaagaucagaaaguuuugaaaaugauggaaaaugagauauacccaguaguucaugugccuguucacuuaagguaauaguaaagauguccccagauauccuucacuccuuaggaguggagucaggguagaggggcucaaaaugcccauggugaggagcaccccuauacacacuauacacuaagacucugguguagcaggaaaagaaagccacaguaauggggggaagcgugccuccuuuucacuugaaauguauauguguuaaauuguugaaucguguucuaucccaaauucaauuaauggccaaacgaucggacccuuuugaaaaagcuagugugccgaauugcuuucuggguucacagaggacaagauuaacuagccacagcugggcuuacagcaggccccacccacuuagcaucuccaacccagcagaaugcugggaaggaggcagggguggggagaggggggugcagggggaggcagcauagcuguccaggaaauccagggaagaaauccugcuguucccagaagcaggccagaguaacacagaagucuugccucugaaaacuaagaacgguucaagccagguaaaacaggcugaguaaccuagcguugacaaaggcccguucaugagguugauccucaucaagccacagcacagugcaugagaccaaggccaagccgagcugacaaguucacagagcuggcuacuguaaaaagguggcugucacaacuucaguguaacagugcauagugguaccauuuaggcuuccuccuucacaggccuguguacugugaucccagcgaaucucuacuuccucaacgugagauucuacugcacaccuuagggugguucguggguaguugugcaucaauuugcauucguugguacugaagccuauuuguugguaguggugccauuagacucuuaauuuauuuuuauuucaugugcauuggugguuugcccgcauguuugucugagugaggguuuuagauacccuggaacuggaauuaccaacaguuucaagcugccacgugguacuaggaguugaaccuuucuacagaagagcagcccagugcucuuaacugcugagccaccucuccggcaccaguuagacucuugacaagguuaaggggaaauucauggaagaauuugagaacucaauucaucauauuccauuucgacacuagaagaagaaaaaaacaaaaaacaaaaaaccuagugcuuuaauauucuaccaggcacuggugcagcugacuguuguugcccuguuucucacaguauuuugggggagaugggacaccuccagcuucuacaggagcuugcuugccucucucucucuuuuuuuuuaaagucagcacauaagugaugaguuuuaucacagcaugucuucccuugaaugagaaacauuucccaggcauuucauuuacauccgcacaaauuaaccaccaagcggucaagugguggagucagaaaggcuuuggaucugacaucugcucugcucucuucuggcuccacuccaggcaaagaugaaaacauugaucaagaaauggaucuccuggaacuuuccaaagguuuugaaagggaccacacagcaaugaagcuucaggaaugugucaggguggcccaaggccugcaggacuccaagcugguucauucuccgugggaguuuucagaacucagggcuccaaaggggaauuucaauggggccuucggcaguuagauggcaaccuuggcuuccaaaaggaaccccucaggaagccgccagcuuuugauggaaaaugaaaugcacgcuucucugugagcauugacaucaaggagccggguccugcaguguggccccuuauuaaagaugcuaagcccggcuggagagggcaagccggggcagagauaaagaugcugcccaaugucugacaagccugggcuucagagcuagaggccccugugggcucaggugugucucggaucagaggcucagagugguggaguagaguggaucugacuuggcuuuguguaccauggagccuuugguucacuagacgguaacuggcaaggcagggcagggcaggucuuucuaaacucagcaaagagaaccucccacucccucgcuaccacccaaaugcucucuccuccgaggccuuuuucuuuuuauccauucugccuggcccaucacugcaggcugcccccuuuuccugucuagcugagcucaaagaaauagcuuuucuuucccaguccccccuggccauuaugaguuacagaucugcaguagugcuuuaaguggugagcucugcucagcuccuggcauaagucaccagauuccagagccacaccugacccgccccuguaagaacgacagucagcaaacacucacucagcaugccucucuccuggacaagcacgaggccccucgguacacaauauccagaagugaggguuauguccccuuuucuuagcaccacccugaagaaggugguuuuuuggauaucuuaggaucuuuaugcacuccgugaacuggaaccuauggccucaaucaggauacgcccaaaguugggggagacagcucccagccccuggugacuguagguacaaugggacuucagggcugauacccggcugucucuagcuagccuuuacuucuugugguaugcuuguagugugcuacagcaggcaagaucugcaugguaugugugaagaaauaaagcacggagcuucugcgugugcacacuggagucagucagguccuuuacgucucuucccuggcgucugaaccaaacuuacuccauucguuguuuccuuagcugaagagcagcuaugauuguaucuuccgcuuaaaggugagauaaugugggaaaacaauauuagcaucuagcacacagagaggccccguuucgauucauguccauucuuauuguuacuagaauuaugaagccugagugaguuucuaagcaccauugaaauagcaacaaaagccagauacagggggacacacuuguaguaccaacacuuagcaggcugggacaggagguuuggaaguuccaaaccggcuuaggcuaucuagcaaaaccuguucucaaagauuuauuuaaaaaauaagugucauuucuauggcgugaugcugucuuacucugaccaaugcaaacgcaacacugcuuuauaugucccccagguuaaaugggaaaacuuuguuuauggcuacaugauaauguaguaggauaauaguaauagagaccaaccucuaaaaacuucuaccuuguucuacaaagacaaggaaucccaccugucccugugggaucucagacuccauaaagagggucuaguggcuggcaccugugcuuggacuccauggcuagcauguauacagugcuuuagagcauagcaaguguccaucuuccagcucagugucacauguauugacuucuaguggugucccuuacuggcuuuagcccacagcuuuggguucagggggcauucaaugcaauaaucacuggccugucucuuccguauguguucuuccagcaucuuugacauaggaaugcucacuaauaaguuguuugaauuguguguguguguguguguguguguguguguguguguguguguguguuaaacucucggcuucauagaggacagugaauaaaaaucacauucugaaacaugaagagugccaucagugccagggggcacacacgcugggcauuaucuuuggcucuuagaaucuugcugauuaaaaaaaauauauauauauauauaauaguuccuucucuguguuucuguucuuugaccuacgcguguagccucagcuuggcaggaacacguuugaaaaaaaaaaucaaaacacucaacuguaaaugagcaaauuuagacucaggaggcgcccacuuagguuggcugccugugucugagaggugauaacacuuacugucaaguguggacuagaaaugaggcugcagagaggagggcuaagaaaaugacuagcuuugcagacccagcaccugugagcugaaugaacguggcagagcauuauuaccugccacuuugcagguucaaggccaccucaccuuuuggagcagucguccucagcuggucugaucgccagggcaagucacagaaggcuauaccugagcuccacucccaagagucugauuuaauugcucuggacgugagcugcgccagggaacucauaaacacuuuccagaugacuucauguccugccugagccuaggaauauuauuauuuuuaacgugauuucccauuucuauaggggaugcucauucuuagagaaauucuuauacaaugggguaguauaugcucugccugcccagaauucaguguuuuacagccaaggaacuuuucagguuuguccuccauagcaaauggaagcucuugaacugcaggauggccucucacauugcaggcagcucagagcuggccucugucuuuccuccuggcuaguucaaugcucuugccuguuuggacaaaguggaaauguguucgccucugucgguaucacaguacguaagaauuuaccuaaacccacaugauccagccuguuggauguuucucgagagcaugccuuccuugagccucagguuuucaucugcuacccucaucacugaaucucuagccuugcaaagccuugggaugugguaggcaccgaaugagcaaaugcaugaaccgugaagguggauuuuucaggcguagggaccuugcaaggacguugaaugcagaacucuuuugugaggugggccuccuuuccauaucccaccauaauagaauggugggcaagaacagauguucaaggaagcauuuggggcucggggcuugauccaacaaacacauucugcccuugccuuuauuguuccauagcaagcuggauuuuuguccugacccuugaccuucugaccauuaacucccugcaaauaggacuuccgcucuuaauuucauagagcagcaggaagguuauaugggagauuguucccccguuucuuuuuccugccuuccuacaagauaguggaaaauuagcccuuugguucccauucaguucuugcuuuuuguguauguuguguugugugccaaaaggaauuuaugcacaagaaagauauggacaucucuguauggauccuacaaagcuaaugcucugauugguuggagaguacagaaaggcagaauagaugguaagacucaaaguaggguagccccuguguaagcccagucaguaaaaaaacacacggacaugagggaaguacacacaugcaugcauacauguaacuuuauuaguaaucaccaaaagcauauuuuccucagauggagaaaugaacgaggguacagucauacuuguaaccuguacauauaaugaacaaacacauuuuaaccugauugcauacuagguacuuauaaguaauauaacugccuuggugcauaguauauaaaugaauuuauuauuccuucacccaaaauaucauauggggguggaaaggaacggaucuuauucuuguuuguuuauaauugaacuaauaauagaauguuaaugcaaaagaaucuucaggauuucucuaggggcuggagagcuggcucagcacucaagaacacuggcugcucuuccagaggacccaagcuugauucucagcacccauacagcagcucacaaacgucuauaacucuacuuccaggggcucuaacacccuucccuagccucuaccaggcaccggacaugcagguagggcacagacacaccuucagucaaaacacccauacacauaagaauaauuuuuuuuaacuuuugagguguguuuaaaaaccuugauaaaugcuaagaaaaaaaauacacaguagauuuauaucacucugucuaguuccuuggcaaaggaaauaaaagggaaguuuuaaauaggugcaguggccugcugggacagugaagaugcugucucucugucagucuccaacaacucagugucuccuguuucucccuguggacaaaccaggauggauuuggauucuacguuuauaaauacuuguuaauuaacuucagcugcuccgcagcuucugcguguccugggaauauaggcaaauuuaauuuuuauuuuuacuaaagaucuuuuuguuauuuaaaaaaaaaagacgcuaacuuugccccagcacucauaaaucuguggcaggaagaugaagagucaacauaggaagaugguaucugaaaacaaaacaaaacaaaacaaaacaaccaaaaaggcucaaccacuccccacaaacuuaacagagcagaaaucugagggcuuugccaaaaucaaagauagccccuguccuuggagcugaccuugaguccuuccagaggcugggggggguggggggugggggcuguccuuccuuuccucuggaucuuuggccuccagcacagucaucugugaggccauuaucccugcuaauaacacugcugacaagauacuuacagcgcggaggaagcugccuguggcuuccggcagaauuuuucacauuuuuugaccgagagauaacauaacagcacagugggauuuaugagaauuucccugugggugaguaugugguaucaccuguuuaauccccaggagaaggcugugugugauaggguacgguauguauauuauaaaguaggccaccaugaugcaguguaucuggaugcccgagcccugcuccuguugccaggaaacagauacagcuaaaccaagaauucagaugaguugcucugaaugcaggcauaaagcaccacacucaaucccaaaccugccacacccgagugucggagccuacugaaugugcuagaugcuuccucguucauuuacagcuugccugccugccaucuuucuuucuggcaaagucuugauacggagcccagguuggugguacucaugagccuuugcuucagccucuagagugcugggauugcaggugugugccuccauccuugguucuguuuauaguucuuaaucuacuuguuccagcuuguguuccuacugugaguuuccuucaugaaaacucccugcucaccccugcagucuccaguaacagauuacuacuagcaggagaaagugcauagccuuauucuguaaggucacaugugugcuugucaagaaaaguauccagaggaucaaccgauguccuuugauacauuuauuuaaaugauuccagugacauugacugauauagcuugauaagaugauccuccaaauccuugugaucagcuuggcuaguugcaagugaucuaacuccaagauggcuuggaucuguuugcuucaugaaaugaaauaaccaacgggucauuucacuucccgagguggagcacaaaaaaaguaaaggaaaucagaagagguaaucagauaaaucccugugucucuaaaaauaacaccucgccacugaagaguggaagccugcggacaaauuacuuuucaaucugcuugaauacaauugaguccucugcggagaucucaccauugcacacgcgcaugucaaauccgcaggauaagaaugugauccacugaacccauaaaacccagcaugccuuuguacugaggagcacacagaugcccuuuggacaucagcagagaaagugguacacaguaguuucucauggaaaggugacguuuauuuuagauuuaugaguuugugugugaacaaagcacugaaaugaugcuuagcaacauuuucuggauguagaguuucgguuuauaaaaacugccagcuuaugccucucuguuuuuguacauucgucauuuacacgugcccucuuccaaucucccucuucagauuauauaaguagcauuacaaaggaauaccaugaccuccugcuuccgauggccauggccaccauuagagaaauuaaugaagugacaaauuugaaaucauaagacugugaagccacggaugaaugcaagauuuuuguuccuuuggauucugccagugacgauagccacaacucugauugcauacccaauucgcuuagcuaccuugggugcaccuaugucaaaugugugcuucuaauuaagccacuccaugugcaucugggccaccccuuucucuucaaauacucacaagcaguguccagggacuacuauauuaucaaguuaucauggaccaaccaauuaguaaagaaaccugcuacuaguuccuauggcaugaaauauaaaguacuuacacuuggcauucauuugaagacaucugauccuucuuccugccagucauuagccagguaaugaagaguuagcugcaucugcccucuagacgcucguguugcauauugaccuggaaagcuauaaggauggcaacucuuauguuauccaucaaucacuuuaauaaguacaagagagcaccuugucacccugccaaacacuauagcaauuaggaacgacucaguccucaguuaagaacaggaaagcuuacugaguuccaugccauacuguagcugagggcucuagaacagacuccaguuugcaggggaucuguguugauggagaaauggcaacagcagaguuucuccaucucccugaacucuguucccugggcaaaauagauggagccgccagaaccaaaagacagagguggauaggaagguguuuaauggauacagaguuccaguuuuacaagaugaaacgaauucugaagauugcucucacaacaacgugaguggauagauagaugcacguuagcucaugaggagucauguggugcuaaaagccauccacgaacuguaacuguagucacucacaaccuguuccaucauggcaucagagcacagugcgcucgaauuggccgcugcauccccuugugauggaggggcuggcugaucacugcggcucuuugauggcacccaaccucugagaaugucacacccucacagugccagccuggggaaaaacaaacccuccaaaucuucauguacagccucugcuguauguuaccacucuuguaccacggcaaccuuuuaggcacacagucugagccaucguaaguggguaccaacucugcugaccugugcacauaaauaggugagguggaguuggguggauggcucacguguagagcguuuuccuagcauauccucuccucaguggugggaaagaaagaagaguuaagaugcugauauugcugacauuucguguuguauguguuuuaccaaagcuuaaaaaaaaauuuaaggcacagaaccacuagauaccaaaacauuaggugacgaucugucccugaaaaaugccacagugcaagugaguuggaaccugugccacaaggcuuugggaagucagccgccaugaggaaggaaccagagcaaaggaaggccauaaugacagcucugacuacagaaacucucaacagaugcucaccgugaaacccacccuugaguagguaccggggacccaaggaaagugcuaaaggagcugcaguugcaggggccuuucaccuacaaagagcugccaugaagaguucaaaacugggcaggcgacacagagacaaugaaggcagauaaaggcugucgagggaaacaaaaccaggaagccacagacagaaagucaucacauuuuuaucacugaaaacauucaaaauggcacucugguguggaucugacauaaaaauaaacacugaguaagaucaaaaucaggucucauaccagaaagaauaagggggguaggggguggucaugguuugaauaugcuuggcccagggaguggcacuauuuggagguguggccuuguuggaguaggugucucacugugggcaugggcauaagaccuugacccuagcugccuggaagucaagucuuccacuagaggccuucagauguagaaacucucagcuccuccugcaacaugccugccuagaugcugcccugcuccccaccccaccccccugauaauacugaacugaaccccugaaccuguaaaacaccccaauuaaauguuguuuauaagaccugccuugaucaugcugucuguucacagcaguaaaacucuaagacacggugcagcucaguuguggggcacgugccuagugugugggugacccugguuuuaauccucagcacugggggggaggggggagaguggcaugugaaagggccaaccaacaccaucucuaaaagcauaucuaaaaaaugugucuacaaacauaaaaucuauaguuuuuugucuuauaauaauaauaauaauaaagacuguugaaaguaagaauuagaacucaguauuggagugaauggcuaauaauuagaaauaagugacauauuucugaaauagaagcaaaguccaaagaaaggcaagagcaagcaauagaagaaccuugagagcagcgggaggggcaguggguaggagcaguugcugugcaagcauaaagaccugaguaugagccccuagcaacagugugaaaaagccagguguagccacauauuccugugacacuggcacugggggaaggagggagagacagacagaugccaggaguucagccuagaugcugccguguuccugccuugaugauaauggacugaaccucugaaccuguaagucagccccaauuaaauguugaguugccuuggucaugguugucuggucauggugucuguucacagaaguaaaacccuaacuaagacagaacuauagaggaggaugccuaacacacucuucuugucucuguagguucauaacacacacauacuauaucuauauaucagacuauauauauaucagacauacacacacgcauauauaugcauauguauguauggauauaugugcauauauauauauauauauacauauauauauaucagagcuggggaauauguguguguauauauauuguguguguacaucuguaaaacuuaaaucuaagaaaauuaacaaaaacuauaaacagugaggaaaggaagagcagccacagcuggccaggcaaacacacgaagauccacuagaccucacacagaguccccacacgcaauuaaaagaacaaucaucaguagcauugccccuucagguugccccacuuuugcaaaacucucaacucucacuaccgggaaaugugugagaaagugagcauucucucgauauugcuagggcugugaauugcccaaguaaucuaggaauaccuguuuaauuuaaaaguccacauguccucugagccagcagucucaguacuggggacccaucacgcagacacaagaacagcaggauaaacauauaagaacagguauggacucacucauaguucauaugcagaagaaaaaccuuccaggcuucucuuaaguauauccaugcaguggaacguuguacagcuacagaauacagugaaguuccuacuuuacuagcaaagaucgagcuuugauacauuguuuagggaaaaggguagaccugcgggguaauaugacugacuuuuuuuuucauuuuaaaaauggaaauggaaaacuauauacaaugaauauagguuacuggggguggguuaucauaggauuaaagaggacccuuuacugucuuuucucgugcuugccuauuguuugaauuggcauccuaagcauguauuguuacaucuuuuaauaccaaugaaaugauuugagaaggauacuguaucauugguuuuggaauguaaacacugcuauacaucuaagggaauuuucucucccuuuuaaagauuuuuuuaaaauuuuuuuuuaauuuaaagaaagauguuuaguuguaaguugggggaggggguguauaugccgaugcaugcauguguggaaggcagaggacaacuuuauggagucaauucucucccauauuuaugugaguuccagggaucaaauucaggcugccggguuugugccgcaagccccucaacuugcugagccauuuugacagccuucuuuuaauuagcaaaaagcaaaauucaaauuggaguuagacucaaagaucagucuaagggagcccacacagggcaucucuccugggucuaugagaccaucccagaucacagcccaggaccaguggugaugugaaaagaaaaauuauaaggcauccuuaggaacucgggggcggggugggguggggggugggacucucaggaaggaaggcugacucucagaagggcuuucuuacuggaacugaguccucaagucacugagugcuucuuuuuccuuccguuucacauggagaaacaaagaaucagagaggauccaaggucccaaaaguacuucuuccaacauggcuucguccuucccuuuaaucgguuaaaaacagagggcccccucgguucaauccacaacagcacaaggccaacaggauguggugggaacuggagccaagucccacucagcuugccuaugcacauauccucuccucucacuuugcucuaccucuguccgacacacaccagugccacuggcccaguuggccuaguaugcauugccuuuuaccugugcauccaaaaaucugucgggugcuaauuacuuacauaaaauaccuagugugaucgaaucuaucaaugucaaaggaccagggaggcaaaaugguuugauuauaagcccaaaguagaaacaguugugagccaccauuaaaaacucugcaaguuccuuuauuuguguugaaaaccuagaaucacuaguucuuuucucccuuuacgaauagaggauacuagcauuuuguuuuuaaaaaucagucuucuagagcgagugagauagcucagcugguaaaggcuugcuaccaagccuugcagccugaguuuaagccugaguuaaacaugaaggaagaagagaaccaacuccuggaaguugucuucuauuuccacacgcaugcggugacacacaugugccugugcauacaugcaugcauauuuaagcacacaauaaauaaauaaauaaauaaacuaauacauaaauaaguaugcaaacaucagggucccauagauccaagagcuguuauggcucaugugugaaauguccacuugggcuguuuaagcaccuacuggucgguacugguuuggauggcuguggaaucuuuaggauagggggcauagcuagaaggaaaaaacugggaaaagacuuugaagguuauaaccugccaccuucgcaacccacacacucucccuuucuaaccugcugacauugcagggcagcaagccguguuccaaacucucacgaccauagaggagucucuccggcuugcccaccuuccucccuuuuacguugccucugggaagcauuuguggcaauagugagaaagguaaccaaaacccuuggcucuaccaggaauccuaagaucauauugcagccucugcuugcauuuaggcucggugagagucccugggcagugguuaccgcuuccaucaccaaauguuuuugugcucagggucuaggcauuacugucccgaucggagggucacaccacacacggaguaggaugugacuaauaagaaaugugacuuuacugcaagucuagacagcuucugauaaauguuuaaaacgaggucaggaauguuuuccuuuguggggggggggggggaaauauguguuccaugguguaagugggaggaguggaacaggagagaucuaaaugcuaguucccucccacauaauuucucagcaugucagcagcagucaaguucaacugcccaucccugcacccucacccucacccccaccgcaccucaccuccaccccccaggcuuuaggacauagcugggucuaagccaggagagaagaggaauacacgugugacauauggguaauuccaaaaugacgaccaggcaaguuuaaccuugacagcauugaaggcagcuuccacccuguagccaacaauguucuagaaaguauccaccaaggcccacuuuaaauacccauugggauucuuacuuccuguacugacaaaagggggaagccccguagaggaagcggguguugacuccuggaagagaaaacacccaaguagacuauauggcaucucuuggcauucuucauagaccgguagauuccagaagcaccaaacaagggcaugacgaggggcugaagaauaugggguugacacugccauccccuggacagggaagggaugcagcagauaauucuguaaggaaaagcauauuaucggcagguccuauccacuccugucuuucaaaaaaaguguuucagcacuuuucuuaccaucuucucgaacuucccaguccaguguauguuguagggaaauggugugggugagaccagagcuuccccuggucaguuauaaauagaaugugaacauuucacagaggaagcucccucuaaacggcuggacagggguggggcugggagauaaguuuuugcuauaaacuuuaguaugguggcuucagugguuucagcugucacccauaucccagagugcacagggcuaggccagguagaaggauggacauggaggaugugggguaaagauuucaucuuaucuccauccucauauccacauccccauuucaugcacuguguuacucaaucuccugucaccauagcaacaccugugcuaaugugaucacuggcaggaaagaccacuuuccuucguaguuugugagguuuccauccacgauuuguugacucugaugcuugggagccuauggugaggcaucguggcuggggauaugagguagagaaaaacuguuuaccucaugacuaggaauuggggguuagggauauaaaccaggagcuaaagggacagauggcucagugguuaagaggggcuuucuguucucacagaguuuuggacagcuguaaccaucugugacucaaguuucggagggggaaucugauguucuucucugcugcaaggguuucugcauacacacgguguguguaaacucacacaagcacacacacauauuaaaaaaaaauaaauauuuuuucuagaaaaaaaaaaggugaaaacaaauugucuugugucucaucauacccuuaacucaacacucccagugacccaaagaauuccagcuaagcuccaccuuaaaggguuccacggucuccaaaagaaaccugaccugggaccacauacauauuuaacauaugggcuuugaggggacccucaauaucuaacugcagcagcaccccucacuuuugcuguuggcauacagaauauuuugaaaacuuggucaucaggacuacaacccuggaaggucaguguuucuucccguuguacaggggaagaaaucgaguugaugguucuuucguucucguagcuaggaauuaguucagaugcccaccaagcccuuggucagcugugaggggaugagaaagcuaugucaaagagccauugcucagaaagcaaugggcaucuugauaagaugcagguucuagaggcaaagcuauucuggaauccuggcccuggugcugaaguucugugagucuguggcuguugcuuaaccagagcccuugccuguaaauacaccuauuagguucucgugggcauccacagaggugugugugcaagagcaugaacuaacgccugccauaucguaaauuuauuacauggugcuggggacgguauuauucacagcagugguaaguuuuauuguucacuuacuauuagugaggaaaaucguggucacagaaaaagcaugucaguaccagaguccccacugagcagaagccaccuggaaagaucacauagaacuucgccuucuggcugucuucccguuaacucuguuuugguuuuuauauuaauauuuccuuaguggagaaagagggcaaaucucuucucuuuguauguauuuucuguugcgcuucggaagacuggggauucaguacaaaauugaucugcagucugucccagugcuggcuccagccucccagugccauggugcuuacucugucaauuauuugacuuucugaagugugccuacccugaagaaccucugcuacggaggacuguguuaauguguaacaccgagauaagcaaagcaccgcucuuuuuauuguccuguuuuuuuuccaugcccguucaguuggaaaaccgaaaaugguucuguuugcaucucaucaagcuccguugaaagacgggggagaaaggguuuuugcuaaugaugagcaugggaaguuuuaacaacacaggccacaaugaaucaccugcaguuuguuuuuccuuuuuuuucaauccaucgcacaaaccagcuuagagaggugaugguauugaacaagcaucaaagaagagcugaguagcuggguguuggguuuuguagauggaaggugugcaccucaguuuaaaagaccucaaggucaguuucuucucccaaguggaaggcagcaauggaaacccacauuuaggaugcacucgcaaacaugagcgucuucgguagaaagcuuuccguugguccacaagcaucugugacuccaugggcaggagccagcucuacuuguggguagguuucccaggucaauagggggagggagguagauggcauaacugguccucugcacagugugacuggaacuuuccauugcuaggggaaacucccagcuaccauccaagugcauuucugaaaugcuugacugugucaggggcccugcaggauguggguuagccagcccucccuggacaaggucaauguucaaagcaaagcucaaaggaaugugguauuguuggcuuaauaaaaaaaaauccuugagugcaaaacacguauuuauaucacuggcucaucaaaggugccuuguaaaaggugaggaagagauaucaauaauucagaaugaaguuccuagaauuuagaacugucuugaagacugggggcaggaaauggaucuuuugucaugguuucuguggaccucaaagucuguuugcauguugguuagugcagaggcagagcuuuugacuauuuaggaaguguuacaacauagugguuagaagccuggguuccaagagccuguuaccuaauuuuaauuauuguugcccuuguuguucuuacuguuaagacagaaucccauaaaucccaggcuggcuuugaacucuuuuauguagccaaggauaaucugagcugcugacccuccugccuuuaucuaagagcugggauuacagaccggugcuggcuugccuuggaacaaggcauuuguuccccuuagcaucucaucuuccguuaccaaggcaugaagcuucuguauagaauucacccucaggcugguuccagagucagugucagguguguuaccuguguacuuaccaugaagucccuccaccaagaaagggcugcuuaaauguguuccguggccucauaaggcauauuacauuacgacugugugucuuauucugccuuguuuccucuguuuaaaucuaaaaugacucugggaaguggugguucaugucuuuaaucccagcacucaggaagcacagacagguggaucccugaguucaaggccaaccuggucuacagagugaguucuagcacagccagggcuacacagagaaacccugucucacaaaaaaacaaacaaaaauaaaaaauaaaaauuaaucuagaguggcaugguuagaagauuauuugaguucuguugaucuuaaauaaaucauuucauggggcuggagagaugguucagagguuaagagcaccagcugcucuuccagagguccugaguucaauugccagcaaccauaugguggcucacaaccaucuguaaugggaucugaugcccucuucuagugugucugaagauagcuaguacaguguagucauacaaauaaaauaaauaaaucuuuuuaaaaaaucauuucagauacuagugaaaaugaccuuaaaauaucaaguaauaacuccuuuuugguaucaacccaucuuugauuggauuuuucaugagauuaugaauaaaguuuuugaaguuguuuucaucugagaaaaguaaaaauuaagacuucaucccuaagagaggaucugcaucucugcccugguuacuugucuucuugcugugaccaguuacaugacaggaagggauugaagggaucaggggauuuaucucagccugcagcuuugaggggggauagaggcuaucaagguggggucacauggaggcagacacaugagcuggcuugucccucugcagccaacaggaaagaugaagcagguaaggaucaggguggggcuauaaaaacccaaggccuacccaugucaaccccccuuccagagagguuucauccccuaaaggucccacagccuucccaaacagcagcaccagcugcuagaagacacaagcccucaaggggugugucauguucauauugaaacagcaucauuucagguauauaagguacuucgcacacgucucccccaggugccuugccugaagcuaaacaccugugcugcuuccguuguacuugucauccucuagccugccguuuccggucuucgccucauucuuuguucauuuguaaccucugcugcggacaaccacuguaaccucugcugacaaccuugaucucccaguucuucuacuucaguccugggaucacaggcaugugcaaccucacucugccuagucuugcacaggacaggagcuauaagaccagacauaucaguguagaacagauagaggcuagccauguugacauggaccaagauggcaggagucuuuguucagccucacugauaucagggaauaaagauggagugacggguaugggccaaggaaagaacuugcaaagcucuuucagaguaguucaagucucuguguaucuacugcuguuacaacgcaucaaaaccagggcaaggcauaagaaacuaaugaauuugaggcucacugcuccaggggauuagcguccaugagcagcaugguugugggaaucauggcagcagacaggcauggcgcuggaacaguagcugagagcucaugucuggcucuacaagcacagagcagagagagccaacuaggaauggcauguggguuugaaaccugaaagccugccucuaacgagaccacgccuacuaauucuucccaagccauucuaccaacuagggaccaagcauucaaauguaugagucuacggggugggggaggggauguucucauucaaaugccacagaaaccuucacuauauaaacaaagagaucugugguauauacugaggaguuuuguuccuccaaauuuuguaugccaagucuugguuuuuuugugguguuugcaggugaagauuuggggaggugauuaauuauaagagcagagccuucagggaugggauuaauauccaugucaugccauaugaggcuacagcaggaggauggccaucugcaucagagguaaagcucuugccaguaagucagccauuuccugcacagugaccuuguaccucugagccuccagaacucuggcaaacuucuucuguguaguugauggcauagaugccaaggcuaacuaaagcaagaccuuuggccgaagauuuucaugugccauuccuaaguaguccgguaggacgucuggaaauggaauuccaucugugugggaacaagcccauuuggacgauccauuacagauacacacaggugugugggacgagcaacaguuaagucagcugugggaauccgagggcuccuuuaucguccccucauuacugucauguccacccacuauaucagaugugggcaugguuuggacuuuuuuuguuuuuccauucaucaaauguccguuaacuucuucagcugccauacugaccucuccacucccuuagaggcauuuguuugcuguugggcuuuuuuuuuuuuuuuuuuuuuaauguauuugcuucacggaagccuugugcucuuuuuaagguuuuaugguuagcaugcagaaaucucauuagauacgcacuuuaacauaauacuuggcaacuaggcaucugaccguguuuuaguucauuagucuggaaaaccuccgcaggcuuggaggaccaggcuuucugcuguggaugggggggcuuugaucaugccugcaggguucaggguuuacuuuaaagcguguuaggggaggagaagcagguauccuaaacuuuuugcaaaauaaaaauaacccugacugagaaacuugggguucugugauucugugguuaucauccccaucuuuugaagacagagcucauguuaacacacggucuccugcgccgggcaggagguuaguuaaacagccucuaccagaucacagaccccguucugaugauccuaaugagguuggacuccucaaagccauguucaucucacuguggauaaauggauucaagucuuauccaugggccuuuaacuugcaacuuugaauuugcaaacucucaaauuccuucaacgccgcgguguacagagaaggcuaugaauagcaggauugcuuauuuuuaaaggaagaugucugcgggcaaagcaccgggcuuugaaacgugauuagucaagcauccggucagcucgauguuccccacugaacauuguuucccauugcguuccaaucagauucaaugucugucacacaaaacgugacacgacucugaagacgccugcacuugagcuagauaauggucuguuguuuuaauagaugugauaucaaauuaaauauaauucaaaauguugaagcaugaugguauuugggugcugguaaguggguuucguguaaauaucuccccaccaugaaaucuguuuguuugguuaauuggucguuugguugguuggcuuuuuuuuuuuuaaguugaaauauuccaaaauaaguaagcugcugaaaaggaguuuauagcacugagugugagguauaugacacaccccuaguuccagcacaugggagguugaagcugucagaucuugaguucaaagacagccugggcuaccaggugaagccuucucugaaugaggggcugggauaugcacgcuuguuugaaugguaaaaaaagaacuaagcccagggcugagcugggcaagggugacgucagucccuggugaugggcuguguguuccacgccggggagaggaccaggucuggagugcagugcggcuugccuagaugagaaacagagcccacaugugcuuuccccacacucucagagggagcagagaggauggaaggagggugacuuaauccgcuuucuguugcuaauagcacauuacuaccaagcaguaaguuauaaagaaaacagaucuguuuucgcucgugguuauggagcaaggucaagggaccacauuuaauggugaccuucuggccggccacgucccaaaguggcacuacgcaucgcauggagagguaugugagccaccagagaucuagccagccuggcuuuuauagcugacccgcuuaaaauaacccauuaacccacuaauccauagggcaugaaugggucagaccacucgugggggcaaaacucaaauugcuucauagaggucccagcccuucucacuuaguaacucaaaauggggauugaacuucagcuugagcuuuggagagaacaaaccauauuucagugaagcagaggcgagaauaauacaccggguuugcucuggacuagaagugcaguuuacaaagagguaaacaggaugauaaaaagguaaaaaccuguuccauacuaaccaucacaagcaaaauuuugaaaaucauuguggcccccugaaaucuacuguagggugaccagagccaaccuuucuacugaguugaacacagagcuuaugggccagggacauaauggcucagcacguggguuugagagccccaacccacacaggggaccacccaggggaaacaugaagaguccagcuucccuugcacaguguugagggggccagaguugcuuaaucuaagccuacaguggucaagcaaacuuucauuagcacagaugggguagacaugcaagcugggguggaaggcucugcuugauggaccagccugcucuccugacacagauaggaugcucuugauggaugaauggucaccauagcagcaaggaguaaaggguugggucagaaucagcuucccaaaggccacaucaggaagaguguucuuugcaaaaguuaguguuguaugcuccccaaguaugguaaaacacauacacacacacacacacacacacacacacacacacacauaugugaagagaauccaucuucaaugagcuggccccgugguagcuuucuugaaauggaagaguagugucuucaacucuccaucaccagauugaugacauuugucuuucaagguuaauccucccucccucauauauguguguguguguuuuucauugaaccuagaggaaaggcugucugucacuuuggaccaaaauauucucuugcuauuccuuaaacugauguacauucagauguagagcacgugcucacagguccugggggcuuuaucaacaugagguacaagguguauucagagcagaagaccuaucaagaguuguaaaaugacccgaguugggagaauccaucuucaaugagcuggccccgugguagcuuucuugaaauggaagaguaguaucuucaacucuccaucaccagauugauggcauuugucuuucaagguuaauccucccucccucaugcacacuaugcaagcacuuuaccauuauagcacacccccacauacacuccccccaccccgcccacacuccuggccagauggaaaaauaccugauggucccaugagucagugcucacccccgguucccccaacuggugagcugacuuauacauucuaaacagaaaacagaaguuuucuuacguaagugcuugguuuuuuauuuuacauguuugacuugaaaagcauuaugguucaagccugcacugggaagguagccuggggcacccaucaugucuagccagaggaaaauguagaagagugauuuggaacacaugucuccuacaauuaauauuuuuuuaaugguuugcacuuauuucuguccccaaagagauuugcuaaaugcuaucuucagcgggaaaaugugcuuucuccgauuuguuagacggaguggaagugcacagauaaacagaaucuguuaugcuaaugaacaaucugacuuuuaaaucuuuuuuauuauuauuauuauuucuugauuagauggaggaggcaaugguagaaucaucaaauguagcaugaguccuuuuuuuuuaaauuuaagccagccucuuuaugaaaccucgugugucucugugugucuacacacacacgcacacacacacacacacacacagaaagagagagagagaaaugucuauacacacacacacauauauacacauacauauggagaccagugucuauacacucacacauauacauacacauauacagaugagugucuauacacacacacauauacagccacauauggaggccagugucuauauacacacucauauacauacacacauauggaggccggagauugauauaggaugucuuccucuguugcucacgaccauaaucaccccugaaacagggucucucauuaaaccuugagcucccugauugacuaaacugucuggcuaguaaggcccuugguuuguuuugucucuaccaccccaggauuggcaucacagacacaugcauccacaccuagcuuugugugugggugcugagaaaccucaaccucagguccuuauguucauacagcaggccaacacucuccccagaacuacuucccugaaaauacuuucuaugagaguccagucagcuuuuugagagagaccauggcauaaugucguaaagucccuguagacaagcugcugugagcuggugucagagcacugcugcuaaguaucuccugaugggcuuuguugugagggacuguaaacagccuagaaauaagaaaucuuaauacagaugucccucagcccccacaggaaucagaauaucaaugcgaaagaugcucagggcgcuuuuauaaaaugguauuauuuauacaucccugcaguuuauaucaucuauaguuuacuuacccuaucaugaucuaaauuguacaaagaguagguauacuauaugguuugagauucaaagucaacaagcauaagccagaugugguggggucugcccacgaccccagccaacauccaggagucagaugcaagaucauugaaaguucaaggacaucuugucuacaagaucuaguuucaggccagucagagcuguauagaaaaaccuugucuugaacaaaaacaaaaugauucuauacauauucagacaugguaucguguaacagauuaaucccacuauuccuuaaaguacaaauacaagacuagcaagacaccaaugccccuuccauuucugugggcugcuuaaacuuauggaugcucaugaccaaggcuugugcuuugugaauccugggcaguauguuucagcucuuucuuuuuuucuuuuuuaagauuuauuuauuccauucaugugaguacacugucgcugucuucagacacaccagaagagggcaugggauccccauuacagaugguugugagccaccaugugguugacugggaauugaacucaggaccucuggaagaacagucagugcucuuaaccacugagccaucucucaugcccccuucaguucuuuuuaauauaaugaauuauauaacuuaaagcauuguggaaugaagaguacaaacaugucaagaacauccuagaaauguauaucauuaugaucagugcacacagcucguuggagcuagaccaucauagucacaaaaugcuaacugcccaucuguggggaccucaugauaaugugugauaggcauaaucuccuuuuuguguugcucuugauuuuauggugagucuggaggagaacuuuaugaucaaaaaacaaaagaaaaaaaucuccauuauuccuaaagagauuacaguuauuaauuaagggagacagaccuccagcugugguggggaaaguucaaagauguauuaguuauuuacuacuacauaacaaauuaguucaaacuuuagaagccuaaaacaacaauaaauauucauuaucucaggcuuuuccucccggugggccuaaacuuuggaauagcucagcuucaccguccuggcagugguugucuaaugaaauggucaaaaugucagccagggagcuagagaguuggcugagucagugcagagccugccacacagccugaguuuggauccacacugcucucccguggcagcuaggaucccagagccaggaggggaggggaagagacaagcagauuccuaaagccccuggggcagucagucuagccuuucgaagagcuguaagcucacugguagacucuaccucaaaaugcaauggaauaauaccaagggauauaccuaaaaucauucucuggcauccauacauguggcuccccugcaugcacauauacuugcaccuucacauguaugcacaccauacauacacauacacauacauauacauacauacauacauacauacauacauacauacauacauagagagauugauugauuagcugacugauugguugauuuauugauuucagccuaagucuuggauugcuggcauggugcugucgugaguacuuagucccuugccaaauagacuucucacuugucauuccuaagaauugguacaggguggcagccuccuccuggaucaugggaucccacauaaagcaacagggaagcugcagcaccauuuaugaccuagucucagaagucacacaucgccacucacacacauucuguucaagugagucacuagaauaaguccccauagucaaggggaacagaaauagauucuaccuaaaaaggaagucaguugacaaucagaugggaaaccaacacggcagaugggacaaaugggacuugggucagaugcuguagugguacuggggaagaaaguucacagagugucaacacaaacucacaucugugucagugcaggggcugauggagucauagcaggaaaccaggcuaacaacugacuuucuaacacucgagagcuauuaaccaagacacuggagcagagagagaaaucaagaagggauuuaccauggccccuucuaagcauuuacacacacacacacacacacacacugaaauaaguaugcccaaaaaaugugagcagucuuacauucuucauauaucuaucacaagagccaaauuauggaaacagucucaguuuuaaucagcagauaaaagaggcuuuguuuaaaaaaaaaaaaagguauauaugcacaagggaauaguauucaaguuuuaaagggaagggaaauuucuauuuuuaacagcauguauagaauuauagaccacaguggagaguggaauaagccaagcccagaaaaauguggcauguucucaguucuauguaggauccaaaaccaucaaaaccaaagaagcagagugcaaagaauaguggaaccuguggccagguggggaugcuguggaaagggaugaaggaggcucaagggcacagaagcucaauuaaacaggagugauuuguuuuagcaaacugugcaauguggcggauauagcaaacaaauaauaguguauuguauacuucaccacuaggaagagacuagacuucaaauguccucaccacacuagguagguagguagguagguagguagguagguagguagguagguagguagguagauagauagguagauagauagauagauagauagauagauagauagauagauagauagauagauagauagauagauagaugauagagaugauggauggauagagauacaugauagauagauagauagauagauagauggauagauagauagauagauagauagauagauagauagauagauagauaggugauagagaugauggauagagagauacaugauauguagauagauagauagauagaugauagauagauagauagauagauagauagauagauagauagauagauaguagauagacagacugaugggauaagaauuugaagugauaaaaauacucauuggcuuggcuugguuuuacucauaaauuauaauaucacauuuaucccguaaguacauacagcuauaauuugucaaguugcaguuaaagcaugcacccacaggaaggaaggaaaucauucaaagauaugucagagauuuccugcacccaggaguuagccagagaggagcgacguugaaggaguggcauugaccggugagagccaggccucuaaaagugaucuuucccaggcagaucuucacuugcaguugcugaacacccuuucccaauggaaccauuaccaacucuguggggagcugcucagaauccagcugcacgcuucuggcacggggaggaggcugaccucuugguacaucuaucuccggauggaccugccaauuagaaaaugcuugccugguggcacuccaggacucuacaauaaagagugagccucauccuuguuguggggucaguccagggauggugugaagauuguucucaacugccuaccuuacuggauuagaaaacaccugagagagccgggcgugguggcgcacgccuuuaaucccagcacucgggaggcagaggcaggcggauuucugaguucgaggccagccuggucuacagagugaguuccaggacagccagggcuacacagagaaacccugucucgaaaaaccgaaagaaagagagaaagaaagagagaaagaaagaaagaaagagagaaagaaagagagaaagaaagagagagagagagaaagagagaaagaaagagagaaagacagacagacagacagaccugggagguugauaaagcauguuugcagcuccaucugggcauuuccagaaaccauuagaucaugcaagcgguggcccaaucagggcuaaucccuugauagaguucuaagaugacagcauugcuagaaggugauucaucuucgggggccuuuggaggaaguagcuuaaugagauggaaucuuccccaggccacugucuuuauguccuuuccucuacuuacuguucaccaagaagccuccaucaugugaccccguuaccauggugaucugcuugcaaccaaggggcggagcaaccacgggcugcacaauaugccaacauaaacccuuccucccuuaaauuguccucucuaguauuuuuggucucgggaugaggagaguuaacuguguucucuccagagccucuuucccaagcuuccucaacuacccuucucaccgcaguuuccucaacugcccuucucaccgcaguuuccucaacugcccuucucaccgcaguaaacugaguuaucuugcugggggaucccuguccuugaacccaucaccugcuuuccagcucucuugccagagaacacaggaagauauguuuugcuuagugugcguuuuuuggaaagcuuuuccucuuuguuuuuucuaucucagacacaugugggcaagccagcaacuggaaacgggacugagacaagcccggaaguaugggcugaggucacuugggaaguuucuacucaggacuguuugugauguucucgaauuccagagcaggcugcacuuuuccaacccgaagcucaggagaauuggggaaaucacucacccagacccucaguuaucuuauuuguccguguuucauccaugcaaacuggaauucuuuccaagcugagucuggcagcugaccauccgccuaggagcacagggugggaugcuucauggcuauccccagcacauuucugcucucccagucgcuaugcugucuggacggccucagaguaaagauaggugagguuccugcgggguuguuaaucaaaucaaggagacgaguucauauagcccacugguuccuuuucuccaucaucuucagaugagcuuaggcaaaugugugagccuuugacccucaucuggccaaagaagguuugggcaggauggaguugagggccccuccaaaucuaaaguucauugacuucaugguacuuucuuacugagauuuauuuauuuugcguauaugagugucucacucagauguauaucugggcaccauguguguuccuguuguuggcaguggucagacgaggucaccagacccccuagagccgaggaugauugugaccugccauauggguugaacccaggugaccucuaauguucacaucuuacauguugacuaaaauaggaacaaucugcuauagagcaagucuuuagcuuugucuucuggguuguaucuaaacuuuuaaaaugagauugcuacuuuuuuuuuucugcaaacaacaaacacuuuuaauugcugaccuaucucucccgcccugacaccauggcaauuuaaagaacaugaagacaaagcuuaguguaugggugagugauauuguguuuuccuugcaugcauguagcccuggguucaaucuccagcccaguuaaaaacagaucaacagcuaggcacggcggugcaugcguuuaaucccagcacucaggaggcagacgcagguggaucucugaggucagccuggucuaacacagugaguuugaggacagccagggcuacagagagaaacccuguuugaaaagccaacacaaacaagugaaaauuaaaguauaaacaggaaauugcugcuuucccacgagcagagaaucuuucuuucuuucaucaccuacuccaccagcaaggccugcuccuuuagagcaagcuucccccguguuagaucauccacagaggagucucugguguugggagccugaaguagacgggcuucgcuuaaaaauccuaguacuugggaggcagaggcagguggauuucugaguucaagaccagccuggucuacauagugaguuccaggauggucacagcuauucagagaaacccugucucaaaaaaacuugcugucuuguugacagcuuuguauaacuugucuugccaguuguauccccaaauccaucuuuuccagaugugcacuucugcacuuuauucagucgaugcuccagacuccuuucuagucuccacuaccagaccgacuaaccagugaccuccaauguucacaucuuacauguugacuaaaauaggaacaaucugcuauagagcaagucuuuagcuuugucuucuggguuguaucuaaacuuuuaaaaugagauugcuacuuuuuuuucuuuuuuuuucuuucuuuuuuuuuuuuuuuugagauugcuacuuuucuaaaacacauguuuuuuccuuaauggaugaccuguuaguauaagcauaaaaacaaagauucagcaguucuaaccauuucagggcucuccuugagagcugacucagcagcccgggaagggcaagccccaacauucacauauuguaccuacaaacaguugaggaccaguucauaaguaggucacaauuaaucaaaaucucugcacuugaaacucucccaaaugcuaaaacaugccggugcagaaacuacagaauaucauaguggccgcuagcugguuuuauauaaccuggagcccuacaaggucguuuuuaauaaggaacagccaggaaaaccugcuucuuggagugacuccugaacucauacuguuuaaaccuuccaugaacuaagccaagugcgcauucugguagaagcugcuuuucugaugcucagggguuuggugguuaucccuggugugcagggaugagacucaggaagaaacuagagagaacaaauugccugugccaccagcacuggggcuccaaucuagugggaggacaggaaggaggccccgguucugagcaagguugguauagaaacgcaaaguggaagcgucgagggagauaacgguuuuggugucaaacaaaaaucaaggcgaaacugaaaggguauguagaaauuaaccuuggaaaaaggaggugaauguucuagaaaaagacuggaaugugcaaaauucaggggcugggaagagcaagacauguguaagaaaccaggggaguucgcuguggcugagcucauagugggggacgggcgugacaaggcaggaggucaggaggguccucgggaucagaucagacugaucugcacuuuguagguaaauaaguaguucaggagaacagaacugccccuuuccuaguggucagacaggugacaguguaagccagacagcuauaccaaaaacauucuugcuuguuucguuuuuuuuuuuuuuugcuuuuuugagaccaaauuggccaccaacucaugaccuuucugcuuuagccuccuggagugcuguggcuacaagcauguacgaccacacacagucgaauguuuuuacaucuacuguagaggagccccagacagucugucuguauuacaguugccuguacacuugucuauccaugcuuccuggauuucaguccuagguagaagccaacacccuccuaccccguugugucaacacaccacuugguucauggcagacccagauggacucuucgccucccacauagauuuaauugccuaagaccacacaguacugaaauuugauuuacucagugugcuaaccagacuuuuuauuugcugugacaaacaccuaagagacacaguuuaaagaagaaaaacuuguuugggcucugauaucaaucuuucguuagcugguuccuuguuucugggccauggugaggcagugcaucgugcagaaagggcacuguagagggaaucugucccccauauaguggccagaaagcucccuuuaucuuuuauccuuuguggaguauucuuggguuuucuucuaguuuccuaauagaacuuaucauuccuucuauaggaaggagccaggguuaagacauguuucaaccaggucccaauaacgucuccuucuucuaauauacaccaccuacagaccuucaccuaugaaccugaggggauggcuguccccaaaccauagcacauggcacucccuccacugucacaucauuuucuauagaugucucccucucucucccuccucccucccccccucucugcauuccuuaacucccuguguuucugucucucugugcucugugugugugugucugugugugugugugugucugugugugugugugucugugugugugugugugugugugugugugugugugugugugugugugucugcugucucuaugucucuaucuccaggguuuacucuguaacucuggcugaucuggaacuugcuacauaaaccaggcuccccuccaauuccaagauucaccuacacguaaagcugugaucaauaucaucuugauacuuaaagcuggccagcuuaccugaacucacagaucuaucuguucuuuguccccgugccccgagauuccuaaaaggaccacauaucuuacugaagagauucccugagaauguacccaagagaacugaagcuacaacuucaagaguuuggagaauauuugaauccccuguguuuauaacagaguuuccccuuaucuguguggcuguucuaaaaaaaaggagaaagacacgugaaaucccucugucuaaugaggaaauuauuuuacuuaaacaaagcaaaaaugcuccaagguuaaugaugguguuugcuguagcaggaaacccugcagagaaagggccggccgccaagaggaaccucaggcacaccuggcauuugggcuaauuugcauuuuguuguucccgguccuucuaaaaguacagcauccagcuaggccuggugaugcaggccuguaagcucacacacucucuggaggcugagacaagaagauugaagguuuaggaccgcccugggcuacaaacuaaauucaaggcgcucggaaaaacuuuuuccucauugugacaaaacacauaaggagaugacaguggcgcacaagacaagugcacagcagcauucuucauuuguccccaagaccuauccaagaagaguuagccucaaaagaaaaacaaaacuuucucuuccaaguuaagccucagaaacaacaguagaaaauacagaacgcggaagaagaaaugcuaaaucccgcuaggaaacugggagaaaagcccagaacacuucagcaaagaguagaaaacaagggugacuuggggcggauaacugagagcuucugggucuguggucaugacagaacgacgacacagaaaguaaccagagggcauggggcugggguggaaaaccacagagaacagggagggcucaguuaugcgcggcugauucaugucugggguugucugccaagcaguuguaagcauggagguccuagcugagacagaggcuaaggccugccggguaaaaccaucagccagugcaguggcugaacgccgguuuagcaagggcuguaaaccaccgugcccccaggagccugaccccccucugcagcacaccuugcuccuuucaaagccagaagguguccuggcaggccaccugacaaggaaggaacagagaggggagcggggauaccaugaguaacacccauauacucgcaagggagaaaccccaucuagagauggaauccagagugggagucaagagagcagcaguggggcagagugggauagccagagaaccagugacucuaacucacaaaacuagaaaaagaaaaaauggucaagaaggagacucagaaauaucagugaguucacugcuuguaauaaggaggggcagugagccacuguccgcugugccuggacagguuaaauaaaccagccagaaagggccuuggggcuguggccaaguuuccauaccauugacacagagcuggcucccugagguauccccaucaccccagggacuacuuagugguacuaaguacuaagugguacuuagugcuucuugcccaaagcugcagcaaggaccauucuuacucucagucaucccuucccuccucccuuccaucuuccuaccugucuuccucuccaguuacugccugcccugcccucaauuacaaucuuccagggucagaaccaacgagaacggggcauguggccuaaguucccauguauucuggaugccuggaagagaguccaaugugcaacugaauugucgcccacuggugaagauacagugggauguuuaugguuggagcuuccccugugggcccuuccagaggccacacaaacucugcuaacagauucuauugcacacuccaacucugagggcugcuucuagagcuguuagccuguaagcuuaggaacccacggguguuccuaaaguacagaucucucuccuggcugauccaauccucagaaugccaaaaaccuucauccuuuccugaaggcccauuguucucagcucugugagauuccuguaaauucagacuuugcccuucuucagucuuugaaaaucuuccagccacuuaaacaguucaaccugaugaugcugagagcccucugggaggcccguacguauuuccccccagggaggacaucuauuuguaaccagccugcagccuuuauugggcagagcagagccuguucugaaaugggcaagccuccagagcagagaguucccccuccacagcgggaugaggaaguccguccaggugccagaggguucccggaugccugcggauguucauuuggagaauggggcugccauagacuuguggauguggaguucugggagcucccuagcuagcuagccuuuagacauccgagaauugggaaggacugucugccuggcuuggccuuccuguggaaauuuccccuaagcaguucugugcuugcggaauaggaaaaaaugauaucuuagcaccuuggauuuauggucagucaucguccaggcaggccaggccugugauuuccaaggcuauguuaauaugaguaagaaacacccagguaacuagggaguuuccccucagaaagacacacuuuaaagucaguucuucaucuguguacaucaaauaacacccagccuaaaugaacguguacggacauuagucagccacggguuaggccgguaguuaaggacuccgacuugauggggucugugcugaauaguuuaacucaccacuuggcgagguugcaacagaggccuguuggggcucauccacccucccagagggacuucaugccucacuuaccugaacaugccuuguuugacuuaacccucagaccgcaugugacagaagcauccuuagggugggcucagacccaucuagaacauucugcaguagguugaggggacagacuccgaauugagaccuuuuauucagacuggaccuuguucuugugcugaauccacacaagaaaggggaagauaauaagaaaaugccugagacuaugccggggccuagcaaacacaaaaguggaugcucacagucagcuauuggauggaucacagggcccccaauggaggagcuagagaaaguacucaaggagcuaaaggggucugcaacccuauagguggaacaacaauaugaacuaaccaguaacaccagagcucuugacucuagcugcauauguaucaaaagauggccuagucggccaucaguggaaagagaggcccauuggucaagcaaacuuuauaugccucaguacaggggaacgccagggccaagaagugggaguggguggguaggggaguuggggggggaggguaugggggacucuugggauaacaugggauaaaugaggaaaauaccuaauaaaaauauuuuuaaaaaaaagaaaagaaaaugccuguuugugagccacguacagucuguucauaagcaacaaaucgcaagaagcaauuuucuguucacauuccauggucagugcaaaccccaggaaaggaugugaaguuauuauaagaugcucagucugaagaaagacaucugaacacggugccuaucauugagaagaagaaaaaaaaaaaauaggccgcacuacacucaaagaagagucuuagcaucaaauauuggagccgaaaacggagugucucacuaacccagaggcuaucagaaaucaaccaagaaaugucauuaucaggucucuguacaccgucaccaagauuugcuguauuggauaaugugggcucaaaaggaccagcccugcaaauacaaggcugggaugcuuccauuucuccauccgaucugggcaggggagaugggcccagugagccacagcuaccuaagauuccccauagggagggagagugaagacugauuccuucccuagggaggagcccacauuccuuucccaggcuaaaauggaaacuagguggggcuugcccugccuuugcagcucaacacucugaauuuguucugaacccaugagcccauauccaacagaucugagagaggugguggggcgcgaagggggggacaggguguauguguguggaaaaggggcugugauaaccacauaugcaauugguuugaagaaauucuuuuuguugcacaguuacugaaaacaacuguuuaauaugucaaugcaguaaagaagcacagaccaguuuccuggcuccaguccagacugacaccauuuuaguuuggagacuagugaucuccucuaacauuuuauguccccagcuuguaacaauuucccuuguccccaagaccuaguuacuagguugcauugcauauucugaguacaucuucaucuuuuuuuaccccacccccagacccuuaacccucgagagugucugggucgcacaaagaccuccauaaucaugccuagaaaugccccaugagucacgugacuccucauuuggaggcgugcaggacugucagagcccaaaucacaaacagcagcuaacacuaauacauauggagugaucacucuguuuucuuauaucauuucguuucucgucuaagugugcugagcuguccgcaauagauccacccccaauagacuauuucuagggaaacaaaaaacaaaaaaaaaagaaacacuucuacacacuuuucccaccaagcgguauuuugucagggccccaucacucugaaauccuggcgcuuuauuuauacuauaguguuaaugacuaauaggagcuauuauuuaaccauaagaauuuuccuuagacugaaacucugaauuacccauggccugugcugcuuaagauuuaguacugucgucucggucuccuuccuuugcugaccuaagaugacccccugagaacaugggcuagauucccauaccaguguucagcuucuguaucgcccaccucuggaaguucccaaaauggcuggccuuggcagauggcgcugcucuuuaaugagcugcacaguugcugcuucccauugcuuagugccaggaagcuucuccucgcuucauccccuuccccuucuugcccacagugccuuccuacuauucuucucccguuuuugaccuuuuguuucaucuuuuccccuuggauguguuaucagaaucucaucucaaucuagggacuucugccaagaugucugaacucuuccauaugcggaguacgaaaucuuccuuaagcccuacuuugcccuuauuugguauaaauauccauacccuaugagcuauuauucuagggccaggagucauuaagagucaguaugaaugugguuugcagacuacccuggcuuagagaaguccuuauacucggcuguguaugccauguuaacauacucaguggauggcaugaggugauaauauuaaccacugggauacagaaugcuuuauuuuguaugcgggaaugacugucgaagcuuucucaucaauagagcugcccuuccccauggaauuugcucugagugauggauguucaaauuaauucuaucuucugguggcauauacuaauugacugguuggugggcaggagccaaaacagcauagcaugccgcaacagaaagucaaguggaagguuaaacaaaauuguaaugggugcucagccagcugguaaacgguagcuaugacaucacuuuagguaaguaacauagcgauggcacauggguucauuucgugacaguguagaucuucucaauucuuaaccagggaacucugagauugcuagcacauugagccuccuccuucuugugaacaaugaagagcaccugacuugacaguugcuggcuguucagaugucaucagaacacuagcauccucaugaguccagccaggacagccccagacaaaaaugcuaugcuaagcuguguagggugaggcagguccuggagggcggacaugacggcugagagugggcuugaagagaaugaggaagaaugguuguuagaagggagaaucagggauggugggaaggaugagaaaugcaaugaagcuaaaaucaugcagccaaaugugacguuagaagacagauccuguaggggagaacuuuauuuuuggccaucuucuagauuagguuaggugaacuaaauauucagccuaaaaacaugacuuuugacaucuucuacucugccauuuuagacuuuaaaaauuagucaacuagggaagaggugacacuuaaguguguuccauuuuauucaucccugggagaguuaccuggauuaacaaaucaugcaaaauaugguuaggcagauacagaacucuaauugaccugccuguguuccauuaauauccagagccagacacuagacccaaaaaauuugauguauguuggcugugcucugcaacauucauauuagguagacucacuucaaaacccccaaagaggcccuaacuucuuguacuauagaaauggcucggcaguuagucuaaagucauuaggcaaaggauccagauccaaguguucuauucccaggagagcuugguguggcggggacagcucaggucauguguagugcuuuguguucugcaggaggcugagacauuguuuacauaccucuuaagcauuucccguguguguguguguguguguguguguguguguguguguguguguucauaggaugaguuuuaacuccaucuucucuuuuacagcuuuauauaaaaucagcuuacaugaacugcuggucagauuugagauuaauuuauauuauauuuccuuggcaucugugugacuugugagaauugccuuuucucacucuucacaaccaaguugcgauguuacaaauguagauucgcccaucuguaauuauucccucucuauauuuuuggggacacuguaacuuuugggucauaagagacuacuccuaaaguagucugagucaucugucugggacacuauuagaggggacaauacacaugcaaacaggauuugcaggaggcuucuaacuguuucuggguacuuuuagggugacaucgauucauucauugaauuuuagcuuucuuccagugaauauauggaauauuauuccucacugccgauucacccaggaucucguuauuuguuuucauuuucauuucuuuucuucuccuuguccuccaccucagccaucccucuucuuucucuucaaaaaaugggaaaaaaaaaccaccuaagauuugaagggaauaauaauguuuuaaaguaaggaaaugaacuugggagauaaacguguauuauuggaagcaauggggauugaaugagaguuagcugaguugugcagguaagaaagcaaagaggugcaguguggguggggcacagacaucugggagaguugaaauaggagacugggguccggagagccugguggcggacauuucccccaugccugcaucacuguggcaguguggcucuuugcuggagcugccugcaugagugagggaagagaagagcaguggagagucagacauccuauaggcaggaugcuugcuagacagacguuuaccacccugaaaucccucguggggcaagagcauggguaagcaaauaauuagauuuauuuuggguuugucccuaugcacugaaaacaaaucugggauuuuccucuuuaguuggaauccagacacagaagauaacuuaaggcgccaauaucaugacucaucaacuggccuugagauucaauuuucagaauuuuacaucaaaaaaaaaaaucugcucugggugaauuaaagucuuucuuuuuuuccuuccuuccuuccuuccuuccuuccuuccuuccuucuuuccuucuuucuuaugucuuuaucguuuggaacagaaaugcauucuggauuuucuuugacuuucuuggaagaaaggguagaaagaggaguucuuugauaaagauaauaaagacauugagcugaagcagagcaggaccuuuucgaacugaacucugggauacagaguuggcagcagugccacuuuccagcagaagaugugcagagagggccuuuguggcuggggggaggggcugucacauccaccagcagcucaucuucugcuugcacguaggaccaggacccuguugguguccccgagucauuaggaaguccuuucugugucucuccucaccccuccacuaucuuccuguaagacccacauucugccuuugccaagagucucccagcccacguugguaacgcaggucuguagucccagcuguggaggagguugaggcaggaggauuccaaguucaaggcaugccuggguuaugcagugagucugaggcuagucaggacaucugaaucagacccugacacaaaauucaaaguuaaaaagaugucagggguagagcccguugguagagugcuugcccuagcauguauaagacccuaaauucagucuccacuaguggaggagggaaugggaaaagccucuuuaucucuccugcuuguuagcaggaaguucccagagugggagacggcaaagauccaggcagccugagagguagagaagacacuggguggguaucagcucugagcaaggugaaugaggagaauucugaacaccuguggauucuaccaugacaaaaaccauggggaacaaccugucccgccuacucugaggucuaccgaugaccucaucaguuagucauugauugauugauagggcuuuccucugcacaagucuacaugccaggucugaaagcccuuuuguagggugguaguuuucaauguagaugcuguugguuaaacucuucauuguguuccugaguuuagccuuagguacaacaaggucauucauaaugaccaagguuuucuuucagugucuugccgggaacugccugcccacccacccagagcaugaaugaggcucgcuuuuauuaucuagaacuuguaggauucuacauauagccugguagcaaaaugaacaauaaucauuuguuuucaauaaucugcaaguagacucagcucacucaagucaagucguuuuauguaucucaaugggagcucaccacauaauugguucgaauugugaacucacuccccaccccaucccccacccucaccccccauccccaucuccaucccccaucucacccucccacucccacucccuugauagcacucauucaggguauucauaggcucagauguuuuucaggaacucuuacuucuccagaaagucucuuuucuuggaauagcaagaaaccccgagagagacccauuaucauaaaccugcccugccuuuaguacucgaaucuuagcauaauggguuccuggaguguacuacugauacaaguacauggacagacagacugguggaucagaacagagcccagaugcagacccacacauucggcugagggacagaccagaagguauuauuaaugauucaguaggagaaauacggcccucucaaaaucuacugaagcaauagauggccuuuggggagauggccuguacaucauaauagaggcaaaaauuaauucaagauuaaacaaaaaccuacuuggagaggaguugaacauaaagauugaggaagagaacagggcccuuuagagcauugcaucaaaguuuaauaaccgggcucaaaaaauguaaagccuagggcacgccuuuaaucccaacacucaugagacagaggcagguggaucucuaugaugcaaggccaguguggucuacaaaaugaguuccaggacagccagggcuacauaaugagacucuuuggggcgggggggggggggggggguaaaaaaaaaaaacuacucgcuacagugaaucguauuaaaaagcucaagcauagaacuucuacuuguauuaauaacacuggaaaggcugaggcaggaggaucaugaucaugaguuccagaccaaacuggacuacuaagggagaucaugucucaguaaaacaggacuaacccuaacugcuugaagaaggcugaaggaggucuguggccugcuccuagacccccgaagcaguaccaggcaaggacuguuccugcuccugaugaaggcgggugcgucugggaagacgaaugcagguugcauaggggacacucagauccucacaauugaaccauucccaugaagcuuuacuccuuugcuacgagagcagcagcuuuuccccagaccccccuugcuccacccugccccgcagccgagcucuucagagcuuuggcauacugguauauucuucccagaacaaccucuugaaaucccuuggggucugagucaggcugccccagcccuuguugggaaggacagagcaguggggggcccucacaggggugggagaaaggaguucaaaggccagccagauccgguugugugacgucaaagccuuggggucucagcagccaagaggaagcuagggagagggcgagccccgcauucuauaucagggcguucaaacuaggaaaugucggagacaaggccagaaacauacauauaaacacagccucgcucugcuuccccguguccagcuuugcaaaaaaaaaauagccaguacuccaagucacggugugugcuuccuucugggacccacgauccacagagaaggaaacauaaaauauauuuagagcuuucgaaacugauuguuuuguguauucuuacaaagggagaaaaaaauaaauaaaaccgccccaagagauuuguuuuaaaagcuucucuaauccuugagaugagugggagaacguugcauaguggggucauuuccuugccgucuccagacguuaguacgcacugaaaauagauguugggaggggaagacuccguggccugugaauacggauugugcaagaaaguuuuccaggccaagaggggaagguugggccuuucccaggcccccgguacaagaugacccugugguuggauauuuaacuaggcuugaagaccccagacagagggaauaauuaacuuacucauuccagaaucggggcaaagcaucccggagggcggagucuagggcaaagcaccccggagggcggagucuagggcaaagcacccccggagggcggagucuagcucuucagcugcucagucucucugugggaacccaggcucccaggucuaucuccccuccgagguacacugucccaagucucucuggagggcccagggggcugaaaccuggcauuccaaauuaguagauggaaaauaguaauugcuccacuaaaaaagaggggugugugggcuggagagauggcuccgugguuaauugaguugaguugagaccucugccacccacauacaagccggugugauggaaugcagcuguuggcguaacaccagccggucucagcgccucggagaucaagggcaaacaagugagcuuccaguucaccaagagaaccucucucaaaaaaaagguggagagcaauagagaaugauacucaaaauccaucucuaccuguaugagcacguguacugacuccagccgcauauguagcagaggauggccuugucagacaucagugggagaagaggcccuugguccugggaaggcuagaugccccaguguaggggaaugccugggccgggauggguaggugagugggugggugggagagcuaggggguucccagagggguaaccaggaaaggggauaacauuugaaauauagauaaauaaaauauccaauaaaaaagaaaaaggaaaaaaaagaacuacaaaaaaagaggaaauaaauguaauuuuuaaaauuaguauuuuagagcaacuuaauuaaugaaagguaauuaacauccaggcaauguuggucgaugcugcagugcaaacagggccaugacucuuuccauaucuguugaugugagaagugggaguuucagggccaaagcagaaaucaccugcugacuuugcucauccgggcucaagagaaacugagcaggcuuguaguucugagucuuucuccugguccuugcuuacacauuagucucuuucuucuguggauuaaagcuggaaucagccauuuccuucugugaaggcccagaucuacaauauuuaggucacacagucuggaauacaaaccacguggucccaccagggugacagagacacucugugaacgcgugaaugaagcuguuccacugacauuuauggacaguaaaugagaauaucuucuaguucucacaugccacaaaauaauaguauucucuuaauuuuccccaaacauuugaacugacugaucuuuggaggccauacagacauaacuaggaaggcaaauuugggucacaguccaugguuuaccaacuccaggaacagagagccaaagaagcuuacagcaaaagggaugcccacuacggguggaucugaguaauaauagcauuuuuacucacaggaggaagggaaauuacuggguuccagaacaccaagaauggggagguaucuucuggccucucuuggcuuccucagaucugcucacagucccuuuaaccaaugcucacugcugggaacccagccaccgaggacccugaaacuagcccccuccugcccuuucuuugggggcuuggucccaacagaaggcagccacugcuuugagcauuugccuucuccacuagcagaaagacccuguccccaccuucggugacagccaggccccuucugugccaccagccgauccccaggacagcccacuugaaucuuaccccagcaagccugccugagugcucucagcacacuugaaaauaacuucuuagauuuuuuuuuucuuuuguuauacaaggaaugguuguuagcacugaccuccaagugaagaugccgguccacaaaggaagugaaacauucagcauuucagaacugaaauuucuuggcguuaauggaaaaaaagaaaaaaagaaagaaagaaaucccagcuaaugcaaaacagcuggcgaaauaaaccucauuuaagcucggcuggggaaaagaaggcaauuuugcuagauuuuuguuagauaaacagaccuuuuuuccuacuaauugcauuuguuguuguguuugcugguuugcuuauaucagcccuugccuuccuuagaaagauugcaguaucacgcuggcgacaggaagaggccugucugucuggccuuugagaugcacgucagauaauccacagaggagagaggcucauaaacaaggauuugccuuguaagauccugacuggugaugggcagcuaaaaagauggacuuggcuuucuggcuucucuuguagguccuuccauagugacgccccccaaggacaucuggaacgucacuggugccaagguguucuugagcugugaggucaucgggaucccaaccccuguccucaucuggaacaaggucaguagugcaggccucgggaaagcaucgugcaagccggaaaucguuuuuugcauggcccagggcggugggaauggcacagcucagucugcauccacugccggcugccccacaaccaugaagccuguggcagcugguaucacucuacacuggcacggaucuuuccugaccuccaucagcccaguucugcuuuggguagcaguguccaagcagggagcuugggaaacucaaagaaccguggugaauaucuaaacccacuguuuucguugcuuuugguuacugugaccaaagguuacccgacagaaacuuucaagggaggaagaaaggugguucgcuuuagcuuccagguucagaggcuuauagucccuuacacagcagggaagacauggugcuaucacucagucugugguggcaggaagcuaugaaguaaggaagaaucuucaaacucgugcuaauaaaacagcaaagccagacaccccucuuuagcuaguuugcuuccucagcaagcucagaaauggaggauagucucaauuauuuugugugcuuguugucuggucagaggggagaccucuggggcucugggaggggguuucggccccauugucagaagaauccuaacagauuccaguucauauagccgaggggcaaaaagaaagagaaggcaguuccagcguccgggcacccaaaugugaucgggacuggaauucuugaucucuguuaucaaucucucggccucacuuucuccuucagaaagcuuccuccgcagagggcagaauuauccucacagaccuccgaagcagcaaagcuuucccagcugccgagugagaaaccuuagucuagaucaugguuccuggcagccucuggcgcccccguguggccagaagaaugcggccacugaggaaacuaccuggcuugagugugguuaccaggaaacgccuggaccacggugugggcagaggugacccaguucuaguacagcagaccgaugacccaguucuaguacagcuaucccucgcagcugaaacuuucguuaaagggaauaaugggauguugccucuaaauugugcuucggaaagagauguggacggggagucaggcaugucaauaacguggucggcuacguguucauuuaaaccuucccccuggcagcugaaguuccccaaugcuuauuugcgguuaguggcuugugaagagcauggccgauaguuuucaaggaaaaccggcaagaagcuuuguugcuucucaaggggucuccauggaauuuacaaaaugagaagccagggugacucgagguacuuaaguuuauaagccucauugccgaaacuugcagagaauaaggucuguggcaccccggcaaaauacacaugggucccaggggaaaugagucggccucgggaggcuuugaaguuauauggcuucccuuagaacaccagacaccagacaccagacagagguggggaccuaggggcuuggagaaaggggacuaaaagaaaaagcucacaacugccucugacucccacccacuccaggacauccaaagcccucuucuggccucugagggcagacccaaacucagauaugcacauuaaugaggauuaacauuaaguaauggugcuaacaagaaacagcacccagagauguauagcauucgguaguuauuggcgcuuuuucuuauuuauuccuuauuuacaauagcaagauuuuuggaagaaucugcugcaaccaaaguacucuagagcuaggcaucaggugccgcguguucugggcaggcugagacaggauggugaguuugaagccauccugacuauauauaaagagaucuugcaaaaagauuaaaauaaaauagcuagacaccuaaacgacuucuuggucuccccuugagccucccccagccccagcuggccauuuguggauagcaggguuggguuugcuuuuuuauuuguuuguuuuguuuugaagauucuuuuugucacagggcaguggugguucauuaaucccagcaccugggaggcagaggcagguggauuucugaguucgaggccagccaggucuacaaagugaguuccaggacagccagggcuacacagagaaacccugucucgaacccccccuccccaaaaaaagauccuuuuugucagggugugggggaucuucuauugcucuccacccuacuuuuugaccuagagcucacugauuugagcuagccagcuagccuggaggauccucgggucuccaccuacccugcucugagauuacaggugcuagugaugugugggagacuuagcagagucucuagccuuugagucaaacacuccucccagaacauuaccuauuuuauuaacauagacgguugcaccagcugcuugggaaauucaaggaaaaaaaaugcuuauuuauacacgucuucauagcuuccauuugaaacccuaaguaccagguuuuucucuccgaauugggggagacgugggacaaaccugaacuuagcauuugcuuaauuacagaaggaaacuccugacuuucucgugacaaagacaaucgaaguaaacacuggcuuggcucuuaaagaggccuugguagaauuaaagaaaacuguuucgugucauuuuuuuuaauuugguuauuauaacuuaaaacauauguacugaaacugaggaacuaaauguguucaacaacaacagaaaaagacuuuucccuguguucuuuucacaucuuuuccaaaguucuuauuaacauacuuuaaccuuuaaaauagguagggaaggagagacacgaaguaaggauuggcuguaaaccgagggagaugaauuuccccuucguacacggccuucggaaucucucucuccauagcacggacagaaacaggcaggguuuaucacacauagacagcgggaacuguuucaugcucccuuagcccccagagcaagcacuagacucagcucuggacuccagcugcugcuucucuuugaugagguuguuacaggaagugcccacaaggucccaaacaucaaacuacacugcaugacagcuugccagucaaacacagcaaggcaggcaaagaaggcccaguaccaaggaucaaacugucgucggacaccagugagugaagcagggugaccaugcauacuccacaaguuuuccagaaaaaaaaaaaaaaaaaaaaaaaaaaagcuuaaaucauguugcuuaaaaaccagauggagugguacacaccauuaaucccagcacuugagugacagaggcagacugaucuccuaggucuauauagugaguuccgggccagccaagggcuacauagugaaacccugucucagaacaaaacaaaauaaaacaaaacccagguugcuuagguaaaauuggcaggaagaaaccauucugcuugcucaguauucagaaaaggaacagauugaguaaauugcuagauuuaaucuuauuaugaagucuggugaacaccuugugcaauucugggaauggggcauuuccaaccuugauguuuuuauacgagaacuaagacucuccccuucugauuucucagguaaaaagggaucacucuggaguucagcggacagaacucuugccuggugaccgggaaaaucuggccauucagacccggggugguccagaaaagcaugaaguaacgggcugggugcugguaaguagcaagagcuggcaaccguuucauucucagaacacccaggcuuggcaaaggucgccugccugaaauuauucuccucccauuucuucgaagcagcccugcuguggucguacagauacagcuacaggaacuaauggaagaacugaaguuacuuuguuuaaaaaaaaaaaaaaaaaaaagaauuaagagaauccugcuugccuaaguucaaagcagaauucuuacacagaacugaauuaauuaucguuaaugguuagcaaguaugcgauuuugcuuaaccuuugauucuguauuugaucacagccccuaagcaaggcucucccuccagcauguaugugcgccuacccagauuuuaacauucacauugugaucaaaagccacccaggccauuggaauacagcggcuccacgggcugcuagcauaggacuucacuacuucucauagcagcuccgcucccaagccccugcucgucacagggauccuacuagguguaauggaagccacugaaagcgaggagaccuccacagagaacuaaagagccuuuaucuuucgcagguaucuccucuaaguaaggaggacgcuggagaguaugagugccacgcauccaacucccaagggcaggcuuccgcggcagccaaaauuacagugguugaugcccuccaugaaauaccacugaaaaaagguauguaagccagcucgccauuuaaaaacaagcggucuuuuaauaaucaaguagcacacagaacuauuaauacaauucugaaaagcaggaaguccagaaaagcauuaagcauauguaauuacagccagauugcaugccucaagauggcggagggcuaccaggacuuagcuuucaccucaucuugaacagaauuccugugacuucuauaugucauuuccccuuugugguuugacuauuauauucaucauuuaaaaggaaguggucauggucaauuugguccuucauuuggagcuuuuaagaaggaaaaaacaaaaaacaaaaacuagacacucauugcucuuccaggggaacugacugaguucaguucccaggccccauauggggcaggucacaauuaccuguaacuccaguuccaggggcuccuaugugcucuucuucuggccuccauaggcaggcacacacucaugacacacauucacacacauacacacacacacacacacacacacacacacacacacacaaagacaacaagcuagaaaaagagaagagguuggcaaauacucaggugugucccaaccacugcuaaaauguuucuuccaaagaagccacgcuacaguggcccagcagggcugccuuacauguagucagugacaccugaccagacccuccucagaccaaacaaagcuucucccacaugcugaggugcaggucaugccgcuggccagaccacucagcugugcggcgaaaggcauuaccaagcacaaguguugguggucagaaauucucccucuccaccaagacguguggggaguccgacagggucaccugucggaaccucagucuggaacagcacucuucuaccuuaagcucugaacgggcgggcgcugggcugcaaggaugcuuagcuucucuggaucucaccuuggaagaauguagcacuggcucucauacuugaaagugcauagcucacccuccacggggcacuccagcaugucaugugcgugaccacucauacauccuuuauccccagguuucugaauccccacaaccucaccuguuauguguaugagugguuuacuugcacggcugcaccacaugcauguagugcccccagaggccggaagagggcaucagaucccucaggacuggaguuacagcugagagcugccacgugggugcugggacucaaacccaaguccucuaaaagagcagccagagcucuuaauugcacagcuaccucucuagagguuuccuuuaaagaaugaggucucacucaggcacaugcauguaaucucagcacuugggaggcugaggcaggcaagccaugcguucaagauuagccugggcuacauaguugggggugggguggggggggagagggagagggagagggagagggagagggagagggagagggagagggagagggagagggagagggagagggagagggagagggagagggagagggagggaggcagggagggagggagggagggagggggggagagagagagagagagagagaucuuaaguugcccaagccuuuaacucccaaguuuaaacaauccuccugucccagccugaacacugggucuauaagcacauuaccaugccccucccuguuagccauauaauuuaucauucucacuaauuuagaaacugacaaucugccauaccaugugaauaugugugacuaauuuuucuuucuuucuucugaaacaggugaaggugcucaguuauaaccugcgaauccaugagccucuguagcuaaaggugcucucagacagccgacagcuauaacccugcucuugccugacacacuucucuuaaccuaacccacuaacacuuuauuacagccagcugguuuuacacagagaaaucaaagauaacacaucaagacuaucuacaaaaauuuauuauuuacagaaaaaagcacauguagcuuuaaacaaaacaaauaaaauucuuaucacaacaguaaauuuuuuuuuaaugacaaucacagaaacaagauagugauagucacaguaucugaccaugaacuucuggcagcuaaacacucaucauucguggugcgaugcucauggacaugagcuccuggaacaacagcuugcacgcguacggcauucgcaccaaggaaaucugcagagagaaagacaguggucagcagagcugcaucagguuccacgcucucccugagggcaggcuaaagcuuugacacaccagguggaugagaguggcuucgagcucucaucuaggccuagugcaggcucucagaccaggcaggcuuuguuuguuccuccuuucugcccacacagccauuauucacccuuccugauacauuucaaguaaaaggcuuaagaaaagcucuugguugggcugaagaggugacuccuugguuaagagcacuggcugcucuuccagaagaccugggcuggauucccagcacccagagagcagcucauaaccaucuguaaccuccaccccagaugauucguugcccgcuucugaccuuucagggcaaugcagacacauaauacacagacacaaauacaggcaaaauauccauaagcauauuuuaaaaaaaugucuagauuccuugugcaagaccuugcaauuucagagaugaauagcuuagugaaauugcuuuuaagcuuguuuuauaaaagucaaacuaucuuucguugucaaacuaguaucuuaagagaccugcuaucaaaacugaaagucccagccuauuccacuacacuaaaucugccaugagcaccguguaagaacaucgaggagaaucaagugcacacaccuggguuuuauugcggcauccccugcacucauauguaugaguccucguguuagcaauugccauuauuccacaaagauuacagacaugaaccugauacggaucugaugcuucaaacagucuuucucuuagaaacugugcugcaccgugggcaauuugacagucucguuccauuucuccgaagcgcaggccaccaucacuguugauaagaacacgagagcuuguuuguacuuauuuauugugaguaucugugagugccacacaugcccauguguagaggucagaggacagauugcaggagucgguucucuucugagaauuguacccaaauaguuaggcuuagcagcaagcaccucuacccacugaaccaccucaguggcccgguaccgaugaccuuuucuuauaaacaccgcucugauuggugacaagagugaaguagcaguagugcagaacuagacucugauucuuaugcccuagcaaucucucuaaccuggugaggaggggaaaagccauuuacuaggugucagaaggucuccaaaugaaguagccagaaaacacgcucaaguacagcaugcaagcuuccucauccaauacacuguagaagagcagacuccugggaacuucacuuaacuuuccagcguucaauucuau

SEQ ID NO: 2509 - RNA, 1338 nt, Mus musculus
cuuucuaaggaaggcaagggcugauauaagcaaaccagcaaacacaacaacaaaugcaauuaguaggaaaaaaggucuguuuaucuaacaaaaaucuagcaaaauugccuucuuuuccccagccgagcuuaaaugagguuuauuucgccagcuguuuugcauuagcugggauuucuuucuuucuuuuuuucuuuuuuuccauuaacgccaagaaauuucaguucugaaaugcugaauguuucacuuccuuuguggaccggcaucuucacuuggaggucagugcuaacaaccauuccuuguauaacaaaagaaaaaaaaaaucuaagaaguuauuuucaagugugcugagagcacucaggcaggcuugcugggguaagauucaagugggcuguccuggggaucggcugguggcacagaaggggccuggcugucaccgaagguggggacagggucuuucugcuaguggagaaggcaaaugcucaaagcaguggcugccuucuguugggaccaagcccccaaagaaagggcaggagggggcuaguuucaggguccucgguggcuggguucccagcagugagcauugguuaaagggacugugagcagaucugaggaagccaagagaggccagaagauaccuccccauucuugguguucuggaacccaguaauuucccuuccuccugugaguaaaaaugcuauuauuacucagauccacccguagugggcaucccuuuugcuguaagcuucuuuggcucucuguuccuggaguugguaaaccauggacugugacccaaauuugccuuccuaguuaugucuguauggccuccaaagaucagucaguucaaauguuuggggaaaauuaagagaauacuauuauuuuguggcaugugagaacuagaagauauucucauuuacuguccauaaaugucaguggaacagcuucauucacgcguucacagagugucucugucacccuggugggaccacgugguuuguauuccagacugugugaccuaaauauuguagaucugggccuucacagaaggaaauggcugauuccagcuuuaauccacagaagaaagagacuaauguguaagcaaggaccaggagaaagacucagaacuacaagccugcucaguuucucuugagcccggaugagcaaagucagcaggugauuucugcuuuggcccugaaacucccacuucucacaucaacagauauggaaagagucauggcccuguuugcacugcagcaucgaccaacauugccuggauguuaauuaccuuucauuaauuaaguugcucuaaaauacuaauuuuaaaaauuacauuuauuuccu

SEQ ID NO: 2510 - RNA, 1086 nt, Mus musculus
uauuggauauuuucuuuauuuacauuucaaauguuauaaccccuuuccucguuuccccuccgaaaacccucuagggucauuuugaaugaacaaguaucugcagaugauccaaauuuaggacauagugugccauuuugccuguaacacuaucagggaaaucuggaagucauuuaugcgcaaggcaaggguaaccacacacgcaguuauuguugccuucacagaaucagagauuaugcucuguguguggccguugcuauaagcuaggcagguaaagugcuccaccaggcugguuuucaugaugugcaggggugggguugagggguggagugagaguuucaggucccagcacacuuuccccuuuaugccuuucugggcugugaacuugaugagggucuuagaaaucagaugcguucggccuggugggcucugcucuccucuccucauucccugugggauguuagcauuuugacgacaaaaagccccacuggcuguccuguuugaucauccucaguauuucuucugaugauaccuuucuggaaguuccacuuggacuuucucgagcuucauccucuguggggagcggggcagaauauuuucaacuauuccagguugggcagcaucagcacaauucgaaggaagguggaaggcgaucaacuugcaagucauccuggaugccaucaccuaccugagaggucacacccuguguauuagggcuggucucucugugucuugagcagcugagagacucaaacccucauugccaacuuuguuuauucuccuggacagcaacagcuuccugaugcuuguugguuccaaaggcaccaaagcaaaaacccccauguuuacucugaacguuuugaugugauucucuagagucgauucacucucaacugcuuuuucagcaaacagcgucugcauguugagcaacucaagcaucuugcccuuucauuuuggucacaggucuuguucaaaauucccacaaagugucguguugcaaccgaggacaaccgucucaaaaugauuuucaacgcaggagaaagucuccguuucagccgccagggucggcugacuccucuuggagauuua

SEQ ID NO: 2511 - RNA, 5325 nt, Mus musculus
uguggugucuagggaccaaacucacaucuucgugcuugcagcauagcaaacacuuaccuucccuaagcucuccuauaccucuuucuucauagcacuuuccauuauguaauagcuacagcauguuuugccuguauuguuauuucugucauuauauucuccccucucacuacaaacuagcuuucacaggauauaaaucuuuauuagauuucuucauuguuguaucucaaucaguuagaccaaugccuggcacaagauagccaugaguaaaaacauucauacuaccuaugcaguauuauuuucuuuuauacucucaaaguuauuuucuuuaacauaacucucaacuuuugguuaucaguugaaguuaaucacauauacuauaauuaucuuaaucaucuucaccuuaaaaaugguuauauuaguaagcauuaauuugucuuauaguugcuuuuauuaagacuccuaaauaucaucuagagaacuuaagagcuguauuuagaguucuuaugaugucugccaccuagauguaagugaaauguaugguuaugaauugguuaguaauuuuaaauuugcugcaaaguaacaugagaguuggccagugugugaucccuaauuuagcagguauuuauugauuaccuaagugacuggacacuuuagaauagugaaugagaucaauggauuaagacuuuuuauaaagacugaugcucgcaggcuuaggugguuauuuauuaaguuuuguuuccuugaguagcuuugaaauauaaauucuauuccaugauuguucccauagcuauuuaguguuaaaguauuaguaaguauuaguacgcccuaaaaauguaauagcacaggaggaauauuucauaacuuuuaguucuuacuauuuguuauuauacaaacaucccugauagcaaauagucuacucaaagaaacuggcacauuaauuauuaauucagacuguaacuaaaaucauuauuauaaugacaucauaccauggacuuuguuaaaucaaaccucuguuuuggguuagauuuccuuagagcauuucaaggaggcaaaagcaaacagcuuaugcauauugaaaaauaaaaagaauacacaugaucucuuuggaaagucaggugauauggauaugaaugguuuuuaccauuucacucuuuuuagagugaaguuauguauggaacaaaguaccuuuguaaaauggaaagagcaucaugggggguuaaauagauaacauaauucauagccuggcagccaaaccuugcauagccguagauauggaaguggugagagucaugcagccagcacagcuacuugacacaguuccagcaaagcaaaguggaaugcugucauugcugucuuucugucucuaacuuuuagguuuuggucucugcaugcugcauucuugggggacuuucuguuaugauucauuuuaugucuuuuccugagaaaauuauaucugaguccuuuuagggaagucauaaacucacuaucccuccugcuuuuagggaaauaauuauaucuggcccuauuuggaagucuuccuuaugcuguggagaucaugauacgcucagagaagcacaaaguuaggaauuucuuuuugaggccuaagcaaacugaaacaguguaacuagaacagggaaagcuuagagauagcugacaaacuccaacuggcaguugacuugguaacagauguaaggccucuuuuuacaguacaccuagagcuccccaaaaguauaguuuaaagauaaggaaucauacagaguaugccccuggagaaguagaacuugguaaguaagauagauggacuaaaaaaccuuuccuacuguauaccuuagaugauaaaaggaguuagguguuaguauuugcuguuuguagaaaagaccaguucaguuauuuucuguuuaucuguuuaaaacuguaaauacugucagcuuaaaagcaggcuaucacguaacagugugcuugcuuucauggagacaguguuuagagucuuugaauuggaguuauagggcuaaaaauaaaaauagcauauucuaauuguacuuucuaauuauaacugaacuuguaacccuggacacaaaaugaaaaaaaucacaugucuggagacaaaguaauaucaucuguacuucucagauaaccauuagucugucuuuguucuacuaaaccugcacaacugaaaaagcaaccugaucacuagucagucagagcugcaagauuccacugaucaccaccacaucugacucacucuucccucaaggacuccuuaucuccucucagagaggacacuacagcggcuccccuccuaccccccaucccuggcacaaaucaauaaaauaaagaauaggcugcgcaguuuguauuuuaagauuuuaaugaacuuacuuuuuuuuuucucuuaaaaaaaaaugcuagaagauccauuaugucucuaaacuuggcagugaaggaagaaucacugcauuacucuuugggauuuuuguuucuuuuuugucaugaccagaggacguccuauuagauacaugcuuucaauuuggagcuuuuaguaaggaaaaauuaauguauaagaauaggcaaauuauucauauuuuaaaguauauaugcaaguucaaucucugacuaguacaaaguaacaaaaaguucuuucauuuaaucaagucaccaaaguacuuaucuuugcuuauucuuagaaugcacaaacuugugaagccuuccacugagaagaaauauguggaucuuacugugucauuugccccagacgcugauggagaugaagauuugcccggcccuccagugagauacuacuucagucaugacacuaaugaguagcauuguuaccgagauacuccagcacuacuuuauuuuggaaaguguacuuaauucagaagcucagcucauaauacuguggauuucuuuuugccuuaauguaagggaaccaucaguagggaacuuacuagaguggagaauuacaaaccauuuugaagcauaguacacauuugucuguugcucccugcgguuaugaucacagcaccuuugaacuggaauaccauuuucuaauacuuauuaagcccuguggaugaaagaaggaacaagaaaucauuuaucuaugaccagaagaaauaaagaugaagaaauugaaaauagugaauuuguacuauucagaaaguuaaauccuucuucaacguuuucuuuuuuauuugguauuugagacccauuauuucaauauaaauaguguggcacugugcugcuuacaugauuaggcuuugaaaauuccauagcugauaggaagagggguggcagauaggugaugaguagagauuuaaaacuguaguuacaguuaguguccugcuaccugugcuaacagugugauauauuacucccuucccuaagucaggauugucccugaucugaucaguguuguaaacagugagguaacaugacauguuaacuuggacuaaauguuaacaguauuacaugcacucugauagagaauccauaaaugugagcagauaaauaugguuaaucauuugauuguuaauauaccuuuauuuuauuuaucuggaagucuaaacuagucauaguauuuaagaccaaaaauuuuuuauaaagggaauauucuuagaaauagaugaaaguuacaaauuaauuugguugucuuuuuuucccuuuccagcaauguaauggagaaaaaaaaaaaauauauauauauaguauuuuuuuuuaaaggaggcauguuauuucacucuucauucccaaauuggggauugacugaaauagaaaaaauuauauuuuuuuagauuuuucuuuacugaaagaaauacuccauugccugaugugaacaguugcuacuuaugauauaauuggguccauuaaaauauauaaacaauacuugacuguaaaaucacugaaaacagccaguaagucuuuuuuacaaggguuaucacgcauucuaaacaagugcuuacagccucuggaaguuacuugccuggaguuccuauucuuaagaccauuacuaaauacuuugaugaauuaaaauuuagauugcaucaguauuaacuccaaugguaucucuuuauacucuauacuuucuuuccauuuacaaacaauuuaugaucucugugguaaccagcuuuuuguuuccuccuuuuacgaaguguccaguugggaaauggggugaguuuguacaauaaaaugaucuguucauucagagguggagaaaaguggacaggguuuguuuuaaagaacuggcuaccuuuaaaauaaacuauaguuuuuaucauauccuaccuuucccauuguucauaaauugaauccaugaauaucaaaggcucuguggcuuagaacuuaaugacaaaaagaaguccuauuuuccaguuuucacuuuguuuucucuucuuugguaguaacguauucuguagguaaucauucaggaauccucaaacaugaagcaauagcuuggcucuguuuacuuaagucuacacguaucuuugaaaguaaaugagagccaugcuuuguagagugcuuuaguaaauaaaaucaaccagguuugguuuguuucuaauuaaauccacaaccauuuugucauuggguuuuguuuuuguuuuucuguagguagugauuauuacuguccuacuaaauuauacugaacuggaaagccauaaugaaguuaaugacuuuuuuuuuuuguucauuuuguacuuuaagauucuugguacuaaaauauagcuauugaauacugagugcaaaaaaaaaaaaaaaagaaggaaaguuguguuauuccauuugguuuguuuucuguuuguauguuuguuuuaauacuaaaaguaagagaaauuuuaggugucauucucaaccaugccccgugguucaucgcagagaauuuaauuauaccucuuuuucuguguuuaaugcugcuacugucuccucacuuuuaugcuuugcaagcagacuaguaagggccuuguaaaccaaagagggaguguguuuuuagcaaguguaaagcccucacuguaauauacaggugcaaaaauaaauaagaaaaaagggcagaaauagucacuccaacagaaacuuaguuugagguuucuaaagucaguucuuuauaggauuuggagcaauuguguuaugugucuuauuccuuauauacuguucaagaaguagaaauuggaaucacuauauuuugcuuuuacaguuugucuuccauggcacauuguuggggagagcaucaacauacaaaaaaaaaaaaaaaaaaaaaaaacuauagcuggaguuguaacucuguaguacacaagauacaugcacaaggcucuggguuugaguuccaacucauua

SEQ ID NO: 2512 - RNA, 1806 nt, Mus musculus
caugucacacacacauuguagcucuuucucuuuggaggugacuaacagaauaucauccauauagugaauacuauaagccugaaggaaggcuugcuucacaggcucuaaaaucuuuccuacauaaguggauuuuuaccauaccucaagguaauauauuccauugauagcaaagaugggguuuucuaugauugagugaaguaacagaaaauguuuuauauacauuauuaucaaaacaaauauguauagugaaauaccagcucuucaaauccaaaaucaauugaagaccaaucuuuagcaauagcuaucaguguagauaaugcaggcuguaaaacuccuauuggcuacaugguggcauuaagauuucauaagucagucaaccucuauuuaccauauuaucuuuuaacuaaaaauaugagagaauuccacagagggaaacauagaucuuuguuccuauucuucaacauuuggcugacuacugcuaaggagaucauaacuuuccuuuaaaaauaugucuuuggagcaccugcagccggaaucucuguguucuaggucagaucagacauucugucacaaugccugaaauaaauaccagccauccugaugaaaaacagguacagcuucuagcagagauguguauucuuauugaugaaaaugacaauaaaauuggggcugacaccaagaaaaauugucaccuuaaugaaaacaucgacaaaggauuaauacauugagcuuuuagugucuucuuguuuaauacugaaaauaagcuccuguuacagcagagaucagaugcuaaaauuaccuuuccaggucguuucaccaauaguugcuguagucauccauuaaguaucccaggcgagcgggaagagaacaacgccauuggugugaagugagcagcaaagcggcgcuugaaagccgaguuggaaauacccuuggaagagguugaucuaaaugaaauggauuaucuaacaagaauuuacuacaaggcccaaucugaugguaucuggggugaacaugaaguugauuagauuuuguuucugaggaagaauguaacuuugaauccagaucccaacgagauuaaaagcuauugcuauguaucaaaggaagaagucagagaaauuuugaagaaggcagccaguggugaaauuaaguuaacucugugguuuaagauaauugcagauacuuuccucuucaaauggugggauaacuuaaaccauuugaguccauuuguugaccaugacaaaauacauagauugugaauguguaaaugauuugaaaaauuuucuaccugguaagaaugguuugguuugguuuuaaauuuaaaugauacauagguauuuuacaaccagaauuuguuuugagaaaagaaaaacucaacuagcuuacaguuuuaaauuauauaucccauauauaugcacugaugucuguaaaagauauuuaggugagguuauuguaaaauuaugccauaaguaaaacuuaauuuagccuguccaaauaccuggcuaugacaagauugaggaaguaacuagaacucauauuuuacauuugacagacacuuucagaacacuuugcuaauugccaaguguuguuuauaucuuuagauuuuuaucauacaucagaaaauugagcagcugcuuugaaacagcacuaagagguuaaauggucagggcucaggagacagcucaguguaccaugauugccuugugggcaugaugucauggguuguugagucucuaacccuaaagauaauuguaacaacagcagcaacagagcagguucagaggaaaguacguggcucucucucucucg

SEQ ID NO: 2513 - RNA, 1249 nt, Mus musculus
cauuaggauuaccuucgggucaccucugccucccgcacaguccagcugagagcuugcccgagcacgugaccugggggguucggagcccagcggggaaguggaccuccguuccaggacgccugggucucauggauagggagggagucgccaucagagaggacagcggaaggccuuggacucgcuuucugugcucugauuuaggcaagcaccccacgaacugagagccacauccccagucccucuacgccgcccgcacuuaaaaaaaaaaaaaaaaaguuuuucugcuuguaacgacuuggggggagauggaauuuugggaaagggaaauaaauguuuuaggagguaagaucuuuauuugaacaagcuagcugucuagggaaacggagggagcccaggagagcugaggaccagauucccugaggcagggacgcugguuauccauggccauacggauuaacuaguuguggagucccuucgaagaacugaugcccaaaacgcugggaauuauucagccaggcgcucgaaggaacuuuaguucucaccugcuuaagaggcugagggcaaagcuuuauguuuaaagacuguuugauggcuccugagaugauucagccaguaaaggaacuugccaccaagccugaucgccuggaacccacgcgguaaagagaaccaguucccacaaguuguccucucauuuccacacaaauuaaauaaauagauagugcgugguggugcuugccugaaucgcuauaccucagagauggaggcaaaaggaucacaaguuuggaguaagccaagacagcacaggaaguuguuuguuuguguguuuguuuguuuguuuguuuguuuuuaccauaggagacagugguauucuuuacucgcaccugaugcugaaucgaggaauuuaaguggaacagugugcagauaguagcccaacuugagcuuagcguuccaaaagacagaggauuccugaaagugaugcaaauauucaauuuauccgauuucauuucuacaccaguagucagccgcguuggcuaaaugguuuuaaaaaccuaaaugcaagaaacccgaaccuucuauuaucucaggaacagcaaauaauaacgugaaaagacagcuucaaaagccuuuaagcccagaacugggaaggcagagguaggcagaucugugugagucuaaggccagccugauuuacauauggaauuccaagccaaccagaaauaacauagugagcugcugucuaaaaaaauca

SEQ ID NO: 2514 - RNA, 893 nt, Mus musculus
auuaaaaaagaaaaggaaaauaaaaaagaggguuggaaucuaucaaucuucugugccaggcauccucgacuucauccucaucgugagcuucuucacuuucauccguaucuccuucuucaucaauaucuuccaaccccuccuccucauuguugucgucaucauccucuucugccucucccucuuuaucaucaauaucgggaaccaaauaguacugcaagggauuuggccaaaugucaccuuugaugaccuuuccuaacucaucagcaccugcgucagaauggucgguaaaccagguaaaggagcucucuggcucuucgcgcugccuuuuccugccuuauugugcgucugacuuuagcguuuugucaaguccuuuccagauuuccauuugacuucgguggacuucgaagaagggucaccacuccccuucagaugaaauucguuggagagaacuuuauuuucaacguaaggaucuucaucaaaauaaaaaucuauucuguaaccugauuuaaugucuucaaauucugucacuucaacucuggucauuaaugcagagccuccucguccuccuccccaagcagugcagacacuuguggaugcuugacaaauguuguuacccccaaauuuggaauuuuggcgaucaguucugaccucuucugaaaaaaugguuggcggaguuuguuauauuuuuguucuacuuucaaaauuuccucacuggcuugcucacuaagucuauuucauuuuguacuucaucaauauguucaauugcuucuugcuguucuuuuucucccuucggcagguggggagaggccaacuuguccuccagcuuuggggcagcagucugucuggguuucuugggcugaggcaggaucgcagauugccgcuuuggggccaug

SEQ ID NO: 2515 - RNA, 893 nt, Mus musculus
cauggccccaaagcggcaaucugcgauccugccucagcccaagaaacccagacagacugcugccccaaagcuggaggacaaguuggccucuccccaccugccgaagggagaaaaagaacagcaagaagcaauugaacauauugaugaaguacaaaaugaaauagacuuagugagcaagccagugaggaaauuuugaaaguagaacaaaaauauaacaaacuccgccaaccauuuuuucagaagaggucagaacugaucgccaaaauuccaaauuuggggguaacaacauuugucaagcauccacaagugucugcacugcuuggggaggaggacgaggaggcucugcauuaaugaccagaguugaagugacagaauuugaagacauuaaaucagguuacagaauagauuuuuauuuugaugaagauccuuacguugaaaauaaaguucucuccaacgaauuucaucugaaggggaguggugacccuucuucgaaguccaccgaagucaaauggaaaucuggaaaggacuugacaaaacgcuaaagucagacgcacaauaaggcaggaaaaggcagcgcgaagagccagagagcuccuuuaccugguuuaccgaccauucugacgcaggugcugaugaguuaggaaaggucaucaaaggugacauuuggccaaaucccuugcaguacuauuugguucccgauauugaugauaaagagggagaggcagaagaggaugaugacgacaacaaugaggaggagggguuggaagauauugaugaagaaggagauacggaugaaagugaagaagcucacgaugaggaugaagucgaggaugccuggcacagaagauugauagauuccaacccucuuuuuuauuuuccuuuucuuuuuuaau

SEQ ID NO: 2516 - RNA, 9278 nt, Mus musculus
cgcaugcgcgcaaccuccuggugcuagugcucuaguuggccgcccgcuccguguaaccaugcugugccggucgugugccggguggcucaggucgcugcccacccugcggcucccggcaccgggaucaccgcccgccuggagcagcgcgcggcucccagcccuuccgguaugggcagccgcuucggugucugcggccucuccagguggcugguaugaggcccuggcagcgucggcgccggugcgcaccgcggaggaagugcugcugggcgcgcaggaggcuaccggccuccccugguggagcaacaucauacucagcaccguugcccugcgcggugcugucacucugccccuggccgccuaucagcacuacauccuggcuaaggugaggggcgucgguccccgugcugccugccugcuaguguuaacauggaggcuaaaauaauuuaguuagcauugcauguuaaaugaugguuggugacucgaguaccuuccaguucacccgaccuaccaaguauuuauucgaaauacaagugccucccaaauguucgguugagaccaauauucagaagaaauggcacggaggaaccugaaacauuagggucauaaacauuuuaagagucugcagcaucauuugucacuauugauacugcucuuuauuacuagaaagguaucacuaaguuagcaguuuccagacaugaauucuuccucugggccuaccaccuacuacccuguaucugauggauugaaacuucgaguuggcuuuuuaggaacucuguucaguggaauugguauaacguuaccucccccauggcugugccugggggugggggugggguaagucaagauuuuaauuugagucacagaggauugccaggaagggagcagcagcauugagccaggaagcauucacagugagguguuaacacuggaaugcuguuuucucucuccugggaaauguagggauggaacaguaagaaccaggaugcaguuuucauuuacucgaaauccuauggaggaggugcuguuagauaugcuacauacugggaaucaggauuucagguuaugcacagccagaaacagaaaacaucagguacccauaaccaagaaguugcaguugguuuaacucaguaugguugccaagaucacgcagauagauguacaggcaaggaauuuaaaucuggggucaaagauacuuuaagcaaacuaauaucuaauagaguuuucuuaaauguuuucgauuacaagugugaucaguaaacaacauuuguauauggucuagggaacagagacuagaacugugaguuugguuguccugaccaaaugcugagugggggaggaaagggauuaugugguuuguagguuauauagucuauuguggaggcauuacagagcagggacagcagcagaguccuuggaggaacacugcuuacuggcuuuuuauacagcucacguucacaugccuggggcugguggcacacaguguccuguguucuuccaugucaauuagugauuaaaaaaugccccauaggcuaaucugaugggugaaaugucuuaguugaaggcccuuucuucuggaugugccaaguugacagcugaagcuaaccaugcaguaguuaucaguaaagauccuuuaugaacucaucaaacaacuuuuuucuuuaguuagguggaaaacuugcaaccagaaauaaaagacaucgccaagcgccuuaaccaagaaguugcagucugugcccgucaguuuggaugguccaagagaguggcuagguaugcagcuuugggucugcggucacgaaaauguguguguggugugugcguguauacacgguuagguauucuuuugauuggcguauucauauuaaucacuaugcugcauggugguuuuauguauuggaauggaaucaaagaaaggaagaaacaggcguuauuccaacuccugugaagcugaaucguccuccuaucucagccucucucucagcucugagauuacaggugcagaccauuguaucuggcucuguaugucagaauaugacaggguuucaugugcaccagggaugcccaguggguaacuguacccaggaaugaccuugaacuucuaauccuccaaccccgaccucccaagugcuuagauuacacauuugugauaccacaccuggccuguguucuugggagccacugaaaagauaaagucagugaauuaaauacuguauuaagauuugacguaagucaguggagcugggcaaguaaugugccaccaugcuuggcaaauucuauuuaaugugagcuuugucaucuuuauuuggugcuaauacaaacuugacauugcacugaagagcagcugaaucagcaauuaagagcacuugcuuucauuuguuuauuuguucguugauguuuuaaucuaagacaggguuucucuguauagcucuggcuguccaggaacucacuuuguagaucaggcuggccuugaucucagagauucgccugccuuugccuucugagugcugggauuaaaagcauuggucucuguaucuugccuaaagaacacguacugcucuuucggaggaccuagguuugauucucaauacucacaugguggcuuauggcuguuuguggcuucaguccccgaaguauccaguacccacuucugaccucugagggcaucaggcauucauguggugcaauuaaauacauguaagcaaaccacuuaugcacauaaaauaauaaaacaaaucuuaaacaagaacagcaaagaaaacuugacauguagggaaacauuguagcuaaacaguugaggcaagacauuauuaaucucaguacuguggaggaagacguggguauaucucuuaaguucccccagccuguuuuaccuaaugguaaaacccaggccuuucaggccacagacugagaccuugucucagaaagagaagaaacuagaaaguguauguauuaaugcaugaaacauaaagccuuauuuguuacauauaagcuuaaguacgcaugguguuuugauauuuuuaugaagagaaaucugagagcuagagcaguggaccaggaccaggugaauaguuagcuguccauuuggguugcagacggcuugaugaagugacauuuaugaugccuuccuugccuguacuacacugguccauuuuguuggaugaccuaaaaauuuuaaggacccggaugugcaaguguacguagagaaagaaaguacagauaaaaguagaagggucuagugugugcugucuuaguucagcauauuacaaauugauuaaacucaauacaccaacuaaaggccuaucuuguacuaaauguguaugauaugagauugaauaugaggaagaaacugggcaaggucagcggugggcacacaggaggcuacccugggcuagugcuacccucccugccucaaacaaaacaaaacaaaacaaacaaaaaacccuccaauaauccucccucaagaccuuggccuagaaaguaagacuuaacagucaaaagcaacaguuuaguguggcugcacguaaucccgagauccuggcacuucggagguggguaugggaaggguaagguagccuuggcuaccaaguucaaggucauccugggcugucugaggccacaucucagaaaaccacuaacauaacugagcuggguguagugcugcauauuuuaaucccugcaucuaggcagcugaagcagguggaucucugaauucagggccagcuugguacugacugagugccaggccagucagggcucacagugagacucugccuuucaaaagcaaaagaaucugauuuggugaacagauuaacauagcccuuggugggaaguugauuuggugaacagauuaacauagcccuuggugggaaguugauuuggugaacagaauaacauaacccuuggugggaaguugauuuggugaacagguuaacauaacccuuggugagaaguugauugaaaacacuggaggccauuuuggcagucucagacuauacacuguuggaacccccagaacagaagagcuauuuuaggaggugaaguaauaguauuugccugaacuacagaguuaaguaaaauaugcuuucagcuguaauaucuguaguuaaaaauguguuaaacuuuguuggucuugaaaccccaauacacuuuuuuuuuucuugauuuugagacaggaguucauagauagcccagguuugccuuauuaaacuggcuauguagcuggagccuggccucaagcaguuagagacugugguaaauaaaauuauuuuuaaaaaccuuauuggcuagagaucauuagauacuaaagcuguagucugacaguaucaguagaaggcuacaugccuucugcuuaguggcuguccccuacugguuaccaugguuuaaaccccuuucaacccuucggccaucgccacagacugcuguagggugacccuucugccgguggucaggugucauucccucugcaccuuccccguagacucaccuaucugaagaacaugcggagacuuaucucagagcuguauguccgugacaacugccacccuuucaaagccacggugcuggucuggguccagcuuccaauguggguuuucaucucugucgcccuccggaaccucagcacuggggccacacauucagacgguaacuaucgcagaaacccucaucucucaaaaucuucaggguugcaucccaguagaaaaacaaucuuagcuuuuauuauuaccauuuacugucuuccuuacauacagaauucagagucuuaaguauaaacacacaaucuguguugagaacaaaaacuugagaaaaugaaacacaaaaaaaauauugacuauaaauagcuugaauacaaaggaugcagauguuugagugaggcucucugggaguguugggcugcuccucuguguauguuccugacaguucucagcuguucugagcauuccuguuuuguguauccacuguuucagcaggcauuucuguucaggaacaguuagcugcuggcgggacgcugugguuuccugaccucaccgcaguggauuccaccuggauucugccugucucuguugguguugucaaccuacugauaguggaggucggugccucacauugggguugcugaccacuucaggcacugggauugccuacuccgggggcaggaacuguguuaugccuucccuuccaaauagccaugcacgacuguagcacccaaggauuuaugaaucccuguggaagaaagaaaagauggggcuagagaaguagcuugguggugaacacuggcugcucuugcacagguccugggcucgauucccugcacccacaacagacuuuaccuucuguugcugggauaaaguauagaaacacauacacaaaagcacaggguuugucagucacucuucagcuacccacagugcuucugaacuccauggcaccaggcacacguaugguacauagaaaacugaagucaucggugaacuuuuguuggggaaggacgucauguguaguauaaauguucuuccuuaagaacacuccguguggcucugguuugugcucagugacugucugauaguaagaaggcagugauggauggaggcugaaacgaauuacugucagugcugacaaagagcucuaacucuacacugcggugugccagcgacugaacauuugacacagauuaccuaaucccgaccaacccagugagaauuacacggugguuauuucacuuuuagggagggauagcagugcacagaguuagagcuuguguaagaugauagucucugggauacagggcugccggauguggggacaccugucuauaaucucaucaccugcaaagugagccacuccugaagucagcagcaacagcagcaggaggcagcuugccucugcaaucagagcccugcuucacaggcagaggcuuaacuggcucccagccuuggagauagacaguuaguuauguaaguucauugauguugaaguuguuguguucaagugcuggguauggaggccacggccuuguacacacuagucgaagugcugugccauugaaccagugccagcccuuaaagguacugauagaggcuggucucaaaccagcuuuuaacagaccauggggguccacgccugugaucccagcuuaggcaguguuugaggcuacccuaaucuauugagugaguuccaggccagacagggcugugcauaguggaacccuaucagaggacacuagcuggucacaaauccauaggcuaaaaaugacguugaguugcugauccaguuuaucaaugcagggauuauagcagcgccuuaaagccuaggcgucagcugguguuuuauuuaucugauuuaaugugugcuuuaguaaucgugguguguucuacuucagauuuuugcucuacaaaaaauugggacgucucguuuucaaauguauguuacaaauuuuguccgagcuguauccguguugaugauuccaguugcugcaacaguacccucggugaguaacauagcauugccuaggaccaugaggcgcuuccacgccugccguccugccuuggggauuccuuuuacccacaggacccuugcuguugaaaaggauugcauaacugucgucuguaucacugccugacacugagcacugccuagacugagucaccuuucacgugaauguguccagcuguccugucacucccugcuccccguccucuauuuuaaucugacaacaccuccauagucaggucgcuaccuacuccacuagcuaagauauuugaacaacuuccauauagacugcaucaugaacuaaaguacguacaagaggaaaaguccauauggauuccugaggacaucuuaaucuuauguguuacuguggccuuguucacuugucucuguugagaccuaagcaagguuuugaaagaaauggaagaacaauugauuguucagucuuuuccaugguuuccacagauacuuuagaaguugucaaaagugccgggcgugguggcgcaugccuuuaaucccagcacucgggaggcagaggcagguggauuucugaguucgaggccagccuggucuacagagugagguccaggacagccagggcuauacagagaagcccugucucgaaaagccaaaaaaacaaaaaaaaaaaaaaaaaaagaaguugucaaaagcgaugucagguugguuuucaucuuuacuccacgccaacaugaagccaguaauuggcauucaguggcuggcauuaagguuggaugagcagguaggaacuucccaccauccuuggggauccacagcgaugugauauuggugugaaaguguauuuuuaaguuggucccugugcaaaauaagcuuccauguaucugaagcccaccugaaaugguggcuaucacagcgcuuucccaugggggagcauugcuguaagauucuguguaacccagcacggcggcagaagaaacccccgaugaagcaggugugccaaggaucgagcucagaguuuauaacagaugugaaacggugucuuaacucugacccgaguccagagugguccagaugagagaugaacuccacaggggcauccagaggccugcggcugcuuccugcuccaucacacacugccucugauacguguccucauggccacggugcucauggugccugcuggagcagguuagguugcagacagcagagggugccucagguacacaugguccuucugagaaguguugcuaggugucccaccgaagaagaaguguccuuaugucacauuuaaucacaucuaauuuaagagccuagaaaauauguauaguggcuuuuuagauaucauauagccagcaaaguuaggguuuuguuucuuagcaacaaaaggaauuauguagauggcagcuuaugguuccaucugguugcacugaaaaguguggugagcuaaaggcuuggcauugcuugugugagcugaaggugguguccagccacugucccagcuacucagaaugugacagggugcaugugugguugucacagacagccuccuagagucgguucucccuucccccaugugaguuccaggaguuacacucgugucaucuggguuggggcugaacgcuggugcaccgugccguuuguaggcaugcuuauuaaugcaccuaguaugucaccucgagucucccggcgguacagugaggcaggcccgcuacagucucgcugagugaugagccugagcacgggagggaacuuaacgcugacucugcuccucgggcugcccuuuuccaggcgccucagguacugacuaacugcugugccgaucugccuuugguguguuccuucugcccuugcggucucucuguggguacuguguugugcuuaucauucuguacaaaugcucucagaacagcacucugaggugggaacaguugcuguccuguuuauagguaggaaacaagcaagagcaaugaccaauacaaagccggaggauagagaacaggacucagacuuagagagcuucguccauuuggggcucaacagccacauaguuuuacuuccgagaccugacugccuucugaugcucaagcaaagcaugagacacacguauguuuacaaaauccauguauguguaggaaacacguguguauagaaaggcuucagggcuuagucugaagugccacccuggguuguaucacaaaagaaaguugauaauucugucuugaagaacuaaagagaaauccguccugccgacagagaagcuaguccacgcucuccgguagcuugcucagaaugccagugcucuuuaccgucugugccaagcuuggccaugcaggcccagcugcugacccauguguucucucuaggcgcuuguucucuacuggcugugcuccagccucaugggccucgcacagaaccugcugcugcgcuccccuggguuccgccagcucugccggauaccaccaagcaaguccgacucagagaccccguaccgagaccucucugcugccuuuugcgccaaguuccuuucaagaaaacgaugagaguccacucccaacacccuugaaauaauuacaaaugucacugucaguuucaugcauugaauuuggaagucuauauuuaaauaucaugaagcacugugggaaauucagauguauuugacguuuaguaauuaaaaacuaaauauucaauuguaagaguauaaaaauaacauaggaugccuggccuuauucauaaaaaucauaguuuugcugagaacaggauuagguccugugugaucucuacccaacuguccacaaauaaaguuuuguaaguuaaaggcu
